United States Patent 9,328,346 (POLYCOMB-ASSOCIATED NON-CODING RNAS) - sequence listing, part 65

SEQ ID NO: 12539 - RNA, 22478 nt, Mus musculus
ccagcuggggccggagccaggguucagaggugcggccccccacgccccuucgggugcggggcgcggccucggcguccccgggacccaggaaugcccccccgccagccggcccggcggccggggggagggcccagccgggaguuuggcaaacuccuccccgcguugagucauucgccucugggagguuuaggaagcggcuccgggucgguggccccaggacagggaagagcgggcacuauggggagcuggacgccacggucgccucgaucuccucuccacgcggugcugcugcgcugggggccccgacgccuaccgccgcugcugccucugcugcugcuacuguggccgccaccacuccagguugggggcuucaaccuagacgcggaggccccggcggugcucuccgggccccccggcucccuuuuuggcuucuccguggaguuuuaccggccgggaagggacgggugaguggcgagguuggcggcgggaagcgggcagggggccaccuggaaacugggggcgcgccgaggacuggaagcgaccaggacuugaguuggagggcggaguuuggaaagaccaagacuugaguugggggcccaagcuagaauugggggcccgcgcugcagcagggagggaccguggccgacguggagugugagaucggugucgaaacuuguguggcaugaggagaggacccgaaucuagaagcuggagaaguacaggcagggucuaagggccaaccgggaggagagggcgcagaaagcuuagggucucuggcgaucugugggcugcgggagaccuguggcgggugggagucgaggggggugcggaggccgggcagggccuuaggaggcaguggaagaaccucgagauccucgguggggcuauugagaggguuggagcuggguaagcgugugccguaagaggaaagacagacugagagggucggaagguuaugugggggccagucucauccuccccucccccaucaacucagacucgggaaagacccgggaggaagacgaaggcucccuccccuuucuccucauucuccugaauugccucccacccccagucucuucaggcgaagagauccaagaacuuggggagaaucccagaacccuggcacuggggguacuagggcuaguggccggaucaauccagggcggugcacggaugugucgggaggggugugagugcgcgcgccugaaggggggugggcgguuucccucuugcucuagcucuugggaggaagagaaaagcugauuuccuguagcuugucggcuguaguagaacucagacuucugggacuagggucggaagcugagaaagauauaggcucucugggcccaagagcaucagaacgaagguuccugaaaaucucuauggagaauccuuauuuccggguaguaagcagaccuagacuggugcccagaggcuugggaaaauuagaggccacauugaaacaaacguguuuguuuaaauaaggagaggaggucuggaaguaagagaaaagugacggucccaacugcugggcuaagggaccccagaugccauauuccugaaccccuuugaugacagcaguagguguuucuccaccuacuagcucugagccucucucugcccauggcagcaccuacaccgacccugggaucuuagggcuugauuggaccuuugucagaagucaucugauuuuagcuguuauuuaauuagggggcugggggugggauuaacucuagcuaauuugguuggggaagggacaguuuuuuuaacuuuaucugagggacuuagggauggaaaaacagaaagauaacuaggccacagccguugaauuugagcuuuucaagguccccacccaacccccaccccgcacccuggccucuugcccaaaccucauuucaucacccugucccggagccucugccagggucccccaaauuucuuaccacaacccuaauggagcagagaggauggaggggguauagggucuuuucccccaucagggugucacucuuccccacacaaaacugucaguucucuuuuaaaauaucuguuggacuuugcacucccaguagccccuggccugauccuccagucccugagguuucuucuaaaacaagccccagccuccauuccucaagagaacccagguguccagcucacauucuacuccgcccucaccuuugcucugggcauaagcucuggggcauucuccuuccuugugacuucccucccagcaccuguguguuuuagacuccccuccaccccucucagccccuuuguggcuguggucuugguguuccuuguuccuccugcauuacuucucauauugaauaaugaagagaacggggugagcucugcugagguuacacagacauaaaggggugaagaagcuugaagccaggcagcucugggugugagugcuuaccauucacuaaagagcccgggcuugagcaaguuacuuaaauccuugcaguucagccuccccuugcacaggauaccuaacugauucuuaggacugaaggagacaauagcuaaaaggugccugcccacagaggaugagcaacauacacaaggcacgaguucuguggaggaauuccugauucugauguucuucccugacacccuccuauucuaaguuuuccuuucuuucuuacuugcaaucauucauucauucauucccaggcuggucugaaacuguagccaaggaugaccuugaacuucugacccuaccuuucuagagugcuaggauggugggcaggcucugucacacccuccaccacacccaguuuauggagauugaacccagggccucugugcaggauuggcaagcaguccacuugcugggcuacauccucaguccuuacaaugcuuguaguacuugcuaauaacugugauaguuauaacaguuuccucacauuaucuuauaagcuuucauauucauuucucauugaauuauuuuuaaagaguuauuuauuuauguauuuauuuaugugaguucacuguagcuguacagaugguucugagccuucauguggcuguugggaauugaauuuuuaggaccucugcucacuccaguuggaccugcuggcucugaucaacuccgcucccucagucccugcuugcaccaccccaaagauuaauguauuauuauacauaaguacacuguaucugacuucagacgcaccagaagagggugucagaucucauuacaggugguugugagccaccaugugguugcugggauuugaacucaggaccuuuggaagagcagucaaugcucuuacccgcugagccaucucgccagcccuggauuauuuuuuaaaaaucuguguugaacagagaaaguauuauugcuuuagaagucaaagaaauuuagaaguagaaauuagcuuaggaaucacucaaaagcaacucaucacugagaaagaaaggcuagaggagggaaagugacuuuuaaauggaccagucugcuagaggcagcucuuacucagccaaucagaugucucccguugggauguacaugggguuccagaaguagauguccaccucuggucuggccagaagugagguaggauugugggaguugggcccugacccaccuaaugcucucuacccugaccuugucaagccaagggagucaaacaguaacugaauauugaacaacggcuugguuaaucaaaagccuggcuaggaagauagugaagagaggaggagauguuuuggcaauggggcagaacagaauacuagccuaggaaacagcauuacaggucuccaggcuucgguucccauccugggaaagauucugagcaacucuggaucggugugacuucucuuggauuuaguuuucccaucugucaaauaaggucauaagacuagggcagcaguuugggaacuuguugaaggaugucagaacugagguggcccuuccuuuacugcaugcaccacucaaagggcaucuacauuaguccuaaagccaguggauguucccucucaaaagacuaacuagaaccuccaaacccugaggcuucgagagaaacgaugccaaguauucuucccauggacucuaauagaguauaacugccaagcugcguucaguggaugauaauuaauggucuuuucaucuuuuaugaaccaaaaguaucuauagcugccaaucagagcuucugaccagccugagauaaccagguuccccauacaaguugguguaaugccagccgaaagcaaaugcacuuggaguuuuaauuagccugggaugccuuaucagguaaacgcaggguuuccgugaggcuuucugcaauauugaaaauagcccaagggcuggggcuggugagauggcucaguggguaagagcaccugacuguucuuccgaagguccagaguucaaaucccagcaaccacaugguggcucacaaccauccguaacaagaucugacucccucuucuggugugucugaagacagcuacaguguauuuacauauaauaaauaaauaaaucuuuaaaaaaaaaaaaaaaaaaaaaaaagaaaauagcccaagggacccucccuugguacccucuugaauuacugugaagauucuacugcugugggauuuaggaagcagcagguaggaggagaaucaggguacauggcaaucuuggcacaggcaccucaccuagcauguaugggugccagaaugaggacuacuaaaauggacacaccacuaaagccuuagguggaagucaugggucagggggccuggucuggauccuugugcccuguuugcauucugggauccccgaaccuucacacagugaacagauaugccccuggccuaugggcuuucagccuucagcagcuuugaaaggacugacagaugcuucuuucucaguuucuccaugaaugcagaugguaugggagaaauuuggggauccugauagaacccagaggaagagaggaaacccaaguuuacacugagacagggcaagaaccagagucucagcucccuguguagcagucugguuccugugcucugcccucacucuuguggagcuaaagacagaguggccaaguucucuguguagcccagcagcuugagcuacacaaggaccacaccacugucucuccccucaccccugcccuggggcuacagcuuccuauuuuucucagaauucucaccugaaagucacuaggccaauggaguggugucucaaaccucuaauuggcuuuaaugccuaagaggugggagacaaauggagaagugagagguugaaaacugaccggaagccacaggcaguaaacauuuccugucccccugguaaccaaagcuggcaccuccccucucuauaacuuaaggcaccuccuguuugucuccauccuacuccucuggacccccugccuucucuauucucaccuguccucucacacuccacccauacuccacugguguccugggggcuuccuuccuugaugcucuuagacccccuugccccucaguaugacucucagaagacaucugucuuuuccucaaguccccuuuugagcucucguuccuacagauaaagacugaggaacagcucgcuggcagucuuggguucuauaagagagcaggcugagcaagccaggggaagcaagccaguaaagaacaucccuccauggccucugcaucagcuccugcuuucugaccugcuugaguuccaguccugacuuccuuggugauaaacaguaguauggaaguguaagcugaauaaacccuuuccuccccaacugcuucuuggucaugauguuugugcaggaauagaaacccugacuaagacaggugaaaaggccuacgaucugagaauaagaaagaaggaagaagccagucaaagauggagcaagccuuuaauccuagcacucagggaggcagaggcaggcagaucucugaguccagggccagauuggucuacagagugaguuccaggacaaccagggcuacacagugaaacccuauuucaaaaaaaaaaaaaaaaaaaaaaaaaggaaaaaaagaagcgguuaagaacauuggcugcugcucuucagaagaccaggguucaauuccuagcaccuacaugacagcucaugacuaccucuaacuccauucccaggggauccagugccuucugcuggucuccucuggaacaaaguacccacauggcacguaaacauacauacaggcaaaauauccauacacauuaaaugaauaaauaauuugaaaagaaaaaagacaggaggggaccugggaauauaaaucaggagagcaagcagugcuggguacaggcggaggcugaggagcaaugccaguggcaguaggggaggagaguagaggccaaggcuggcaggaacacuggcccagagcuggggugccaaggaaagcugcccagacugccagaugcagucauugcaggagauccugaggagagugccagcagagaagaaggcuguggcuguauguaggagcuggaaacaagagaucggggcuaguagaggagagcuguguggagaccccagaagcaaaggaccagaauugguagaagaaggaugcuaggagccaucccucgaaagaccccaucucagacauguguguccaggaagaggauucaaaagaacaggauuugaguuaaauuuucuggggcuaauuugugggaaagagguacaagugugucagaggcccagcuaggaaggugagguccccuauaggccacaggguggggcaaaccaggcccaggaaguggccugcuuucauaguccuaauuucagagacucauuuuuuccuccaacaugccccaagacuuaaguggccgguugccugaguuccauccaagggagaaaauuuggcuuggaaagaaaggugagggccaugaggcucuacaggagccugggguucuggagcuaaauugucccuuuaauauauauauuuuagcuaggcagugauggcauacaccuuuaauccugguacuuggaaggcaggcagggagaucucugugacuucaagagcagccaggucuaaggauagaguuccaggauagccagagcuacacagagaaacuguaucucgaaaaaccacacacacaugcacgcacgcgcacacacaccacacacacacacauuaauccacuuucaaccaaaggucauacauugcauuuggcauuguuucuuagccuggugcugagggccuugcguaugccgagaacauccucuacuccugggcuacagcccuaguugggcuggacaucuaaccuuggcaaguagauggaagagacaaaaaagccagaguccagacccuagucuucuuuucccuuuccaggaacugacucuggcuucuccucucuaguaguaggggaagaagguaagagaaugugggaggaggggaggagcugaguuagugacagcagcacauggggaaugccugacuccagccccugccucuggcaucuguggcaucuucugagauauaaauacaacccaagggacaucuaccccacccccacucuuggcccaaaggucugggugcaucuugccuccagacacugaccuggaaauaggacccguccuaaucuacuucuccuuuccccuccacagagucagugugcugguuggggcacccaaggcuaacacuagccagccagguguacugcaagguggugcugucuaugugugucccuggggcaccaguccuauccagugcaccaccauucaauuugacagcaaagguaggcuggaagaguucagggaagggccuggcauaagagggugggugggcgggccugcaguuuggggguggggccugggugaagggugcuccucccccuccccuucccccugcaguaguucuggugcuccauccagcuccuagcugugggcuucccguggcacucacuccauguucccagcccagcccaagaagggcgggcaugauucagaaacauguggcucucauuucacugaaucacccacagcucugggaggccagggccauaaugcagacaaaggcagaggaggcugcagaguucuguuccuaaacuaagugauagugcacacugggcacagugugauucagccacugcccccagggggggcucagccuucaggcagauggaccuaaggaagcugaggcuguucagcuagcacucagagagcuuuuacuccaugcuaggcacuauugugccuuggcacacuuaauccugcagcaacuguaugaaguauuaguauccccauccugugaggaaggaagcaagguuaagucacccaacuaguaagaaagcaaggcugugaacucaggcagucuguccucagagauaagaggacaagaaguaagcauaagaauguggaagccugcuaauuucugaagggguacuaggcauugaacccaaaguuugauucgugguaaacaugugcuguggauguaugagugcaugaguuacagccccaguuccuaaggcugacuuuaaaaagccugagggcacaggaggcugaggcagaaaaagagugccagaagcucaaagccagccugggcuacauaaugagacacuugucuuaaaacaaacaaacaaacaaauaaaaagccugagagguggagaguaagaagagcaggaaagcagugcuacagagggcagaguuuagacuuggaaagagacagaaagggaagucuaguguggaggcgaaaggagaggccguuagagucacagggcuggcuaacagacagagaugagccaugggacuuggccaauguucccccaacaccacaaugaaaauguccuguuccagcuacgaggaagucagaggagccaacaagacaacuugggaagcugugguggggguggggagguggauauauguuuuucuguggauguaugaguguacgaguguguauguguguuucuguggauguguguguguguguaugaguggguguguauguuucuguggauguggguguguguguaugaguggguguguauguuucuguggauguggguguguguaugaguggguaugggugucucuguugauauauguauguggauguguguguaaggagagcaagaaccagucaaguccagcuacauaaaggagucuaaaacuccuuccauuccccugucccagugggucucagggucuacaaaugcugagcauccuagaccaaggcuagggucaccuuccugagaacaagugugagaguacacuuucuacuuccccaaggcucccggauucuggaguccucacuguacagugccaagggagaggagccuguggaguacaaguccuugcagugguucggagcaacaguucgggcccauggcuccuccaucuuggugaggcaugagugagcucaguggugugguagcuaaggguuaagcugugguggagagggccaggccuggucugggguggaagguggucaucuuacuaagcuaaaucugaacacccccugccccgggcccccucaggcaugugcuccacuguauagcuggcgcacagaaaaggacccacagaaugacccagugggcaccugcuaccucuccacagaaaacuucacccggauucuggaguacgcaccuugccgcucagguaggugccagaguguaguggaccauugugccuucuccgugggaggguccuugguaccuggggcuuucucuucaaggccuccaggcauugauauauauuuuuucaaggcugcucaggugacccuugagcagucuucuuucuugcuccugccucucuucccugucagcccaucagugugcagcuagcucaucucauugucuucucucacagauuuuggcagugcagcagggcagggcuacugccaagggggcuucagugcugaguucaccaaggugagguggcuggggagggaaggcaggaagugaggaucuagggucaguaccagaugauauauaugcucauccaucuucccugcaccuccccacagacuggccgugugguccuggguggaccuggaagcuacuucuggcaagguaagcccuuccucugcccucuuccagcuuuggugccacaucccuucuuugauccaaaccuuuucuuuuuucuuuuuuucuuuuuccuuucucauuuuuguuuguuuguuguguuguuuuguuuuguuuguuuaagauaggguuucucugugaagaauucauuuuguagaccaggcuggccuugaacucagagauccucuugccucugccucucaacugcugggauuaaaugcaucugccaccacugcccagcuuugauccauacuucuaaaauccuacucagucuccccaaagccucugugaccucccccugcccaucacccugcuccccuuccaggccagauccuguccgccacucaagagcagaucucggaguccuauuacccagaguaucucaucaacccuguucaggggcagcugcagacccgccaggccagcuccgucuaugaugacagcuacuuggguaggcaagcagguggggaggaaaugggaggggaaaucaggggccucuagccucacucaguucccugcuucucccacucagugccaccagcucugcugccauacuuguguacaggcugacaaugaagggauugagggccagagaguagggguccccaaggaggcaaugcuaacauccacacacucuguccccaggauacucuguggcugugggugaauucaguggugaugacacagaagguaagucaaucuucaagccaaaguggggacugaaaagaaagccagaaacaacauucugaguccacccuguccucaccuccacccaucaguuucucuucucuuugcagacuuuguugcuggcgugcccaaggggaaccucaccuauggcuauguaagacccugcccgccacccgcugccucucacccaggcuaagugcagagccuugugugguaguuuguuggguauaucaaggaaagagaucagagcauaggcucugggagaacacaucagauuucugaagucugguucaagggaaggaagugugugaagucagacucaaguucaaauucuggcacugacucuggauaaaugaaucuguucuuuuauugcuacacuguccccugcuugaccgcucuaagcuguuucuuccauguacaaugggguaauaauaguucugaccucacaaggcacuugugaggggaaugaaagcacuuguaaauuguuagaccgugugcagccaccagcuauuauuagaccaugacaagugccacacucggucgcucaauuaacaacauuuauugaggcaaggugagagaugagaugaagacaucuuaucccaucucuuaaggugcuucuagucaaauaugugagcuaaaacacacagcuuuaauccugaggaagccauuguuuguuagccucucgaugucccagguacuguccaugcauggugguguucccuuccccaccaugggacuguggaauggagaacaaucuugacaguuuacacacaagaaaacuguuguccuaaaauaccaauuauguugcuuaggggcagcuggauaaauauuuaauaucuaucauacucuaaaucucguacucuuucugaauuggaaguuacagaaaagcacccaagauaacagcacauuuuaagaaauuaguaaucuccuuccagagagggugccucagagaagguucugugaggguuccacacagauggggcaagagggagucccaggcacaggcaugaagaacacagagaauauggggcugggccuaguuugcagccucauaagguaaaggagggugagaauuguaagggaggguugaacaaacacaggcaguagggccagacaccagaaccuuagagggcuggccaagaggcagggacugacaguggcugcgggggccccugggguguacaggugggaaucacaguccuccaucugcuuucuggcaucagugccaguggggaaaacccaagcuauaguccagccuguccugggaagguucauaccaggucucagcagaacaguggggggugggcagagagcaagauccaagagacguggaggucugcugggucaguagcuaagaggagacagcagagaugugaguaccuugcagacccuggugugugagggauggcuagaguucugaauccauuggguuugaagacccaguguguauccaguauugcuguuugccugcugccugcuaagcucugggaggcaaagaccaaagaucaugcucugggucccacugaucugauucuggucacuagaaucuaguggcuggggaugaaaauccaucaaggguauaaaggaagaaggcagaacaguaaagugagagagaaaaccuggagguggagagaggacaaauuuggaaggagacagaggagugcuaagauuccccugaggaaggccugucccaugugucccagaccuucagacauggggcauccaggaccuauaggccuuuaucuucaucuucaggucaccguccuuaauggcucagacauccacucccucuacaacgucucaggagaacaggugaggauacccucaguucuccaucuugccaucuaaucugcagcccuggaccaacagugucaaacuuccuaccgucucuggagcccaugaauguccacuuacagccucucuugauccuguuuacugaccagccuuguucugacuccaugcuacccuuuguccccacagauggccuccuacuucggcuaugcuguggcugccacugauaccaauggagaugggugagugaugggaagggaugcaucuuccagaccugaucgaugggggaugggacagugcaggcagacugcucccucaggauauuuuuuuuucuagacucuaauucauacuugccuucuccuuggucagggcaagaagagggcuggaugcuacaucagagcccucagggcgccuggggauccagaaugccuggaguuccuccacaagggcaauaaauuauagcaagacaggguugucagaaugcuugggucuucccuucuccucaggcuagaugaccuacugguaggggcaccccugcucauggagcggacagcugaugggagaccucaggaggugggcagggucuacaucuaucugcagcgcccagcgggcauagaucccacacccacccucacccucacugggcaagaugaguucagccgauucggcagcuccuugacacccuugggggaccuggaccaagacggcuacaaugguaaguaucguggcccagggugcugaggcuaaguaggggggaugcuaguuggucaggaacuuagugggagggcuucugucaacuaaaguaccgggcccucuugacuuuccagggguauugggguuuaaagauauuagaacaggaacugauguggaaaaauaggauccugaggguuuuuugauagaaauuuggaccccuggccuccuaaccuaguaaauaauguguguugugucuugcagaugucgccauuggggcuccauuugguggggaggcccagcagggagucguauuuauauucccgggaggcccaggaggacugagcacuaaaccuucccagguuuugcagccucuuugggcagcuggccguaccccagacuucuuuggcucugcccuucgaggaggacgagaucuggauggcaauggauacccugguaaguuguggccacugcccuucaucuuagaaugcaagcuuugugaugcaauucuaggcagcugccaccagauggugcaguccccuggcucaggccucugagccaugaaacuagaaagccucagaugaaggcaauccugauuuggggcuugccauaaaggguggaucuugacuuucuacagaucuaaucguuggauccuuugguguggacaaggcucugguguacagguaugaacucaggaagacugaggcagucugaacaacuaguuuuucuuuuaaaacuaagacuggggggcuggugagaugucucagcgguuaagagcacugacugcucuuccagaggucaugaguucaaaacccagcaaccacauuguggcucacaaccauccuuaaugagaaacaaauuaaaaaaaaaaaaaaaaaaaaaaaaaaaaaaaacuucggcaggugugaaagggaggggggugcuaagacuaggaccaucggugcagagggaacugggguccuggagcaggugcccggccuuaauucuauguaccccacauccacucuuggcagagggcggcccaucauaucugccagcgcaucucucaccaucuuccccuccauguucaacccagaggagcgcaguugcagccuggaagggaacccuguguccuggugagcugugcccagagccugcagagauuugugccugccagugggcaggggggccaugucugccucaggaagggacaaacagggguguccuagucugggucuuucugagucaggcaggcaggaggccaguucuaguuaaccugagcacucucuccuccgucuuucuccagcaucaaccuuagcuucugccucaaugccucuggaaaacauguccccaacucuauaggugagagaagcugcucgagugugccagcugagggguggggcaguggaagguaagaaaaacagacagacacuguguuuccuggucauaggcuucgagguggaacuccaacuggacuggcagaagcaaaagggagggguccggcgggcacuguuccugacuuccaagcaggccacccuuacccagacccugcuuauccagaauggggcucgggaggacugcagggagaugaagaucuaccucaggguauggccugaggaugaggguggccuggccuggguagauagccaccuaaaacaaaggacugugguggcggugacgguggcaauagugauggugugcgugcacgcgugugugcuugcauguggcuggaugacuguggggagaggguaaagaaaaaggcuuucugucagaagagccagacaccaggagucuaggccuacagagaaaugaggucagauuugggcucugagcagauaaagggagaagcaaggcuaagaagcauggucacuaagcgccacccaccccgccccaccccacccccgaaucccuaaucccaugaauucuuuccacuggcccuagaaugaaucagaauucagagacaaacucuccccaauucacauugcccucaacuucuccuuggaccccaaagcucccauggacagccauggccuccggccaguucuacacuaccaaagcaaaagcaggauagaggacaagguaaggaaagaacuugggaagacaggccuggccccugaggcagggcccugggagaggggugguagaacccuucucaaggcugcuccacuccccaggcccagaucuugcuggacuguggugaagacaauaucugugugccugaccugcagcuggauguguaugggugaguggcacugucacauggcagagagacagggacacucuagcuauauguggccuugugagauccgugagcaucucuggauuuggguuugucuacagggagcauucguuucucuagcucuagacauauuaaacacgguacucagcaugcagcgucucgccuuaugccugccagagccgggguccagucagcagggccagccccacuguguuauucccaggcccuauugcccugguuuauggauucauucuuucauguccuuacccugugugccccuccagggagaagaaacauguguaccugggugacaagaacgcacugaaccugacauuccaugcccaaaaucugggugagggcggugccuaugaagccgagcuucgggucacagccccucuagaggccgaguacucaggacuugucagacacccaggggugagaagggacucucaagugggacugcaguggugauccccuccagaggggugccaaagccugacuggccugugccugccuauccccagaacuucuccagccugagcugugacuacuuugcugugaaccagagccgccagcuggugugugaccugggcaaccccaugaaggcaggcaccaguguaagugagggguagaagaggaagggcuaggauagagcaugugacagguccuagcacacagguagacauccuaucuaacagccccuuucuccuccuuguuuguuaugcagcucugggguggccuucgguucacuguuccucaucuucaagacacaaagaaaaccauccaguuugacuuucagauccucagguagggagugacuggaccuggacuggggcugaguugaaggugaaagaagggaaggugggauggauggcagaaccuggagauucuugucaaacugcuugccucuugccuccaucccacagcaagaaccugaacaacucacaaagcaacguggucuccuucccacucucgguggaggcucaagcccaggucucccuuaaugggucagugcccaggcagaaagggaccuuuagaggggagggugauggacuuuagagaaggacauauugguuccuuuuguccacucuaaacuauccuccucuucagugucuccaagccugaagcugugauuuucccagucagcgacuggaauccucaagaccagccucagaaggaggaagacuugggcccagcuguccaccaugucuacgaggugagaaggguuggaagacaagccucagggaucgagccauaugaagggaaagaaaguaggagccgguauaaaugacaguaccuaggaccugggugaggugaagagaagagggggcggccuggagaauacugaggaucugugagagauguccagaagaggggccuguugguccauugccuuacaaaggaaagcuauuucaggaggauuacuaugagucucaaacuagcauggauuacagagugagaccuugucucacucuuggaguaauggcugaaguggacuugauugcugcucuuggguguucuuucauuucucagacugaugcacuauguauggguggugaccaaggccugcaugucaaaucagcuuucccuuccucaaagugugcucuuucucucagcucaucaaccaggggcccagcuccaucagccagggugugcuggagcucagcuguccacaggcucuggaaggccaacagcuccucuaugugaccaaggugacaggacucagcaacugcaccuccaacuacacccccaacucacagggccuggaggugaggaccuggucauggugugggguggagcgguggggcuaugggacuauggagcugggaaaaguugccuggaggcuauuggaagugguggggagauucaggcaccucaagaucugaaaggaggaaaaagauucacaucuacuacauuuguguccuuugcucugaaguagucucucucauggugugcuaucagaucugugccaccuuguccugugagaacuguccucuggcccucuuugagaguguguuuguucauaaacagcauuuaaugaaguaagcguuagaccuaggaaaaaccccacaccaaaugaaauucacaaaguccccacauucugggagcuugcaucuagugaaagcugguagacaauaagaaguaaaaagaguugggcaugguggcacacgccuuuaaucccagcauuugggagucagggcagaggcaggcagauuucugaguucgaggacagccagggcuacacagagaaacccugucucggaaaaaaaaaaaaaaaguaaaaagaaaccggguugugguggcaccuaccuuuaaucccagcccucagaggcagaguggggaggaucucugaguuugaagcuagccugggcuacaacggagugaguuccaagacagccaggacuuacacaguaaaacccugucuuaaaaaauaaaaagaaagaaagaaaagugcugaagccugguaaggcagccccaacacuugugaagugaggcaagaggacuggaaguucaagauuauucucaaguacuuacaugagagagacccugagugacaacaaagacggguggaaagcaauaaaguauaaagugacaaagaagaugggcuggugagauggcucagcagguaagagcacugacugcucuuccagagguccugaguuuaauucccagcaaccacaugguggcucacauccacucauaaugacaucugacgcccucuucuggugugucugaagacagcaacaguguacuuaucuaccauaaaaaauaaauuaaaaaaaaauuaaaaauaaaaaaauaaagcuacccaggcaugaugguuacaccuguaaacuuaaucaccaucccuuagaaguggcuggaacaggaggacaaccacaaauuaaaagccaguuugaucuauaaagugaguucugggacaaccaaagccucauagugagaauucuugaaggaaagaaggaagacaggcaaguggaccugugggaugugcuauggguacaaaucugacuugugacagcucuugaagagguagccauuagccagguagaacacuugccuaccauacccaaggcucuagguucaaucccagcacugcuaaauaaacaaguaauaauucaacugaaaccugaaagacaaagcugaagccuccuuguaagacaagggauaaacauucccaauagagggaacagccaguacaaaggcccuuaggcgggaaagacuuaaugauuucuuuacaaaucuacacggugcagagcaagguacacuuugcucuuggcaauagguggguuagcugaacacagggacagagacagaaucgggucccuggcucuggaacauagguucaggcugacuuaggagcuauaaugaagcagaaggugcaacuaaagaugccucuucuuccaguuggauccagagaccucuccacaccaccugcagaaacgagaggcuccagggaggaguucuacugccucaggaacacaaguucugguaaguugcugcagggaaagauguuugucccaaguguuggacaccuguuuggguucucagggucaucaggugagaauucugggcucagacuccuucuaucuugcuagaaaugcccugaagccaaguguuucaggcugcgcugugaguuugggccacugcaccgccaagagagccguagucugcagcugcauuuccgagucugggccaagaccuucuugcagguaagggagcuucauccauccuggaccccaaccuuugguccuagcaggacugacccugucauuuccccaugcugucaucccuuccaccucugcuuugguaacuggacaaacacacacacacacacacacacacacucucucucucucucucucucucucucucucucucucucucucucucucucucucucucucucucucccucuccaagucuccucccucccucacccugauuuagaccaguuguguguccuuggcgccaccucuuggccacuguugaagcaacuagcaacuacuucccuuucuggcccugauagaaaaacagaacguggugagcaugcuggcacuggcucaccuuuaaccugagcacucagaaagcagaggcuggugaaucucugugagucuggggccaaucuggucuucauaagugaauuccaggccaaccaggacuacagagugagaccauaucucaagcaacaacacaaaaacaaaaacaauaaacaaauaacuacacacacaaaaagaaaaacaaguggggauguaggucaguggucagugguagagugcauaacuaguauacccaauccauaaguguaaagaccagaguggauagggcuggggagaugcaaacaugaagaccagacuucaaauccucaaccuccacauaaaugaaugccuagcugguauaccagcaaccuauauguaagagaaaaaagccaucauuuauugaauacauauuauagaccaaccaugguccuggauguuaaccuauauuaaucauuaagaaauguauauugaacguguaguuaucugauuaugcauuauuuaguuuuaauuacacaauuuuacauuuauuauuucgcauaaggaacaucgagauuaaugaguccauaauagggaaagaucacauccugagacagacuguggggaagcccuguguccucugaaucccauagggguugcccugaccaccuuucuccacccacagcgggaauaccagccauuuagccuucagugugaggcuguauaugaagcucugaagaugcccuaccagauccugccucggcagcuuccccaaaagaaacuucaggugaguucaagguuagaagucuggaucgcagaagacaagcucaagaaugucagaagcaggauggggacauggauagaggcuggucuugcuuugugcaaauauuuccuggcuuuguagguccagaucggccagauuaacacgugucucugcucuaguguucaccgccuagagggcagugacaucagugugauauguggcaagacagucuauggaaacaugucauaggaauaucugaacccaaucuuacagagucaggaaagacuuccuguaagaagugguguacaaguugaggccugaaggaauuaacuagacugcuccagagcagaagauucuggguggagaaaacagcacaugugaacacagaaacacuugugcacuucagacucuuaaguucagaaugcuguuagcuaaaaaaugagaguuggguccagauccaacagacagagguagccaggaacaggccgggaagaauucacagguucuuaaugucauuggcuuguccacagguggccacagccgugcaguggaccaaggcagaaggcagcaauggugucccguuguggaucaucauccuagccauucuuuuuggccuccugcuccuaggucugcucaucuacguccucuacaaggucagccacgccaagccuuggcuuagcuuccagccugucagacucugccuuuuacccaguagaaucaaagaggccacccucagaucuguuuuccagcacagacccccauguaugcccuagcuacucacgccccauuugucuuuuuuccuauuggaccccucccuucagucugcagccuccaguuuacaaagaggccuccugucucuggauaaguuugcccauauugcaaaaccacagauggcaaauacaugauggcauuugugcugucgucucuucuaacaucuaucuaagaauaagugaugguauccuacaaguggcagccagggcuaggcucagauguggcacuuguugaguugaguuuguuuacccuuccuggcuuaacuaguaucuuuuucaguaucauuuuaaaaccuugauaaaugacugucccauaauaacucccuaauuuuagaucucccacaucuauuggagcccuugggaaaguaucugaaugaagccacuuuggcaggguggggaggauagaggcaggagaguccucaucccccuggaucuguggucagggagaaugugaucucuaauugugccuccuuucucaucagcucggcuucuucaaacguucccuccccuacggcacagccauggaaaaagcucagcucaagccuccagccaccucagaugccugagcccuccugaucucagacucaugaucccgaagagccaguccaauaccuuccgacagggagggacuaggcacuuccugaaggugcugagggcuggggagaagcucuucuuccuagcccagagacauacuugaagggccagagcuggggggcaagaagcuuguggauccuuccccccaugcacugugaaggacccucguuuacacaugcccucucguggaugggggccucagguccagggacagaagcuccagcuuuccuucagccuuugcauuuuggagacuuuucugaaaucaacuuggaaccauaauuagggaauccaguugugguucucugggccgggcaugccaacaggacuucccaucugacuccggccugcaaagaugcaucuuuggucuugccagagaaccaaaggaagucugcagcuaagagccugagacuuggggagugagaccuggcaacuccaacagcccccauccuggaaggccaaugaagaacacuaaccguggauggugcugcaggaccagcucaggacaaaucccaaacaaaggucgaugcuggcccagacccagauccauggaagucagaaagagaauggagccagacccagucuggggccuaggguugaucuggagcccagucucggauucuaagaaccuaugcuagcagacccaagguggcauuugggucagcugcagaccugggcuuagaaaccuauuuaucccugacuuaggacaagucaggaauugcccaggacccuaaccaggccacauuggcaaacagaccuggaaccucagccuggccacucauuccccagagagaacgggaagccccaggccuguaugaccuggguucugcccaccagcugcacugacgcugccccucucucccuagccaacccuccccucuccuccagaacccaccccaacuuauuuaaacucuguugcaagugcaauaaaccccacccacugcccccacugaccaaa

SEQ ID NO: 12540 - RNA, 23622 nt, Mus musculus
cggaagacgcgaccggcgaggcgggccagugacggucugcgcaggcgcaguguccccgggccaaaauggcugcgugguguuccccacgcugguugaggguggcaguggggacuccccggcugccggcugcagcggggagagggguccagcagccccaggggggcguaguggcaacaucccugugucgcaagcugugcgucucugccuucgggcuuuccaugggcgcucacggcccccgggcgcugcugacauugagacccgguguccgccucacaggugagggaggcuuccagcucuggaguagaggcuccugggauuagaaagggcgauucggcuccaucugaugaccaggguagcgggauggagaugucuuccggcccaagagaggaauuucuggggacacaggcaagcaggaggcagagaggccaaggugcuggcuacccagaagccgucgaggggaaagagcugcguggagccggagguguugaaacgcuccgaacgccaugaaccuucaccucugucaacaguucaccucucuguccaggcugcugcccccuugucauagcccuucucuuuuucuucacgcucuagcuuguaguggaagauguaacugccauuuagugagugcuaggcacccauaaaucaagggagaugcaggugcuugcccucauuaagguuagagagugugaugaauugucauuucauagcguucauccuaaauaucacgugguguaauagaagggcauuuaucagucuuuuagaauccuuaagucagugaauguaauaauggagucuaacauuuauuaaacauuguguaggaaguaugauuucacuccuuggagaauguuucaaugugacaggcauuguuaaccauuccauuuuauggagaaacagguuuagauguuaaaaaacuugaaaaagucacaaagcuaaaaacugguagacuugguaugguaccuaccuuccuuauagcuggaggggaugccaaauuagugugcauuaagccuugaaguguuuuagccacgaucuugucugucucuuuaaaaaauauuuuuguaaguuauuuugaguucugugugucuguguguggguaugugcucuuaaguacaggugcccaaaggggccagaggcaucugauccccuguaauuaugagcugcuagacuuagggacuaggaacugaacuuguguccucuacaagagcaguaugugcuuuuaauugcugagccaucuuucugucaucauaguuccuuauacuguguuaucacuuaauuuucagugagaaugaaggaagcaagcacugaacuuuauuuuggguaguucuagggaucaagcauaaggcuucaugcaugccuuagaguggcuuuuaaauuauguauccuugugugagagagauauggaggcgcauguacacaggcacuaaguauuacuucuguaugaaagcauaacugaagaacugcaguuggcuuuccucaagucagcccauaggcuacagugggcauauuuuaucucaagugacaauauguguggacauggcauccuguagugguguauccugacaccacaucuaaggucaucaguuuggccccaaacuuuagucugugaucauuccucaagucccaaacaggggcuggagagauggcucagcuguucagaacgcugacggcuuuucuagaggacccagguucaauuucaauucccagcacucauaugguagcucucagcugacuguggcuguaguuccaggggaucugacaccucuucacagacauacauucagucaaaauaccgaaacauaugaacuaaaaagaaaucauaaaaaagaaaucuccuaaccagaaagaaaucagcaauuagcuacuggauuaggcauucuuagaacaacaugaagacuaauccuauucuggguucaaaaagcaagacaugugcugggcauacuuuguagagaaaaaaaauagauauuuccuaguaguugcuaaucauuggccuuuagaauagaaaaaagcauccgcuguguaauaguuaccugugguuauucacaguuuccuugagcugucugcugaugucguagaagcugguacagcugacaaacuuuugccacuaauagacucaugcuccugauaauggaaggagugaggaguacaggaauacagccaggcagguagcaaguaaagagauccaauauaggaucaccaaguaucgaggucuaaugucuucuccgggagugacugaagagucaaucacaaucucauucugauuauuccugcucauucuuuuuuuuuuuuaauuccuuucuauauacuuuuuauuuuauuuuauuuuaauuagguauuuuccucauuuacauuucuaaugcuaucccaaaagucccccauacccaccccccccacuccccuacccauccacucccccuuuuuggcccuggcguuccccuguacuggggcauauaaaguuugcauguccagugggccucucuuuccagugaugaccgacuaggccaucuuuugauacauaugcagcuagagucaagagcucugggguacugguuaguucauauuguuguuccaccuauagagucuauauacuuucaacuucucuggcugauuguuuguuuguuuuuguuuuuguuuuuuguuuuuuuguuuuuucgagacaggguuuuucucuguauagcccuggcuguccuggaacucacucuguagaccaggcuggccucgaacucagaaauccgccugccucugccucccgagugcugggauuaaaggugugcaccaccacgcccggcuguuuuuguuuuuacuuuggaaacaggguguucuauguuccagacuggccuagaacuuccuguguagcuaugaauggagcuugaacuuuugauccucugcauccuuuuccucauguuaggauuaugcuggguuuguucaguucagggaaucaaauucagggccuugugcauaccugguaagcaguguaccuacugaacuaugucccugagcuuugcccacauuugaagaacauugaguuuggccucuaguguacucagugggaauaggcccuauagcuggggcuuguuugcuuuuuuacagauauuucguagcuggucacuuauuuauaauuucuucuuguuggauaaacucccagacuaacuuacuuucuuguuucauuuccaggaacaaaaaguuucccuuuuguuuguaccaccucuuuccacacaagugcuucuuuggccaaagaugauuauuaccagauccugggagugccccgaaaugccagccagaaagauaucaagaaagccuauuaucaggucuguauuggucuuagguuuacugacaagacuguagaaagauugcuggucuggucacuguguguguauguguguguauguuuugcuuuaauuuuuguugguuuuuuuuuuuuuuuuguuuuugcuuuucgagacaggguuucucuguguagccuuggcuguccuggaauucauucuguagaccaggcuggccuggaacucagaaaucugccugccucugccucccgagugcugggauuaaaggcaugugccaccaugccuggcuuuuguuuuaguuuuuaaauuugugcaucuguggaauaugcacaugacugcagauguucacagaggacagggguaagggauccccuugggacuauaguuacaggcagcugugaaccaucuaacauggcugagaauugaguucaggucuuuugggaaagggguaugugcucuuagccacugagccaucucuucaacccagcuuggugcugauguugucugguccuuacugccuugauguauagccugcuaaggcaggucacaagcagccgagccuauggaaugaucugggaaagauggaguuuggggugccuuuggugggcaaugaaugugauaucaaucuguuaacguuuuaagaaagaagagaagaggcagguaagauggcccaguggguaaaggcauuugacaucaagccuagugaccugaguucaauuccuccaaaaccauuuaaagucaggagagaacugauuucacacguacaccaugcuguccacacaauuaugacauauauaaauaaauagaaauuauauagguaaacaucauuacucuuuuuuuuaaagcaguuuuaucauuauguauuuuauauauagggguacacuguagcugacuucagacacaccagaagagggcaucagaucccauuauggauguuuuugagccaccacguagcugcugggaauugaacucaggagcucuggaagagcagucagugcucuuacugcugagccaucucuccagcuccucauaauucuuucuuaauucuuaauuucuuuauuuuuuauagcaguaacugucauacguuuauuacguaauucuucaaaaccuugcacagcaggcaagccaggugugguugugcugccuuuuuaucccaguacugggagacagaggcaagcgaagcucugugaguuuaaggccaguuugucucaaaaccaaaccaaaccaaaacaaaaaaccauacuagucuacagagcucauucuaggacagccagggcuacauaaacccugacuuguaaaaccaaaccaaccaaccaaccaaaauugugcagguuauuugcuucccuguugcauagguucagagcaccaggaugcuaaagggcuagucaaguauuuacuuauuacuuuuuuaaaaaaagauuuauuuauuuauuuuuauuuauuuauuuuuuuaaagauuuauuuauuuauuauauguaaguacacuguagcugucuucagacacaccagaagagggagucagaucucauuacggaugguugugagccaccaugugguugcugggauuugaacucaggaccuuuggaagagcagucgggugcucuuaccugcugagccaucucaccagcccuuuauuuauuuuuauauaugugaguacacuguagcuguacagaugguugugagccuucaugugguuguugggaauuaaauuuuaggaccucugcuugcuccggcucaaagauuuauuuauuacuauacauaaguacacuguagacacaccagaagagggugucagaucucauuacagguaaccaccaugugguugcugggauuugaacucaggaccuucggaagagcagucaguggucuuaccugcugagccaucucaccagacccuacuuauuacuuuuaacauauauuuauuuuugguuugugugcaugcauguuugucucauguacauauacugcaugcauucuuggugccuucagagaucagaaaaggacaucaaauccccaggaacuggaguuuuagaguugugaucuaacacaucagagcugggaacugaauccagguccucugcaagaguaguaaaugcuuuguuuccuaaagauuguuuuauuuauuauguauggaguguucugccugcauguguacaugcuugccagaagauggcaccagaucucauuacagaugguugugagucacccugugguugcugggaauugaacucaggaccucugggagaguagccagugcucuuaacugcugagucaucucucuggccccuaagacaucugugaaggaaugauuuauuuucaaauuuuaaaucuugcuuuaagaauuuguugcugucuuggccgggcgugguggcgcacgccuuuaaucccagcacuugggaggcagaggcagguggauuucugaguucgaggccagccuggucuauagagugaguuccaggacagccagagcuauacagagaaacccugucucgaaaaaccaaaaaaaaaaaaaaaaaauuuuuguugcuaucuuaagagagacagcuguuauaaagagacauaauuguagcaaguauuuggguucuguuuuagugacuauccauaucuauaguaauuuacuuuuuuuccccuuagcuugccaagaaauaucauccagacacaaauaaggaugaucccaaagccaaggagaaguuuucccagcuggcagaagcuuaugagguaaugugacuuguggguucauucacuggccauucagcucugugcacacaucagagucugcacugcacaagauagcuuggcauaucauacaguccaggguggugcugugucccugcuaguucugcuaacuuagacucuaaaugaagaaaacaggcuggugcgaucuaucugcugccaagccugaugacaaguucaauccucagcaacuuccauaaaucguccucugaccccugcugaguuccauagcauuugaacacucacauauguacacaaaaggaauagguguaauuuuuaaaaaagaaaagagacccgaagugguggcauauauguaauuuagcacuggugaggcugagggcaagagaauuucuguaaguuuaaggcuaagcagggcuauauagucugccuucauacaaaacaaaacaagagcaagguucaucugaucaauaaauauacucagguaauucauauugauagcugaucucgggaaaucccaguuagacugaucaaaucaguccuuauuugaugacuuaaguuagcaauuguaaaaauagaccguaaagcacauaggaagaaaccaaauaucugugagagaaccauugaccaguuacagaauuauuggagaaugacccugugucuuagcuaggguuuuguuguuguuguucuuguuucuguuuuauuuauuuauuuauuuauuuaauguuauguuuauggguucacugucgcucuccucagacacuccagaagagggcaucagaucccauuacagaugguugugagccaccauguaguugcugagaauugaccuuacgaccucuggaagagcagucagugcuuuuaaccaguaagccaucucugcagccccguaguuaggguuuuaguucugugaagagagaccauggccacagcaaguuuuuuuucauggugcuagaaggguagcuuugcguucugcaucuggaucagcagacagcaggaagagaaagcaacacuggggcuggcuucugaaaucccaaaacucacucuuagugacacacuuccuccaauaaacccacaccuucuaauagugucacucccugugagucugugggggccauuuucauucaaauuaccauagcauuccucuuggaguugacuauccccaauggguucugcauguguuuauguguucaagggccuagauagcaacauguagagucauaguucaguaaguacgaagguuuuauuaccugucagccauagcuaaucugugcuagagcuuucucgagaaguagaaccuauaggauauaggcaaucagagauuuauuaauuggaucauaagaucagcugcugagggacuggagagaugacucauuacaauguuacaagcauucuagaggacccagguucaauucccagcacccaauugguaacuuauaaccaucuauaccuccaguuucaagggauccagugccgucuucuggcuuuuuuuucucuuucugagacaggguuucucugguguccuggaacuugcucugcagaccaggcuggccuugaacucacagagauucaccagcccuuuccucucagugcugggauuaguaacaugcacuacaccugacgauuuucuggcuuccgagagcaccagguacacaagugguagacagacaucaaugcaagcaaaauacccauacacauaaaauuauuacuguuuuuuuuaaaacagggugucuuuguaccccggauggcuggaacuaagagauuugcuugccuuugccucccaagugcuaggauuaaaaauaugaaccaccaugccaggcuuauaaaaauuauuugugcugggcaugguggcgcacgccuuuaaucccagcacucgggaggcagaggcaggcggauuucugaguuugaggccagccuggucuacaaagugaguuccaggacagccagggcuacacagagaaacccugucuugaaaaaccaaaccaaaaaaaaaaaaaauauauauauauauauauaauuuguaaaagaaaggugcugcucaagagcccaugguggcaccuacaggcuguagcaucagagcaacuggcagcugcucagucuaaagcuagaagcaguggcaguggcccagucuggagcugcaggccugugggccccugagagggccugaugcaaguguacauuugaaagcugaagaaaggagcgagagagaugguucagugcuuaagagcacugucugcucuuccagaggaccuggauucaauucccagcaaccacauggaagcuuauaaccaucucuaaguccaguuuuagaggauccaacaccuucacacagauacacauacaggcaaaacaccaaauaaaauaaauauuucuuuuccacauuuuuuucuaggacagccugagcuacacagagaaagaaauccuguaucaaaacaccaaaaaguauagugcuguaccaguccuguccuguccuguccuguccucuccuguccucuccuguccucuccucucuucuccucucuuuucuuuuuuuucuuuucuuuucuuagagacauggaggguuucucuguguagcccuggcuguccuggaacucacucuguagaccaggcuggucuugaacucagaaccgcccaccucugccuccuuagugcugacaucuaaagugugcgccaccaggccuggcuauuuuacauuuaaaaauaauuucugcccagugugguggcgcacaccuuugaucccaguacuugggaggcagaggcaggcggauuugugaguucgaggccagccucgaacagaguaaguuacaggacaggcagggcuauacagagaaacccugucuuggaaaaaaaaaaaacaaaaaaaccccucaaaaacaaaagaaaagaacugaacccaaggaugugcagaggcuuaacgaaugccccagcacugaucucuaacgugauugugguguuuguugaaacagggugucacugugcagcgccagcucucuucauacucauccucuugccuuagccuucucacuggugggauuucaccaccaugcccgacuucuguagaguguuuugcacuuaguaaaucgacagacuuguuugacauaagcuguguugccugugucccugagccuuagaagacucagagcucucugacugcuguguuaucuuucaucacagguguugagcgaugaagugaagaggaagcaguaugacgcuuacggcucugcuggcuuugacccuggcaccagcagcucugggcagggcuacuggagaggaggucccucuguugaccccgaggaguuguucaggaagaucuuuggggaguucucaucuucuccuuuuggugauuuccagaauguguuugaucagccucaggaaguacguuucuuauucuuuauuuuuguauuuuuugagagagggucuuacauucuagccuuggcugucuuagaacucacucugcagaccagguuggccuuaaacucacagagaucugccuaccucugccucccaagugccaggauuaaagacacgugccaucauacccaauguucuuuauuuuaaaggaucaacuuuuagguuuaagugcagcacaagggucuuuuuuaguuuuuguuucucagaaaggcaguggaaugauuuaacgucauccauuugacaggaaggaauacuuggaaaauccuuuagguagugaugaacauguacauugugaugucauuaucaauagcugcuuacucaguagauugauucaucuagagcagggguucugaaacuggauugugacuucuucggguggggcuugaauaugagauauccuaugaaccagcuauuuuuauuaugauuuauagcaguagcgaaauuagagcuaugaaauaauguuaugguugggggucaccacaccuguguuaaaggagcucagcguuaggaaggcugagagccacugauucuaaaaauaaaauaagaggacacauccccagugucauaaaaccucucaccagacuccaccucuucaagguccucuaccucccauuaguacuaaauugaaaaccaaguguugggccuuugggagauaaucuagauuuaggccaaaacaaguguuaaaugcagacauuauucaugucuucaguugaagagaaaauuuuuaccuaaaacauuuuagaaucuguauuuuacaucuauugaucaacuaaauaaauauugccauucuuccccugaaaaguguacauguacacauguuugguacuucagaaguaacuccagcuacugaccucaaacagagcaucacuguagucacuguaaagcuaagcgacaggccaugccucacucuuucaguacaucauggaauugacauucaaucaagcugccaagggugucaacaaagaguucacugugaacauuauggauaccugugagcgcugugacggcaaggggaacgagccuggaaccaaagugcagcauugccauuacuguggcggcucgggcaugguaaggauggaugcuuuggggcccugcccuacuucuccugguacugauuugcuguuacccaccugccugugcugcucuccaacccuuucuuuccuguuccaagagauccuuuauuuagauaguccuggggcuugggcuggguccccuagcacuggaccaggcugcucuccaacuaccuauaugugugaggaugaucuuccuuuaucuuccaagugcuacugucccacccuggcucuucuagggaguggggguuagaggaaggacagggucucacucuauuucaggcagaccuugaauuuauaucaacucucuagccucaggcucuuggaugccggaauuauaagcaugugucaugccugguuauaauucuuaaaagucuuuuuuuauuauuauuacuuuauuuauuuauuguaugcucaugugugcuaugugugcccacauguggcauucaaaggacaauuugugagacucuuuucuuuuuuuuuaaacacaucuuuuuuuuuuuuuuuuuuuuuuuuuaagauuuauuuauuauauguguguacacuguagcugucuucagacacuccagaagagggcaucagauuuuuguuacggaugguugugagccaccaugagguugcugggauuugaacucaggacuuuuggaagagcagucggugcucuuaaccgcugagccaucucuccagccccaugggacucuuuucucuuucaucguaugagacccugggaaugaacucaagacauuuugcuugguggcuuuaagugccuuuaccugcuggccaucuugccauccauuuuauauauuuauguuuuauuuuauucauugagaccgagucucaauguauaguucuggcugcucaggaguuugcuguuuagaccagauuagcuucaaauucagaauuguucuucuauaucaugugcaggcauuccauauuuagaguucuuguauagggcugugucuaauuggugaacauguucuuagcaugcucagagcucugaauucauauuuuguuuuguuugagauaggcuuuaacucuaaucuaggcuggcuuggaacucaauauauaccucaggcggccuuugagcaugaguuagucuucauuugucagucucauuagugcuauccaaacaagugugagccaucgugcccaaccuugaagucaguccucagcacguacauaugcacacacacacauauacauauauucauuuaaaauauuugaguguuggcacacaccuuugauuccagcauuugcagaggcagguggaucucuauggucuaugaagcaggauccaggacagccaggggcggggucaggguggggaguugacuucugugcuaggugugguuguagguauuuguacucccagcacuugguagguggagucagaaacaucagaagguggaguuuauucuucacuacauagcaaguuugaauucagcuuuggcuacaugagauaucaucuuucuuccuccaccagaaaaagaaguucagauuaucagugugaggcccugucccuguuuucuaaaaaaaguguguucuagagcagcauauaaggagaaaaaaaauccguccauccaugcucccucccucccuucauacccuugucucucccacuuaagauuuaagauuucuauucuuugaaguuuuuauguguguauauaauguauuuaaauuguuauucacacccgcccucccaauggggguagggugugggcagagucucauguaaccuaggcuagccuugauugaacuccugaucugucucuacccuccauauuuuaagauaauagaccugugcuauauaaagucuuaucuuuuugauaaaacaauguaucuacguucuuagcauuuuucucuucaucaggaaacuaucaauacagggccuuuugugaugcguuccacaugucggagaugugguggccggggcuccaucaucacaaaucccuguguggucugcaggggagcaggacaagccaagcagaagaagcgcgugacaauuccugugccugcaggugggccacugccuggcagacgggcuagcaugugugccuguuguaugcaugauuguacaguuagagauaaagccccaacgcccugguugaaggaagagcuagacuccuuucuuuuuaagauuuauuuauuuauuuauuuauuuuauguauaugaguacacuguagcugaacagaugguugugagccuucaugugcuuguugggaauugaauuuuuaggaccucuacucacugugauuagcccugcuagcucuggggcaggguguaagaucucauuacaggugguugugaaccacccugugguugcugggauuugaacucaggaccuucagaagagcagucagugcucuuacccgcugagccaucuuggcagcccccaagagcuagacucaaguucuccuuuguuccagucaucguuacaaugugcccgcucuguucuugucuugggaugcugcagcuccuguccaguuuucugaccucgcucucuucugucuucacucagugaggaccaacaugagcaggaaacaagcuauuaccuagugauacuguuaaccucaguacucaggcagggggagcacagguuuguggucagccugagguccauagugaggcccucauagccaaaacaagaagaaaccuggacaaguggguuuuccuggguagaaauugcugugggagaccccuaccauaacugcuauuuggaacuuuuguucuaggaguugaagauggucagacuguaaggaugccagugggaaaacgagaaauuuuugucacauucaggguaggugccugccugucagcuuauguugggucuuguugucuuggagugggugcagcugagauuguucauuguaguaagguagacaguucacgggcacagguguugcuguuccaguuaaggaaaggcugccuggcaugauuauuaauugcuuucaugcuuauguguagagaaugaagcuuucucacaacacugacaaguuagaaacacagccaggcagugguacgcaugccuguaaucccagcacuaccgagacagaggcuggugggucuuugaguuugaggccagccuggucuacacugagaguuccagaacagccaaggcuacaccaagaaacuccaucuugggggggaaaaaaaacagaaaaaaagagaaagaaacauagaacacaaaucccagaacaucugaugugugguggugguguuguuucuguauaaauuguugguuagagagcaaaagcaaaacccuuuuuuuuuuuuuugguuuuucgagacaggguuucucuguguagcccuggcuguccugcuggaacucacuuuguagaccaggcuggccuucaccucagaaaucugccugccucugccuccugagugcuaggauuaaaggcaugcgccaccaugccuggcuuuauaacuuuucuuuccccguuuuugaaccaggaucuuccuguguugcacagguuggccuggaacucauaauugucauggcuuagccuccagaauuuuuguauuaugggugggcuucccccccccccccccgucuaguaucuuuguaaugcuuaauuccauuagcuugauguguagcuugaugugggugucuuauugcuguguuuacuuugccuuuuucuguuugugagauaucucauuggaaucgaguacuagagauaguaaguagcacgugccuacaauccuagcacgugggguauggaggcaggaggacccugaguucagagccagccugggcuauacaguaaaacccugucuuuaaaaacaagacugaaaacaaaaacaagaaauaguacucagccgggcauggugacgcucgccuuuaaucccagcacucgggaagcagaggcaggcggauuugugaguucgaggccagccuggucuacagagugaauuccaggacagccagggcuacacacagagaaacccugucucgaaaaaccaaaaaaaaaaaaaaaaaaagaaaagaaaaagaaauagggacucaggauguagauaaaguuucucgagugacuggccauggugguggcgcaucccuguaaucucagugcuugggagguagaggcugggcccacagaggauuugaagcaaguccccaguaauaguaggaaagcuggcuguaguggcacuaccuguacaggaaaagcugaagcaguggguuuacauaagucugaaguuggagucuaccuggacaacauagugacaucuucucugaagccaaagauagcacaguaaauaaaaauagugggagggguagaucuuguagcuggagaauucacagaugcagggaugugcugaacuguagcuuagugguggugugucugauaugugcaaagcccuguguuuuuucccuagcacugcaaaauaaauaaaaauuuaaaacuacauaaaggcagaaaccuggagggcauuuuauaagaauuugguugaggauccaacugcacuuuccauuuuauaauaaaugaaagaaagaagaagucaaaggcagaggauauuuuugagauaugaaaaacaguauuugaaagccaaauaaauuccuguccugacuguuguccugaaggcagcuuguguuaggugagcaucggaaagccguguguaaaccugugucugugcgugcagaggacagagguugguguggcuccuuucucauuccuuguucuugcugaaccuggagcucagugauucaucuaagguuucugggcaguaagcucagagacucacaugcacgcacacgagcacacacacacacauacacacacacacacacacacacacacacuucccagcaguguacuaccaugcccaguuuuuacaugaguguuguggauccuugucuuguguggcaggcaccuccacgucuccugcagaucacguuuaccuuuguagauguauuggucugugguuuaguaagauuuggggaaaacauuuaaaagcccgauugcauucuuucuucuguaacuaaaaguagugauggaggcugaagcagugcagacauugcucugcagugcaguguguguggaggcugugucccuccagagccuugcggugcugucuccuauugaugggagguguaggucucgaggcgcuaguuaagugcaaagagguuaaagugugucagguuccaaggucaggucugacaagacacauggcuggugucuagccucaggcagcacuuccaccgcccuuacaccugucuucucucuggcauuaggugcagaaaagcccuguguuccggagggacggugcagacauccacucggaccucuuuauuucaauagcucaagcuauucuugggggcacagccaaagcccagggccuguaugagacaaucaaugugacgguaagagggcaugaggacagcugucucugcagcuuguugauccuuuuucuucccuuccccucccucccucccuucuguuuuacuuauuuauuuuuugagauggcuauuauguauccucaguugaucuuggacuuguaauccaguugccuucccuguguuagguuugcauccaugugcaugcauguuauuuauuuuuuuuaagugggaaauagcugagguggucuaaaccugaguguccagccugucaggaacucugaauagaagaggcauuggagccugugacaccaggggcugcaggcuguuccaugaggaguaauuacaacgccacgccuuucugcucccuggucugugccuccucuuccgaugucaguguccuggggacuaacagcauaacuaaugcucuggaaaaggugcuguuuguucacguucccgcccagggaugucuggagagcaggggcucuaggacuacuaugugcuacucugguaaccaccucuaguuugggaguuuguauuugucguuuuuuuugggaggggggguugacacaggguuuuuuguguguugaccagacuggccuggaacucgauuggucuaccucugccucccaagugcugggauuaaagaugugagcuaccaccuucuggcaaccaucucuaguuuuuaauugcagcuguaaauggaugcuuccuguacccacacuuacaccacuauauuugucucggggccaucuccagccucuggguauagagacuuuggccauaccauaggcuguggcaacagucacuggggagucuucuuccaccuccuccuagagaccaccuggaaccucugcuucucuagggucccuugcuauccagcucuugagaguaacagagcaaucuuagucucacaccugcucucaguguuuugcuucuagagccuuugcuucacuucucacaucuguuucuagggucggcucucagcuguccuacagcuguguggguaguuaguucugcacaccugguggaaguccuuuuuugaagacaucucaggauuaucucuguauagugagauguuuuauuuuugaauagugggaaccaggaagcaucagcauauuucuuuuuuuuuuuuuuuuuuuuuuugguuuuguuuucgagacaggguuucucuguguagcgcuggcuguccuggaacucacucuguagaccaggcuggccucgaacucagaaguccgacugccucugccucccgagugcugggauuaaaggcgugugccaccacgcccggcucaucagcauauuucuuacucaacagaucccugcagggauucagacagaccagaagauucguuugacuggaaaaggcaucccccggauuaauagcuauggcuauggugaccacuacauucacaucaagaucagaguuccaaaguaaguauucaguaagacuauggccaaaacuguuccggcaaacaggcauccuuugagucuuuuagcugccaggcccagcacccagcaguucaguugcccuuugagcucuuggcuugggcaaguuuuuucuuccuuggaaccaguuucgucugaccugauucccaucugagcauuggcuauaguaaguuggccucauugaguuguggaaugaaugacacaggagcugcugaacuccugauguguucugggcuuaaugcuguggcacccaacaugugcugugccuguuccucucaggaagccagugucagcucuugucccuuuugugagauugguuucucaccuguugccugacaaacacacauaacaugugcaccccaaccugugagcaucugcuuagcagugaugacaguuuaaacaacucaggguuucagagagaagcucaaaggaccagcauuagcacaagguaccccaagaaagggaagggaauaagggugaggggcauggauagaggcagacaugucauaggcaaaugacugucuauaaagguaaaggggaccccccccccguguuaggaugagguguuuaauuuugauugcuguacuccaauucuuugauaguugaaccuugguggucagcgucaggaggaggaaguggccaaauaagggaauaggccuugauggcuagcuuuaggaaugugaucuaacaguuuugcaaggaagagagaauagugaaggguaaggccugccagagccacacuugccauguguaggcuggcuagagcccuuuucugaaacguugacuuggccaucaguuccucaccacuggcucagugcgugccucugcgcgagucagacauguaugugcuuaugugcuuucaagggcugccuggaggaagugcucggccacuaacuguuguugguucacaggaggcugagcaguaggcagcagaaccugauccugagcuaugccgaggaugagacugacguggaggggacgguuaauggagucacccacacaagcacugguaagguaccugggacugacauggcggugugagggaccucugagucucuauugacagacauuucagaacuugaguuuucauaggcccccaaaagucauuggaagaggggacucguggguauacagccaucucucaugggugcgucuccuauucacugcauccauauauuuaagaaagcccaggagcacuugcugcccggcagcugugccuaaaaguuguuuccugaguucuagccuugguucugccacuugcccugugacuuugggcaauuaccuccaagaauucuuuguaauaguuuaagggggagaugaauugaacagagcuauagacacuuuacuaggaguccaaaguaaacagugcugacaacaguauaaagauacuaccucccacuugaugaacagauuuguugccuaggcucagaugucaugaacucagacacaagugguugaugugugggcuggagcuuuccugugccccugaggcuguuucucaggugaagcuucuguugauugauauaggucaggacaggucaggacaggacaggacaggucaggacaggucaggacaggcugugcccagcugcacguguuucuaccucauugcaucauuuuguuuuugugggaaccugaacagaguccucagaucuggaguggccuuauauuaguguguggugguuuauagccaguauucagagcuagggcagcuuuuccagcagauuagagggaggauuuggaguucucagagggaagagacaguaguggaaguggaaaucccagcagccuucccuggaaguuuuguugagcuccuguuaagaacaagagcccuguuuauagcuugaccaaacaccaaaugauauuuauuuuaguguuuagaugcauaaugcauaaacuuuucucuuuguuuuucacucauguuugcuuguuugagauggucuugguggcauguaacaugagauccuacugcuuaggcuucugagagcugggauucaggcuugguccaccauaccaguucuuguguucucuuuuaagcuaaauaggaagugggacaaguuauuccauagaacucugauugugugccuauaacuucaugacaaguccccaagguuucauaauacacgagauuugcucuguacacaggagcuccuguucugcagggcagggcgcagauggggacaggaacaguccauccuuuuuagaauguccuuacuauuuucuuccauuaaccucuguugucauuguuuucaaaaucgcaucucuuugggaguuugacucccagauuugauuuuguaaagcagcucaguugauaaagugcuaaccuaaaaucccugaggucucaaaaccaaaaaccaaugggcuuuuugauaaucuugcagagauggguuggggagagggucaugaggcucccuccuucccucccuccagcaccuccugcuggcuguaucuaauucuacuccauagcauguguucucuggaaugcuaacugacaggggacuccacgaugcagucuguuaggucauugaccauguguaggacuuuucugcauugagaacauuugggcaucaccaauguuccuguaagcaaccccucauccaugucugcaaguaaacccaaaaaacacauugguucccucaagcuggacauaguuggaacugcuuuccugugucugugcccaucuggggugaguagacauuguucacauccaucucccugggguaguugaugcagcaucuagaugcaggacagacagcaggagcacagcucacucugagugggcacacggaaaggagugcuguaagcaacgcgcucagugaggccggugcuauugggagcugcagaggugacucagagacaucgcugcucuuacagaggaccuggauuugguuucugacacccacuuggaggcuuagaaccauuucuaacucaaauuccagggaauucaaugacuuauuauggucuucuccaugggcaccaggcaagcacguggugcacauauguacaugcagacaaaauagcuauacacauaaaaaguaauuauaaucuuuaaggaaaaagaaaaauguagaugggcagugaugguacacaccuuuaucccagcacucaggaggcagaggcaggcggaugugugaguucuaggccagccuggucuacagagcugguuccaggauagccaaggcuauacacacacacacauuucucuuuuucaaaaaaaaaaugcuuuaaaacagucugggugguggacaaagcugccaggacacagcugagcuccacgcuucacacagagccagagccagagccugcacagcucucugcucaguucugagcauuuccuuuuguaauauguaaaggguuaaguaacauaaaggacucuuaacacaucaacacaucuauaaaccaugggcucccuauaccuccugagucuucuaagauaaaauacauuucauuuccuugguaaaugaugacagacauaauguguugacacuguaagucaccacugguggcacuucuuucuuuuuuucuuuccuuccuuccuuccuuccuuccuuccuuccuucuuucuuucuuucuuucuaaguacacuguagcugucuucagacacuccagaagagggcgucagauuucguuacagaugguugugagccaccaugugguugcugggauuugaacucaggaccuuuggaagagcagucggcgcucuuaaccacugagccaucucaccagcccccugguggcacuucuaauccaugccagguaccaugccacuggcuguacuuuaucacuuggucucaccaaauugcauagaggcccuauauauuuugcuuuuugagacaggggaacucacuauguaguggaggauaaccuugaagucuugauucuccugcuucucucucaagacgcccguguacaacacaugucgcugguguugugagaagagacaagaugggguguacagcagaggauccugggugagagcagcucacucguggguuaucuuaaacauguuaauguauacaacauaggcagugugaaauguggcaguggguuaggaauuggaucuuuucuugagguccauugcuuacguugcagccaacagucugguggugaagagucugggcugggguugaguuagguucugccucuuucuaguggcuuugggacucuagguggaccugacagcauggcuucuguguacauggagcugagaugagcuacugcauagccuuugugucuuggccccgaggccucuggcacuuaguguugcuguuguugucauuguucagauuauagacagucccuuccccucccuuuuuucuuguuugccuacuguggguuugugacuccuaaggcucugagugucccauuugcuucagucuaauaccugagguaccccuugccagccugagaguggcccuuauguuccuggaguggcccuuggcuacuccucagcuuuugggcaguuagguggguagguggggcuggcauuugcugcauggaggugucugcucuugaccucgguucuuucuguuguuugugcccagguggcagaaccauggauagcuccgcaggaagcaaggauaggcgagaggcuggggaggacaaugagggauuccuuuccaaacuuaagaaaauauuuacuuccugauaccccugcugagguaggaaaaccugugagcuugcuuuccuguaaaccucugaacuaaucucucuucuuuaaccaacaugagaucccaccucacccuacccuaucccaggaggugggagaguauaguaaaugugguuccccuucaauccuuggggcagagcaugugguaccuagccagcacagcguugagcaggcuucaguggccagccucuucauuuuaauucaauuuagauuccuuccuaaagagguuagauuuagagguaccuuacaguccucauugucauuucccaaggacucugucccucuguggugggaccagcuugcccgaaguccagagggcaaauuguggcagagccacgccuagaacucagaucuccuccaccucccaccugcuuuucagcacacuguucugcccaggcaacauggcacuguucauguuugggccacugaggagugacggacauuuugucugccuggagacacacuguuguuucauguucaccccagguccuggggcucuugacccucaaagcucagcuauucuccagggauuaacagagccucuuccacagggauguguucugagauguggaauauaacuguuugucuucuuggcucaggaaagcggucaacuggaaacuaaauggagcagcagcuccucucuguggccagggcaucagacacaggaggaucccagaacggcagcacugagccccugcucccagaucccucugaaccgccgagcaacagcaaaacuaugugacaacacuucuccgcauaaagguuauggugcccuaggcagugacauauggccucaggcuggacaccgagacagguggaaauacccuguccauugguagaugucuugcuucuucugguucaggcagggaaaacacuuggacucuucuugcagcacuaaaacuaaccuggaaucgcauguaguagagcugaaagaauuaaagacccggcuuacagcuucagaugaagcuuuaagcugcaguguugugaagugauuaauucccuuucuaccaaccccgugggaguucuacaguacggcuguccugacacggcucuugucuaggaccagggcggcacaucccaccagcgccaucuuccuggacagagugagcugucagucacuccccagguuuuuuuuguuuuugggguuuuuuuuuuuuuguaccaaguagcuagaaagugggaccuagggcccugggaggacaccuagcaacagcagguuccauuucaccucagauggcagcuugccuggcaguggacuuagaguguucuagucugauguaugugggguuuccugcccuguuggaccaaaguuuccaugguccuaugggauagccuucagccucuggagacccagagcuugccugccagggcuugguucuccauuuccacugcugacauuugauuuccaguguauuuaaauuacuccgugguaaauuucauugucuuuuccuguguaaauguuaaaugacaauaccaucggugaaggcccuccacaguggacagagcaacuuccuuuccagccucugcugguagcaugcugcagcuucuguguuaaagguccucuggagcucguguaagacaggaagaacacuuucucuguaguuucuuucuuuucauuuauaauuuacaaaaguaaagcauuuauuagugucugauuuaagaauguaaagugauucuguaucaauguaaauaagaugaucuacuacaaaagauauuuaaaau

SEQ ID NO: 12541 - RNA, 23622 nt, Mus musculus
auuuuaaauaucuuuuguaguagaucaucuuauuuacauugauacagaaucacuuuacauucuuaaaucagacacuaauaaaugcuuuacuuuuguaaauuauaaaugaaaagaaagaaacuacagagaaaguguucuuccugucuuacacgagcuccagaggaccuuuaacacagaagcugcagcaugcuaccagcagaggcuggaaaggaaguugcucuguccacuguggagggccuucaccgaugguauugucauuuaacauuuacacaggaaaagacaaugaaauuuaccacggaguaauuuaaauacacuggaaaucaaaugucagcaguggaaauggagaaccaagcccuggcaggcaagcucugggucuccagaggcugaaggcuaucccauaggaccauggaaacuuugguccaacagggcaggaaaccccacauacaucagacuagaacacucuaaguccacugccaggcaagcugccaucugaggugaaauggaaccugcuguugcuagguguccucccagggcccuaggucccacuuucuagcuacuugguacaaaaaaaaaaaaaccccaaaaacaaaaaaaaccuggggagugacugacagcucacucuguccaggaagauggcgcuggugggaugugccgcccugguccuagacaagagccgugucaggacagccguacuguagaacucccacgggguugguagaaagggaauuaaucacuucacaacacugcagcuuaaagcuucaucugaagcuguaagccgggucuuuaauucuuucagcucuacuacaugcgauuccagguuaguuuuagugcugcaagaagaguccaaguguuuucccugccugaaccagaagaagcaagacaucuaccaauggacaggguauuuccaccugucucgguguccagccugaggccauaugucacugccuagggcaccauaaccuuuaugcggagaaguguugucacauaguuuugcuguugcucggcgguucagagggaucugggagcaggggcucagugcugccguucugggauccuccugugucugaugcccuggccacagagaggagcugcugcuccauuuaguuuccaguugaccgcuuuccugagccaagaagacaaacaguuauauuccacaucucagaacacaucccuguggaagaggcucuguuaaucccuggagaauagcugagcuuugagggucaagagccccaggaccuggggugaacaugaaacaacagugugucuccaggcagacaaaauguccgucacuccucaguggcccaaacaugaacagugccauguugccugggcagaacagugugcugaaaagcaggugggagguggaggagaucugaguucuaggcguggcucugccacaauuugcccucuggacuucgggcaagcuggucccaccacagagggacagaguccuugggaaaugacaaugaggacuguaagguaccucuaaaucuaaccucuuuaggaaggaaucuaaauugaauuaaaaugaagaggcuggccacugaagccugcucaacgcugugcuggcuagguaccacaugcucugccccaaggauugaaggggaaccacauuuacuauacucucccaccuccugggauaggguagggugaggugggaucucauguugguuaaagaagagagauuaguucagagguuuacaggaaagcaagcucacagguuuuccuaccucagcagggguaucaggaaguaaauauuuucuuaaguuuggaaaggaaucccucauuguccuccccagccucucgccuauccuugcuuccugcggagcuauccaugguucugccaccugggcacaaacaacagaaagaaccgaggucaagagcagacaccuccaugcagcaaaugccagccccaccuacccaccuaacugcccaaaagcugaggaguagccaagggccacuccaggaacauaagggccacucucaggcuggcaagggguaccucagguauuagacugaagcaaaugggacacucagagccuuaggagucacaaacccacaguaggcaaacaagaaaaaagggaggggaagggacugucuauaaucugaacaaugacaacaacagcaacacuaagugccagaggccucggggccaagacacaaaggcuaugcaguagcucaucucagcuccauguacacagaagccaugcugucagguccaccuagagucccaaagccacuagaaagaggcagaaccuaacucaaccccagcccagacucuucaccaccagacuguuggcugcaacguaagcaauggaccucaagaaaagauccaauuccuaacccacugccacauuucacacugccuauguuguauacauuaacauguuuaagauaacccacgagugagcugcucucacccaggauccucugcuguacaccccaucuugucucuucucacaacaccagcgacauguguuguacacgggcgucuugagagagaagcaggagaaucaagacuucaagguuauccuccacuacauagugaguuccccugucucaaaaagcaaaauauauagggccucuaugcaauuuggugagaccaagugauaaaguacagccaguggcaugguaccuggcauggauuagaagugccaccagggggcuggugagauggcucagugguuaagagcgccgacugcucuuccaaagguccugaguucaaaucccagcaaccacaugguggcucacaaccaucuguaacgaaaucugacgcccucuucuggagugucugaagacagcuacaguguacuuagaaagaaagaaagaaagaaggaaggaaggaaggaaggaaggaaggaaggaaagaaaaaaagaaagaagugccaccaguggugacuuacagugucaacacauuaugucugucaucauuuaccaaggaaaugaaauguauuuuaucuuagaagacucaggagguauagggagcccaugguuuauagauguguugauguguuaagaguccuuuauguuacuuaacccuuuacauauuacaaaaggaaaugcucagaacugagcagagagcugugcaggcucuggcucuggcucugugugaagcguggagcucagcuguguccuggcagcuuuguccaccacccagacuguuuuaaagcauuuuuuuuuugaaaaagagaaauguguguguguguauagccuuggcuauccuggaaccagcucuguagaccaggcuggccuagaacucacacauccgccugccucugccuccugagugcugggauaaagguguguaccaucacugcccaucuacauuuuucuuuuuccuuaaagauuauaauuacuuuuuauguguauagcuauuuugucugcauguacauaugugcaccacgugcuugccuggugcccauggagaagaccauaauaagucauugaauucccuggaauuugaguuagaaaugguucuaagccuccaagugggugucagaaaccaaauccagguccucuguaagagcagcgaugucucugagucaccucugcagcucccaauagcaccggccucacugagcgcguugcuuacagcacuccuuuccgugugcccacucagagugagcugugcuccugcugucuguccugcaucuagaugcugcaucaacuaccccagggagauggaugugaacaaugucuacucaccccagaugggcacagacacaggaaagcaguuccaacuauguccagcuugagggaaccaauguguuuuuuggguuuacuugcagacauggaugagggguugcuuacaggaacauuggugaugcccaaauguucucaaugcagaaaaguccuacacauggucaaugaccuaacagacugcaucguggaguccccugucaguuagcauuccagagaacacaugcuauggaguagaauuagauacagccagcaggaggugcuggagggagggaaggagggagccucaugacccucuccccaacccaucucugcaagauuaucaaaaagcccauugguuuuugguuuugagaccucagggauuuuagguuagcacuuuaucaacugagcugcuuuacaaaaucaaaucugggagucaaacucccaaagagaugcgauuuugaaaacaaugacaacagagguuaauggaagaaaauaguaaggacauucuaaaaaggauggacuguuccuguccccaucugcgcccugcccugcagaacaggagcuccuguguacagagcaaaucucguguauuaugaaaccuuggggacuugucaugaaguuauaggcacacaaucagaguucuauggaauaacuugucccacuuccuauuuagcuuaaaagagaacacaagaacugguaugguggaccaagccugaaucccagcucucagaagccuaagcaguaggaucucauguuacaugccaccaagaccaucucaaacaagcaaacaugagugaaaaacaaagagaaaaguuuaugcauuaugcaucuaaacacuaaaauaaauaucauuugguguuuggucaagcuauaaacagggcucuuguucuuaacaggagcucaacaaaacuuccagggaaggcugcugggauuuccacuuccacuacugucucuucccucugagaacuccaaauccucccucuaaucugcuggaaaagcugcccuagcucugaauacuggcuauaaaccaccacacacuaauauaaggccacuccagaucugaggacucuguucagguucccacaaaaacaaaaugaugcaaugagguagaaacacgugcagcugggcacagccuguccugaccuguccugaccuguccuguccuguccugaccuguccugaccuauaucaaucaacagaagcuucaccugagaaacagccucaggggcacaggaaagcuccagcccacacaucaaccacuugugucugaguucaugacaucugagccuaggcaacaaaucuguucaucaagugggagguaguaucuuuauacuguugucagcacuguuuacuuuggacuccuaguaaagugucuauagcucuguucaauucaucucccccuuaaacuauuacaaagaauucuuggagguaauugcccaaagucacagggcaaguggcagaaccaaggcuagaacucaggaaacaacuuuuaggcacagcugccgggcagcaagugcuccugggcuuucuuaaauauauggaugcagugaauaggagacgcacccaugagagauggcuguauacccacgaguccccucuuccaaugacuuuugggggccuaugaaaacucaaguucugaaaugucugucaauagagacucagaggucccucacaccgccaugucagucccagguaccuuaccagugcuugugugggugacuccauuaaccguccccuccacgucagucucauccucggcauagcucaggaucagguucugcugccuacugcucagccuccugugaaccaacaacaguuaguggccgagcacuuccuccaggcagcccuugaaagcacauaagcacauacaugucugacucgcgcagaggcacgcacugagccaguggugaggaacugauggccaagucaacguuucagaaaagggcucuagccagccuacacauggcaaguguggcucuggcaggccuuacccuucacuauucucucuuccuugcaaaacuguuagaucacauuccuaaagcuagccaucaaggccuauucccuuauuuggccacuuccuccuccugacgcugaccaccaagguucaacuaucaaagaauuggaguacagcaaucaaaauuaaacaccucauccuaacacgggggggggguccccuuuaccuuuauagacagucauuugccuaugacaugucugccucuauccaugccccucacccuuauucccuucccuuucuugggguaccuugugcuaaugcugguccuuugagcuucucucugaaacccugaguuguuuaaacugucaucacugcuaagcagaugcucacagguuggggugcacauguuauguguguuugucaggcaacaggugagaaaccaaucucacaaaagggacaagagcugacacuggcuuccugagaggaacaggcacagcacauguugggugccacagcauuaagcccagaacacaucaggaguucagcagcuccugugucauucauuccacaacucaaugaggccaacuuacuauagccaaugcucagaugggaaucaggucagacgaaacugguuccaaggaagaaaaaacuugcccaagccaagagcucaaagggcaacugaacugcugggugcugggccuggcagcuaaaagacucaaaggaugccuguuugccggaacaguuuuggccauagucuuacugaauacuuacuuuggaacucugaucuugaugugaauguaguggucaccauagccauagcuauuaauccgggggaugccuuuuccagucaaacgaaucuucuggucugucugaaucccugcagggaucuguugaguaagaaauaugcugaugagccgggcgugguggcacacgccuuuaaucccagcacucgggaggcagaggcagucggacuucugaguucgaggccagccuggucuacagagugaguuccaggacagccagcgcuacacagagaaacccugucucgaaaacaaaaccaaaaaaaaaaaaaaaaaaaaaaagaaauaugcugaugcuuccugguucccacuauucaaaaauaaaacaucucacuauacagagauaauccugagaugucuucaaaaaaggacuuccaccaggugugcagaacuaacuacccacacagcuguaggacagcugagagccgacccuagaaacagaugugagaagugaagcaaaggcucuagaagcaaaacacugagagcaggugugagacuaagauugcucuguuacucucaagagcuggauagcaagggacccuagagaagcagagguuccagguggucucuaggaggagguggaagaagacuccccagugacuguugccacagccuaugguauggccaaagucucuauacccagaggcuggagauggccccgagacaaauauagugguguaaguguggguacaggaagcauccauuuacagcugcaauuaaaaacuagagaugguugccagaaggugguagcucacaucuuuaaucccagcacuugggaggcagagguagaccaaucgaguuccaggccagucuggucaacacacaaaaaacccugugucaacccccccucccaaaaaaaacgacaaauacaaacucccaaacuagaggugguuaccagaguagcacauaguaguccuagagccccugcucuccagacaucccugggcgggaacgugaacaaacagcaccuuuuccagagcauuaguuaugcuguuaguccccaggacacugacaucggaagaggaggcacagaccagggagcagaaaggcguggcguuguaauuacuccucauggaacagccugcagccccuggugucacaggcuccaaugccucuucuauucagaguuccugacaggcuggacacucagguuuagaccaccucagcuauuucccacuuaaaaaaaauaaauaacaugcaugcacauggaugcaaaccuaacacagggaaggcaacuggauuacaaguccaagaucaacugaggauacauaauagccaucucaaaaaauaaauaaguaaaacagaagggagggagggaggggaagggaagaaaaaggaucaacaagcugcagagacagcuguccucaugcccucuuaccgucacauugauugucucauacaggcccugggcuuuggcugugcccccaagaauagcuugagcuauugaaauaaagagguccgaguggaugucugcaccgucccuccggaacacagggcuuuucugcaccuaaugccagagagaagacagguguaagggcgguggaagugcugccugaggcuagacaccagccaugugucuugucagaccugaccuuggaaccugacacacuuuaaccucuuugcacuuaacuagcgccucgagaccuacaccucccaucaauaggagacagcaccgcaaggcucuggagggacacagccuccacacacacugcacugcagagcaaugucugcacugcuucagccuccaucacuacuuuuaguuacagaagaaagaaugcaaucgggcuuuuaaauguuuuccccaaaucuuacuaaaccacagaccaauacaucuacaaagguaaacgugaucugcaggagacguggaggugccugccacacaagacaaggauccacaacacucauguaaaaacugggcaugguaguacacugcugggaaguguguguguguguguguguguguguguaugugugugugugugcucgugugcgugcaugugagucucugagcuuacugcccagaaaccuuagaugaaucacugagcuccagguucagcaagaacaaggaaugagaaaggagccacaccaaccucuguccucugcacgcacagacacagguuuacacacggcuuuccgaugcucaccuaacacaagcugccuucaggacaacagucaggacaggaauuuauuuggcuuucaaauacuguuuuucauaucucaaaaauauccucugccuuugacuucuucuuucuuucauuuauuauaaaauggaaagugcaguuggauccucaaccaaauucuuauaaaaugcccuccagguuucugccuuuauguaguuuuaaauuuuuauuuauuuugcagugcuagggaaaaaacacagggcuuugcacauaucagacacaccaccacuaagcuacaguucagcacaucccugcaucugugaauucuccagcuacaagaucuaccccucccacuauuuuuauuuacugugcuaucuuuggcuucagagaagaugucacuauguuguccagguagacuccaacuucagacuuauguaaacccacugcuucagcuuuuccuguacagguagugccacuacagccagcuuuccuacuauuacuggggacuugcuucaaauccucugugggcccagccucuaccucccaagcacugagauuacagggaugcgccaccaccauggccagucacucgagaaacuuuaucuacauccugagucccuauuucuuuuucuuuucuuuuuuuuuuuuuuuuuuugguuuuucgagacaggguuucucuguguguagcccuggcuguccuggaauucacucuguagaccaggcuggccucgaacucacaaauccgccugccucugcuucccgagugcugggauuaaaggcgagcgucaccaugcccggcugaguacuauuucuuguuuuuguuuucagucuuguuuuuaaagacaggguuuuacuguauagcccaggcuggcucugaacucaggguccuccugccuccauaccccacgugcuaggauuguaggcacgugcuacuuacuaucucuaguacucgauuccaaugagauaucucacaaacagaaaaaggcaaaguaaacacagcaauaagacacccacaucaagcuacacaucaagcuaauggaauuaagcauuacaaagauacuagacgggggggggggggggaagcccacccauaauacaaaaauucuggaggcuaagccaugacaauuaugaguuccaggccaaccugugcaacacaggaagauccugguucaaaaacggggaaagaaaaguuauaaagccaggcaugguggcgcaugccuuuaauccuagcacucaggaggcagaggcaggcagauuucugaggugaaggccagccuggucuacaaagugaguuccagcaggacagccagggcuacacagagaaacccugucucgaaaaaccaaaaaaaaaaaaaaggguuuugcuuuugcucucuaaccaacaauuuauacagaaacaacaccaccaccacacaucagauguucugggauuuguguucuauguuucuuucucuuuuuuucuguuuuuuuucccccccaagauggaguuucuugguguagccuuggcuguucuggaacucucaguguagaccaggcuggccucaaacucaaagacccaccagccucugucucgguagugcugggauuacaggcaugcguaccacugccuggcuguguuucuaacuugucaguguugugagaaagcuucauucucuacacauaagcaugaaagcaauuaauaaucaugccaggcagccuuuccuuaacuggaacagcaacaccugugcccgugaacugucuaccuuacuacaaugaacaaucucagcugcacccacuccaagacaacaagacccaacauaagcugacaggcaggcaccuacccugaaugugacaaaaauuucucguuuucccacuggcauccuuacagucugaccaucuucaacuccuagaacaaaaguuccaaauagcaguuaugguaggggucucccacagcaauuucuacccaggaaaacccacuuguccagguuucuucuuguuuuggcuaugagggccucacuauggaccucaggcugaccacaaaccugugcucccccugccugaguacugagguuaacaguaucacuagguaauagcuuguuuccugcucauguugguccucacugagugaagacagaagagagcgaggucagaaaacuggacaggagcugcagcaucccaagacaagaacagagcgggcacauuguaacgaugacuggaacaaaggagaacuugagucuagcucuugggggcugccaagauggcucagcggguaagagcacugacugcucuucugaagguccugaguucaaaucccagcaaccacagggugguucacaaccaccuguaaugagaucuuacacccugccccagagcuagcagggcuaaucacagugaguagagguccuaaaaauucaauucccaacaagcacaugaaggcucacaaccaucuguucagcuacaguguacucauauacauaaaauaaauaaauaaauaaauaaaucuuaaaaagaaaggagucuagcucuuccuucaaccagggcguuggggcuuuaucucuaacuguacaaucaugcauacaacaggcacacaugcuagcccgucugccaggcaguggcccaccugcaggcacaggaauugucacgcgcuucuucugcuuggcuuguccugcuccccugcagaccacacagggauuugugaugauggagccccggccaccacaucuccgacauguggaacgcaucacaaaaggcccuguauugauaguuuccugaugaagagaaaaaugcuaagaacguagauacauuguuuuaucaaaaagauaagacuuuauauagcacaggucuauuaucuuaaaauauggaggguagagacagaucaggaguucaaucaaggcuagccuagguuacaugagacucugcccacacccuacccccauugggagggcgggugugaauaacaauuuaaauacauuauauacacacauaaaaacuucaaagaauagaaaucuuaaaucuuaagugggagagacaaggguaugaagggagggagggagcauggauggacggauuuuuuuucuccuuauaugcugcucuagaacacacuuuuuuuagaaaacagggacagggccucacacugauaaucugaacuucuuuuucugguggaggaagaaagaugauaucucauguagccaaagcugaauucaaacuugcuauguagugaagaauaaacuccaccuucugauguuucugacuccaccuaccaagugcugggaguacaaauaccuacaaccacaccuagcacagaagucaacuccccacccugaccccgccccuggcuguccuggauccugcuucauagaccauagagauccaccugccucugcaaaugcuggaaucaaaggugugugccaacacucaaauauuuuaaaugaauauauguauaugugugugugugcauauguacgugcugaggacugacuucaagguugggcacgauggcucacacuuguuuggauagcacuaaugagacugacaaaugaagacuaacucaugcucaaaggccgccugagguauauauugaguuccaagccagccuagauuagaguuaaagccuaucucaaacaaaacaaaauaugaauucagagcucugagcaugcuaagaacauguucaccaauuagacacagcccuauacaagaacucuaaauauggaaugccugcacaugauauagaagaacaauucugaauuugaagcuaaucuggucuaaacagcaaacuccugagcagccagaacuauacauugagacucggucucaaugaauaaaauaaaacauaaauauauaaaauggauggcaagauggccagcagguaaaggcacuuaaagccaccaagcaaaaugucuugaguucauucccagggucucauacgaugaaagagaaaagagucccauggggcuggagagauggcucagcgguuaagagcaccgacugcucuuccaaaaguccugaguucaaaucccagcaaccucaugguggcucacaaccauccguaacaaaaaucugaugcccucuucuggagugucugaagacagcuacaguguacacacauauaauaaauaaaucuuaaaaaaaaaaaaaaaaaaaaaaaaagauguguuuaaaaaaaaagaaaagagucucacaaauuguccuuugaaugccacaugugggcacacauagcacacaugagcauacaauaaauaaauaaaguaauaauaauaaaaaaagacuuuuaagaauuauaaccaggcaugacacaugcuuauaauuccggcauccaagagccugaggcuagagaguugauauaaauucaaggucugccugaaauagagugagacccuguccuuccucuaacccccacucccuagaagagccagggugggacaguagcacuuggaagauaaaggaagaucauccucacacauauagguaguuggagagcagccugguccagugcuaggggacccagcccaagccccaggacuaucuaaauaaaggaucucuuggaacaggaaagaaaggguuggagagcagcacaggcagguggguaacagcaaaucaguaccaggagaaguagggcagggccccaaagcauccauccuuaccaugcccgagccgccacaguaauggcaaugcugcacuuugguuccaggcucguuccccuugccgucacagcgcucacagguauccauaauguucacagugaacucuuuguugacacccuuggcagcuugauugaaugucaauuccaugauguacugaaagagugaggcauggccugucgcuuagcuuuacagugacuacagugaugcucuguuugaggucaguagcuggaguuacuucugaaguaccaaacauguguacauguacacuuuucaggggaagaauggcaauauuuauuuaguugaucaauagauguaaaauacagauucuaaaauguuuuagguaaaaauuuucucuucaacugaagacaugaauaaugucugcauuuaacacuuguuuuggccuaaaucuagauuaucucccaaaggcccaacacuugguuuucaauuuaguacuaaugggagguagaggaccuugaagagguggagucuggugagagguuuuaugacacuggggauguguccucuuauuuuauuuuuagaaucaguggcucucagccuuccuaacgcugagcuccuuuaacacagguguggugacccccaaccauaacauuauuucauagcucuaauuucgcuacugcuauaaaucauaauaaaaauagcugguucauaggauaucucauauucaagccccacccgaagaagucacaauccaguuucagaaccccugcucuagaugaaucaaucuacugaguaagcagcuauugauaaugacaucacaauguacauguucaucacuaccuaaaggauuuuccaaguauuccuuccugucaaauggaugacguuaaaucauuccacugccuuucugagaaacaaaaacuaaaaaagacccuugugcugcacuuaaaccuaaaaguugauccuuuaaaauaaagaacauuggguaugauggcacgugucuuuaauccuggcacuugggaggcagagguaggcagaucucugugaguuuaaggccaaccuggucugcagagugaguucuaagacagccaaggcuagaauguaagacccucucucaaaaaauacaaaaauaaagaauaagaaacguacuuccugaggcugaucaaacacauucuggaaaucaccaaaaggagaagaugagaacuccccaaagaucuuccugaacaacuccucggggucaacagagggaccuccucuccaguagcccugcccagagcugcuggugccagggucaaagccagcagagccguaagcgucauacugcuuccucuucacuucaucgcucaacaccugugaugaaagauaacacagcagucagagagcucugagucuucuaaggcucagggacacaggcaacacagcuuaugucaaacaagucugucgauuuacuaagugcaaaacacucuacagaagucgggcaugguggugaaaucccaccagugagaaggcuaaggcaagaggaugaguaugaagagagcuggcgcugcacagugacacccuguuucaacaaacaccacaaucacguuagagaucagugcuggggcauucguuaagccucugcacauccuuggguucaguucuuuucuuuuguuuuugagggguuuuuuuguuuuuuuuuuuuccaagacaggguuucucuguauagcccugccuguccuguaacuuacucuguucgaggcuggccucgaacucacaaauccgccugccucugccucccaaguacugggaucaaaggugugcgccaccacacugggcagaaauuauuuuuaaauguaaaauagccaggccugguggcgcacacuuuagaugucagcacuaaggaggcagaggugggcgguucugaguucaagaccagccuggucuacagagugaguuccaggacagccagggcuacacagagaaacccuccaugucucuaagaaaagaaaagaaaaaaaagaaaagagaggagaagagaggagaggacaggagaggacaggagaggacaggacaggacaggacaggacugguacagcacuauacuuuuugguguuuugauacaggauuucuuucucuguguagcucaggcuguccuagaaaaaaauguggaaaagaaauauuuauuuuauuugguguuuugccuguauguguaucugugugaagguguuggauccucuaaaacuggacuuagagaugguuauaagcuuccaugugguugcugggaauugaauccagguccucuggaagagcagacagugcucuuaagcacugaaccaucucucucgcuccuuucuucagcuuucaaauguacacuugcaucaggcccucucaggggcccacaggccugcagcuccagacugggccacugccacugcuucuagcuuuagacugagcagcugccaguugcucugaugcuacagccuguaggugccaccaugggcucuugagcagcaccuuucuuuuacaaauuauauauauauauauauauuuuuuuuuuuuuugguuugguuuuucaagacaggguuucucuguguagcccuggcuguccuggaacucacuuuguagaccaggcuggccucaaacucagaaauccgccugccucugccucccgagugcugggauuaaaggcgugcgccaccaugcccagcacaaauaauuuuuauaagccuggcauggugguucauauuuuuaauccuagcacuugggaggcaaaggcaagcaaaucucuuaguuccagccauccgggguacaaagacacccuguuuuaaaaaaaacaguaauaauuuuauguguauggguauuuugcuugcauugaugucugucuaccacuuguguaccuggugcucucggaagccagaaaaucgucagguguagugcauguuacuaaucccagcacugagaggaaagggcuggugaaucucugugaguucaaggccagccuggucugcagagcaaguuccaggacaccagagaaacccugucucagaaagagaaaaaaaagccagaagacggcacuggaucccuugaaacuggagguauagaugguuauaaguuaccaauugggugcugggaauugaaccuggguccucuagaaugcuuguaacauuguaaugagucaucucuccagucccucagcagcugaucuuaugauccaauuaauaaaucucugauugccuauauccuauagguucuacuucucgagaaagcucuagcacagauuagcuauggcugacagguaauaaaaccuucguacuuacugaacuaugacucuacauguugcuaucuaggcccuugaacacauaaacacaugcagaacccauuggggauagucaacuccaagaggaaugcuaugguaauuugaaugaaaauggcccccacagacucacagggagugacacuauuagaagguguggguuuauuggaggaagugugucacuaagagugaguuuugggauuucagaagccagccccaguguugcuuucucuuccugcugucugcugauccagaugcagaacgcaaagcuacccuucuagcaccaugaaaaaaaacuugcuguggccauggucucucuucacagaacuaaaacccuaacuacggggcugcagagauggcuuacugguuaaaagcacugacugcucuuccagaggucguaaggucaauucucagcaacuacaugguggcucacaaccaucuguaaugggaucugaugcccucuucuggagugucugaggagagcgacagugaacccauaaacauaacauuaaauaaauaaauaaauaaauaaaacagaaacaagaacaacaacaacaaaacccuagcuaagacacagggucauucuccaauaauucuguaacuggucaaugguucucucacagauauuugguuucuuccuaugugcuuuacggucuauuuuuacaauugcuaacuuaagucaucaaauaaggacugauuugaucagucuaacugggauuucccgagaucagcuaucaauaugaauuaccugaguauauuuauugaucagaugaaccuugcucuuguuuuguuuuguaugaaggcagacuauauagcccugcuuagccuuaaacuuacagaaauucucuugcccucagccucaccagugcuaaauuacauauaugccaccacuucgggucucuuuucuuuuuuaaaaauuacaccuauuccuuuuguguacauaugugaguguucaaaugcuauggaacucagcaggggucagaggacgauuuauggaaguugcugaggauugaacuugucaucaggcuuggcagcagauagaucgcaccagccuguuuucuucauuuagagucuaaguuagcagaacuagcagggacacagcaccacccuggacuguaugauaugccaagcuaucuugugcagugcagacucugaugugugcacagagcugaauggccagugaaugaacccacaagucacauuaccucauaagcuucugccagcugggaaaacuucuccuuggcuuugggaucauccuuauuugugucuggaugauauuucuuggcaagcuaaggggaaaaaaaguaaauuacuauagauauggauagucacuaaaacagaacccaaauacuugcuacaauuaugucucuuuauaacagcugucucucuuaagauagcaacaaaaauuuuuuuuuuuuuuuuuugguuuuucgagacaggguuucucuguauagcucuggcuguccuggaacucacucuauagaccaggcuggccucgaacucagaaauccaccugccucugccucccaagugcugggauuaaaggcgugcgccaccacgcccggccaagacagcaacaaauucuuaaagcaagauuuaaaauuugaaaauaaaucauuccuucacagaugucuuaggggccagagagaugacucagcaguuaagagcacuggcuacucucccagagguccugaguucaauucccagcaaccacagggugacucacaaccaucuguaaugagaucuggugccaucuucuggcaagcauguacacaugcaggcagaacacuccauacauaauaaauaaaacaaucuuuaggaaacaaagcauuuacuacucuugcagaggaccuggauucaguucccagcucugauguguuagaucacaacucuaaaacuccaguuccuggggauuugauguccuuuucugaucucugaaggcaccaagaaugcaugcaguauauguacaugagacaaacaugcaugcacacaaaccaaaaauaaauauauguuaaaaguaauaaguagggucuggugagauggcucagcagguaagaccacugacugcucuuccgaagguccugaguucaaaucccagcaaccacauggugguuaccuguaaugagaucugacacccucuucuggugugucuacaguguacuuauguauaguaauaaauaaaucuuugagccggagcaagcagagguccuaaaauuuaauucccaacaaccacaugaaggcucacaaccaucuguacagcuacaguguacucacauauauaaaaauaaauaaagggcuggugagauggcucagcagguaagagcacccgacugcucuuccaaagguccugaguucaaaucccagcaaccacaugguggcucacaaccauccguaaugagaucugacucccucuucuggugugucugaagacagcuacaguguacuuacauauaauaaauaaauaaaucuuuaaaaaaauaaauaaauaaaaauaaauaaauaaaucuuuuuuuaaaaaaguaauaaguaaauacuugacuagcccuuuagcauccuggugcucugaaccuaugcaacagggaagcaaauaaccugcacaauuuugguugguugguugguuugguuuuacaagucaggguuuauguagcccuggcuguccuagaaugagcucuguagacuaguaugguuuuuuguuuugguuugguuugguuuugagacaaacuggccuuaaacucacagagcuucgcuugccucugucucccaguacugggauaaaaaggcagcacaaccacaccuggcuugccugcugugcaagguuuugaagaauuacguaauaaacguaugacaguuacugcuauaaaaaauaaagaaauuaagaauuaagaaagaauuaugaggagcuggagagauggcucagcaguaagagcacugacugcucuuccagagcuccugaguucaauucccagcagcuacgugguggcucaaaaacauccauaaugggaucugaugcccucuucuggugugucugaagucagcuacaguguaccccuauauauaaaauacauaaugauaaaacugcuuuaaaaaaaagaguaaugauguuuaccuauauaauuucuauuuauuuauauaugucauaauuguguggacagcaugguguacgugugaaaucaguucucuccugacuuuaaaugguuuuggaggaauugaacucaggucacuaggcuugaugucaaaugccuuuacccacugggccaucuuaccugccucuucucuucuuucuuaaaacguuaacagauugauaucacauucauugcccaccaaaggcaccccaaacuccaucuuucccagaucauuccauaggcucggcugcuugugaccugccuuagcaggcuauacaucaaggcaguaaggaccagacaacaucagcaccaagcuggguugaagagauggcucaguggcuaagagcacauaccccuuucccaaaagaccugaacucaauucucagccauguuagaugguucacagcugccuguaacuauagucccaaggggaucccuuaccccuguccucugugaacaucugcagucaugugcauauuccacagaugcacaaauuuaaaaacuaaaacaaaagccaggcaugguggcacaugccuuuaaucccagcacucgggaggcagaggcaggcagauuucugaguuccaggccagccuggucuacagaaugaauuccaggacagccaaggcuacacagagaaacccugucucgaaaagcaaaaacaaaaaaaaaaaaaaaaccaacaaaaauuaaagcaaaacauacacacacauacacacacagugaccagaccagcaaucuuucuacagucuugucaguaaaccuaagaccaauacagaccugauaauaggcuuucuugauaucuuucuggcuggcauuucggggcacucccaggaucugguaauaaucaucuuuggccaaagaagcacuuguguggaaagaggugguacaaacaaaagggaaacuuuuuguuccuggaaaugaaacaagaaaguaaguuagucugggaguuuauccaacaagaagaaauuauaaauaagugaccagcuacgaaauaucuguaaaaaagcaaacaagccccagcuauagggccuauucccacugaguacacuagaggccaaacucaauguucuucaaaugugggcaaagcucagggacauaguucaguagguacacugcuuaccagguaugcacaaggcccugaauuugauucccugaacugaacaaacccagcauaauccuaacaugaggaaaaggaugcagaggaucaaaaguucaagcuccauucauagcuacacaggaaguucuaggccagucuggaacauagaacacccuguuuccaaaguaaaaacaaaaacagccgggcgugguggugcacaccuuuaaucccagcacucgggaggcagaggcaggcggauuucugaguucgaggccagccuggucuacagagugaguuccaggacagccagggcuauacagagaaaaacccugucucgaaaaaacaaaaaaacaaaaaacaaaaacaaaaacaaacaaacaaucagccagagaaguugaaaguauauagacucuauagguggaacaacaauaugaacuaaccaguaccccagagcucuugacucuagcugcauauguaucaaaagauggccuagucggucaucacuggaaagagaggcccacuggacaugcaaacuuuauaugccccaguacaggggaacgccagggccaaaaagggggaguggauggguaggggagugggggggguggguaugggggacuuuugggauagcauuagaaauguaaaugaggaaaauaccuaauuaaaauaaaauaaaauaaaaaguauauagaaaggaauuaaaaaaaaaaaagaaugagcaggaauaaucagaaugagauugugauugacucuucagucacucccggagaagacauuagaccucgauacuuggugauccuauauuggaucucuuuacuugcuaccugccuggcuguauuccuguacuccucacuccuuccauuaucaggagcaugagucuauuaguggcaaaaguuugucagcuguaccagcuucuacgacaucagcagacagcucaaggaaacugugaauaaccacagguaacuauuacacagcggaugcuuuuuucuauucuaaaggccaaugauuagcaacuacuaggaaauaucuauuuuuuuucucuacaaaguaugcccagcacaugucuugcuuuuugaacccagaauaggauuagucuucauguuguucuaagaaugccuaauccaguagcuaauugcugauuucuuucugguuaggagauuucuuuuuuaugauuucuuuuuaguucauauguuucgguauuuugacugaauguaugucugugaagaggugucagauccccuggaacuacagccacagucagcugagagcuaccauaugagugcugggaauugaaauugaaccuggguccucuagaaaagccgucagcguucugaacagcugagccaucucuccagccccuguuugggacuugaggaaugaucacagacuaaaguuuggggccaaacugaugaccuuagauguggugucaggauacaccacuacaggaugccauguccacacauauugucacuugagauaaaauaugcccacuguagccuaugggcugacuugaggaaagccaacugcaguucuucaguuaugcuuucauacagaaguaauacuuagugccuguguacaugcgccuccauaucucucucacacaaggauacauaauuuaaaagccacucuaaggcaugcaugaagccuuaugcuugaucccuagaacuacccaaaauaaaguucagugcuugcuuccuucauucucacugaaaauuaagugauaacacaguauaaggaacuaugaugacagaaagauggcucagcaauuaaaagcacauacugcucuuguagaggacacaaguucaguuccuagucccuaagucuagcagcucauaauuacaggggaucagaugccucuggccccuuugggcaccuguacuuaagagcacauacccacacacagacacacagaacucaaaauaacuuacaaaaauauuuuuuaaagagacagacaagaucguggcuaaaacacuucaaggcuuaaugcacacuaauuuggcauccccuccagcuauaaggaagguagguaccauaccaagucuaccaguuuuuagcuuugugacuuuuucaaguuuuuuaacaucuaaaccuguuucuccauaaaauggaaugguuaacaaugccugucacauugaaacauucuccaaggagugaaaucauacuuccuacacaauguuuaauaaauguuagacuccauuauuacauucacugacuuaaggauucuaaaagacugauaaaugcccuucuauuacaccacgugauauuuaggaugaacgcuaugaaaugacaauucaucacacucucuaaccuuaaugagggcaagcaccugcaucucccuugauuuaugggugccuagcacucacuaaauggcaguuacaucuuccacuacaagcuagagcgugaagaaaaagagaagggcuaugacaagggggcagcagccuggacagagaggugaacuguugacagaggugaagguucauggcguucggagcguuucaacaccuccggcuccacgcagcucuuuccccucgacggcuucuggguagccagcaccuuggccucucugccuccugcuugccuguguccccagaaauuccucucuugggccggaagacaucuccaucccgcuacccuggucaucagauggagccgaaucgcccuuucuaaucccaggagccucuacuccagagcuggaagccucccucaccugugaggcggacaccgggucucaaugucagcagcgcccgggggccgugagcgcccauggaaagcccgaaggcagagacgcacagcuugcgacacagggauguugccacuacgccccccuggggcugcuggaccccucuccccgcugcagccggcagccggggaguccccacugccacccucaaccagcguggggaacaccacgcagccauuuuggcccggggacacugcgccugcgcagaccgucacuggcccgccucgccggucgcgucuuccg

SEQ ID NO: 12542 - RNA, 1729 nt, Mus musculus
uuuguuucuuuuaaaaaaaaacuuucauaauaaaguuuauuaccuaaacuggcuguaaaaauauaaaauaggauauucugcacagcagaaaaaugaagccagagacccuccccgaccccugguuugugcaaagauacugggaauauguaaacauggagagguaggaguggaauucagguccuggccccagacacaagcugcuacaaccaggggggacccggagggagcaccaggaggggagcacccccaccccugagaggugggaugaggucuccagccagaagugggaggcaucucacccuccacaaccacucccuccgacccaggcggggagggcucccacgugguuccagaaaaauaauaauaauuaauaauaagaaauaauaaggcgcccccacuuaaugcugcggcacagcggcagccggucagaucuggaaggggaaggaacucagguagucacggaguaccggguuaagagggaugcgcgccagguucucgcgacccacggcggccacgaugcgcuggcgacacagcuccugcagcggccgcacgcggcgcuggcgcagcggggcccccaacaugcggcgcggcgccgccacguagugcuccagcagcucgaaaaggcagucgaaggucucgcggcugccguccaaguggaagcggccggccuggaagugcacgcggaugcucguggggcccgaagccaucuucacgcugagcgcgaagaagcaguuccguuggcgacugucgcgcaccaagaaggugcccacgggcucggcacgcagccgcucgugcgccccgugcacgcucagggguccccaauagaagccgcaggcguccaggagcgcgcugguccgcgugaugcgccgguaaucggagugggagcggaaggugcggaagugagugucgccaggggcuggggcugggaccgccgggcagggccggggacgcacgggggccgcuggcgaggacgaagacgaggacgaggagggcucugaccgccgucggggcucugcugccggggagaucgcauugucggcugccaccugguugcgugcuaccauccuacucgaggggccagcuggaggggugggccauagcguccggggcugcgcugaugggggagacagaggcagugagccgggcguccggguggcacaggccggccaacagaccccaaggagcgagagcggcacgcagaauccgcccggagcuugagccucggugggcucaucugcgaaguaggccguuccuguaugcggaacccuuccagacuggcgguggagcccugccuccccgcgcgcguggagaagggggcguggagaggggcccgacucccggccguccccgcugguggcuagucgccucgcggcugccgccuacuggccacgccggggacuggaacccgggcggaggaucagggcucagggccggagaggaggggcugacggcgccccgcucgagcgaggggccuccugggggagccggggcgggggugggggggcgccagaggcguggcauccucgacccugccauacagucugcgagguuaguccugccgggcucugcucccaucaccucccauccccucccgccugcucccucgcagcugccuuggcucaccuggcggcaggacgcggggagccgcggcugggggcuccggggcggcugucgcgcaugcuccggggcugggagccgugccgcugccacggccgcaguucucucugcu

SEQ ID NO: 12543 - RNA, 2261 nt, Mus musculus
gguaaagagauuaauaggauaguuuuaaauuaaaaaucaagauaccucuaauacacauuuuuuuaaacuuuaccuuccuacaaguuugauaacauguuucuuugaguguuucucaugucuucugugucuucauuuugcagcuacuugggcuuaggaaaugugcuuuguuguagcuuuaaaguaguuacaauuuaucaauauuauauauguuuuuucuuugcaguaucuaauauucucugcuagauuguucuguaaagcuucagccaguaucucauauugaaauauuacuguucuguuacaauaaauaaauguccaaccuaaacacuuugugguuuuaguguucugggagcugccagagguggcacugucacccauacaauguugggugugaggagagcuguauaaaagagaaauuucuguaccuuacuccacugcccaccugucagagacccugaagaacugcagagggcaaagaucacagacucacagcaguccacaagccugcacuuugggcagggauuugaauuacaaacaaagcuauguauuuagacccuggaggguuuguguuuucuguacaacaggccgugcagaucagggaagggguuggaacaaccaguaucuuaguagaaaggcacauagcuuugggggggggggggguuaagcccgcaaacauuacaauuacuggcuuuuggggcugcccuuuuuauauacuaggauauuaauuuguacugguacacauuuuuaaaucuacacguugucccuagauugaggaaaguagaggcaacgaggaaucaaguuucagacucccagcucucuuccacccccucacccuucggcaaccaccuaaaaguuaggccaacuguucuccgccccaggucagccuacucugggaucacacacaugaauuagucaugcuuucccguguuccuuccgcgggcaauagagaccgcgaggaaacgcguccaucuccuuaccccgugugggcaacgcaccuggucggguggcucccaggugcuugcuuuucccuggugaagucucaguauguugugugcgggagagaaugaacauaggaagcugcagcgauuuaaaugcuucuuuauucuuacaaauacuguaaaaaugaauauaaaaagcaugcgcagucucuuccucuuaucuacaaaagucugucggaaaugucuuuucuacaaauguaccuuagcugcaaugguaauaagacguagaaaaugcuaccauuauaaaaaauaauuuaaggggaaagauuaauauagcuucucucgcaguccagugcccaagcugcagcuuccugucgcucgcaggucccaaagaaacuagcgauucgggcggcgucugcuccccgcugucggggucugagguauaggucguucagagucucaaaggcccacgccgcgcguuaccggcagucggcgccggugggcggcaggaaaggcgggcugggcaguuuuuugaagaacugccggaggccagccaggucccgggugagcugcuccacgcgcugaugcagcuucucguucucggccgacaacuccaccagcuucugcugcaucuccugguugcggcgcuuggccuugucgcggcucuugcgcacagcgauguuguugcgcucgcgccgcugccgguacuccgggcugccgcgguccggaccccucuugcccgcgcccuuuucucggacugugccgggcgcgaggcucggccccgggcugccucgaggaggcuccggcgaaguggguggagugggcugagccgcggccgccaagcucaccacugucugcgcgcacaccgccacuugcgccggcagcagggagcccggcgcgucgccgucgccccagucggguucgcgcuugagcggcccccuagcgacagaccccacacccgggggucgcguagggccgcccugcagcagcuccaggccgcccgcgccggccgcuuugugguugcuguugaagaggucggcgaagaguucgucguggcacagcucuagggugggcacggcggccauggagucaauguaggcgcugaagucgauggcgcucucgucgucguacauggcaggagucguggagcccagcucccccagauccccuggcucgggcccucggccgggcuuguccacccugccuggcucguagaaggccgcggguucugugggccagggugugccgcgcaccgggcuguccaggcugaaaagcgcggcgcucauggcggcgucggccggaccuggcguccaaguugggcuguca

SEQ ID NO: 12544 - RNA, 38852 nt, Mus musculus
uaacauaaaauagaaacaagcuuuauuucucuggaagaagcagauauccauagcuggggccacgacuuuggcaacagaggcugaugggaacacaucagauagcaacaggggaggaacaggucaaacaggaaaguacuggugccacuggggucuccuuccacauccggggccuugggcccuggucccugccagagaagauccuggcaccuuuucuguuucugagccacuucaggcuguuuauagguacaaguuccuaagaccagccaagcccacaaguucacagugaagcuacaggucacauucuguccaacacuccacacuccuacagggguucccugggaaggggccuagcccugaggagggccuguugguugcuggcucgcccugcuguguggccaacacauccuucuuguccaugucaagccuggcuuccugucagucuaaucccccagaggaaagccuggggcacacucuagccaccagcccagccuugaucuggagccagaggcaggccacacagagccugccaggcagcuuccugucuugccuucacaaggcugggaacgucccaccucuuggggcacugagggcugaaccaaggugugcagaacagcgcugggugggugagcgaggugggcaaggugaggcucccagccuccugcugccugggucucacuguccccugggagccgcaggcaguuguggguccuucgggccugaggcagggcagcucccccacccuugucccacagacagguucaagagguucuuuuagggcagaccacugcucuccagucaaccaucagcgucugaaagacaggaaauaacccaaaagcucauccaucaacaagagaacgggagcuaguuaaacagcuaaccagaaauccaaggucaccagagggaguuacugccuuuagacaucacgcaaaguauuaaaaaaauaguuuuaggcgguaauuccagaacuuucuaaaguaucuuuuuugauaaacuaugacuauugugugcuggaguaucuaaggucaggaaguuucucaggauauaaauuagggacaaccaccagcagagggcacuacagcuuaguaaagggugucgcugcuugcugagggccacacuauguuugcuucugacuagugcccaagcuugcagcacaggcuggcggacccccacccccaccccccaagggccacgcuugcuuccugagaggauccugaccucaacccugccugccucaccacuucuggguuugauaaauguuucaauuaauauuaaucuguaugcuuuauuuuguaagugugcacauacauaaacuuuuaguaaaaauguaauaagauuuucuuuggauguuucuucuuucaaaaguauuauauauaaagaaaggugugugugugggggggugagagugagcauuuguguuugaacacaggcaugcaugugccacagaaguaugcagagaucagaggaaacuuuuuuuuuuuuuuugguuuuucgagacaggguuucucuguguagcccuggcuguccuggaacucacuuuguagaccaggcuggccucgaacucagaaaucugccugccucugccucccgagugcugggauuaaaggcaugagccaccacgccuggcucagagggaacuuucuugagaccaggucuguuguuuuucugcuacuguacgccaggcuagcugcccuuaaaccugucugucuccagucucucccguaagagcagugggauuacaaaggcucaagcuaugcauccggcuuuuacauggguuguggggauucgaaaucaggcucucaugcuuguaucccauuggcugagccaccauucuucuccccagcaccaacugucacuuuaaauauaauagagguuaaaaaaaaaauuccgucuauguauguguauauauaggcuuaggaaaucaggacuaaaaugcugcucugugaagcaccugggcagcuggagaggagccagagaugccagccuccuucacccaagggcuccgguugccucucucauucaucaacucaugagaaagcccaagcgucuauaggaggguucuuucccagacaaacggccugccucuggggcccuguaccugcccucucuaccagcugaggacucccuggggacauguggccuuucagagguaaguaggcuuucccauaguaguagcagacuucuugggagacagagguggggcacagucucacucacuugugaugagcagggccacaggagcccagaaggugacagccggcuugcucuagguuccagucgaacaucucuaggaccuuguggcacuccacccguggccgaagacccagcccaaagagcugcuccaccugaggggcagaggugauguugccaugagacacacuggcgccaaggguaccagaacagaauggggcacgggacucagagccagaggguagggucagguagagcagaaccagcuuugagggccccugaaugccagggcaggcaggaagugaugguaccuucagauacugggcagcccucugaacacuccagcuguggcucugcagggccgccuggcacuccucuguggucaccccaugcaccauggccugcagcugggcacacccacccaucagcaccacucgggcccauuccucugggucccucagaccccugcccugcacccugaagagggccuggcacucaccaucuggaccuugucugcuggccgagcagccucuugcccguccccugggcagccccucuguggcagccgagccguggcccucagggaugguggccgugccccuggguugcuguuauugguggagaaguuggccuuugggucuggggcggccugaggcauaggucugacgguggcagugggggcagcaggggcuggaguacugggcgggggcaacagcgggggcacaggcagggcggccggcucuuccgggcucugggccucccgcaggaagcgcugauagcguuccagguaaggagggcgcucaggcagcagguaguaaugagugcugcugaccuuccugccaucgcggacaaugggcaggaugcaggggccugcccgugggccaggagccuggaucacuuguggaguggcauacuuagggucugaggcaaagcuuugaguggugggcauggucuuuccaggugagcuagagagccgaugcgguaguggagagcugccagguggcacuagggggcuugggguccuugaaccuugaggagacagagguucccggggaggcacucgggggggcgaggcagguccaggccaccggcuugucucuuccucacccgagggagcuggagauagcuccacacguggacgcgugggccgagggggaauagguacccgggguggcaccuggggcuugucaucaccuccuggggucggggagggggucagcuggccaguggggaccuguagcugccgcauacacuccugcugcagugccuggaaaaucucugcagucugcacugagcugggcggcuugccuccgcccugggguggaaggaacagguuauccuccagggcagggggcaucugcgccugcucagguacaaaggcguaauuggucucgccuuggcuaggcccagcagggaggccugcaccuacuagcgugcuguugauggagcagaccucaaagucauccucauccugggccacgucgucauaggcagggggcgggggcagcggacgcgcgucccagucuaccacaggggugggguguaaaggucguggcagugcccguguggggcucugugguggugucuuguccagcaaggagcaggcauccauggccaacugugccaaggagggugcacagggccgagggguugggaccacaggcuccucaccgaagucgaugagugugaccucacccccacugcugcggucugccuuggugccuggcacucgggcugagggcuuugccagccacagcccucgaggcagggcuggcuuccucaggccaagccucuugaagucgcuggacagggggucuggguccucacucacagggucguauguuggcucugugauaaaaagggggaccccaacagggagauggugucagauaugaauggggaagaggggagguaaaaguguggagaaagaaagccaagugucuccccaacuacugucaacuccccuagccaagugccccccaccccaaccgugccaugcaaggccccuccagguagcccugcugcccagagcacaccugaccuuacucaaacaggacagaaccuucucugcagaacuucaggccucagugugggcuggaaagacccgcaguucugucuaagcuagagcaggcaacacgccauguauacccgucucugaguucguugcuaacacaagaguccugcucuuugccccggugaguaaucucucucuccccacccguacugcagcacacauuuacauccccacccguacugcagcacacauuuacagcagaaacgggccaacgggagccuuccucagaggacugagcucccgauggcuaccacagcuaccaccgcaucccaaaccucgcccucugccucugcagugugaggcuggccaagggacagcagagcaggaggaagccaggcuuugagggcaaagaugagggaggaaggcaugccgggccaguccagcagcuagagcucacagcacacacccgcuuccccuugcacacagccucccgccagggcucuguaccuuccaggagaggagagagaagagagagggggugggggcaggggccaaggcauccugaacagccccacuuacucugagugaagauggcaggcugaggugggcgagguggaggcuccccuguaagaaaggccaugcggacaggggaggcagaaaagaaggauggccaagcaaggcagaggugagguggggagaucagagccagacagagggaaggguuuagauagagaaaggagggaggaagggagggagggaaggagguaaaaggugagagauggagcgagcaggagaucaaaagaaaagaagaggggaagagagagacagagauggagagaaagagggaaagagagagaaagggagagagggagggagagagagagaugaacaggagugagaaaaugcgcgacccaacggaagaugggaggaauggggaggcggacggaacaacuguguuccagaaugacaggcacgggaucugggaggggguggggcucccggcugagacggaacccgaagaggggguacagcgugacugggggcaguaaggaaagccaggaucugaagagccuggugaggagggagggaggaagaggaagcuggggcugcagaggcagggcagggccagcccaaggauccccuccucggcggcggauacagcugccucucugcucgcgccccacgcccagccggagccagggauccagcugucccaccugcugcccugacccgacuguccccagaguacaacagcaggcucaggguggccagugaauggggaacaccuaggaaggaagagaucuuacuuuucacccguccuaggugcugggugggucgggaggugcucaguuccacacucagcaggucaggaggguccaugggguuucccagguacagucuguuggggagaaccaggucaggaggugaagcagagagggaggccuuuggcagauauguaggaccaggccaccccagcacacgcgcacacacacacacacacacacacaggaccaggccaccccagcacacacacacgcacacacacgcacacgcacgcacacacacacacacacacacacacacacacaggaccaggccaccccagcacacacacacacacacgcacgcacacgcgcacacacacacacacacacacacacacacacacacacacacacaccccuccugauuguccaggggauaauacaaagauacaaagacuaagacauaucugagaggaagcugaguggcagacugagucacgaggcucccagaguccugggucuaucuacauagaguagauccuagucucuacaccagaugugccuaucaaggagaaagccccugggaagccucugccucggagggcuccaguaccuuacaaggacaaagcuggucccggauaacugacaacccaugccaggugucuaccugcuggcacacucuucugcagacccuccgggagacuggacaucugcuguuagccccuaggagggugggcaggaggcagcuuccugcugagcugggcagugagcucccgccucaccccagcuccugugcuaucugggaucuggggcuuagucaccaaggcugauuaaagccuggaagaaugaggcugggccggcucaggcacagcaaaagugggagagagggugcaggccucuagcuguaagggccccccucuccucccuucccccuuaccugguuccugugaggcaggggccugauguucuaggauaugggacaagggaaaacaaaggccuguuuuaccauacucucaggaggaggcagcuggagaaagggccacugagcauggagggcuagcagaagagcugacagaggcuaacuaggauggacagaguaccaagaagagccugacucuguauuguccccagaugacucucagugauccuccuuuaccaaaaggagaccaggaaucccuccagaccugcucccagcucugggaaguaagcucacuccugccuggaccugucuacacaacacgagagcugaccucauagguucagggcccuaaacucuggaaaccccugaaggagaugcagguaucaagugucuucccgugugccaaaauggggagccuccucuguuggggugacacgggccauuuuaacaaaucagaaugaguucauuuccgggguuuccuccccugccccauagaugugcagagcuauacuggggagaauaugaugacaagcaagggcccagcaaggaccgcccuggccuccccaccccagcgcauccuuaggacucagccaguuugggccucucuggcaccuacaccuugucccaacccgccuccauuccccacuccugucuaguaggugagcuucuggagcaaagcagcugagacaagacucaugcagagccgagagcgaggcagacagaucucugcuugcaccugcacaucaccccugaggugaaagccaccgcacacugugagggagcuggucacaaugaaaagagugaggacacgccacaccaaaggaaggauccugaggacaaaugagaagcccaggggugggaaaaguucccaucugugccuguuacuggcacccugucaugagagaaaggcagcuaaugacaggaagaacugugugcaugcgcggggcuggaggaccagugucggcaauaggcuugggucaggagaccagagcguguguaagcuucaagauguacuaugggaacaccuucugcagguguccauagucaaggggcaaaggcugucucacugacuaccagauucccacucuaggaaaaacugggauccagaguuuccacaaugaaccccacuugguggaaaagccaacaagauaaggcuuuaacuguuccuggcacucugacuugggaaaugacuuggggauggccucuggcagcuccuggggcugucugcuuugagagcacuuuaauucagagcauacuuccagccuucacccaucaguaacagacagcccaaucuuuggagccuccauacgagaucuugugugcgguaugguaaggggcuacaaacaaaucccaggagcccaggacuaggucgucggcucucuagauacucacucaucgauccugucagggaacccccagcaguggcgggggucacugucaccauguccugugugaaugaagcuauucuguagaggcuggcugauguccugggcugacaggccagccacggaggucacgacauuucgagggaaggguccuacacacaggguccgcguauucugcccacgccaccaguaguucucagcccugugugacagagauagugugguaaauaccggguauagggggugaaagugaccccagacaaagggacccuucucauaccaaggucccugcucauggaaccuaacuaccuuggcaggcgaagcacuggagauaagagcucaagacaagucuagccaccagcccauucuccccaacagcaacaccauaacccgccacucccugaagagggccuggcuauuugcucagccuuagccuaagcuccucuggguaggucgguagcuuucccuacagucuacaaauaaggaaacgggacaugacagguacauuuaccagaacgaucgaucgcagcagagccaguacucagaccaauuuaagccuguaaaaccagcaugguccacaaugcaccuauucccuuccuccagccaaugccuggcccuggucuccuuagggccacuagauucacuccuuggcaggguucuaggaauuuuaagugauacaaguagccaaagggaucccgugaguuuaggacccaugccuuccaguuucuucucgggccucgaaugaacauguucaacauacagaacacauggaaaccugggccuuuucuuccugggacuuugcaccccaugagggcagagcuguggggacccaggccugccauccuccccaucuucucaggauagggccuacucuugccuuacaauauggaguccagaagggaaagucagaauuccugguauggugaaccgugaagaucucaguccacacugcagacaaaccaugagcaaaccuggacccgacccaaugugagcccgagcugaggcccacacagcaagugagcaagugggaaagaauacagccuucucuggauacuccacaugccccgaagcugacuguggaggccccugcaucugcugcucggacaugacgacucgggcagacgcugggcuaaggcaccagcugaaguaaccaugccgcaggguuacaagcacagcaccacugccugucuccucaccuucacaucaccugucugucccagagccagagggccucccgggaaacacggccacagcagaggagcuggggaggggcuggggacugccacagcugccuucuggucacuaaggcugccugcuggcccaccacaaacacagucacccugucauuacucccugccuuuaggguaggaagggccgggaaggaaggaaggaaggaaggagaaaggacaacacccugagaaagaaaaguccucucugaaaauagcagauccauuccaaggagagaaagggaccguagcccacaaucagggcggcccgugagacgcacagaacaguacgcccgccccacacccuggcuucuccuccacaaggcagccccacacuucccggggcacuaggccagacucaacucugcccaucucugaggugcagccgagguaaagauguuaccugaacauucuguucagagcauacagcccuaccuugucccuucgagggcacagacucaaugccuuccaccccuccuaccacaggaaguggaggcugcaggccaggccaggccaagaaccugccaauggauuucaaaaccucugccucuucucaauaccacucugaaaaaucacacaaaggaguuguuagccaccuugcgcuccccaugagacccucaggagaggcuagccaucccuuuaucuucaaggcuguuuucacuguuuaguaguguuuguuuuuguggacucggucucucuaugugauccuaacuguccuggaauucauuuuguauaucaggcuggcuucaaacucauagaaauccuccuguuucugccuccccagugcuggaauuaaaggcaugugccaccaugcucuuggcauaccucucggucuagacagaccccccuaguucauggaaaaccuguguccucuaucugccccaaacccugagacugagcuuacagacggagcuuacagagucuaaaacuacagagucagagaguugggaccaggaaacacacuaaagacaguuucagaaaagagaaauacaaggccgagagacaagagauacggaagucaggagccagaggaagagagagucacacagacagaccuaauccaacaagacacucaacgcccaugcaccuggagacauggagacgaggcaggcaaaccaacagcaauccgggggugagaggggagaauguuccaggaaccagaggcacacaggcccacuccuaagagcucagaggcugcuggggcucaugucucucaccucccaccuccugagcaguucuagggaccgaguaaaagcuggcaccucagaagaaggcagucuagaaguugacccauccgcuguggcaguauuagcagcugaagccagcaggagccuggggcggaagggcaagacagggugcacccaggacaaccucccagaagagccacucccccggccccuccuacagcuggcugugcucucagugacccagggcacuacuagagacacacaggaagcuccugaguugccccgagggaacauaggcuccaaacggagcaggaaauaggacugguagagacuuggggccagaggagcacaggacagagguggauccgggccuuucuggcuccaguauguagggauggccacaggccaacuucuggcuuuaaguagucucugcuagguaccgccaaggagggcucccacccagccccauucuucuaucuuaggcuguucccagauuacuauguccugcaccccucccuuccccucagguccagacccacauguggcuccuuccugcuuccaugucuuaccuaacaauucucuccuuucuaucuccaccaacucucauucucuguaaccugcuagaacaucauucuuguuccaagaauggaacaugagcccaacaugagagcgagcccuggccugcggcaaugaacaggggccacaauggguucagguaaauucaagacaaccagagcccguuccacugacucaggcugagacucaccccacucacuaaccccaguaaggcgcccuacaggcauccugacccaguucugagucaggagggaguacagggaauccccuucugcaucacuuucuuccugguccuccacacucacccagugccaaaacccaggccccagacaguuccucagacacucuggggaucagaugacuggaggaagggccagcagaggguggggugcucggucuagaaacaugggggugcagauaggaaguugguucaagggaggcugccgggaauggagagucucaguggucggacacacagcaguccucaccaggaaggguugggagaaggguggggcgggagggcggggcgguggauggagggggcccaugacuaggacaccccaggaggcucacaggagggaugggaaguugcugaaaggaugaggcagagcagggcaaggggaccuggggucugaaaggcaccagaagaaauggucagacuccuaugugugggcacggcagcucacacuuacaaccccaguaccugagagaucgaggcaggaggaugaggaguuuaaggccagccugagcuauauaagaccuucucucaagaaacugggguggggguguugggggacaccagaggaggagaacgagaaacacccagcaauucuagucuggccuccaauucugaggccaagcugggccgcagccuaaucuucagcacaagggcuuuuggacccuaauacacacacagccagggcugggccccagugggaaagggcaguggggcugagguuagacagggaaaaucccacugaagcagcucucagcaguguggggccugucaccucugacacugcccacuccugccugccugcugccaugggagccucuccaucugugcccucuacggagucucagugcagcccacagcccuaccuucccucgaugacagugaugacgucauucaucuggaugugcaguuuaucuggcuccucaaaguccugaagagcccgcaugucagugggcugagccugggggcagaaacaggucacugcucagcccaggacaaagccucggaccgccacaccugcuugcacuccccugagacugggcagaucugccccucaccuccagcaggaagucccgaagagccacaaaugugggucuguccucuggcuugugggcccagcacuggaccaugacauuguagaugucuugagggcaguccuccggccggggcaggcgcuccccuuccuugucgaucuuaugcaggaucugccagccaggguggggcagggguuagaggcagcagagcaccugccucuucgcuuccugcuuucccucugaccuguccuacagcugaagauaccaucugacauggccacccacccugggaaagcucuguccccacagccugagaccugcccaggacucaugucucaucccuguccuccuacccccgugccuguccugggacauucugggcuaccccuucucuuuuguuaagcucucagagaucccacaccaauaucgggugugcaagaaaugggaaucuaccagaaaagaacuaguugcaacuguucagguuggggaccagggacggaucacucccaccugcccuaugggaaccauaccccuuacccugccucaccuggcugccauugaggccaauccagggcuccuggccauaggugaacaucucccacagugugaccccaaacauccaggugucacuggcaugggagaaaguccgugucuucaggcucucaggggcacaccuggcaaaaaaaaaaaaaaaaaaaaaaaaaaaaaaacaaaggucaaagggacggcuucuuugggaccucuccuugccaccccuuuagcugccucuggcacuaggagacuccacgaucucagcaaaggaucugcccagcaaggacccaaggcaggcuaagcagcaacguggaggucacuaguuagucacugccuacaagauacggugcaaucuauucccgccugccgccagcucuacacagauaagccuacugaccauccuggccuggcugcuugccauauguuuuaaacuuaacagcaaguccuccaggaagccuuuuaaucccccaccaaguacaugcccuuuagauugcuugugccuuccaguauuccuggagaauuccuuggguggaugugcaaacauguaagucuucaagaaaggcacccaggcccagaaaugagaaggacaggccgaggcagacaguccugugguagguaacagaggccccagaaguuggagguguggaucugcugagacuggaguggagcuugggcccuacaagccagcaacacuugccccucaccaggcaaagggcaccuugcgguguucuugcaugacauaguggucaucauucuggggcagagcucgcaucaguccgaaguccccaaucuugaccaggucccggguagccaaaagcagguuucgagcagccagaucccggugaaugaagcgcuuggacuccagguaggccauacccucagccaccugcacagcguagcgacucagcguccccaagaggaaaugaccuugguguuuacguaggcgguccaacaaagaucccagaggugccagcucugucaccugaggccacacagaagacagacaggauaaauccgguagaucgaugccacucucucaaaggcaaaguucccagucucuuucuggaggucgaccauagcuccaaugaacgaacuccauguucguuucugaccugucccuucagucacccccaagaaucuaaaccccagaauaaagcauuccaaagaggcccaggcuaaaaacuccaaagauaacucaugucaagggccagccauuccuaugggcacaucuugccagugagcaguagaaaauccagagaugacagcacuaggcaguacccugguaaaccccuuugccacuuguggcgggaaacuggagcaggcaggaggaagagugcgucugggagcccagacugcagguagcccucuggccuucccucccacccagccacucaccaucuucauggguagugugagcaccacaccauacaagcgaaugagguuucgguggucuagugaaugcauggcauugaccucccggaugaagucguccauggccucuggcuggcucagcacgucaggcuucaggcacuugacggccacacucaccugcccagugcaggauuagcagggcguuagaccuucaugguucccaacacugagcuaacugcaccuuccaacucagaguaaagccccuugcgucagaccuguucaucugagugcacaagcaugccaucaguuuauauccuacauccucugcacugcaagaggguggcagcugacugaccucuaaaggucacuaaaugugggccucuucuuucugggcaaauucccaaauuagcagugacaauaaauuaagagaugagcaauauaaagacagaacaauaauauaguugaacuauaaugccauaaucuauggaugccccccaccuuggaaaaaggggugcugaguggccagggcuugacaaauccugcugggugcuagcaauauuaauauacugucugggaagugcaucuggcccuauauauuuacaauaaucuguauccccccacaccccauacguguauguuugugugugguuauccacuagggaguuuuaauuaagagaaaaaaggcuaugacuuaaauauguaaaucuaauuucuaucuuagugaugagacauagcucaguggcacagcacuugcuucaaagcugauccaagaccaugaaggaaggaaaggauaaagggacagaaaauacuuugucacugcagguucaaagccacccuggucuacccaagaugcugucucacaacaaaucccugcagggguugggguggcaggagggggcgcugcagcccugccucagccgggcagugggagcugcaggccuuugccuuucauuuuuccguguccaaucuuucauaguaagcaaacuaucuuuagacuugaaaaaaagaaaucacugugcucaguuaaaccugaacauggcucaaaaggugaguacuuucacaacugucccuagucacuugucgccugacagaaggggagaggugcccaccccagagcucaccgucuucccugcgggggcgucccauucaccccugcgcaccacgccaaaggagccaucccccagcuucuccagcaggcguaggucuuucuccccaaugaggcaggugaggcucugcaggguccccuccccuggcaggcucccuggggugggggagggcuuccggaaggugcucugagagugcugggaagggaacucggccuccaaccgcuuuccacugaacaccuguuugaaagcagccagaagccagauggaacccagggccccagaggcacucagucccacccuacugguaagccucagacagcuccuggcuuugccaagcugccaggggcagccuguuaaaggcacacacuucuagcguacacccuaacggggaacccacagcugaagccucaggguagucgucaaaaacagaugaagaugcugcuuguggaugaaguuaaccccaaaacggucugugaagacagagauagcccaaagcccuccagguacacccccaagccccagcccuggcagcccuggccuucagcuccuccccaucuuacccuucccuuccugaaccuccuaaacggcacagccucuugccccuagcauacaaagagaggguaggagcccgaggggcccuccaaacaccucccuguccauuuuuagcccuggccccuucucuggguuaaccauuuggcacugucugucucuauccucccuggggagucggcugcccuucauccugcccaggggagaagauaauuuuagucugagguugacccaugaguauguguuauguguguguauguagugcaaaugaagccagucuuugcuggagaagggccuggaaagacagcuggauuucuggaggggcgccuagagccaagggcugagaaggaaggaagacuagaggggucuccaaggccuguuuuggagaaagaagggccaaaggucaagagacaggaagaggggggcuaugaaggaacucaccuggccaugcaaucugacuuggccccuccacugggcaucuaaagcucuagugccaggcuacagacucuucucguugcccucagagcuggccaaccuuacccgugugugcugagugauagguucuuucuccccagcuggugaagugagccaacucaagccacauuagaguggucauggggaaaguggggguaugggcggaaaagagaaagaaagagagggugugcacagagagaagaaaggggcgggagggagagaaggagauagacagacagacagaaagagucagagagagauggaaaugucuggguuacuagggaagagccucugggagaagggcagccccugggcuggaaaguucugaguugggggugggggguggggcgggcagaguaugccagguagggacugagggaugcugggagacccuggaggccaggucugcuuugguauguaaaauaugccccucagccccuugucccgaaaucaaacacuaagggcagcucaaaucugaggaccuguuuggacuuuguccccuccucccaguauuuuccuaauauuugccaauaaguucaauuuacaagaucuacuuucgccacugcagccacgaggcccuuugcacaguccuacaugguaagcuggguaauggagccaaugcugguuuaccaaagacaugacaauuuuagaaaggaccacugaucacccagagaccuacuaugaacugggguaagauccaaaauucccacacugcuuuucucuauugucaauaggucgccacacauucauccucugcaaaaaccugggcgauggaccaggacuguguccccagaaaaggccacaggcucucaagagacagccccuuugccagacugcagccagaaaauuucuacugcccaaucccaguccagcuguucugcccugcucaccccucaccccaguucugaggccagaaguagagagagaggcccuggcuggcucacuuccucucucauugucuuccagacaaugggcaaaguuccacugagucagaucagggacucacaacacuaaagacccaacuuaggggguggggaggagcuguggggaaggaagcugucagcagagccagaugaccacaggaaccugaagagcggagagcacagggaaguguuggggggcagacagaacaaggcaaagauguccagacaguccccucuaccccuuucuggacacuggccugacacucaaaggaaggaacacuuaucaacaagucccagcuccggcacccagagaggcugugaaacccuuacugcacacaggccguucaccggucugucuguggcggagacagacacuuagccaggcagcaccacaaguguccugucagauaagagcuuggaggaggaaagucuguacaaagugugaggcaaucggugagauuauaccucugggcagcaggagaaggcuccugagccugccagcagcgggaggcccuugggugccccaccacccccucacacccuucucacacacaccuugcucauccaugacuugcguuugcacauggccuuccuccucuucacggccucccacagccgccucuggccugcaagcagggaaagugaacgaggucugucagacagcucucacacccucccaacgaggcugcuauccaccuaacugacuuccucaguuccugggacaccacucaacccaaugccaccaacgggaucaguugccaacuaggaauuucauucacccaaucucuacacucuaccucuggcuggagguguuuacucaucaaagcagaaugagaaguggccaguuaccucgccaacucuccagacaacucagguaaggagauacacacauacaccugucuccauucuaagguuuccuucccuuaaaauauucuuacacuacugacaucagacgcugugcuggcuaguuuuaugcuaauaugacacaagcuagaucagagaagaaggaaccucaguugagaaaacgccuccauaggcuguucacacaccugcagggcauugucuuaacuagugacugaugggggagggcccagcucauuguccgcggugccaucccugggcugguggcccuggauucagcaaagcaucagccagccaguaagcagcgcccuccauggcuucugcauuugucccugccucuagguuccuguccuauugagagcuccuguccugacuuccuucaagaacagugaugugaaaguauaaacuaaauaaauccuuuccuuagcaagcggcuuugcucauggugucacacagcugcggugucccuaacuagggcagaaaucaacuaucuaagcaaaagcagcacacguuacugucuuuuucuuuuuuagcuuguaaaacauuuggcuauuuugaguuggacacacuaaaguuucugauuguggguuguuguuguuguuguugagauagucuacuguagccuggccuggaugaccuugagcuacugauccuucagccuccaccucuugagauguuuguguuuuggugcugggaauuaaacccagaacuucacggacguuaaauaaacaauaucuuuuagcaagagaggucuagccacaacccaugauaaauuucucauuucuagaugguaacugcuaguuuuaguuuagaaagaagggaaaguuuaaaguaacaacauguucuuuaaaagauuuuuuuuuuauuuuuauguauuuuguguguguuccuuauguguaagggugcccauagggaccagaagaggugucagaucuguggagcuacuggcaguuacaagcuaccugaugugggaacgaaacugguguccucuauaagugaacaguacacgcuuuuaaccacugagccaucccucuagccccaucugaggguuuuuugucuucucuucucauguggaucugcuggcauuaaccccacugguguucagaaugaaacagaagagacacaggaaauacaucuacaaauaucugaucaaacaccaauggggaaggacuagagagcagaccugguagcacagggaggcugagccaggaggaggcuaaguccauggucugccagagcaauaaaagguucaaggcuacccuggguaacuuacugacauucugcccccaaaccacaaagugcagaaaggacgggccagagcuaaaguaguggagcccuugccuagcacgugaaagguccuagggauaauuccuaguaucucuuuaaaaagggguggaggcagggaggccuggggugugcucacuggcagagcacccagguggcacaagugaggcccuaaauucaguacccagcaccuugggagaaagccaaaaaagguauauccgacuaacucugagugaccacagcucuaagacucuguucucuucaacuuccaacucacauuuacauucaacugcaaacuguucccugggcacccugugaacagcacucuccaccugccucccacucacagccaccaccaugaugaagagauucuucuugugcugggccaugaugaauacaaacgagguaaaugaucagaagagaaagcaaggccugugggcuaccuaccaggccggcccaugccaaucuuuuccaggucuucauuuuugacauauucaaaaugagauaggcggguaauguugaggucaucucgaagccucaggaaauacuguuguagcugcaccucggacagcagcuccaacagccagcccguucccuccuccggcugcaugcugcugcuccccagccucuguagaaacgaaagaauagcugagcagccaagggaugugagcagauggcaggcuugcccaucugugcccuuggcucacccgcauccuacagcauucaaagcaccuucuugcuaccuaaaacagcugagcuggagcagcuaaacugagcccagaccaggugacccucuccugaacacagcacucucucaacacagaugcaguaagaacaggcacacaggcacacaccacccaggcccagcaugagccuccugcucccgcaauuuccaguguccugucaacaccgugccaggagcucagaguuucccaggcagcucagugcagcacaaagaguuacaaugagaaugauaaacccuugguucaaacccuggcucuucaaugaaggacugugaggcaggcagcugggcugacagguguuagcuguagcccuuuauuugaauggcucuccuaaggacugugcaaccauccagagaggggguauguuugcuugucauggugcauguguauggaggcggggcuagugacaguuagcagguggacagagcugaacauacaaauuccacacaacuuaguucaugccaguaaaaacuguuagaaugaucagaauccggagucuuagaucccauuuuacauuuaaacaagaaaauacuuuuguaguuucaacgggacuggauuuuccucuaacuguguaaaauguuuaccauguaaccugaggaaaagucuacguuauuuggagcauggcaaaaguucgcuaucuggaugaaagacguuagugaagaaagugccauuauuaugcugaaacucccucaguggcucugcugaggucugagagucccugcucuuuccuacugcaaccaguaaacgcuucacacgacuucccuccuauccuccaauauuauuaguuaacaccauguuuauugacucuauauauacuuaguacguaacauucugugaagggcaacaaaaauaauauauuaauacuucaaaacuauaguuauggggcuagagagauggcucagaggucaagaccacucuuccagaagacccagauccaauucacagcaccuacauggcagcucaaagucaccugggguuccaggggaucugacucccucgucuggcuucuucaggaacuguacacggugugcaaagacauacaugcaggcaacacccauauacauaaaauaauaaaauaaaaucgaaaaacuauaguuacuaugccaggucuaaccauuagcuguaccgacucucuuauccucaacaaaaccaucuguuugcaaacagagaauaucaagcgccacugcccacaggugugcagugagaagccaugggccaggcuccaccauccacugccucggcugcggagcaaagagaacccacuggcuauguagcagggcuaccagaugaggggcuccugacccccaugaggacaagcagccggcaggcuucccucccuucccaccuccucaagcccugggcuccaggcuccccauuccugugacaggucagagucuuauccuggacagggagggcucagugaaacccagaggcccuucuccugaagcuacuuagaaaacauagcacagcccguuccccuccccugaccaaccagcuaagaaaccucucagcucagcucccuucccugcuccucagcccagaaacagggcugaugggggggggggugaagcccaggaaggacacagggacccuggugaagaaagaggagucgggugggguucuagucccguuccuacugcuaaggcuggagugacuccccccuaagccucccccccagccccagucucuuugucugugaggcacaggcacuagagcagugaccucuagcucgggcagccuccaauucuguguguguggcccacagccugguguggaaucuacaccagcugugugugacacacggggcucaauggccugcauguaagcacacacuagacugaccacccagacccuaauacacacacacacacacacacacacacacacggaugaaugcagcugacagaaaggaaaagcacuccaacccacagaccucaggaaggugucccucaguccugccuacuucuugucccucuguacagugcugcuacugaggggcuaacccuguccagagccaauccauuucccgcccccgggcccccacucacuguguacagccgucgccgcagucuggccaggagagggaaggagagcucaaggccaggaaacccacgggcugccggcaucuccacgacugaagccccuaagucacgggggcuauggccuagcucggaagugggcaggcaagggccccagcuucugaguuuuaugcucugcccagagggugggggugggggggaaccuguccuagaaaucccccagaucccacacagaagaaggaaacauggaagaauggagugguggcuuugcuccccugcaagcccggcuggguuuccacagcuggucgcaggcuggguccucuguccugucuccagugcagugcucacaguucugguccuacucccaggcuucccccaccgccugcuugcccgccuguccuccuucccucccuccccagcugagcggcucugacacuggcugaaaaaagaccuuucugaaucucagccaagaggacagcaggaaugggggggcagggaugggggggcacucuucuucccagcacuggucccucugacucccccuacacaaggcucccugucucccucguaggugcagagaaccccugggaucucaguguggcugugaaucaaacagcacauauaaaagggggcuacaagcccccuaaaggcuuuucugggucuaugggagucuuucccagauucuguagacagaucccucagagacccucccccacacacaucccaaccuuggcuggaugucuccuggcucagacgcuaauguggcccuguuacccuggugcccgacggaaauaggaggcaggcagccugccagagugggacaauccagccaagagcuuggggggaggaugaugagaaucuccaccccuccccugggauugccuuguguaaugcccacgacaaccagggugcuuacuccccagauuagcuggcaaagauccaaaacucccucuaaauaaacaaacauguccuaagcccucuacugggauaguucuaccucaaagcuauaggaaucaggcuguuggauauguaucuuguacagcacccaaaacacacaacagccucagcuuaagggaucuggaggcacuccgucaagcuccugugugcccccauauucuuacagcugacaaauggucccuaugccccucacaagugccagcugcucuacacccucuuguuacagcucacacauacaccugacagcugcaggaaguucuuuucugcuccccaggucccagcuccccacacccagccaugccuaaggagccccuguuucuuguauacugcuuucuugucuguccccauccagcuggcugccagcucagggagacacagcuggcucacgagggaggcagcugagguugaaaguuuuggggagucagcaucccagacucuuauuuccaggaucucuuccagaguuugaacucucuacuuggaaagacaaccauuuccuauucuaauugggggagggggccucccagcaauagcccuuccccacugacauuauucauacaaagaguguggauugucaaguacagccucucuucaaggcucagcaaauaaugagugugaggacugaggucagacucaggauuauggacacugucuuucuucacagguuagcugaccacacccucaagcuggagaagacuacagccuauccaucagaccuaggagccuggaguuaucaguaaauuaaucagguuuauuaccucuacugcaaguugaggcugauuagguuggccaauuuaaaaacucuaggcaccccaaaaaugcaugccucaaauccaccaagaaccccaugucugaacucucagacaucuaaauaaaacgaccuggcagcuuaccccaaagcaggcaacaguuccugggccucuuucuccccagggaaaacagccuugaccuuucugccucucaauucccaggcacauucccccuucuccugacagcuacugcccucuggaggcuaggaaagaaagugcuggaucuccaagggaaaggaagcagcccugugaauacgguuccuuuuucgaaagcacacggggauguuuacauugauacacauacucaacggccaguuaaugugccucccuaaggcacagcuucuuuccacagaagagugagucugcauacuaguuguguguccuaggcuccuaaacugcaccgccgaaagccuaaagggcggcuuauuugggccccuagggauccaugcuuacugagucagauaccagcaucaauaauucaccaccaccaucaccucagacauauucaacacacacacacacacacacacacacacacacacacacacacacacacacaccacucugcacccagccuccuggccccagagaucuagggauugggagugggccggggaggaaaaaaagcgcaggcacccuggacucuucagaagcuccugcugcagagagcagagcugggcccacggaucaccagcagaugacgaggccggagccccacguaucucgcuauccccauuaccugcugucccuccucgccccuagccaggcgcugguaagcagaucucucccccauugggcccgaagucccaccacuggggcagggaggaaagcgaugcugcccguagcccccgccccuccacccgcaccggcggcagcagcagcacccgcagcgucacugcccuacguccgggaggugggggggggggggggcgggccucgagcaucuuucaggaggggaggggcugcuaaagcgccuaggcuggaaaggcuccaauccuggcaccugcaugaauucuaaagacucagguccacagccagcagauuaucagucuccccucugguugaauuuacaggcauucccuccccaccucagcccccucccuagcuucuauucuccucaguguagggguguccuucaggcaccuaaccugcaagccgugccagccgcgacccuuaggaagccagagcgaggcuccacccacucuaauuucagaaccacugcuucucugaaccccaggucgccuccaggaccaccagcauccaaacacguugaugcucaacaauacaauaugaggguuaacuaagaaaccacagacacucaucuccuacuucaccgagcccauccgaccaauccuggggacucaaacaucuuccuccauuacccucagcacccaccuacucaacgccaagaacacuuggcgccaaccuggugggcaagccuacaaguucuaacugguagcucccuaacccacuccucauggaagccaccccccacccccacccccaccgccaugccaacccucacgggcaggaugacagacccagcccagccuagcccauugcccucaucuauccagaccuggaccuuuccucucaaaacagcauugagccugggacugagagagcucggccaaccucagaacuggagagccuagacugcuggagaggucacuucaacacaugcugggaaagauugcaucagugaguccuggggugagguuacggccagucagcaagugccauugcagaggcuuuucucucccgccaacccucagggcccuaagguaacauguguguguguguguugugugugugcgcgcgcaccccaugcaccuucucauuccuauggcaucugaggcauccucugacuccuuccaacuaguauuuagagcucagcugagcucuaagcacucccccuuccugggacagggcagagaaaaaaaaugucuagaaacuccugccauuaucccaaggcaaaggacaggguuucugggaggguacugaguucccagcaggcuuccucuucacaccgcccaucucggagccacuguggcagggagagggcucugccagguccuggguucuaaucuguacggaagccuugguaucucgccauggcgaugacagacauuagucuucagaacagcuacaaggauccaaggcuggcggguugaugcgagagcaggcugagugugacucgcccauccuguuuugcccuggcgggcugaacgaagguucaaaaccauucccccucccugcuuucuccagcucaccuccaacacuauacugccaugaaauccacagaacccaaacugccucugaggucuggggacccaguccacacaagcaccugcacugugcgucaaucucuccucuaucucuccauaccauguagcuaaaaggcgccagcccaccuugcucucucucuccaacagcaacagcgaagucacaaauucccacagagaaguagaugugacaagccacuuccagccaagacgauuuuuuccccuccaaaacaaccuaccauauucuuaggaauauauggcaaccuaacaagcaagcuucccuccucugguaaccacaggaggaauaacaucucggcaaagaaguggaggucacagcuccuccccaagcuacaacacgggauuauccaccucucauaugcaccccaccacgucggcccgcuccacucaccucuauguaugcagggcccaggcuucugaaugaaggccaggcugguuccccucaagaccucaucccagagggaacuguaccaagcaaccccacaccuucaggucagcguguuaugacaucacuggucugagaaggcagcuggccagaggccaaggaagagaagggagugauucagucgcacaccagggcugcccacacccucucccucuucaagacaaggggcccacucacucccaaggaggcugagguccuguggcugggccaggcugagcuguuuucccuagggauaccgggcccacagacuaaggucacccugaaaccucgucaccaucauccuuguauuuuuuuaaaaaaauauuuuacuggaaaucuaauuaaggaaaucauacuuagagaacuagagaaccuuuuaaagcacacacggugguauuuuccgaacguuaggcugguuugucuuuacaauuacgacacacuuuccugagcaccacucacucuuugagcugcuguacgucuuugauuucugucauugcauugucauuuuuuuuauaacccacggaauccaaugcugcccaagugcucaagggucugaggccauccacuggaacaagagcuacuuacccguggccacaccccaaaggaaaauggcacucccuuaccuaccaacagcaauuucuaaagacuucagaccacacccuucccuccacucacaaagaaugauuaacccccugggguuccgcuuccucacucuuagguccucaacugccacccuacuguccccacuccuaggucaaaauuuacagagcaguccccgcaggaugcagcacugguuaacuuaaucugcacagcccaaccuagagugccacccgcccgcccgucaccuccugcuugggaugccacacuauuccugauugguagcuacuccaauaccugcucagcauccuggggcaaacacacacaccaaccaccccaggucaccacccagucaccacuuuaaccucuucagcacuccucccaccuacccuggaaaggucuuugugauaccuguguccuagccuucaagaugaauuccuauauaucuuuaagacacuaaucaaaugcuaucauuucucuaagcucccacuucuauccucgaacaguugcuuccaccaacaccccuggguuguuaaaggaaugcauauaaauaaaagaagaaaaacuuaaaacuugcauggaagagccaaaaguauuuuuagaaauuauucaucucggggcuggaaagauggcucagugguuaaaaguacuggcugcucuuccaaaagacgaagguucaauuccuagcacuuacaugagcuuacuuacaacagugucuagaacuccagucccagggauuaucacucccucuuucgggcucugugggcacugcacugguguggugcauugugcauagacagacauucaagugaaaacgcccauaacacauaaauaaauuuaaaaaauaguauauuccaguccuuaaagaguuauuauuuguguaacucuuuggguaauugcauaauucuauugugauaaccauuagcacagaauucuaaugugguuggugccuuguaaauagccagaauccagcaagagauauauauaauaaagagagcuuagaaggacuucagccuuugugacagacagcguagguacagcguagacagaaagguagccuccuuccccaggagcugcugccacuuggcugcccaguggacaccaggaacaagucagaucaucuucccccuaccaugacgcagcccuugcuggccucaaacucugacugucuugacuuuccaaauacugagauuaaaaguguguaccaccaggcccuguugcuccucacuauuuucaauccaaagaagacaauuccuuuauggaaagaggggcugucaaucauuucaauuacuuucgcccuacccaaggacaacacaggcagaguguaaaacagcuuucuuucuuucuuuuuuuuuuuuuuuuuuuugagacaggguuucuccguauaguccuggcuguccuggaacucacuuuguagaccaggcuggccucgaacucagagauccgccugucucugccucccaagugcugggauuaaaggccugcgccaccaccgcccggcauaaaacagcuuucuuacuggacuacagggaaccagauuugggcucagacugccacaugggucgaccagauggacgccuguaucuaugaggcaucccagacuuccugaggaacuggggaagggagaauagagugccaggggaagagugggguacagaagcaggaauagaagcgucauaagaauggaagccuuuucacggugaauccccuucaacuucagaggggagauucugccuccucagccugcacuaagcacccacaugauggucucgaugggaccaugaaguuguuuugugcuccuccagcuaaagagaagcacacugagauccacagcauccuaucaugguccuguaucucugucuuccuccuaucaacaccccagcaaugugugaccaaggccaaauguccguagcugucuagcccaugugugacacaaacuuuuacaccagggcuuggauaucaacuugcagaucucucacccacugcccugcccagggcacccucauagcaccaaaacccaucacuggcuccaggagaaagggugugugugugugugugugugugugugagaaagggugugugugugugugugugugugugugugagaaaggauguguguguguguguguguguguguguggagaggagggggaagaggagaaugcagccggccacugccagagcucuuccagggcaggguagagccacccagcuggccacccugccuacuucugacucuagcuuugcccacccccacuccuucagcaagagccuggagcugaaguggccuauuguugagcccuggccgaggggugaggaaaggagcaauagcaaagaugcaccagagcugugcagcgugcacugcccacacccuuccgaccaaagccccagcaacuaguacacaggcaccacugcaggcuugaggccccaggagagucugggaauaguaaaagugucagugaaugucaaaucccacgugaggugagguguugggagagaaagcuaaaaaugcucaaauucaagaguauggcuaguuaacuuuaagaacuaacuaucuucccaaacuccaagugacgggcccucuacuacccugcagaggcccuucugucugcauagagaaacacacuaagucucugcacaguaucccaggaggcucuacugacgacagggagaucacacaguaaaugccaagaucacagcucccuucucuuccugcuccagaaaccugggggcucccugcuggcaagacaagggaugucuggacuccaagcaagccaagaaagauauagacacucaaauuagaggcuuccaauaaauggccuauucaagucaccacagaaaacggucaacaauccacccagcaccacacagccucacaagcgucuuccuugauuagaagcgaaaacaaaaauuaucaaauaccaaauaaagccucuaacuugggagagcaaaaaagcaacugaggagggggaaaaaacaggcucuggagaagaaaauuucagacagaaaauucucaguaauaugcucgaacugauaaaauguauccacaaaauaagaacaagggccguuuuuuguguuuaaaccaaggaaacaaaguaucaaaaacugggcuaucgagaaggcucagcccuuacgguucaugccugcccuccaagccugccaccuaagguuagauccugaguuugauccccaggaaacacaguggaagaagaguaccaacuuucacaagcuaucuucuaauggccacacaugggccaucacagcaugcauguacuguuuuaagaucaccgguaagaaagcagacuaggcuagggagauggcugcaaaagugcaagaaccugaaucuguauaaaguguaugaaucugcccggcagugguggcgcacaccuuugaucccagcacuugggaggcagaggcaggcggauuucugaguuggaggccagccuggucuacaaagugaguuccaggacagccagggcuacacagacaaacccugucuugaaaaaccaaaaaauaaaaauaaauaaaaaauuuuauuuauauauauauguauguguguguguguguguguguguguguguguguuaagaaucuacacaaccccacuuuaaagccagcaaguagcacuggcucacuggcucaaaaugaaguagaaaacuaggguugucccuuacucuucacacaugaacuacaugugcaaagcaugugaacauccacauucacagacaaaucauguauacugacacacacacacacacacauacacacacagagagcagacaaaggagaaaacauccauauccaccccaaauagcaggcaggcucacagcaggcauuucuaaguacaggcuacuguuuuguuguuauuguuguuguuguuguuuucaagacaggguuucucuguguagcccugacuguccuggaacucucuuuguagaccaggcuggccucgaacucagagacugcucugccucugccucccaagcacugagauuaaaggcgugcaccacuaugcuccacuggccacugucuuuuaaaccuaauguacacacaagccacaaaugcagauucugaauucaaagauaaaggcugaguccaagagucugaauuuacaacaagcucuugagagaugcuguggucacugguccauaaaauaccaucugaaaacaaggaucucuuagcucuuaguucuuuauccagcugagcauugaaaucaucuaggcauuuugaaaaugucaacauuggacuccauuccguaugauucuaaucaaauuggucuaaucaguccugaagccucuuuagauggaucugaacuugggcugagaaccacagcucuagacaaaccucuaauuguugcagucguuuuuccuggccuagccaauccauuaaaaaauacaucuucacaucacgaaaaucaacaucagcuuguagaccuacucacuguucagaucguucuaaaucccaagucucauuaacaugaguggagaaggaauuuauucugagaauuuucccuugcuagauucccauacucagcccgaccuuucaaaacacaaucuucuuuuaaacgugacuuuuaaguuucagugagucgaggcucucugggaaggagacaucuuuuagggagcuauagauuagcuaaugggacaguauaguuucaacagcucuucaugcagcaaaggacuuuaaacuucaacacucaacacucugaugguuuggauaggaaguguucucagaaaggcucauggucaaggcguggucaauggcauuuugguguuaccgagagugacuggaucaugaggugucugaccuggucaaugaaucaauuauuugauugagucacgaucugaggccauuagcaagccauggauggaucuggcaaaaggaaacaggucacuaaggacgugcuuuugacaccugccccuuccugucuaacuuccuaccuccaggaaguuccaagcauugcccugccaugcccuucugcagcuacagacugccucaccauaggcccaaaagccauggagcuauccaagcccagaccgaagccaucucuccaagcguuuccucccucaagcugauuuccuuauguccuuaucacaaugauaaaauaacucauguaaguaagugcaaacuaugaaaccugaaacacaauggcucacacccucaagacuuggaagggaagcaguuucugaccuagaucucucuauucauguaaccaccaacuaagcauagccugcuauggguacuaucaaaggcuuccucuucaggaagcuacacaggaugugugcuaccaaaaccaucaagaggaggaaguaugguuugaacaggaaauggcccacaggcucaaguguucugguauacgguccccagcuagugaugcuguuuugguaaucugugggaacuucagauggggcuagcugggggaacgggggauuuacagcccagacuccagcacagguauucucugcuuccugaaaugagaagugagccauaccauacagcccugcuaccauggaaggagcugccugccaccauaccuuccccagccccaugaugagcuguaucuccugaccgcugauuacaucauagggagaccccugucaagaaagaaaagagucugucaugccuuuaaucccagcagaggcaggcagauuucugaauuugaggccagccugaacaacagaguaaguuccaggacagucagggguauacaaagaaaccuuauaucaaaaaaaaaaaaaaaaaaaaaauuaaaaggaaggaaggaagaaagagagaaaaggaaaaaugaagucuguuuaauacugaucugauuugguuagaagccugaaaccuuucugcccaggguauuuuugcauugaauccuggaaccugcucuacaguucugcuuuuuagccccugcuguguguuuaguaauaugguucuauuauggaguuggaguacauuuuucuuuguguaacugugucaaaugaguuaaaaaaaaaaaaaaaaaaaaaccuaaaagucaugaauagugcugcacaccuuuaauccugacacuugggaagcagggucagguggaucucugugaguucaaggcuagccuggucuauaaagugaauaucaggccaaucagguauacaaaguaaggccccugucucaaaaaaaaaaaauuuuuuuuuaauuaaauccucuuguaaaagggggugggguugggcuggugagauggcucaguggguaagagcacccgacugcucuuccgaagguccagaguucaaaucccagcaaccacaugguggcucacaaccaucuguaacgagaucugacgcccucuucuggugugucugaagacagcuacaguguacuuacauguaauaaauaaaucuuuaaaaaaaaaaaaaaagggggggugggguuaaaaaaaauggcuuagcaaccgggcaaugguggaggcagaggcagguggauuucuuuuuucuuuuuuuuuuuuuaagauucauuuauuuauuauaugaaaguacacuguagcugccuucagacacuucagaagagggcaucagauuucguuauagaugguugugagccaccaugugguugcugggauuugaacucaggacuuucggaagagcagucagcgcucuuaaccacugagccaucuugcuagcccggcagguggauuucugaguucaaggccagccuggucuacaaagugaguuccaggacagccagggcuauaaagagaaauccugucucgaaaaacaaaaacaaacaaaaaaaaauggcuuagcacuuaagagcacuggccacucuuccagagaaccugggucaaguucccuacauccacacagcaacucacaacugucugcaauuuuaguuccaggggaucaggcaccuccuucuggccccuguugggcaccaggcacauaugugguacauauacauccaugcugccaaaacacucaugcaaugcacacaaaaauaaauaaaaucuaagaagaaagagaauaaggggcagcuagcuuuccaagacgaaagaggggaaaaaauguccuaaguugagaagacggagcugaaaccccagggaagguacagugcuuacaauucagagcacuagaaaagaagcagccccagagaucucugccaaagguccccucaggaaucugcugagcauggcucucagcacgugaagaaacugacaagacuggggaaggaccacccaggggguaggaagaaaauggugcugagcacuuaccacuccaggagagugcuugcucgcucucagcaguaacuauugagauuauuauuuuuauuauuacucauuguagcuuagaaguuaagguucuuauuuaaacgaaccagugccagugugguauggguuuuguaauauaacugguucaaagagaggagaaaugauggcauaucauuucagguucuuacucuaacaucacuugacaguaaacuacagaaaguaaaagaugcacacucugagugcccagcccucuugccuccauucugagugccagggcuaccaacaugcaacacuaugccugacuccacaaaagagcuuagcaacccaggcguggagugcagaccuauaaucccagcacuagggaagcaggggcugaggcaggaggcuaugcagauuccaagacuagccuaagcuauuuagcaaguucaaggccagucuggguuguagaugcccaaccucaaaacaaaaacaaaaacaaaaacaaaaacaaaaguuaacaaauuacuuacaagugguacauauuuauauacuauuauguaauucauguuaacagaucaaaacagaaauuccacugaccgacacaaagccucaaguccaacaaccaaccauauacugauuaaccccaguacucaggaggcagagguagguagaucucugaguuugaagccaaucuggucuacaaaucgacuuccaggacagcagggcuacacagagaaacccugucacagaaaacaaagaacaaacaaacaccucucaucaacaggcagaugaggagaguuuuccagccgaugcauuuguacaugaaauaccuacaagcuacagcaugcuugacagugaaggacuuaaaguguuucccucagggaucaacacugagguauccauucuccuaugacagaugauguagcuguaaugaacagacaagaaaaggaaacagauugcagacagagguuagaaaggaaaaauaaaacuguuuuuuugcuagucaaugacccugagacuaccgagaaaguggauccuccagaaaagcuaaaaacugcuagaauuaagucaguuucaagagguuucaggacuucaaaagucacuguguagcugggcagugaugguacaugccuuuaaucccagcacuugggcacuugggaggcagaggcaggcggauuucugaguucaaggccagcuuggucuacagagugaguuccaggacagccagggcuacacagagaaacccuguccaaaaaaaaaaaaaaaaaaaaaaaagucacugugugugguacucaggcacccaggcaggccugagaacugaaagccaaucugaguuccauuucuagaucccacagcuggccagagaaccuacucuggagagcugucucugaccacaugugcaucugauugguucaaggccagcuacauaggaaguuugaagucagucugggacacauaagauccucucucaaaauaaaagacaaaaaaggucuagcaagaugguucacuuguuaccaugccugaccacuugaauuggguuccuagacucacaucauggaggaacacugacucccaaaaguucuucucuggcaucacacacacacacacacacacacacacacacacaaauaaauaaauaaauaaauaaauguaaauaaaacuaagucaaaacaacagcagaguacagugaagggaaaaacuaggaaaaagaagaugguuaaaaugcaagccgcaaacuacaagaaagcauacacaaccacgcacuucauaagauuuauaaucuuaauauauuuuagaaauccuuuaaaacaauaugagaaagaugcacaauggguaaacaauguauacagauacccuaucagaaacacccacuuggcaaaugagcacaugaaaagacgcccaacauuagucacucaggguguuaauuaaagccauagucauaugccaccgaccucuuagaaugucuaaaguuaaagauaccacaaaacaaugcaugauagguguauaaaauuguucaaccauuuugaaagacagucuguccuauagguuuggggagggaguugagguuuuugggggggugcuuuuuguuugcugagcugggguccugcuuuguugcucagacuggguuuuagcuccuggucucuugccccaagaucccaaggaguucggccuacguacaugccaccaaagccagcuauuuguuuuaugauuuuuguuuuuuuggguuuuuuuguuuuguuuuguuuuguuuuguuuuguuuuguuuuuucccagacaggguuucucuguauagcccuggcuguccuagaacucacuuuguagaccaggcuggccucaaacucagaaauccaccugccucugccucugccucugccucccgagugcugggauuaaaggcaugcgccaccacgcccggcucagcuauuuguuugaaaaagagauauauuuuuacuuaaauuuauuucuaacugguuuauuuaauuguaaauauggguuaugugauaagucuagaagucccuuaaagguuaaaaugcucaucuaaaauauaauccauccauucuagcccuaagaauuuaccugggagaaauaaaagccaauauccacaaaaaaacaaacacaaucacucaaagaagcugugcuuguaauaccaaauccgagugacacacacauaagagaccgcugacaaugacugggaaugaaccaaugugauacaugcaacacgauacuacacgggggagaugugaaacagggaugcugcuccagagaagccagacucuaaaaggucacuaacugacuuccauuuacacaaacuccuaggcacagcaagcucagggagucccaaagagcagaccaguugcucuccuguucauccuaaagugcaggcaaggcaaccuaaaggaagugugaagguguaugcuuuauguaugcgcugagagcagaauucucuccacugaaaccagugagccagaaccacucuggucauuccaggagagcuuggcaccguggacacagcaguuaaacuuccggugucugaauguuugagagacaaugugacuggcacgggauaaagcugaaagacggguuggguuugccagagucggcaaaccggcuccuccagcaguucaagccaccacuaccccuucuucugcccccacaggagaacccuaucuccacccaggucuguucagaacccggguaugggaguccaucugacucauaggcacacgguaggcuagggcagagauauuccuggugaaggcucugagacaguaacucuggauccaucccacaggugggcuggaagugcaagaacuuuugacacggcuagggaaauaaagacagaggcuguaagcugucaaccaagaccaccugaaccaggaaagagguggguucauaugccaacaagaaaucaaaucuacccauuggccugcaggcuccaccucuaggcggcgccaagaaggagccacggucgcggggaggugaggaggucuuaauaggauaccacaggcuucucuauuugccagcuucuagagugaggucaaggcauggguagcagccgcugguacaaccucccuucccauuccauucagaaaugaagaccucaccaguugcucucugcaguucuacccauccuuggcuuugggcccacagcauaaucaaccgugacaaaaccguguggcaaggcgcaggccaggcucgugcccaagucacuacuggcugccacacucacgugaucaacaggacuacaagauaaggcacagcggcuaaugcaacacuauccauuuucccuuucgggaggacuugaggccggugaugcagguugcacaacagcuugcacagagacacaccuaccuccaccagcagauaggugaaggggaugacuuagucccuggggcuauccugccuucucuucccucugccuauaccaggcagccacucaaaugguuccacauccagucuagacuugaaagcggugacuacuccacuacagcagcugcuacuuacaauuauauguggugggugcuugcgugugugugugcgcgugcgugcguacguguguguauguguguguucgugaggggugaugcccagguuggucaacuagagaggacaagggauguuuggaacccauucuccgaugcuucuaaucauaucaacuccgauaacaauauuggccauccguaccugaguuuccagcuguccccaggcagacacugcuucgaggaugcucagacuugagguagcagaaaggaucuugcaggccagugccuacccuccagcaauaucuuccaaaggucagguucacagcgcucuucugcuccccaauccccuacaucuuccugcauuacucuuggcacuagagcaacccugaugccagcaaggaaggcagcuugccgauuaccaccuccuucgccgucugcgccugcggguccugugucccucuuggaaucccucucccccugaggacccuuuaccguucagauacgucuccugaacagcccacacuaccuggcccucuugcaccccgggcagccaauuugcuuccugcacccccaggcgccccucuccuucaggcccucggggcccuacaggccuggcucuccccagcagcucgagucuguccccacucgcuagggaugcuccaaggacca

SEQ ID NO: 12545 - RNA, 81944 nt, Mus musculus
cuuguugcaaaccacaugaggcuuuauucagggaaagccagagcucuggggacgacucauaucccacacagggguagaggaguugaccucgagaggaaagaguucccaguuuuuauaggcccucaggggagaaaggagaagggggagaguaggggauuuccagaucuaaacaaugucuauucucaagaaauggguaugggacggguacaaggaaagagucuggggcagguguagcaacucaggauuggcugggcugugguugcuggggagauuuucugacucuuucucagcaaccgauaucacaaacaccuggcaaugggcuucaucagugggcacacacaugggucaaggaacggucaaaacauuggcagacacacagguucgaggaguggccagagcauugugcaccucuauuuuuuaaaaucagugaagcuaguucugcuaacacugacaucuaucuugccaauuucagggcuucuguguccuuuuacauucugucaggaucuuucauuauaagagauaacaaaacaucaauuaggauaauuauuuaacuucaauuuuauauaaaguguaaauuuggcaggaauuaaaguauauucagucauaauuuaaggcauaucagauaggaaaggcacaacuacaaugaaaaccauaaacucuuacuauaaaucaauuauuuuagcauuucacaauuuggggcaacaguggacagagacucuggaauaguggaucugcagcucauuuguuagcaauuccuggggcaaguuaaguucccuaauaucugaaucuguuuuucaucuaccaaaugugauaacauuuuguuaugacuaaaugaagauaucacaugagaauaccaacaaauaguugaaaauucugaaccaacuuuauuuuuucagcaaaaguugcacaauuuccauaaacauaggaauauuuauucucaauacaaaacagauucuuacacaucucacaaauguuuucucuguagcuugauacugcuucaguccucacugucgcuuucugacucacucagcugcaagucacuuccuaaaauaaaaauaacaaaacuguugaacuguuaauauuuaauaaauccauuuagucuaauaugauugcuuauaauauaacucagccacauaccauguacaccaauuaauacugcauagaaaguaaaagccacggcaucaaacuucagcauuucauaucacccggcauuuauuuuagcuuucuuucacauacugauaacaucauucccuuuacacuacucucuuauuacaucagacuaucauuuucaagaguguaaaguuuauaguguguuuuuaccuucagaugcaauccaaaccauuauggaagagaugucaagaacccuuagaccagaugucacucagugguaggaugccugacuaccaggcccaggacccuguguucaauucccaguaucauaaagacuaucuaggcaccaagggcuuuuguaagucauuuguaugguuagucauggaggcagcauuucaguggagcagaaugacaggaaacacauaucuagucuaaugucaaguaggaguaaguccugggggacuauggagagaggagcaggagguacuauuguauguacuauagcugggaaagcuuaaugagaggcaacguuugaacagaaagucauuaaacaauggaggcagugucucaucuaagauaaguguaaaugcucuaaggcaaguguagaguggcugugauucuuuuuauuacauauuuuuugguaauuucacacaugaaugcaauguauuuacaucacauguacuuccaacucaccccugcagcuaacucuuccuggacccucucucccugacacgacaucuuucucuaaacugcauaucuucuuucucuucuucauucuacucuuuuuuaaaaauagcccacuggcuccauuuagcucugccugaagguaccaggguguagagccaccugcugaagcuugggucacacuucugaagaaagcucauuuucccucucuuagucuccauuagcugacaaaacacgaguggggguuauaggauuuuuuuuccuuauagagaggcaacgguggccagagugggagaaaugagggagacaaagauggggaaugaggccagaaaaaguagagaggaagucucaguaaagacuguuugaacacaaugagaaagcacugaacaguuuuaacaggaacuaaguugaaccugacuauaccaguaacuacacuguaaugguguagaggaaacauggaagcaggagagaagcugagucuuuucucaguucugacccaggcaugccagcacaaguaucacuuccucccuggcaugccgugguuuaaguguuaagguguaucuuuauuauuuucguuugccuauuuuagcaucugcaguagauucauggcagucuucaguacuggaaaauucuaaagguuaaguuuucacaucaucccuucuauucuuucugggaauucccauuauucaguguuucaucuuuuccaucuauucuccuucucucuuaguuuuuauuuuacccuguguucugggacagcaccuuccaucucacuaauuuacuucucacccuugucagucuugccuacuuauugaucuuuuucagaacauuccuaggacuuguuccuccaaauuuaaucuuuaaacacgaaccuuccugucugcgcacacguguggaagccagaggacgggcuguuggugucccuucucucccacucccacgugagcucuggagauugaacuccacucaggaaguuugguggcaagcaucucuacccacugagccauugcacugaugauaauguuuuuaaguacgggagcucagacucugggucuuguguauggcaugcaagcacucuucucucaaaguacuugauucuuauuuauaauauauuggauuuuguuuuauuucugcuuuccuuuguuuugcuauacauagccagcuuggucuacagaguaaguuccaggccagccagaguuacauaauaagacuuugucuucuaaaaggcuaugccuucauauaucuuccuaggaucacauggguuuuuucuuuauuucagaauuauauuuguccauuuugaggaggaaguuccucucucugucucuuugucugucucuuugucugucugucugucugucugucugucugucucucucucucucucucucucgccuuuauaacacucuuugcaggaucuugugauucugccccauuuaccagaaacaaguuuuacaaucaccuuugaagauugcuaucucuuggagauaugguagguccuucaaggagucaaugaguaacaaugcuguauaaacuauggcuucugaaacagagccacaggaaugguguaagugguugcuuuucccccuagccuccuuuuacuaacugaagaacauccaaguaucuaguacucuuucccaucuucacuugcccucaccauacauugucuagcuucccacagaaaguauaauuucccugcaucuuaucaagaaacuuuguuuguguucaugugcacauuugagugcauguggaagccaaggacaguuucaggcauuguuccugagugcuauccgccaaugcuuuggagacaagaucucucacuaucguggaacucacuaaguggguuuaucuggcuggccagcaagcucuagggauucccuugucucugccucacccuacucagguuuuguucuuguuuuuucuaaacauggguucuaaggauugaacuaaaguauuccaagcuccuuccuaagugagcuaugucuuuagcuuguaccaaacacuuugugugugugugugugugugugugugugugugugugugugugugugugugugcuugcaugugucaagaagucagaacacagucuugguuguuguucuucaggcccuagaauuugcuaguuaagcuaaacugaucuccuggguuccuccaaaaggcuugggucacaucuccagcucugcccucuguagcacucuaggcucuggcugacuccacuccacugauccugcuguucuuggugaucauccuaugguacuggcaucuccaacauacuguggucuuccucugcaacuagacuuuaucaauagcaacucauaggcucucuucauggugacaagccucagcuuuuuugcaugaccccuucaguccugggccaucaacuacaacugagacugcaccuucaccaauggccuucgaaggcuucuuacagugccaagccucagcugcucuccauaccuuuaaaacuaguaccaucugggugauuuuacacauuaucaaguccagaugcagcaugagguucaaccuuggcuaucucugaaacacagcuucuuugugcucucagaaaauacuucccagauuucacuucagugauacuggucucuucuucuucuucuuuuuuuuuuuccaauuuuuuuuaauuagguauuuucuucauuuacauuucaaaugcuaaccugagaguccccuauacccuccucuccuaccuacucacuccuauuccccuaccuaaccacucccacuucuuggcccugguguuccccuguacugaggcauauaaaguuugcaagaccaagggaccucucuucccaaugauagcuaacuaggccaucuucugcuacauaugcagcuagagacaggagcucuggggguacugguuaguucauauuguuguuccaccuaugggguugcagaccccuucagcuccuuggguacuuucucuagcuccuccauugggggcccuguguuccauccaauagaugacugugagcauccacuucuguguuugcuaggcacuggcauagccucacaagagacagcuauaucaggguccuuucagcaaaaucuugcuggcauaugcaauagugucugcauuuggugguugauuaugggauggauuccuggguggggcagucucuggaugguccauccuuuugucgcagcuccaaacuuugucucuguaacuccuuccagggguguuuuguucccaauucuaagaaagggcaaaguguccacacauuggucuucuuucuucuugaguuucauguguuuugcaaauuuuaucuugguuauucuaaguuucugggcuaauauccacuuaucaguaagugcauaucaugugaguuuuuuuuuugauuggguuaccucacucaggaugauacccuccugauccauccacuugccuaggaauuucauaaauucauuguuuuuaauugcugaguaguacuacauuguguaaauguaccacauuuucuguauccauuucucuguugagggacaucuggguucuuuccagcuucuggcuauuauaaauaaggcugcuaugaacauaguggaacauguguucuuauuaccaguuggaucaucuucuggauauauauccaggagagguauugcuggaucuuccaguaguacuaugucaaauuuucugaggaaccacgagacugauuuccagagugguuguacaagcuugcaaucgauacuggucucuucuuaaucacugcuaauuuauuaguuccagaaaaucagcaucaauugucccaggaaucucuucuauuuuugacucuacagggagagucacacggacaaagcugcugaguucugcugcuuaguggggcuggaacaugugcccuucuucuauuacaucaucaccagcuuucuguuuucuaauucuuucacuuccuaagcuuagcuguucuggaacuugcucuguagauugaccuugaacucagagaucugcaugccuaucuccuaaauacuaggauuaaaggugugguucuuucuuucuuucuuucuuucuuucuuucuuucuuucuuucuuucuuucuuucuuucuuuuuuucuuucuaacuuuucucuacuuagaaucuucuguaucccaggcugaccuugaacucagagaacggcuugccucugucuacuggaauuaaagucgcauaccaccuuaccugaaccuaagcuuuucauggccgcuaugccucaagauucaggucaaaagccugugucuuucauuucugaauuguaguucauuccagauuaaaaguccaagugaaaacaauaaccaaguaauaauaguggcuaacaugauauaacuauuccuuguucaaugguaaaugcauaaauaacaaguuuagcuggguggaaucuugccagaagucaccacucccuuaaucuguuuaccuccuugaacacaggauucagcuccauuucacuuccuggugcccguuuauuacuugagccacacauuuuauauuuuuccuuucuaagucugcuuugcuucuucaaaauguucuucaugaauggaaugaacuacaauuggggcgggcuaacagguucagagguucagugcauuaucaucaaggugggagcaugacaguguccaggcaggcauggugcaggagcugagaguucuacaucuuguuccaaaagcaaacagaaaacuagcuuccaggcagcuaguacaaggguauuaaagcccaugcccacaguaacacacccaauccaacaaagccacaucuacgccaacaaggccauaccaccaaacagugccagucccuggaucauacauauucaaacagccacacuaagaaaauaaauaguaaauaaagcaauauaauuuuguuaaggucuacucucuauuguaaaaggaauugcaaacuuugaaaaguauaaaucaagagaggugauaaauuaaauuauaaucacuaaaagaucauuaucgcuaauaauauacauaguugaugaaaauuuccuugacuguauauacacaagacuugccuaagaucaagccagucaaaacuucaacaugaaugugcaaggaccucacaaaacuccacccuaagaugaagagcuauuggcaguuggaggcuucuauggaaggaaaguucagcuaucuucagagaugcagcccuagaagauugaccuuguuucagugaauggaccuacagugauguucauacacauacuggcaacaucaaguggacauagcaguuaagggaaagggagaacaugaaguugggaggaaguccugguauugaugguuggggaaaucaagaaaaugagcugaacuacagugguagucauaaagauaaaaagaaguagauggauuuaaaagauauuuaggaaguagaagucaaaaggacuugaugaaauauugaguauacaaaaagguaagagaguaacucaauccuggaauacaaucaggcuucugguuuacauaaugacacaaacgcugccauucacuaggcaaauagacagugagccaaaaaauauaguguuguuuuuuguacagcauuuguacaguauuugaagugccuuuuacuaagaggugaagcuagaccuaucugcccaggacucagaggucugcauggagauugguauuugaaaguucucucuagauagauagauggguagauagauagauagauagauagauagauagauaaauagauagaaacaggagcaugaggagguuaucuaagaaaaagaagaagauagaauaaaaagaaaagggcccauggaaaagcuucgaggagcccucacuccagugacagaguacauuuuaaacuugcaaaggagaaaaaaauuggcuaaugauuacaaaauacauaaauuaagauucuucuuuaaauuuuagugcacaauaaacauggcuacaaugcaaguccuguuuuaguucuuauggcuaugcauacuuacguaaaguacucaucagaaggguacugugguccugaagucggugacaaguagcaucagccucugaaguccuguacuguggcccagcagacaugcuagggugcuccgagcuguauuuccuuggacccaaaggagagaauuggucaucaucuucagaaucacuagaacuauccucacuacuugaagaugaagaacuuuuggaaucugaugaacuaucacaacuacucaucugguccauaagacuagcuucugcuuucaguucugaaaauagaaauaauaaagucaaauaaauaacaagaagaaacacaauaacauaaaugcauuagguuuuuaagauaaggaauaaauaaaacuaaaacacauauuccagcaucuaaaccauuuauuuuagaaauuccuguagugcacuguccaagaaacuuucuaaacauccagccugcugcuguugcccuugguuaucaccacagguggaaggugggucccuaucgcuaaagacaccauguauuucaauaacagggugcagagacccuuuugcuggaacugacccacaagcccucuccuugaggauuaccuuucaugguaccagaaggugacauuuggaagcuucaauggagagaggcaaccaacugucucacccagcuaucgugcccauggaccccaucaauugucacaauaacacaacauaguaguagugguacauacaccuuggugguaaccagcagacucaugacucacacagccagaaagauuauacuagguaccagaaacuuagguaacuucucaguguuagugaagucaugguuauuaggggagaaucuacaaccacuaauuuacuaaaagaccagaauuaucccuaauaauaacacucuauaaacauuuguccuuacagccacagauaaguguagucuucgucccuccauccaggaaauuucuuuuugcaauagacagagagcaaaacagaaaaccacaaccaaucaaaauucugaguuguagagcccagucccaacagauauaccuacaaaaccuaucugcacccaaggcucaggaaacauuugggaggagggaacgaaaagauuguaugacucccagaucuuacaauguuacaaauagaucagggaguuggcugugagauugugucuccugcugacaucagaagcuauacccacagagucuauugcccaagcguuaccuaaacaaggaugauacaaaugagcauaccaaaccggauaucgaaaaaccuaugaagccucaacucuacacaaaaagcuauuagccaacugagggaagcugagaacaagagaaauacucuuccccagggaagagcacaccaauuggcuguccagugcuaaaugaucagcccugaaaacaugcagaaacacacagacagacagacagacagacaggcaggcagacagacaagcacacagcaauauguggacuaaacagguuauauuugguaauguauauguauuuacaugcauauaugcaugcaauauaauauauuauauuauacuauauauaauauaauauauuauuauauauuauauauaauauguaauaauaauauaugcaugcaauagcaauuagugaacaaaagaggccaugaacuuaaaggagaauggaaaaggguauauauaggaguuuuugcagguacgaaaggaaagcgagauauguuuuaauuaaaauaaaaaaaaauaaauuaaaagccccuccuuuggcaccaagcuggauuuuaauaacaggaguaugagacuaaaagcauagguaaccaguuggguauggcaucauaauuuguaauccuagcauucaggaggcugagacuggagaauaucaaguucaaagagcuauacagugagacuuuuccucaaaaagagggagaagcucagcuauuaagagcacuagcuguucuuccggaggacuagagagugauucccagcacccgcguggugguucacaacauccaugacccaggggauaugaugcccucuucuggccuccaaggguacugcauguaugugguaccaguuuuauacauauauaugaauguauaugcaauauacucauuagcauaauaaguaaagucucaaaaacagggcacaaauaauaucuaaauuuaauuugauauguauaauaaauauauaauaaauaaugaaaaauuuaaaaguguaaaaauacaaaaugcauuauuaguuuuuuuccuuaguccuuaguaugcacugugcagugucauaccuauggacuucauucuuuuuccagcuggucuagagaaagcuuugaugacucaugucuuuuggguuuuguuuuugcuuugugaccuaccaggguuuaacuagaucuacucucaugggcaugggugugaagcuacccacuugaagaugagcaggucaucaaugacaaucacugaagacaaugcccucuccuccgguagccuaugaauuccucauacaugacugaacgcuuauuguaugucugucuugcacaugcccuuguaggcagcuacaaccguugugaguucacaagaaccacagacagcaugucacuacccuacagcaugcugucuucccuaucccuauuguuuggcucuuacauucuuucccuucuuccuuggugcucccugacauagcuguaauauucuucuguaucuuuuuaauggccacuggauccacuacugauuauagacauggucauuaaauucccaauauuaaugauucauaucuuuucuuauuuuguuuuauuuuguuuuaaaguuuuauuuauuuaauguuuaucugcauguacagcugcauaccagaagggggaaucagauuucauugagaugauugugagccaucauguggcugcugagaauugaacucaagaccacuggaagggcaaccagugcucuuaaccacugagccaucuuugcagcccucauuuuuguuuuugaauagagguuuaucaauuguguauauguauugauaaacucuuuguuucacugacauucucuacugcuuucaguuucauuuauuuuuauuauuucuuucuuuuugccuuuuuggguuuauuauuuucuuuuucugggcauuggaacuucaguaugacaccuuucuccuucucuaauucaagcauuuagagucucacagaucccccccccccccgccacugcuuuggaugcaucauguccacuuucuguguuucucauuuccuuuuauucucucuuuuuucuuuaacccauggaccauuuaaaaguagguaaauuuccaaguguuuaaagauuuguuuagugucaccugcuauugacuuuuaggguguuuuguuauggucagaguacaagguuuuuaugauuuuguuuuaaauaaaugaaucaagauuuuucuuauagcccacggcaugguuuauguuguugagugcucauuaagcagacacuugaggaaaaaagguucauuuuuuuguuguauuuaguugacauguggugugugugugugugcgcgcgcgugugugugugcguguguguugccuguuacccagagcacacugaggaaguaagucacuaaggauuauugauuuuuauauuucuguuuucaucauaucaguuuuaucucauaaguuugcaguuccaucgcuagucacauugucuuccugcuaaaugaacccuuuaguuguuacuaauguacuucuuugugcuauuuuguuuuguaucugauauuaauacagccacgugugcuuuaaaugcuuacaugguguauucuucuauccuuucacuugaaagcugcccauuucauuaauuucuuauaaacaacacacaguuguauuuuuuugguaaaaaaaaauaaauuuucuccauuucaacuaauugguuuagaccacucacauuuacauuaaucacuggcucacuaaggcuuaccugugacguguaauauuuacuuuaugcuuauuuccugugcauuugauuuugauucuucuguuuuacuuuccuuucauuucugugggauauccaaaucuucuucagaguucugucuuccuuccuuuuuccuuccuuccuuccuuccuuccuuccuucuuuccuuccuuccuuccuuccuuccuuccuuccucgcuuccuuucuuccuucauuccucgcuuccuuucucccaugugcuuuaggugucacuuuacauguaugaugauguacuagcauguaugucuugccaugauucaguguuacaaguaagacaugaaaaucacuuacuuuagaugccuuuucuuuucuuucuuucuuuuuuuuuuuuuuuuuuuuuuuuugguuuuucgagacaggguuucucuguguagcccuggcuguccuggaacucacucuguagaccaggcuggccucaaacucagaaauccaccugccucugccucccgagugcugggauuaaaggcgugcgccaccacgcccagcuagaugccuuuucuucucaauuuuuaaauauuauugucuuaaguaucaguauuaaccaaaauguucaccuuugcuuugauugccacauaugauuuggaaacgucaugaggacaacauuaucuuuugaacauuaucuuucuguugaucuuuaucccuaacugaugcucccaaauuccuucuuguuaucauuucuuuuaugauuacuucaguuucuauagcaaauauuucagagcagcccccucgucacaaguacuuuuaguguucauuucuguggaagucuauuucuccuuuauuacuugagacuaauuuuggcaaacacagaguucauaacuuucagcauuaggcagugcagagccacuucugaguuuccaauaagacauaugcuauuaccuaaguggugcuccucugggugauacagcauagcucucuugccuucugaacuuuuaucucuguccuuaguuuucagauguuuaauuuaugugucugagcgugcauuuuuggggguuuauccuguuugggauuuguucgauuucuugaaucuauagguuuauauuaaucaaccugggauuguuuucagggauuauuucuuccaauuauuuuuucagccccucuuucuuuguccucugaguguucaguugcuucaccucuuggaaauuuugucaguuugcagcaaaucuuugggggccuauucccuuugcuuaaguacacuuucuguuuuaggucaaguggauucucucuauucauucucugguaagugagccugcccuguggauucaugcuguuauuuucuuaguuuuauaauuucuauuugugccugguuuaaaauuucuccuuaagucuacuuuucacuugcuucaagaaaauuaauaauugaaucauuuugugaaagcuaauuuaagaccaucaucagauaauucuaacaucuauucucucugggaauuacuacagacauuucucauucaaguugugauuuuccugauuuacaguauaauauguaacuuccuaguguuccuuacuuuuuguguguauucuaggggacaaccgacuuaaaucuuuuaguuuagcaggcaguccugguucagauuuaacaugcagacacuugccuguuucugugacaaaugacauucuaauuccagaccuuuuacagauauguuguuguuuucuugguaaaucuccagcaacuagaguucccacugguaaacuugacaaaggagcuuuacuaucaaugaagcccaguuccugagaaagggaagucuguggccuaauacaacaaagacugcuuccaggguugaguguguguguguguguguguguguguguguguguguguguguguguguguguucccacgaagggaaagaaagugaaaagugcuucccagcaaggugcuugauauagcagguaccccuugccagugucacccaaucucaaggugacuuuuaaaugcagagcaaacuuugaaggcagggaggcugucugggagauggagagggaaugggcauuugucagugugaugucacaugcacaugccuugugcccaugcauuuccugauggaagaggauagugucagcucaagcacagaggagcaagcgcuugcauggcauuauuccuuuugcuggaacacucagcuuccuggugccucugagugauauggggaaauuuaggcccuaucuaauuucuuaaacucaaauuuacagauaacucgaagauugcaaaaauggaugcacagaauuucuaguguaguuucuggauauaaauugggaagaugauucaaccaucagagaguaaucaguuacaugaauagaaaaguggcccagcaguuaagagcggcucuuaaagaggacccaaguuuaguucccagcacccaugucagaugacucacagucaccugugacuccagguucaaaggaucccauauccucuucugacaucugcaggcaccugcacacaugugagcaaacauguauucccacacacauacacauaauuuguaaauuacuuuguuaaaaauagaaguuaauaguacuauaggaucaauaaagcauuugauagaauauagucuaaggaugcuauauggacauuuccagguagcuaauguucuuuugcauacacguuuagaauaagaaaacuauucuggguucuuguaagcugagucucuaugaugccgaagguaugaugccgaagccaugcuuuaauuaaggucugaaacacaagugccauaugaagaaccuuuaccucuacuacagaccacuauugaagacacaauuacuucccagaauugcuucacacaaugaauugcuuuuaguaucuaguagcaaggaguagaaugggucucgggcaccuaucuuaauauacuguauauuaagguaauauaaaauacccaacuuauaucuuuauucuuguuuugcuguccaguaagugcaaagcuaaauuccauuuuaauuuuaauaacuagcaaauauacuuuaaaaauucccuuuaaucucuuaauuuugugacucuauauguguacuggagugauaccaugauacuauuuuggaaguagucuuaauauaagauaaaauaaaauucaagaucugggaucuuguugauguucaauuacuguaacauccauauccuaguguagcuaggaaaaaaaaagagcuuuaacaucuugaacauccuauaccuccccagaaguguccuccugcaagaagggacacgaaauagaaagaaacuuccuccuguuucuguugauuuggaggugccuuagcaacugacuauaaacaaaaaaauuucacaggaagaugcuauaaagaacugaugaaacacuuuuuuucuccuaaaugaugauaaaaaaugaugugacauggauauaccuacauaaauaugcuaauuuacauguuauaucauuaucccagagaaguacacacucauaaaaauauauucuauccucacuaagucccacuguuaaugaaaauuaacacuuaauauuuacuuaauauuacuuaccucuauaaacugacaugccauacacuuagauuuuaccucuuucaauaucauccauuagagacguuggagacaucuucucuucugauggagaaugcuguacaagauuggaaguccuaggcagauuccacauuugcuguugcuguuguucuagucuguacuggauucugcuacucccuuccacucugcaauuaagaauaucaaauaucaaaaaagguaagcaaaaaaaaucacaaacccaacuuccagaguuacugaacauuaucauguggucuuuagaaaccucuccagugacacugaaggauuaaaauguuaguccauuuaacaauuguguaucgaguuccuccuauaugugugcuguacacacaggucuagggaggcaaccgcucaaaggagcagauaguauucuuauaaaugacuacgauaaggagaaaauauaugugcaaauuaaacuaagucucuuccacauuucccacucaucauuuuaaaacaggcauauaaacaaaggaagaguacacuucagaaauuaugguugaggcccacucuuccugcuuccugugaucaaauccuucuggcuccuccuuccugaaguuuuuaggcccucauuuucucucauucguuuauacucccaaaaaaucuugguuuacccauuuucuuguuucccacauuguuucuuuuuauccaguuucuuugcuaauguuucagaccagaacugcaaacaugccaaucccuaguuggaaagaucuuaauauguaacuacugccagcaaggaaauguccuugcugguucucaguuaauauucaaggcauuaacccccaaccuaccuuuacaaccuaaacucuaauccacuaccaucaucccccgcuuuccaauucucacacgggcgcagagacaaauaccugcucuguuuaaagagucuuauucaccagcccugaaagaaucagcuauauuucugccuucacacuugcuuuauuuauauauucucauauccuuucuggucaguuuaagggagcugggacagcagggauauuagcaaauagagguucucagguuucuucucucuguugaaguuggcuuuggagacagcuacuuuguaaaacauguuuuuguuaguauauauuagcugcacaagauaaugagcuucaucauggcauuucauacauguacaaggugcuucgauaauauccacccuucaguuccccucccuugcucucuccaacuacagcaccuucuguuuuaaacacauauuuaaggugauucuuaggauuuuagcuugcuuugaaguaacauuuuucuuuuuaaaaaauuuauuuuguauuagauuuauuuauuucacuuuauguguauuuugucugcacuuuuguauucuguaccauaugagugcaugauacuuguggaggucagaagagggcauuggaucuccuagauuuggaguuacagauggcuguaagugaccauguuguugcugagaauugaaccuggguccucugaaagaggaacaagugcucuuaaccacugagccaucucuccaaccccagaaguaacauuuuucaacaauuuuuuucuaaagauuuuuaucaaccaugaccccucccuucaauuccuacagucgcuaaacuuucuacuguuuguuuagcucuuagaacagauuaaaaugguuuaaaauguacuauuuauaucuaaaaaguauuuaagauguauauauaaauauguauguauauuuauauauauacauauauacacauacauagugauuuuuaaauuaaguggacuguuaguaugauuaaaacguauaaaguguagaagucuuaagguuagucuuuauuuagcaaacuuuccuuucucuagugugccuuccauauucuaaguagucaauuuacuaauaaagguaaaguuauuuuggauaguggauaguguuucuguucagcccaaugauauacauaucuggaaaucauuucaacaucacaaggcagugugcuaagaucuuuuaacuaagaauuauuacuaaauuuaaacuuuaaaagauuuaaagaaacuuuaaaaauguuaccuuauuuuguucaucuguuuguugauguguauagaucuggguguggcacauguacauuuaaauugcauuagucagguaugcugcucuaucucucuccccuuagucuuuggaggcagggucucucuuugauccaguagccuccauguuuuggcuaagcuggaggccagcgagcccaucauucuccuaguucaaacagcugcagugcugaggugcugaguucucagacacauacaggguguccggcuugccucuagagcaguguggucugaacuauaauccucaugcuuacauaguaaguucucuuuacagcugagccaucuuuguagccccaauuaacagacuuuuuaaagaacacaucucauagcacaauuugacuuaauccauucauucuuuuuccuuagaaauguauaugcugguaaaauaauuucuuucaaugcaccaccuaccuuguuuuuuucacagugauguugcugcugagcuuuucuaggcgacauuccccaguaucaugguuaauaaucaaaaugcauucuuuuaaguaaggucucuuggaaccuuugaaaacugugacugguggaguugaacccuguuuaagaaguuaucaucauuacuucaaauaucauagugauucaauugagaugggcauugaguucuuuuuguacuauuucuuuuuaauccguguuauauaucaagucacuuauaacugguuuaaacuuacuaccauaaaaccaacaaguguggcuuaaaaauaaaaguacaaagacaggguugguuuuaaaaggcugagaucaacccagaucuggccucuauuucuagcugcucaggaggcacagucaggagggucccaaguucaaagccugucuggauuacagaaugaguacaaagccaaugaggaaacuuagugggagccuaucucaagauaaaaacugaaaaaaaggacugugguacagugguacagcacuuggcuagcauguaugaaacuuuagauccagguagacuugcgcacgcacacacacacacacacacacacacacacacacacgagaucucaaaccugccaucacugaagaaaggaaaaguaauuacccugaaauaguuugauuguucauuuucacuaggcaacuuggauucaaucuaaucuaaucuaaucuaaucuaaucuaaucuaaaaauacauauacagggaaggaaacaggaccuuugaaucauauucucauuuugagaugaucuagaaaauaucaauaaagaccaaaucuuauuaauccucuugugugacaacaacauacacuuuauuaaaauuuaaaaaguucuuucucagcaaugcauacugauucaagaaaugaguuaaacuuuagggauuuucuuuaaaauguaucagaagggagugguaagagaaaaauuacucagaaacaguuauguuuucuauuaagucauucuuaacaaaaggauaaagagagaaugaggagauggcucauuugauaaauguuugccacacaagcaugaggaccugaauucaauuccuagcaaccacauaaaaagagugcacagugguacuugcucacagucuuagcacuagagacaagacaggcaggucucuggauuuugcuggccaguuagccuugucuagucugcuuaucuagaauaguaagaugaauggcucuaaaaaaaaaugaagugugaaaauucucucucucucucucucucucucucucucucucucucucucucucugucugucugucugucugucuugcgcacacacaauuaaagaaacucagcccauuacuauuauucuucaaauuuccuuauuuuugucacugucaccuccaaacacgaagacauuuuauauuauuauucuuagucuugcaugaauaauuccuaaacaugguucaccuggucagagcucacagguucucacagucucuguauuuuaaggaaguuuaagagguuuauaaacuuucuucuuuaucaaaccgaacaacauuucuaauuuuuuaaaaaaauuaaaacuuauuuuauuuuauguguaaggguguuuugccuauauacaugucugugcagcauguguauacccaguguccugagguuagaagagggcauuagaucuccuggaacuggaguuauagacagugagcugccauguaggugcugggaauuaaaccugguaccucugaaagaaaagccagagcuccuaacugcugagccagcucuucagccacacccuuccuaaucuugaacauuuaauuucugcucauuuccuuaaaguaccaaguaauuauaaguauaugaauuaucuuugccugaaaauaacuacugaauacuuccuacaucuccauauucacuauuacccaccuuggggacucaaucaacauuucaccuagauuacuggcaucacuuccucuauucucuuuccaauucuguuacuaauuguguuaauaggaaaaucaaacuuuauguacucaggauaagagucauauucuacaaaccuauaugacuuuuuaauuucuucuccaacacucuaaaucagaacgaugcauaccugguuuguaugugugaaaguuuagaccuugaauagcuaccaaaggccuacaaauuauagccuugucaucuacuaaagugguacuaucaggaaauuguggacacuuaaaacaguggagucuggugacagcucucugguuauuagggcuaaacccccgaggcaggugcuggaaguccaaggccuccucuuaccgucuuauuuauauauuuauaacagugaagcaacacuuuuuuucuggugauguauauucccacugugaugugcaauagaucaacguggccaugaacugaaacuucuaaaccauggucccaaauuacccucucucuuuauaagcugauuguucucagggguuucuuauauuaauggaaagcuaacuaacuuaagcaauagguaccaagaaguggggucauugcuaugacaacaguugacaauguggcaauaccaacagaaaaaaaugagauaggaaagaugcuguugggugagguuugagauagaaauaggauucuguugggaacugaccugaagucaaccuuguuauaauacacacgauaaauguacgccuacauuuuuuugacuauucccugagaauuugcuggaagcugagcuuaaaggcagguuauuaacggaggaaguuucaaggcagcaaauaccuagauuauaccauggauaguucuggcugcuuuuagagagauuuauagugagaacaaaaaaaaaaaaaaaaggaauauaaagauuuggaaagccugcaguuuagcuagaaucagagcauuaagaaaaagccauugcuaaaaagauuaauauuauuggaaagaagucaaaugccuucuaccugauuaaaaggaaagacaccuugguggcaccucugaaauuuaugaggucauaggcauuaaggacucaaugauauaaagaaugcaaauuuguuccaaagacuuucuagggcauagucuuuugacaagagauuuccagggcacccugcucacuuaggacuucuuaaaugggugaggaacucagagguuguggguaccuccaugacacacucuagccucaucuguaggaucuaggcuuuguccacaugcagaguauaaagguuaugggaucauguaggauuccggugagauuucaauggcaagucagguguggggguggggaacaaguaguguugugguaguucugagccccugcaagcagccccugacaggaugagacacagagggagcagugagagugaggcuggagcugcaguggagacccaggagggaagaaggccggaauguggaacaccugccucccugccuaggguaugauaccacaaucagcagaguccagauguguggccccgugggcugcauccaucaaggcugugggggguggagcugccuaagcccuugggauccaccauccuaccauggugugcccuggaugccgagcaugaagauuuagaaucuaaugucuaucuccugggggcuugaucucauuccuuuuugcugucucccuguucugucuuuuuggaggauuaaauaucuguuuauuuugcaccaauggaaauauguaacuuuauuuuuuauuuuucagaccucacagcugaaugugucucagagagaacuauggacuucaacuuuugaacauuuuauacucuggggacucuuuggggugcacuaaaggcauuuagcauugagagguagaugugagccuugggggaacagaauaggaugcuuacaguuggaucugaaauguuccugaaagggucauguauugaagguuuggucccuagcuuggugcgacugggagaggaggaaugugcaacugggagagguggaaacuugaggaaaguuuuuagucacuggacaauucuguagacugagaugugaggauucuggucuuggcuaugauauaaacuuuaauuuaauuuuauuuauuuuuuugcuaugacuaaaaguagaaaaagaaacccauaaguugaaucuuuucccuuuacaaacugauuaucacaggcauuuauggcauaguagagauaauugacuuaaaguggucagccaagaggcauacuaauacauacacauauauauacauauauuuauauauauauguuuauauauauauauauauauauauauauauauauauauaugaacagcuuguuugagaaagaaaaagagaucugguauccagcaucugugggcaucagcauuuaaagggcauccuuccccccaacccaacuccccccucacacacauacauaaaauuuaaaaaaauuaauauaaaauauggacuugcugagggcuggagagauggcucagugguaaagagcacugacugaucuuccagagguccuggguucaauucccagcaaccacaugguggcucacaaccaucuguaauggaaucugauagccuaguaugaugugucuaaagagagcagcaguguacucauauacauaaaauaaauuaauuaauuaaaaaauauggacuugcucacacuucuuuauuuuaaagaauuuuaaauguuuuaaaaucucuggucugaaacaauauuuuuguuacaaacuaaaagccauuuucacauugaaacaugcuuuaagaugugagcucaaagacucuuaagcaugaacaaaugaauuagaacagaaccucaggauaagggaaugaagccauaguaguauuaagcaaaggaauuuaguuauuuauguuuaauuaauuuuaaguagaaaugagcuauauaaauguauaauguuaaacuaaaauuauuuaaagaaauuuugcagcaaaacguugcauuaacaaaacuuaggugucuggccgagguggcagggaagggcagugggaagaaaaagggaaggauccuaggaaagacagaaauauaucccuaacacccacccgucuuauaugauuucauaauaccuggagaaacauagcuuucauaaauaacugagaguuacagguuugauuaugaacaggaagggggaauaaacacaaaauaaugauaaaaaauggaaagauaccugauguuuggcaauacucauaaauaauguaaaaggauaaauaaggcaggcuaggaauguagccugcuuauagacagaguaccugcccuaccauuugcaaggcccuggguuccaccccagaaccaauaaaaaaauaaaaguuaaggaggagcaaggugaugccugauaaguucuuccagucaucucucucucucccuguagacacaccaagcugaguagcuguucauaugauaaaggaaggaaacacagcaagaccucacccuaccuguuuuuaguauaacaaaacaaaaggacacacugcagccugcaagaaggaaagaacugucagagccaccugcaccccaacuguaagcaacccugcagggagaagcacaccucuagccuuggguaaggagagagugcaguccucagccuuaagaaccaacagcaggcucaucccagugaaccacaguguugggcaaagccccacgaacccuaccacguggcuaauacuggggccugaaccaguggaccuguguuaggucagacagcagcuuguuucacccacaucucuuacaaaguuaguugacagaaagcagaacucuucccauugggaagcagaaacuaaagguaggacccaccacaguaagaacuucagaaaaaaaaaaaaaaaaaacaaaacugaaagccuugaguucaaagaaacucuagauuggcccuagcaucagguccagaccuauguguuaaaggaauugaacaguuuugaaugcaucuguucuaugcacaauguugacuuaggcuauagucaucuccaccuaagguacaggauucuacagcugcaauccaacugacuaacacccuucauagcuaagacacuguuucuaccaccuaucucuguccgcaggcugcauagauaucacaaggcccaagcuccuagaaaaggccaugaaaccucagaugugguugagauuugugcccuagugggacagacuuguguuuugaucugcaucaucaucagcuccacuguaaacaccaacauaccuugaggcugcauagguccuuguaguuuugugacucucauuaucuagcuuaauaacaccaaugugggugaccugcaggcuaccuucccaaacacuacccuauccucaagcuguaaagcuuauuucaagccuuuuuucucggugagaauaggacauaauagcaagcauaagguuuuuguuguugcuuguuuguuuguuuuuguuuuguuuugcccuggaacuuaguggugguaacaccugacacuggguuaggccugucugugaacaaccacaguuccaggaaaaaacauacagucugcuucuacuggaccucacuuuuagccaauagcagcuaaaacuguucuaguagcucuggaucucaagguccacagcaucauaacacagccuugguccuaacagagagcugugcugguggagcauaggcucauagcugacuuggugggauugguauucacagguaccacauagaaaccuagguucacucuauccacagugaguauccagaguccagcagaaucuuguguccaaugacaguuuacuguguaugaggcaaucaggccuacccuggacccaggaauauacuuguaggaauagauaagucuuuccuguacucugcuauuucuuuuuuuuguuuuuuaaagauuuauuuauuuuauguaugugaguacacuguagcuguacagaugguugugagccuucaugugguuguugggaauugaauuuuuaagaccucuguccugaucacucuggucaacucugcucgcucuggcccaaagauuuauuuauuauuauauguaaguacacuguagcuggcuucagacacaucagaagagggcgucagaucucauuacaggugguugugagccaccaugugguugcugggaugaagagcagucagugcucuuacccgcugagccaucucgccagcccacucugcuauuucuuucugaacagaacaccaaugggguauuuaauaaucugggcuugggcaccaucuaguguugaaaugguggaaaugaacauggacucagagaaaaagagaaaaccuguuuagaaauuauggagguggaugaggagggucaaauuaggaaauaaaauagauaacagauugguuaaugccuugaugaugucacacaugacacacaucaccgacuguuaugaaaccauguauauuuaaagccauguauauuuauuuuuaaauaaagugcugggaacugacgaggagggaaucaguacagggaguccucagaauaaauaauccuucaaucucaauggaaacacaaagaacuggaucaacagucuaacagaaaagcuuaaaagacgugggaacuacuuuugaaaauagaaauucuugagcugaaguugacucaggaaaauuuaaaacugcuauauacgagguaaagauaacaggauagauuaaacagaagaaacaauuaguaugcuuggaauuaauugcaauguucacaacugacaagaaacugacauagauuacagaaggaauuccaaaaucucaauagugaaaacuaaacccaauaccaauuaaaaaugauucaaugauuuaauaauucaauagauucaaauaagcauuuaacaaaagaagaaaaacaaauagccaauaagcacaugaaaacauguucaacaucgcuaacccuaugaaaagucuguaaaaugugauuauugcaacuauauggaaaacaguuuagagauucuacaaaaaauaagcaauaaaaacaaaaaauaccccauauauauagauuuaccuuacgcucuagcaaucccagugcuagaugguaagccauaauaaccacauuuucuucaucccuucucuagacuguggcauuguauuauuagcaacagaaaacagacugaggacagguccugcucagggccaugugucaccaugagaagaagacugaggacagguccugcucagggccaugugucaccaugagaagaagacugagggcagguccugcucagggccauuugucaccaugagaagaagacugaggacagguccugcucagggccaugugucaccaugagaagaagacugaggacagguccugcucagggccaugugucaccaugagaagaagacugagggcagguccugcucagggccaugugucaccaugagaagaagacugaggacagguccugcucagggccaugugucaccaugagaagaagacugaggacagguccugcucagggccaugugucaccaugagaagaagacugaggacagguccugcucagggccaugugucaccaugagaagaagacugagggcagguccugcucagggccaugugucaccaugagaagaagacugaggacagguccugcucagggccaugugucaccaugagaagaagacugagggcagguccugcucagggccaugugucaccaugagaagaagacugagggcagguccugcucagggccaugugucaccaugagaagaacaccagucucuggcagaggcuuagugaggacaacgaccaaagacucaguuuuugcuaucagcugaaauaaggggccuucacuacauggaacugacacugagaaagaugcugugccucagaagguagcacgugaggcucuaaagaccauggggaugggcacaaauaauacagagaagacaaggacaagaaggcaucagugagggguacacugggaggagcuucaccaucaguggugacaugggucacuugggaagauucugcccucugauaaucuccccuagagucuucuuuuguaauuuuuuuaucuauuaauguguguguaucugugugugugugugugugugugugagagagagagagagagagagagagagagagaggcaugccauuguacaucuguggucauuuauguccuuucccuuucccuuggucccaaggacugaaucagguugccaggcgugcacagcaacgccccugagccagccaucucuccuaacagugucuucuaagccacuccaagucaauguggaaacagcaaaaaacgcuuuuaaaaaugccaauaagcauaacauuauuauguagcuguggauuguggucuguuuuacauacuuuacucgugcuaauucauuuaaucguuuuaacaaccuuaugagacaauuguuaucuuuauaugaaaaaaaaaugaggcacaaaagacuuuauaauuugcccaaguucacaccaaagggggcaaagggagauuuaaacgugggaagucugauucuagauguaugacuuuuaacgucucugacauggagauauggcuaggugugcaaaagaaugaaauagucaaguguuuaguuaccccaauccaaccuaacugccuccaugggcccaccaccucugaggaaucugucacuacuugccgacaaccuccuucuuguucuacuucuagaaucgaauaggugcagaauaguggaccggagauuaaaguccuggaaacuagguagcucagauggagaaggaaacuuugggagaagccaaggaaauaauuucaauccucucucuacauaaacuucugucauuccccauuauacagaagacaaaacaucaguucucuaaggugaccuaugagucuccagcuccaugauuggauuccaucuuuacaaaggcucuuuuguuucuguuacuucgugcgugcuuuuccacagccccuguagacacucuuacccucagcuuaucaggaaagauucugcauugugagggaagacaacucugcucgaagccucacagaguggagcaagacuuuuaucgcugguauccagauucuaacucccgugucucuuuccaucagcaugugucacagccaugaacgaagauuuggaaugacgauagcaaggccccauuuucucaaaugaucugaguuuaaauugaauuucuuucaauagaacaugggugacacauauauuugagugugaacuuuauaauauugugauauguugggcaaaguuuacuuauaauugaauaaucuguauuuauauguagcaugugcccauguuacauguauacaauaaagcagugcuaaguagaaauagcugucauuuuggaccucaaauacucuuccuucauaucaaaaugggacuuaagagcaaacuuuguaacuugauaucucuuauuucagggguuguuucuuggaauaagaggaaaucugagagggaaucuggauuagaagaaauaaaaucucacucaugcuuuucuuuucugcauaccccuucaccuacuugguuaagagagcaacucuguuuuggggguaucugugguuaucgucuuuagccugucugaugucugaugccucagcugcucugccacaucagacacacagucaucacccuuaagucucacauguucaguuaucuguccagcaguuucccaaagguuuacucguguuccacaguuaugucauuccugucucggaaauagcucacccacaccugcaugucaugguacagaaggcagaagaucucauugaggaguuucuccucccccccauaaaagagacaaauugagaucuucccuuucuugacaaagcuagagagaagaguuggaauuuuugguuuuguauguuuuuggauuuguaguaucuucuaaagaggaucucaauucugccuucgaauuuguuuacuuauggagcuggaaagauagcuccuuaguuaagagcacauacuggucucacagaggaccaaaguacaguuccuaucucccuuguuggggguucacaacugccuaugauuucagcuccaggugacccaauggucucuuuuggccuccacuaauaccuccauuuaaguguauaaacacacacacacacacacacacacacacacacacacacacacaaauacacaucauuuuuuaaaauuaaauuaaaucuuuaaaaaauauuauuguaguucaacuucaucuacagcauaucagaagucucagaaggaacauuuugucuguuaguccaccuuuaacauuagugguaucugugcuuguuugcuaaguguacagguacaacgugcacucuccuuaaacaaaacugaaacaggcuggacaggaaagagcucagagagccucuuaggacuccacauuccucucuguccuccuagccccuccccucugugugaaaggugacucagagaacuugaaacuugcagauguucagaaggaagcacuggagaagagcaggccccgccccaccccaccccccacuugccugaggcaaacaaaggagaacagcuacccaaccaaggcccguuagagaaggugucagaugguuuaugaaaaaagcaaggacccucacaguugcuugcuaggcaacucuacugcaaaugggcaugagcagauaugaucccugggacggaauaaauuagugacauggccaaacaauaggauuuuagaacacagaggaccuguucugccaguuaauuauaggagagagauugccccucucugggccucuuccuucuaguugaaacuggagugacaauaucuacuuuuccagaugaugaacauuaaaguccuggagucgaugccuggcauggagugagcaaugugaacgaguaugcucuuggauaagauggugaaccacacaucccacagggguaaaguccugacugucaucuauuaguuuuguacuuggggcaauaggaguaagcuccuagucauuguuguagagaguugaugaaauuaauacauaaaaaucacuaagcacagugugugagaccagccacaccacauccaauagauguuuaucauuaguauuuaauauuuuaaaaaauauuuacaaaacuuauaaguccauaguauuuaacuggucuacagauuucauuuuuauuuguuuauucuauuugguaauagagaaagaaaauaaauggauuuuaaaaucuaccuuauuaacacacacacauauacaaacccuaucagaaaucaaagcuauucuuauuuuuuuaaauguuauuuuaucuauuuaucuauuuuuuuuuucuucaagauaggguuucucuguguagcccuggcuguccuggaacucccuuuaaguagaccaggcuggccuugaacucacagaguucuaccugccucugcuuccugagugcugggauuaagggcgugugcuaccacugcccgacuaauaauuuaauuuuuuaauuaugaguguguauagguuugugcacgugagugcagaugcuuguggaggugucucgagccaacugaaagguggugguuacuuccuuccauuguuuuggguuuuguuuuuacauuucagauauuuauaagccauagguuugaaaauauagaccucacccgacagucauuugcauaagaugauuucuauugagaacaugauccaaugugguagauuauaacucuucacuaggcaggauaaaagugagcaaaauaauuuaucaauauauagaagagaugccauagcaaagcaauagaagggaugaaacgggacguuuguaacuugaaaaacagauauuauguauggcaaggacggcccaguuggaauccuggugcaaacuaaccaucacuggcuaagacuaccacagccugaaacuacgcaacagugguccccacugugaacuuaaagccuuucagucacuuuuauaaugaaguggcugcauuccuuugagugucuagggaugggaggacaugagaggaauuugagugaaggaagccaaggaggggcuggaggcaagaaaggggguggacaguauaacuacuuauaguaaaaacuuguuuucaaauaguauaaaaauaaaaauaaaauugaauggcucauucaguuugcuccuuaauaggcacuauagaacaaauaagguuugaugcguccaaauaaauuuccaaauggcauaaaaacaccagaaucauaauagaggauuugaaaagcuaguuuauccaugacaucucauagucaauugauuuuucauuuucuucaguuccuaaggaaacagaugagaaauauucaauacgaacucccacacacauacaaagcucuaccuuaagaaaaccuucagaagcagcaacugacuccaucugauauagugguggggucucaguaagugguacugaauuacaaacuaagaaaaagagagcagacuagaagauaaaaacugcuauaccucuaaccacgacaagcuagcuuacugauauauguaagacacuguaaaguggccaaccgcaaacuauucccaaaaaauuaaaggcaaggugucucaaaaaagugcauuuaaaaaaauauguuacacaaaguuauggaguuguuuuuuucuauaacuuuuucuauaacggaugaagucacuauuaaagaaaagcaaaagaaaacucuagauaauaggaaauuucuagcucaaggacugaauuaagaaaacuuguauuuuaugaaaguaauauugguugcaguauuuggauacacuuggaaaaaccuaaaaacagagaaaguguuuggguaagggguccagagccuagaagcugaaucugaagaguccagcuccuaaacagcagagugagcaucccgaauucacaauucaaaagucugaaaugcuacaaagugugcaucuuuucagcucaaacauaacagcacaaguggagaacucuauacuguaaauuguuucaucuacugaguuauugugaguaaugcauaaaauaaucuuuuggcuaaguauauacagcauauggaaaaauaaauaaauuuuguauuucacuuauaggaucuauccacaagauauuuauuacauauuugcaaauacuccaaaauuaaaaaaaaaaaaacuagaaggcccaaacaaguauuuguuccaagaauuugcauaaaagauguacuuaaaauaggaauucuauaauucuauaaucauuaucccuguaaucacuuucaagucauuggcuaugauauuccuugaaaccauuaaaugaauuaaaguacuuuaaaauuguuucagccaaaguugauuuugcuuccucuguauaauauucaucauuuuaaccaaccaucauuauaugaaugguauaaauauuuucauugauauuuaguggaaauccuuuagaacagaccucuuucaucuucauauagagaacuacuuacuucuauauuuggaagaguuauugucaccuguucaccuuugccaaccucaagauuuccuucacaagaaguaucaauagaagcagguuugaagucaucuaaaaauagauauaaauaucaauguuuauaagauagacaauguauuacucaugacugugaacagagagugacagaagcagcuaagaggauuauuuugacucacuggguaguuuuguuuuaacuacuuuuauuguauguguaugcauguuuuguuuccuuguaugcacgcgcuggagcccaaggaggccagaagagaccaauggauccucuggcacugggguuagagauagauauaagugccauguuggguaguuagaaccagauccagacccucuggaaaaguagcaagucccuuccuuaauuguuaagucccuuggggcacuguuuaaagaguacaauccaucagagcaaggaagggaugccaagguccacacuggucagggaaccguaagcaucaacaucauccaauccuaguuuaaacuagcauguuuucugauauuuacucccaguaacacuugacuacucuugguggguggacccacuugaauagaagaccuuucugucgucacuacuuauuagcucauccugugacaauaacaaaugaugucacugaaacaggagauuuacuaauuauuaacucuuacauagauauaaauuauaaugcuggugguagcccaaauccaaaauuaacucuaaugaguuauugaagaucucugcagugaaucuuuguugcuaaaaguugucauuguuacauuuaagcaaguugcaugcaucaguacuccucguacauaauugaauagaacucauaaaaacuaaugguggcuauuauuuauucuuuaccauguucuaaauaccauguuagauucuuuuuuauguuaccacaaccucucuaggaaagaauccaaaaagguagauauuaccauuuucaccuaugaauacugugguugaaagcuuagagacuguucccaaagucacguuacacacagguuuggugaaguucaggguucacauacaggcuuaucugaagcauucguauaaaagauaggcaagauuuaucccauauaugagacaaaacaauacuuaaucucaaauagcauuggcuugagugguuuaaauuagguccaccugcucugcauaaaugucaaauacuauaugauauaguuuccauuccuuacgaguucuugagacugaggggacacuggaaaugaaccuguucaaauaaaccuaaaaggauucuguguaauauuauacuuaauuggauaggguggggcggggggggggggagacaguauuuuuuuaagucuucugcaggacuaaggguggagucuaagcuuguuuacugugcuugugauuaugcuuugucuuuuggcauaugcuuguuuauugucauucuuguggcucgauuauccgacucuaauuuggaaaauauguuuucaacaucuuaagaacuuuuguaaagccgggauguagcucagcgauagagcacuugacuaguaugcacaaagcccuggguuugaguucuaacgcuguaauuaauccuguaaagaacccauaaauaaaagucuuaggaacaccugcaaggcacuuuucaaaagcuguauuucauucauuuaauuuuggauuugcaucuguaggaagagaaugcauaucuaagcuguaaaauauauauacaucgagggacuggagagauguuucagaaguuaagagcaccacuggcuguucuuacagagaacuuggguccuucucagcaccagcaucaggucacugauagccacgguuaacuccacuuacaagggacuugaggcucucuugcggucucugagggcacugcauaauaugaugugcauauauagacucaggcccacacauacacauaaaaaaaauaaacauaucuaucacuaaauaacuuuuuuguaacuuuaaacuuuguacugaaaaacaaaagaucacugcaugccugagaagaaggaagaggaaaaggacauaguacuugggaaaggggcauugagaggucaguuaagaacaguaccuugcuuuuggaaaggggagagacagagagacagagagagagagggggagggaggggagggagggagggagggagggagggagggagagaaggagagagggagagagagagagagggagagagagagggagggagagagggagagagacuauggcugcacaacacucacugauucauuguggggaacucuggaugguaacccagagcaaaauaaacaaggagcacuacugaaguucuguugguaaacuucucccauuuauuccaccaaaacaugauauuuuugcuuaaugcagccuuuuuauaaagcuuaaauauaaucaauggaagguuaaacccauugguucuuccuacauuuacucugaguuauuauagaugaauugucuacaacuuaaacuuugaagacugaguuuuaaaugaguguuuuucagaauauaaaccuuguaaggaaaaggacagaaugguggagaauguaggacaagcagacaguaaagaagagcugggcugcaaaagagaugugaaaaaaaaucuacaauuucacacacacacacacacacacacacacagaggucacaacucagugaccuuucccuuaugcgcuagaauucuguggccuauuaugcaaaaaagaaguuuuacauacaaaauuaaguuauauuuuucgugcuggcaucucauuuaauuacuaaaacgaaaaggcucauuauaaccucuuuuucaacaauauuagagauaaccuauuaaaauagaucccagagaacaaaacaccaaaggguagaaaucauuaggagguagauuuuuaaaguaaagaaacuagauaaaaaaaucuuucaauuuuugauaaucaguaauuacuuaguugaccaugaaaucugagauggaaagagauacaaacgauugagacagcugacaaucucuucccaagaacaaacuaaaugggaacccucaucagccagaauggggaagaaauguccuuguggccucuccacaucacuuuugcccugcauucgguccuuuguuccaucugucugucaccuuuucaaacucugcaccauccacuugucacgcuagucuccacagccacccgugcagaucgucccacaaaacuuccucucaggucugucagucucacuuaaacccuuccaggguucuccuacacugugggacgccaggugccugcacagaggcuggcaacuggguaguggaucacugugccaucuggucucccggggagcaaagagcggcggggacagaauuacagaauccggaggagucugucuccauaccacccucccaucccagaaggaacccgggguacagucugcacucacagcgcacgguguggaaggcacagcgcggcugcuucucgaaacuuucgccuagcuugagaacccgcucgcgacgguccagguaugcaagucccgcugguccacucauccucguccccugccucccgcuuuuggccuucgccguccccugccacagccucuggaacagcugcacuggcugcgagcuugaguucggugcccgggaccagcuccuuucaccuccagacgcgugcggccgccccuuggagcgccccgagucuugauuggcugucuggagacaccugccccgccccucgccccagggccccgccccgccccuggccaccauccccgccccuagcccccuucccgcgucgcgacgcacacagcucggcggagaccgccucgcugagguacgcugugcgggucgggcccugagguggacggacgcggggaaagagaugagguaacagacccgagauggcggcugggauggaggaaaggcccuaggggggcggggaagcuaggacgccagacacccagggcagaacugccuggcggggccugguaacgggagcgugggccuccuccgcgccgggcccgcagguuugguguggaaacggacgccugacgagagguggcggccgggcccaggccuggggccuccugaggccuagcugcucugaggcgggucuggaaccccagccgcgcccccucaggugaugugaccagacuggaaaccucuggaagccgcgcaguuaccuuuaagggccguucauuuauuuauuuuuucuucuuucuuucuuucuuauuuauuuauuuauuuauuuauuauuuuuuaauuagcccuuuaaaaacacaggcuuuucccgccgggguuaggaccugaggagggggcguuuccggaggcgacggagaagccuaggguuagggguaacugacugcuguacguuuguuucuggcauuuguuucuguagugauuccuggaagcacugaagagcgcggccuugggacucuugauuucucagagaucagucuagcaguaggguaagagcgucaauugauugauaauugccuucacacacacacacacacacaccccaccucacagaaguguuaugaaguaggagaaagcgugcuuuguauuggaggauuauucagagaaagucuacagugagcccccucaggugauucuucagguuaauuguggcaucagacuaugcuuucagcacuucuaccuuaaauagguuugucaauuuauuuuuuucagauggaugagggauuauuuuuugccuucuacccuuuaaagauacaaggagagauuguucaauguauuuaugcacgaagguucugaagccagaaucucugggcuuguacgucagcuucauacucucaaugugauuuuugugcaagcaaaucaaacaaauguguuuaucauuagaauuggggaaauaauaauagcuauguaaaaaauaaugccauuccuuagaauuguugaggugguuaaaugaguuaauacaugcucucuaaauaauuauuuuggguucagcaauacuuucauauuuuuagacuuaaucauugcugaaugccuuauaaauuuugaagucuagggacaagggauggcuauuauguucauagaugaaaacacugguuuagagaaacccaggugguugauuuuguggccaucuaaugucaagagggauuuguucaguggcacaagugaguggauguauacuuucacauugauuuuauuaccauauuguauaaaguaauuugcaaucagaauggccaccagugaagggaauguuuaagcauauuuugaugaauucuuacaaagaacaggauaauguagacaccggaaagaguaagacaacaugcauucucuuggaaaguuuuacaucuucuacaugcuaggaauguuauugggcuuucuuuaaaauaguuucaguggauuugucuauuaaugauuuauauuuuacucaagaagagggucucacuauaguucugguugucuugaaacucacuauauagagguccgucuugaacucacagagauccaccugccucuguuucccaagugcugagauuuaaaggcaugugccacuauguccagcuaaguuuuauuuuucuuaacugcacauuuaagaugauuaugguaacuauuucauaaccccauugaaaggauaaaauaaugcauuaaaacccauuuagcacaguucuucauaauaaauauguuuauuaauuaaaauauguuuuauauuaaugauacuauugagcuucaaauacuuauauagaaaaguuauaaagaaaaguuuuaguaaaaaacuauagaaaacuaccuagaaaacuauauagacuuauauagaaaagcuuuaguaaaaaaaaauugagguguggauuuuugaauuuuagaauugauagacuauaaguaauuuuaaauuuuguuauaauuucauaacauuucuuaggucuaguaugugggguuuuccaaaccaucuccagguucagugauuagguggacgggcucacaggauucaacacauacauugucuuauuuguagcuguacuuuauagugaagauauguaaagcaaagucaguaaagugaaaagaucauauaggauacaauccgcagaaaaccaagcacagucuuccaagacccacuucuaguagaauuacagaguauacauaauuucuuaaggaaaacaguugugaccauaccugugaaguauuuucuauuagagaugccuaucagacacucagugaccagaauuuuuacugguuuguauugaaagauugguucuuuaugccaauacuaagagguaauggaaccaucaagauaucauugggcucaccacccucaaaagaauugauaaaguuuuuguaagaguuuagauaguccuuaagagaagacuguuaauaaaaaggccugccccccuccuuagucucucucaagucuuuugugcuauauaucuucuauucaugcuaucauaccaucuguaauaugggaaagccaagacaauuuucaccagaagccagugcccugacauaaggcccuugaacuuccagaacugugagcuaaauaaaccucuugguaaaaugccucagguaucuauuauguauugaaaaucagacaaagaaaauaccagaauucucagaaucuaaaaggaaaacauguuuauuuaccacaaccauuauauuuauaauagauuuggcacagugaucuaagcuuauaagagaacaauaaaaauccuucugaaauccacauucuagauacuagccaacagccagucuuguaaaaugaccuuugaagaaaaggcuguaguuaagccugccauaucaacucguuguacagucuguuucuccuguaugaagucuauauuagaauuguugcacagagagaguaaaugugaagcugguacaauuucugauucuuaauacauuugaguuuuuaaaaauuauuauguuuaagcauaggugguagaaaaaaaugaagccagccgguacagacccaaggaucuugucuuuagcugcugaaguugcaaaaaguccugaacaaaauguuccuguuauauuauugaaguuaaaagguaagaaaauacuuuuauaguuaggaaagacauuagguaaauacuaguucugucaugacacaauguuaguauuuuaauuuguuuggagaaaccuuaacacuguggaauaaaauucucuuuuuugcuauauuuuuaaugaucacaacauauaaauacaaguaucucuuggaugaauugagcaaaaauaaguauauauuauuuucuuuuuccuuagaaauaauaaacaacaccccuuugggaagcucagaguuaaagaaaguuaaacaagauauauauuguuaugaccucauucaguauugucuauugguccucagucaagauucuucucgaauccagggugguuggucuacaauuucccagcuuacacagauacuaagguaaaaugaagcaaacagaucagcuuguucuaauuuucaauaauuauuuuuuugucauucuauuaagaauaggaaucuccuauauguuuugauuguacuuaucuuucacacuguaugcucuuguuuguaacuucaggugcaauugauuguccuaagauuucuuuacacaugauuaugucguuuguuugccacuugaguccuacuuaacuaauguauucuuuuugacucaaauauuugaagaaauuaaagcucuguacuuggaaaacuuaacaguagagauugaguagcagugguacuugauacaaacacaaugaauaggugacagaaugaaaguauauagcaaagaacuguagaagaacaaguauagaaacuucauuucauuuguaaugauauugcuauuuaaacuguauauuuaucaggaagcccaaauccuguacaugaaauuuagaagcaguguuuacuuuccuacugccauguuaaaaauagaaagaucaagauuuuuuaaaaggugaugaugaaguguucucaguaccugaguuaaucuuccuucacuugcauuugauuuuauaaaauuuguuauuuuacauuauguguauaugucagugucuguauguggguauguguacaugaguacagguacccauagaaaccagaagaguguauggguucugaauuugaguucugguauuuuguaagaguagaaagugcucuuaccuacugagccauuucuccagucacaccccauuugauuucagaugaacuauccucacaggagagauauuuuucauacuuacacuauucugucuuagauccuaacuuucuaaauugcuucauucuacuuuguuauuacauaaaggccuaauucaaaguaugcaguuacaaaaaggguuaacaaauuuauguacuuuuuuauacuuaauuuucaagauuauuucaauauugauuaaacauaaguaaauaaaugcuuauauuuuuguuuugaugauacaugcuaguuuaugacaauauugguugaauauuacuuuuauuaaugcugucuuucauauagauaugcugaguaauuagguauaagaacuaaaaagaaaguaaaaacuucgugauagcaaguauuagccaaugagguuuuuugauuugggggguuuuuuuuuguuuguuuguuuuguuuuuuugguuuuugguuuuugguuuuuugagccaggguuucucuguguagcccaggcuguccuggaacucacucuguagaccaggcuggccucgaacucagaaauccaccugccccugcuucccaaguacugggauuaaaggcaugugccaccacugcccggcgccaaugagguuuuuaacaugcucaauuuguaauugucauuguuuaucaguguguacauauuuuguugaaaagauuuagucaauagugauuacuuaucauacuaauaucuacuuuuggguugaaggcucuuuuugguauaagacuacuauauaaguacuuuuauuauugauauuucugaauaugaucaacucauauccagggauuagcuuuaauguauaauuuuaagaagauaauuuuucuauaaagggcuuuuuuucaauuuuuuauuagauauuuucuucuuuuacauuucaaaugcuauccagaaaguccccuauacccucccccgacccuguuccccuguacuggggcauauaaaguuugcuagaccaagggaccucucuucccaaugauggccgacuaggccaucuucugcuacauaugcagcuagagaaacgaguucuggagguacuggcuaguucauauuguuguuccaccaauaggguugcagaccccuucaguuucuugggugcuuucucuagcuccuccauugggggcccugugauccauccaauagaugacugugagcauccacuuuuguauuugccaggcacuggcauagcuucacacgagacagcuauaucaggcaggguccuuucagcaaaaucuugcuggcauguggaauagugucugcauuugguggcugauuaugggauggauccccagguaggguagucucuggaugguccauccuuucgucuuaguuccaaacuuugucucuguaaccccuucuauggguauuuuguucccuauucuagggaggaaugaaguauccaugcguuggucuuccuucuucuugauuuucuuguauuuugcaaauuguaucuuggguauucuaauuucugggcuaauauccacuuaucagugagugcauaucaagugauuucuuuugugauuggguuaccucagucaggaugauauccuccagauacauccauuugcacaagaauuucauaaauucauuguuuuuaaaagcugaguaguacuccauuguguaaauguaccacauuuucuguauccauuccucuguugagggacaucuggguucuuuccagcuucuggcuauuauaaauaaggcugcuaugaacauaguggagcauguguccuuauuaccaguuggaacaucuucuggguauaugcucaggaaagguauugcuggaucuuccgguaguacuauguccaauuuucugaggaacugccagacugauuuucagaaugguuguacaagcuugaaaucccaccagcaauggaggaguguuccucuucuccacauccucuccagcaucugcuuauaaagggcuuuuucuucuuuauuguguauuauaaaauguuccuacuacagauagguuaauguuuuuacuguuuucccuucugauauaagaauaaacagauaauuugugggucuuaagaaagaggaauaguuugaaacuagaguguuugauuuucuuaucuuucuucccuaacgauuaaccucaccccagauauuuucagcuauuagauccuaaaauauaucaguuaauagaaauuaacaugaauuaaacagucaagguauucuuugccuuuagggugauaguagccaauucccugaaaaguucucucauuuuuucuugacuguaaagcaaguaucuuuuauauucuuuuguucucuuuccuucucucucucccuuuuguccucccuccuccccucccucgcucucccuucccuugaccucucucucucucucucucucucucucucucucucucucucucucucucucucucuuuuuuuucuuuugagacagggucucacuauguaaacuuggcugaucuggaacugauuauguaaaccaggcuugccuugaacucacagagauccuccuguguuugcuuucuaggguugugggauuuaaagaccuauaccaucaccuaggucuaucuuucauuucuuaaagaaccagcauauuuguuuucaggauuugugaacccuggaacuaaaugcaagcgagguccauuucacagcuuaguuccuuagaaagcugaaauuuucuagcaacuuuuuaauuggcuugucaacaaaagaaugacacuuaagguucucauuaaggcacaaugccuauggaaguuagacuauucaaaugauauuuaugauuaauacaagcuuauacucuuauuucagccauugcugugugggcuuagagccaggagaagauggagaagaauuuuacaaggaguuacuuccaucagcugcugaaaauuuucuuauccuggggagaagguuacaaacauguuucaucaaugcaacuaagguauaaguguuguauagccaaauaauuuucauuuuuuuuucacuguauagcccaagcuagcuucauauucgguguauagcuuugcaggucucaagaguuucaguccuuuuguuucaaccuccucagcacugggauuacuaggauguaugccauaucuaucccuuccuaaguuauccccugucauuuuucaaauaugccauaucuggcugaacauacaaguagagaagugaauuuaaacaucuuuaagcuaaaaauuacaaccaagaaauuaaucucuaaauuagaaaaauugaaaauguuagcuaaagaauacuguaugauuuuuaaagaguuugucuuaccccuuaaugugaggaaacaugcauauauacuuauauccacggcauaacuucauuccagacuguaauagcuguuucagacuuuuaauugcugacacuucaggcuaguuagaccauagcuuuuauuuauuuuauuuauuuuuuaauuuuuuugguuuuauugagacaggguucccuguguaguccuggcuguccuggaacucacuuuuuagaccaagcuggccucgaacucagaaauccaccugucucugccucccaagugcugggaauaaaggugugcaccaccacgcccggcagcuuuuauuuuuuauuugacacauaaaguuuuacauacuuuaagggaacuauguaauguuuugauaccuuuauauuuuauguaauguuuguauacagagaaaaagagaggcugggaggggaagagggaagaggagaucauggagaaaaugauucuuugccuuaucaaguaccuauuucagaucuucagauuguggagcuguugggcaaaauccaggccuuguguauggaaaucaguauucuaguauccaggaauguucugcaucuagucuacuuucuguaaagaagugccacaucaguauaucagacuuugaaaauguaaucugugaacacacccuagaacagcagcaaaugccauacuaugcuuugaauuuguaauaaggccuuuucauuaugagaagcaaacuuuugaagaccuuguauucuaccauccuuaaguguccaacccuguuagaucuauuuucauauuucuuaguguagaacacuacguaugcuguauaagcaaagaauccugccuaaugagaagucauuaggaauuuacuuagcacuguugcuuauuaagguagucauguccuuuaucuguuggaugguauuggcagcuucuguuuccauucuuguagaugacuaaaucaaucauauaacuaacuuaucaguuucccaucuauggugcccauucuuccucuaaccaacuugaccugaccuuaagugauuaucaagauugucucacugugcucagucagaccuugaguguauuugugcucaguccucaguccuaacucugaggguaggaauaggaccagaaguugagaauuuccucaucuucaguucuuuuugaguuaguugaauuaagcuagcguagaauggccccgcagggaauucagauuccaauuugaauaccaaagacuucucaucuucauuuauuaugaauuaccauauaggugauuggaaucaaacccagguccccugaaagagcagccugugaucuuaaccacuaagcuaucucucuaccuccuuaauuccacucuuucaauuauuuuuuuuaauauguguguuagcuaaacaacauuuauaugcaguaaucacacuguuggacuuauuauauuuauuuaaaaggagugagauuaauaucaaaacaucuuuacuccuauguuuauugcagcacuauuuacgauagucaaaaauaguaauaaccuaaauaucagaaaucagugcauaaauaaugaaauaaaaagggcagauuucugucauuugcaacaccauggaaagaaaugaaggccaguaagugaaguaggccacaccagaaagucacauacuguaugaauucaaugacauauagaaucuaaaacaagcucaucuccuagaaguugagacuugaaaacugguuaccagaggcuagggauaauagaagaggaaagaugagagaaaguuuaacaauggguauuuuguaauauuuaguuuaagguauuuuaugucauaugggaugauuauauaugauaaugguaaaccuuuacuuuaaaaaagaauaguuuuauuuugaauauuaaagaaauuaguaaauaguugucucauuauucugacauucauauaaacucaauucuauugagaaaacugcaagcucauauaguuuauagcaacuccuaauuagccauuaagagaauuauagacuagaaauggcucauggccuuaggacuugggaaguugauucaguaggacugcucagucccaagccagccugggcuacugagugaauuaccugaaaaucagcacaagacagguuuacuuaacguauaugauauaaucagaaauguaaugugcauaggaaagaauagagauagaaagaccaauugagauagauuuuuuucccccauuuuuuccuaggauagagcuucacuaugcagcccaaauaauguuaaacucacacucuuccugccucagucuuuugacugcuggaacauagauucccaucauuacaccuugcuaaaaggaggcuuuuuaugagugaaguauuucuugaucaugagucagacaggccaauuucugggaguuugaggccagucuaguccguuuagaauuccaggucagccagguaaugaaacccugucucaaaauucaaaacaaauauauaugguagcucacaaccuccuauaauugacgaccuucucuucuggccuccucaggcaacgcuuagaugugaugcgcauuuauauacacgcauggaaaaacacucauacauauuaaaaauaaaacgaauggaauucaaugagaaauuuaacaauauggacaauauaagaaauauuguuggcagaagauuuaacucagagaucauauauucuacaucuggaauuuugguggccauuagccuacuuggaagcuuucaagaaaauuuuuaagaauuugauauuuguggguaguauaaaauaugguaggacauauauuagauguucuagcccaggcuacauauaguuuuuugaauccauaucaaaagagaaaaauaccuauucaagaacuuugaaauguuuuaauggcaaauuuuguuaacacaagucagggguuauaaauuaaugauugacaucaucuaacaggcuuuuaaaguauaguauagacaucuagaaauacagggucuuucuuugauauugacaacaaaaaauuauggugaccugucuuguuguaucuuuggaugaaauuagaaaagcaauuuacuagacuaaggaaucauaguuuaaugugacacuuuuuacguuuggugguuuuauaggaaaagacaaguuauuuaaguuaauguguguuuuguuugcuugcuuuaacuguugcuaucaauuuuaugguacaguagaaacauucaggaucugaguugguuuauacaacuuuacauuaaaguuaaauagucagcaaaugacagacauagucaauguaaucuguuuugucuccuguuguggcacuauuaauaccuuuucacaagauuaguuucagcaaaaaacauuguuuauuuacuugguauauauuaauggaacauuuacuauacaucagaauuguagacagugaauuauaauaggcauuauaauuauaauagaauaugaauuauaaucgcaugcucucugcucucauaaaguauuagaguagauacuuagaacuggaaaauucuauuaauaaugccuaacaugcuuacauuuucauauuaucaggguuuuuaauccuggcuauauaaugaagucacucaccugacugugaaaauacaagugucugggcuuuagcuuuggaaauugagauccuguauauuuggauaugugcagagagguuguuuaaaaguuccacaaaucauucugaugcauuucaagcauuaaguucuaguguauccaucuguaauucguaagcuacuuacuuuguuuauguuuugucuggguaauuacuaugaauuaggagaguucauauacuaaaaccacagguugcacaaaugaagaaacaaagcacagaagaucagguacuuuauauauaaauagcuauugaauuuggaaaucaaggcugcugacuacucuggagaagucuuaagaaaaguagauuagaaaaguaaauugguuuuaucuuuuguauuaagggugaagagcaagauaaauuacuacauuuuuuccaaauugugacugauucucucuucugguuauugggaggucauguucaacugauacagaaugguaagaaagaaauacugcuuaauauaacuaaugucaugcagcauuugcuuuauaaaugcccaauuaaaggaacuauuccugaaauauaacuuucuucuauguuuagaaaaucugagagauggauucauuuaaguuugaacuguuuaggaaaguaauuuuuuaaaauuauaguuaguguuacaaguuuagcuuuagauuucuagagaaauccccauauacagaguaaauagaguuucacucauaaucugaaaggacaagcuguuauaaaauuuuaccaaacuuuaaaguuauuucauugaauauuguuuuacauugaaaauuauaaauauguauuaauuuuauguuuucauaggacuaaaaccguacucuuuuaugauaaucaugacacaauucuuacucuuuaaaaaauuuucacauuacauaaaugcuauaccaugguuuuuuuccccagauauucacacuugaaucuuuaauucuacauccuuucagaaucauucaugcauguaaagagucacauaauucuuuaaguauaaaagcacauuccuagggauuguaaucuauaccauuuaccacuuucuaaaggcuaccucuuugauauuaguguaacuaguacuuuugguaguuguagccauuuagcuaagugagugacuaaauacuuuuuuauuuaaaguauuaucuuuuuuccuauaauauauaucaaccauuguuacaaauuccuaauuuaaagacuuuuuaaacaaaaaauauaaggcuguuagacuugacuugauauaaaggcauauaaaggagaaagagaauacuugaaucauuuuuuaaaaugccauauuccauuuugaaaagaacuauaauaaaaugauaguauaucuaggauuaaugugaaaccauaauauaguuauaaaaauuuguuaaauguuuauaaaauuacugagcaaaaacccaaauauauauauuaaaauauuuuuaauaauauuuccauguaaaauguuucacaccuaugaagaaaguuacugaccuguaggccugggauaggaaguguauacaaaugaacuugaagugucuuaaauaccagauauaaaggaagcaauuaaacuuuaccaguauuaaaaggacucagaagccaacacacagaggccucuacuaggacuggugagcuggcucaacagauaaggagaggaauuuuuauuuucguuuaaaaggcuucugcuagccaaauaaggaaaaguugaguuaaaaguuuaauauaccagcuaaaaguuguguaguaaguuuaacacaccaaauguugcuguugaagccugccagagaauacauuauuuuugaauaaaaauuaaccuaaaucuaacuuuuauucuaccauauacaucaaugaaauuuuccucuaugugaaaggauuccauaaauuaaugaagagggcaugaaagaguagcaccuauuuugcaaucucucaugaauaagcagauauaggaauuagcuaccuauuccugucaacagcuuuaaaaagagacagcuaaacacucccaaucauuaucauaauaucacagauaaaauucaaaaccaaaauuucaaaucuccaucauuucaaucaucuaaugccaacuaccaaguuugaggaaagcaaagaaacaaauuacacuccaggaauacaguggcagaauuaaaccugcagaagcuagaggacaauuuacaugguuuuguuuucugaauaaauuacagaaaaaguaaaaauggaagaauaauugauuuuuuuuuaaagauaaccauguuucaugaaucuuacuagaaucuuaauugaaacaaauuuaaaaauucacaaaccacuuauagguuggaaaucuuaucuggcuucuugaugaaauuaagaaauaauuuucauuaagggauauagugguuuugcuuuuuuguuugucagucuuguuuccaggcuauguugcaauguuuauggagaaaauaaucugauggccuagauuuguuucaaccuacaaugaaagcagaugagaguauaaauaaaacaagucuggccaugaauuuauucaugguuaaaauuuauugacuugcucauggggaaucauuacauuauccugucuguuuuaaguaucuuuaaauuuucuauuacaaaaaaauuuaaaaauugauagguccuuuucuaacaaagaaaaaggaaaauuuaugaacuacaugccauaugauuuuaguaaauuucuggcuauuuccagagucauuaguaagaguaugacacaaauagaaaauacacuuauuguaauuacagggauuuuacuuuuaacuacuagagaaacaauguaaaacagaacuauguuuuuuccaugcuauuauaaaaugauauguaauggauaauugggcuauaaguauaacugaagaacagguguuggugugggaacaaacaaauagaaagcuacaguaguguuccacgggccagcuuauaacauaucuguccuuauuuuuaauuaaucuugucacucaacugacguaaggaacagaaacugacauuuauugggaacauaauauuuucuagaacauaugccuuugccuguuaagagaguuauuuauuucuaauuucacagaugaugaaaugaagauuaugggagguugucuuaguuaggguuacuauugcuguggugaaauaccaugaccaaaaacuacaugaagaagaaagaguuuauuugguuuauauuucuauaucaauguucaucauugaaggaaguaagggcaggaaccuggagucaggagccaaugcagaggucauggagggcugcuacuuacuggcuuguucaaugugacuuaacucagcuugcuuucuuauagaagcuaaaaccaccagagcaggaaugaccucacccaugacagacuaagccaucccacaucaauuacuaauuuuaaaaaugccccuacagccugauccuguggaggcauuuucucaauugaggaucccuccucuauagcuuaugucaaguugacacaaaacugaucaggacagagguuaagcaacuuauguagacauuaaacaccaaguuuuuguaacuggcuaauggagccuaaaaauuauaaaccuaggaaaauuuuuuauucagugaaacucauuuguagaaaaaaagauucagauuuagaugauguuauauucaauuuaaaagaaguaauaauaaaauuuuagcuugguauuuauagauggcccauuugacuauaacuaacuucauaaaaaugaaugacucuaacuaugaccauuuaaaacugcuugcaucuauaaaaaucuucauuauagggcauucaaugccagaaguuuagcagaaaugaucaaacuuucauuugauuuuaaaaaagacaaauccuuacuuagguuauuauaaaaucuuuaacauuucuuuuucucucuauucuuuuaguacugcagagugaucauuucuuacacuugcugcaaacugacaauguucagauaggagcuucagucaugacucugcuacagaauauacuacagaucaacaggugacuuaauuuacacaauuuuuaaucagaagcauuacuaauuuuaugauaguuugucaaaaucuacuacauaugacuuauacaugaaauuuaaguucucuuaugauugacuuuuaguaaaagguaauauaaaauacuauaaaagauuagaaauuuguuaucaaauuauaaucuaaaagcuauagaaaauuucaggcuuagaaagagaauuuuugugacaccuaaagaaaaauauugggaucacaguaaaaaauguuuacuuacauauuuaauaagcagcaaauuaaauaucauaguauaugcuaaaaaauagcauaaaagaaguaauagguaauucuuaggauccaaacagaaagaauguacuuaguggaauuacucauuuuuucacuugaauauggguuuauucaucaggucucauggaccacaauuacuguguuucuccuaguguuuacaauguuuauuuggauauaaucuugucuucaaugagugacaguugaauagugagacagaaaucauuacauuuugguauauuaauaugcaauguuaauguuauccacaaauguuaagaauuguauucuaacuaaacugagugaagaugcauccuggagaaguuaaagcccaagaugaaacuuugaagauaaauuguccagggaggaugaggaaaaagcaguauuucuaggcagagguaacugcaugagccagcuuuguugucagacaacagagaagcguuaugcugugggugaaaguagagaagauuuguccugcugggauuuaaaguucaguaucaguuuauagccagcacauuuugaagagacuugauauauguuauaaaagcauaucuuaaagacaaaaaaauggaagauuuuuuuuuaaguagaugaguauagucugauuacauuucaguauuauuacucugguuacugauggagaaaagaugagagcaaaacuagauaaagaagacaauuggaagaguagagguauuuuaggguugggacacuugccuuggauguuaaacauccuaaauuuuuugcccaauaguggggaaaaauaugaggcagaaccauagcaauucaaguaaaguaauaaagucuuggaagugguaauagggauuuuuuuuuuaauuaaaaucaccagaccuuuguuucuacuuuagauuaaaauagaauuacaaggaugaauuuacuggaccauuaggggaaaagaaaaagacaaauuaugaaggaucaauuccucaauaaacugaacacgacucaguauaugaaugaaaaccuagagugggauuggggagaguaaguaaauuuaggguaauuagcuuucugucauuguaacaaacuacgugagauaacagauauauacagagaaaagauugacuuuggcucaugauuuuggagccuccaguacaugacuauuuguccugguuugagccuguagugaggcaguguaucacagugagaacagguagcagggcaaagcuacucacuuacagccaugaaguaacacaaagagagaaaggaccaugccccuaaugaucuccaggccucccaguaacgucccacuccuuaaacauucagacaguucccaauagcuccuuccucgagacugagcuuugcauacaugagccuugggagcacauucgagauccaaacuguacaaaaagcuucauagcugcccugaauuaguacuaaguuuuuaggaugucguauagcaggaaaguuugaguucaagaaauaaauuaauuaaauuaaauauaaaaacaaaaaacaaaaaaaagaaaaagaaaagaaauaaagcugagaaucuaagaaaaacaagaugccgaaaauuuacaagacaaaauacuagcaaagaguuauauuagagaucuauagauggguucucuucaaaaauguaguagaguaccaaucaacuuauacauguaaaaaaguacccacuucuuuuaaauaugagggaacauuuucuaaaaggcauaucuagugucuuuaacucucaguaaacuuaagaggauuuaaauaauaacugggcuauaacuggaaugagguuggagguuggacaugagugaugugcagaucucugaaaaguaccuaaauaauguaacacaauacaccuacguaacauacaagacaaagaagaaacugaaagaaaaauaggaaaauuuuuuaaauaaacagauugugaaaauaacaugagaauuucugagguacaucuuaauucaaacaauacuuaggagaaauuuuuuauuuuaaaaaucucaacucuuaaccuaaagucaaugaaaacaauagaaaagauaagaaagcauaagcugaaucugagaaaaugaaugaaaugaaccuacagcaaaagugguuaggaaagaaacagagcuuccagcaacuuagguaaaaauuuagaggaacaauaucauuuacugucauucaaaagucacaaaggagcaauaugaacaacuuuaugcuauaaacuuaacaaguuagaugagauagacaaguucucuuuuuaacacugcauuuuucaauuuguuuuucauacaauacugaaugaaaaaaaaguagaaaagaaaggaacgugauuguuccuagguaugguggaggagaagauuuacuguagaaugugagagagcauagccagaagcagggacaucugggagagccgagaguggacaugacccugauccaugugaggaggggggagggggaaggagaggagaaccagguacagcagcgucaaugccuaaagaguagacaaaagagccaggugggauuauauaggaaagggcagcccagcuccuagguuggagaaguuugggguaggggugggguaugccaaccaagagggcccuguaacagguaucuacugaggaaugcagagagaaccuggcagccagcaucuacuuugauguguuacauaggcaccucugccauuugucccaggcuugaaaccuaaacauacauuuuuauuuuuaauuuuuuucccuuuucaagacaagaucucucuguguagcucuagcuguccuggaacuuacucuguagauaagguuggccuugaacucagauauucaccugccucugucucccaagagcuaggauuaaaggcgugcacuaccacuaccacuaccaccaccaccaccaccaccaccaccaucugccuggcuugaucaagauuuuucgccuuuccuaguuucuuucagguccucccuaccucucccuaguaccuagcaaacuuuauguucuuuuucucucuuuaaaaaugaaaaaaaaaucaagaaacacagaaccccacuaaaaaccagaaacaaacauaaaaacaaagaaacaaaaggccaguaaaacaaaagcccaaacaaaacagcaaaacaaaaaguucacaauaguaauaaaaaaaugauaguuaaaaaaaugucaaagggccgggcgugguggcgcacgccuuuaaucccagcacucgggaggcagaggcagguggauuucugaguucaaggccagccuggucuacaaagugaguuucaggacaaccagggcuauacaaagaaacccugucucaaaaaaaaaaaaaaaaaaaaaaaaaaaaaaaaaaaaaaaaagagaaaaaaaaugucaaaggaaaugaaauguucuuuauaaauuaagugcauguaugucauuuauuuguugaaucuuauugcagucuuguaauuugucaccuugaagacuuagaagcacuuguuuaaucuuacaguuuuuuaaauuuucaauuuuauaacaaguuucucugagaggaaagaagggaccuucauuuacuuuguauuuucuauuggaaauagaaagucuaugguuuccugcccacaguaggaaaucugaaauguuaguuggcuuaauaucuuagaauccaaauucucagaaccaaguuauaugcuuuaaaagguggcuaucuucaugaacuaggccaccauacacacaggcauuuaaguuacugaaacuuuuauuuuaaauuuguugugauaaccauauaugaauuauuaauuaugcuuuuuuauucuauccuauuagugguaauuuacucaaaauagaaggaaaagcccugcauucuauuuuagaugaaauucuuuucaagcuuuugucaacuccuaguccagucauaagaaguacugcuacaaagcuccugcuaguacuggcugaaucccaucaggaaauuuugauuuuacugagacuaagugccugcuauaaagguaggacauacauauuuucuuuauuugauauuagcaaagacaaaaauguauugauaguuuaugaaugguaaaauccuuauauuuugaaaaguuaguagcugaacugugcaggcaaaccuauuacaacauauaccauuuuagaacagaugucacuauaugaucaacagacaacaugcauauuuuguugaugguguucuaauaaauguuuaaucccuuucugacaaaaauauuuauauugaacauaccaaauaguguaauaaugaccaaagaugucuaugaccuuaucaauagaggagaaaauacaauugugcauuauuaucagguaauaguuaauuccuuacuuuuuacuuccuuuacucaaaaaauauuauauacauacauauaauauguaacauauauaauuauauaacaauuuuauauaucacauauguaugauauuuguucauauuuuuaguauauuauauauguguguguuuguauauaccauaugaauauauaucacauccaaacucaaauacauugauuaaaaagucauaagccuuaagaguaaaugaacucauuguuaacuaccauucuugugugaaaguguuaauuuaauugaacacuuaacugauuguaagacuauccuccauacuuacauuucauuccuuuaguauauuggauauucuuauccguauagacauggaauaagaggcaugaaaaaauuaggucauuuacuaaauacuaguuuaccaacuaccauccaaaauucuauguuagcuuuauguuguuuuuuuaaccaauauuauuuauauucaguauaguaaaauauggguuucuaguucauuaaauaugcuuaauauagaaugcuucauggcacuuuuaaaauugguagggucuguuaauuacuaaucaauuagaauaaacuuuaaucuuaaugauuugaaagacauuuuaguaacuuucuuuauuugucauuaauauagauaauuuaauuauuuuauauauugcaagaaaagagaauaagcaccaguauuagaccucuaguuguuauuaugccagacauacauuuuuucaauacugcagcuagauuucuacagaaauaugaacguccauuccaggcgcgguagcauacgccuuuaaucccagcacuugagaggcagagacagauagaucucugugagcucaaggacagccuggucuauguagugguguacuaggacagccagagcuacauagugagcucugucucaaccccaaacucuaauaaaaaagcaaaagcaacaaaaaaguaaaauugaccuuaauauucuuugauugauaaaauugcagcaguagaauuuacucaaguuuacuaagauauuuugcaguuguaaguguugcugagaacuuggaucucaaagaauguauaaugcauucaaagauccauaugauggcagcuuauuuauauuuauuaucucacauucuuuagacucaaagguuacaguguaccuuuuaugauacuguguuauuugagaauuaaaaugcaguauccuaaugucauagcacuuuuacuuccaaauuauagauguuaguuuaagaagaauugguuaaugaaacuuguuaauagcaaauaauaauaaccugcuuaagugcuuccacaagguaggcauacauagaugauauguuuauaauuuauuuucuuaagaauguuucaguuuaagauguuuguguugaaaagaaaacaaauucuuuuuucucugacuuauugcaauuauuuuagacauuuuuacauucagaugucacaagugaaggacauaaaaaugaucagaacagaggaagauuggaaagacuucaauauagaaauuguugagaaaaagaaaaaccauauacuuaaucaucuuguuauauuuauucauuuucaaaccagacuuuaacuucauuaauacuuagauaacaaaaaaaucuuacuuuauugauaauuguuuuguuuuguuauuauauuucaggacuuagaagucugcuaaauaaacaggaaacucuuacagaauuuagucgagaacuuagacagcucguugaucuuuuaaccccuaagauccaucaggaaguagaagaacagguauuauaaaaauaauuugugugauauuugauaacuguauugaacuuugguucuuccuaaauaugccucacuuucguucucuuaacacuuuaagcaaaauauuauuccugcccaguagauuucaauuucaacacaauuucaaucucccuuuuauaucuauuuauacauuugagcaggccaauuuuuuuucaugaugucucaugaaauccccuauuuacuguuuuaucaguaagccauuuaaacuucauuuucauuaaaaauaucuaucauuuuacaagcuauauauggccaccuguggcgagccuuucuuauucauugauacaaaauaauacauguauaaaauuauguuugauaugugagagguuuuauuuuaucacacuuccucaacacauacucaaaauggaggcuccagcuaacuucuguagaaagagacacacuuuuaugauuuucaggugaggccuuaaaauaaauaugaaaaauagucuaaaauaauaaaauauauuuuuggaguaaaaggaaaugagauaauucuguaccuaaaaucuuaaaugguaauugaaaagaagugcaguuuaggcaagagaaugaaaggagaaauuuggaaggaagagaguaaaggaaaagaauuuuacuuccauagacuauuuucaacauuauacaggugaugaacauacucaaaacagcauccuaaaagcuuacagaauuaaaacagauuugcauuacuacacauacauagucagcagaacuuacauagucuaggccuaaucaaguugauaauucuaaaaggacuggagcaauggcuuaacaguuaagacuguguacugcucuugcagagggccugaauucuguugucagcacccauguuggauggcucagaaaugccugcaccuccaguucuagggggauuuaaaaccucugccuucuacacaugugcaugcacacacauacgcauaauuaaaauaauaaagauaaaucuuuuaaaaguacuaaacauuaccaagauagcucccuggccaugguggcacauuuaauccuggugcuucagaggcuagggcagcaggaucauaauauuggaucaacauuggcuaucuaacaaaauguaguuucaaaaacaaaacccaacaaaacaaaagacauuagcccaaaauaguuuaugaaagauuaaggcagaacugugaaguccuugaaaaggaaguaagaucagaagagcuaacuagacugucuugaauauguucuagauguuaccugagcuuagcaucuuaugucuggaaagugagauauagugaguuuacuuggacguuuugggccugaugaacuucauguuucuggcuacccgucugucucagaugaugauuaccacuuauccuggccugcgguuuuaaaagauaaacuucucaaaaagacuuuuuuagagauguaucaaaauuauuucugguauauaauuucagaaacuacauaaagcagcuugcuugauucaagccuauuggaaagguuuccagaccagaaagagauuaaagaagcuuccgucugcugugauugccuugcagaggaguuucagguagaaaacccaaaccaaacuguugguagaaaugauaaucuagcuuugcauguaaauuuguaaucccaccgacccaccaaaaaaaaaaaaaaaaaaaaaaaaaaaaaaaaaaaaaaaaaaagaaaaaaagaaacaauauaagagcauuaccagagcacaguuaaaugcaagugggagaggggaguguuugugugugugguuuuuucuuuucuuuuuacuuuccuaauguguguuguuuuauucuugucuuuauucuguuccauaguguuacugaguaccaacgcucaaguaaccagguacccuuucagaacaaagggcauaauaagacaaaucugauggaauccaauacucaauccuguccacuuccuauccagguuugugggccaauccugaagagggagccagugaaauuuauauuauuaaauccucaaaaccagcagugcucauaagugcucauauauagaauuauauuuguggauacauaaagauuaaagauguuaaccaagauuuccugaguaaauauggcacggguaacugugauccuuuagauaugacaaaacugucaaucucuacaucaguuauauugaaaaaugugggucacuuucugaugacuaaccuagccacauucuuaaagguuacagaacaaaccauagcaaaaauaaauuuaaaaaguaguuaauacugauuauaaaguagacccauucagagguaacuuuauuuucauucaucauuacuuaaagcuaaauuuaacucacuaaaaugaaacugacauauuacagaaguaaccuuuaaaaacugaaaccacacuuuuaauaauugcagcugcauuucuguuacaaaaacaucuaaaaauaacuucaaaauugucacacaaucacucuauguuauuuaguagauauccuauaaaaacuuucuucuagacaaauuuaaagacaaguauuuuuacuuuugggcaugaguauuaucagcaaagaaaguaucaaguuuucaaacauucaucaaguagauugugagugugugugcacguguguguguguguguguguguguguguacacaugcauacauauacauacauagagagaggggguggaaaaaugugugaguuuuauuuauguguauauuguuuuacauauauaguuauaugaaaauauuccaaaauugugcguguguguguaugugcauauauggaaagagagaguuacagacuugaguuuguaacuggcuuuagcaacuugacaaguuaucaaaauucuuagccucaaauuucaaaucuagaaaauagagauaaugccuguguuucguagcacaggccaguaaucucaccuacucaggaaacaaaggcaggaagaacauauguuuaaacccagccuggauuacagaaugagaucaaagcugcuacugcuggacaauuuaguagagacccugucucaaagaguauaaggaggacuggauauaguucaaugguagaacauuuaccuagcaugaacaaaccuuagggugacuucccagcacuguaaaaauuaaaugaaugaauuacuaaaguucauguaccucacaagguugagauaauacauuuaggauaauuuaaaagguuuuaguauauggcacuuuaaaaauaggauugaaaaauauguauaauuucugcccuuaauguauacaauucuagauuaggguuuaguuuaaugauagaaugcauaguuagcauaaagucuaaucacuacacugaaaagaagaaaaccucaggaccuaaggauugugagcucauuuuuguagaaguguauguacagaaucuaauuaauacuuaaucauuuuaaaaauuuuaaguuagcauacagaguaaugaauuucuuuauagcauuuucacacacacaugcuguuaaacuuuguuuucacucacuccaucacuacacucaccauacuccuugucuccaccucuggcuaguucucuucccuaccucaaauagacuccuuuuuucuuuaccucuccuuacgauaccauuuuccccucucacagucguuuuuacaguuucauuaaauguacacacaaaauuuaauauagguucugcauaauugucugagucuagcuuacuuuaauuauuuccaguucuuuucauuuuaugcaaauuucauagcuuuguuuuucuuuauggcugaauaaaaccauucuauauauguaccauauuugcuuuauccuuccaucuauugauaaauaucuauuucuuagucacuguaaagaaugcaucaauuaauguggauauauaaauaugucuaugguauguuaacuuacucauuuuguuuggagguuauuuuguuugaggauaguguuguuuuauuuuauugagauggugucucauguaaccccuucaggguucaaacuccuaauuuguuuuuuugaaguauuuauuuuuguucuugcuuuugggagagaagaaacauacuuuucaagcaugcaaauucaucuaaguaaaauaaauacuugugaugcuuuacauacugacauauaggaaauauggaagacuagguugcaguagucaaacaauuugauaaauagcagaaaauauagaaauuauaaugaaauaaaacaucuuugaacacagaagacuuuauagccaguuauaaaacaguauguauuuaguaaacaguugaaaaauaccuguaucuggaggcagacuagaugacuaauugggauaaggaugucugucauccagccugauguguuuuagaucuacaggaucagcguuuagagggagaaaccugacuccuucagguuguccucugaucacacaugauucauggcugacaaaugcacacaaauagaaugcauggacacacagagacaauaaauguaguuagaaauuaacuuuuaaaaaaagauuuauuuauuuauuauauguaaguacacuguagcugucuucagacacuccagaagagggugucagaucucauuacggaugguugugaacuaccaugagguugcugggauuugaacucaggacauuuggaagagcaggcagugcuguuaaccacugagccaucucucuagcccuggaaauuaaauuuaacaaaaggaaaaauagggguguggagagauguuucagcaguuaagagcauuugcuacucuuguagaggaccugaguucaauuuucaguacccagaugguggcucauauugacaccccagucuggccucuauaggcaccaggcaugcaugucugcucaugcagacauacagacagauaaauguaaaaaacauuuauuucucauuuuuuauaaguauuggguguuuugccugcauauaugucuauguaccacauguauuccuggugcuuguggugucaagaauaggguaauagauuuuuuuggaccuggaguuagacaguugugagccaccauguaggugcuaggaauuuaacuugggacuucuggaagaacagcuggugcucuuaacuguagagccagcucucuugcccccauaaaucuuaaacaaaaggaaaagugagagagagaaaaaaaaguaaaaguuagauauaauuauaccauaaaguaaaaaccacuauugaaauuuuaacgucuuuuaaauaauuuauauuucuauguaaauuaauacaauuuuaguacaauuuuuauucuuauauauauauaauauguauauguuuuuucuuuuucuuuuuuuuuuuuuuuuuuuuugguuuuucgagacaggguuucuuuguaucgcccuggaacucacuuuguagaccaggcuggccuugaacucagaaauccaccugacucugccucucaagugcugggauuaaaggcaugugccaccacgcucggccaauaauauguauauauuuuaagacaggcuuucuuucuuuuuuuuuuuaagauuuauuuauuuuauguauaggaguacacuguagcuaucuacagacauccaacagaugguagcagaucccauuacagaugguuaugaaccaccaagugguuucugggaauugaacgcaggaccucuggaagagcaaucagugcucuuaacugcugagacaucucucuagccccgagauaggcuuucuuuuuguaggccuggcuguccuuggaacuugguagaccaggcuggccuuaaacucagagaaccaccugccucucaagcacugggauuaaagguguaugccaccaccacuuggcauauucuucuauauuuucauuuuauuuucaacuaacaguacaugucacuacguuuuuugcaaguuuucuauuuuaaaacuaaaauuccaucaguuagaugacucaguauuucuuuauucaauccacuauaaugagauacuuuucgguuuguuaccacuauaauacuaugcuacaacauccuugaucaugccuuuauauauuugauuauuucaguaagaaaaauaauagaaguagaauuggcugaucuguauuuuuuuagccuuuuuauuuguauuuaaaauauuucuucugauuuuugauauauuuauucuaacaucucuagagaaauuuauauauaagaacaauguauuucauuauaccuuugucuuaggguuuuacugcugugaacagacaccaugaccaaggcaacucucauauggacaacauuuaauuggggcuacuuacagguucagagguuuuguccauuaucaucaaggcaggagcauggcagcauccaggcaggcauggugcagaaggaccuaagaguuccauaucuucaucuguaggcugcuagcagaauacuggcugcuaggccacuaggaugagggucuuaaagcccauacccacagagacacacuuauucuaaccaggccacaccuaauagugccacucccugggccaagcauauacaaaccauuauaacccuaccaaugcuaggaguuaucuuccagaacauuuuugucuuuacuuguuugguuacucuugagaucaagauuuuucauguauuucuugauggacaugguuuauaaaauuguauguaaggaacuuacucuuuuucuuucacagaucuaaacgaacaaagaugauguuggagcuaaauaggcagaaggaagaagaagaccucagauuaaaauugcaacuucaaagacagagagcaaugaggcuuucacgagagucacgcuugaacaugcuugaaauaauucauccaggugaguaauaauguaaaacuguuagaauagcuuaaaccaaguuuuccucuuccuugguuaauuuuuuuuugaaucuucuugccuuuucugucucuauuuucuuucccuagagaaauaauacuaaaguucuagauuuuaaaaguuacagcuuuucugauccauaccuauaauuuaauuuuuuuaacuuucagauacauguauuaaacauaaauguuuauaauuaaagauaguggucaaugacauaaaaaaaaucuugaaaaggauccagucugucaucugcacucauucccuaguauaaaaucugugacaucuuaacauuugugacagaugaagcagaauuaauaagaacaugcuauggugguguaucuauguguacacguucaucugugugcauguguauaucuggcucaagggcaacguaaggcuucuuccuccaccccucuccacuauaguuaggaucugggcuggcuucaguagagagcuaaggaugaucuugaacuuucacccuccugcuucuaccucccaagugcuuggauuacaaguguaggccacaaauucugacuuuauucauugcugaggacugaacccagagccucaugcaugcuagcaaguacucuuagcaacugagcaaugugucucuccccucaagcguguuucaucauucauuaacuucccuuauuacucauucccaagaacauuuacucguucccuccuucuuuuuaguuuaaauguauuuuccagaauuuauccuuucucaguuauucucaaguugucucgcuugaugugucccauccauaacuauacugucagcuaucagcaaaaugcuuagcacucucauaccuggccuuccauccuacuuucucuccugagcagugcuaagcauuccuaacuagcagugcccaauaacacauuuauguuaucauugaaaaguucuguuuguauuaaccaauacaguagcaauagcuagaaguagcaauugaguauuuaaaaugugcuacugcacuuguagacuuuugaauguuuaauuuuauuuuauuuaaaucuccuuaguagccacauguaucuaauagcugcugcugugauaguuuucuuugcaauucacagauaguuacaaaacuaaagucuuacucccaaauuuucucuucauugauuccccauuucauguaaugccaucaaaaucuguucaguuucauucaauauccuuacuuuuucuuugucacucuucuauaucaggucagcuacaaauccaauuaguuugcuuuaauauuauuuauuuuuauuuauaugaguacacuagcugucuucagccacacaccagaagagugagugcaucagaucccauuacagaugguugugagcuaccauguggcugcugggaauugaacucaggaccucugaaagagcagucagugcucuuaaccacugagccaucucuccagcucccaauuaguuuuuuuaaauacucucucuaagauaccuucuuuguauuaaccacuggugcuguguucuacagcuuuguucuuuuauuuaacuauggugaaccuugaguuaaauaugguuuaugcucaccaacuccaaagucaagagaagcuuauuugugugaacaaucagaaguuuggauuacacagaguagauuaaagagcacauaaauacauuuuguucaucuucccuggucauuccaaaugcuuuccuacauagauucaugauuuuuuuuuuuuuuuuuuuuuuagucaaacugguuuugguauuggccuuuuaucccuuuucuccuuacucugggacgacaauauuaugaguccuuuuuggaaagaaacugcauauucuaggaaagcuuuacuuucuacaaucuuagaacuauuauaaaaugaaagagauuggcaaauuagugugaacaguauugacaaauacuuuuuuaaaaaagccugcaaaaucauuauuaguacuguuguccuaauuucagaccucgagaccuugagaaaauauagcugaguauguuauaauaaugucugucaucucuuuaggucaaguggagaaguacaauagggaaauggaagagaaaucagcauugacuauucagaaacauuggaggggguacagggaaaggaagaauuuucgccaacagaggccaucucucacagaguauaaagcagcugucacacuucaaagagcagugagucugcuguaguauacauagcucuauauaaggaggcaaacaaguguucaaaauugacuuugcuguuuaccaaauauaaaucugugaucaagcccuuuugcuuuucugagcuuauuuucuuuauaaaauaagaaccuaggacuggaaguauagcucauuaguugaguacuucccuagcaugugcaagaaccuaggcucaaucucuagcaaccuaaauucaaacaaagaacaauaauaucaacacuuauuugccucugcucaagcugauuuagacacuaaguccaaguacugccuuaaaaucuuguaugccauuuacuagauugcaaccuuguuauuguugcuuauuuuucucuccuauuugaccugcaaauuccucaaagauagggaacuaauccuuuuauauuggugccagcucucaacaagcuugauaugaauggauauucuguuuuuauauacuguuauauacaucagaaucagaugacauacaugaggauucuaaagucuguaaauugcauagucuuaugcaaauguauauuuuauuuacuucuuuuaaaauaaucaacuuauggagaaaguacuagcuauaauuagaacauauaauuagaacucuggaauuguagaaugguauucauaugguaguuuuucuagggauuauguauaguaagucauauuauauuggaaaagcauagcacagggcuucuuuuucacuuaguaaccuuuucccucuaauaccuacuucucuuauacaucauuaggccucuauuaagauuucaagucuggggcuggagagauggcucagcgguuaagagcacugacugcucuuccagagguccugaguucaauucccagcaaccacgugguggcucacaaccaucuguaaugagcuccgauucccucuucugcuguguaugaagacagcuacaguguacucguauacaugaaauaaaauaaaucuuuaaaaaaaagauuucaagucugaaagcauguagcuuaaucaccuuuuuuauagguuuuacuguuaauucucauuucuuaccaugauaaauuuugagcacucaauguggguuaacauuuauaaggauguuuuaauuuucuaaauuguauguaagcaugugugucuaucugugugggugugugcacuugagugcuaaugcccccugaugccagaagcaucacgguaucugaagauaguuacagguaguugugagccaugggugcugagaacuaaaccugggguuuccugcaagagcaguuuguagucuuaacugcucagaugucuuuccauccuuaugaagauauuucuaaaccaucaaaaaccaauagaauaaauacuagggaaaugugaagagugaugugucucuuccuccucccuuauguuauauaugaaacaaacgugauauuuauccugagcuaaagagacaaggcaaccugaggauagcucauuuauauccaguuagagaugcuucuuuuuagagauauuugccuuugugauagcugcccaaccagauugauuugugggaaagccuguggugcauauauauauauauaauacucauucucauuaauauguucauauugccuauguuggaaugcuaauguuuuacauauagcauccuaggacuucuacagcugugauaaaaacaccaugaccaacugcaacuuggcgaguaaaggauuuauuucaucuuaugcuuccaguuaacaucacugagggagggaagucagggcaggaacuuggagguaggaacuagagcagaggcuauggagaaaugcugcuuccuggcuuaaugcucagccugcuuuguuuauucuagcacccacuaacuagcccagggauugcaccacccauauugagcugguccugcucaaaucaaucaucaaucaagacaauguucuauaagcuuuuccacagaccuuucugguuggggcauuuuuucaguugagguuuuuuuuuccagaauaacuuuagcuuuugucaaguugacauaaaaacuagcuagcacauauaauuauguuuuuauaacucagauauaaaauaauauuuuauauagcuacauggaauuuaaaauaacuggaauuuguuaucuguguuauauuucuauagcaauuuucauuuagugguuuguuaaagccaagcauuguaacaugaccucuaaaacgcugagaggucagagaaucccaugauuccuaagcuugaaaccauucugguuuacacagcaaauucucacuucaaaggaagagggaggcauaauuaaucaguuucauuaaaaauaaauacagaguaguaagguuauccuuuacauuuauuuguaucuuaggaacaauuguuuuuucagguacuuggcaacaaaagaaaaguuaaaccauuaucuaccuucucuuucuugcuugcuuuguacaaaagccaggaccccucuuaagacauugucucacugugccucccagauugcugaccgugaucuugaauuaucuuuucucacccuucacuacuaauauuauaguucacuaucacaccuaauugaggcaguguauuuuuuaguugauaaaaguagaaagaaaaaauccaaaaugauguguaguauauuauaucucuaaugcaggcacucagaagauugaaccaggaucucaaauucaagguuagccuagacuacauagcaaguuccaggcauuccugagcuauguagcaaagacauggcccccaaauaacgaaacgcugaaagcacuucaauuauuagacuucuuuauucucauagacaaauuaagaguucuugguagugaguguugcaguguuagaacuaaauuuaaauuuuacuuuugcauguuuuuagauguuuucuuuuuuuuuuuuuuuuaccuuuuuaaaaggcagcaguaguucagaaagaguuaguuggucucuagauccagaaggguagcuugacuauagaauacuaacacacaauguuauacacucauccaucacuaagcauccauacaaaggauuagcaaaauaaaccauugaaauuuuuaaaagccaaaaacaauggcagagaauaauaaaaugacaaaauaaaugaagauaagagaaaaacaucaagggaguuuuucugagugagguauagagugaaguucucgucggaacgucauaaacccagggugguacuaaaaggaaggcuggaagagaaaaagaugugugaccaaaaaaaaaaaaaaaaaaaagagaaaaaaaaagagaaaaaaaaagaaaaaaaucccccaaacagaagaaugaaacaaagaguaucucuuuugcaggugcaagcaccauacuaaaaaugaguauuaagggacauuuaacauuuaaggcaucauucaacccccuuucuucucagcuuucaggcuuaugacugcagauaguagaguggaagcauuuucuuugggaaaucugaagucugaauaaagucaaaguuuacuaacauugaaggauccaaacaaaacaacuugguucauuaguccuaugcuguaaugcauaguagaugagcccuuuauggcagcucaguaugucuaaauagcuuuuuagugcucaacuuuauaggccauaggcaaauauaagugaacaugaggaaagcugcuugauagaaauagaggauuuaauacuuagggguuuaccucagagaguagagcaccugaccagcauauaugagguccuacauucaaucccugacaguggggaaaaacaaacaaaacaacaacaaauauuuagagagaugacacaggaauuagaaaauaagauuaguuuuugaucuaucauuuccucugauaagagaauaugguaaaaaaucaacauguuuaaaagggaaaaggaaaaggguggggguggggggggaggcagaccuggguugaacaguuaaaauuuacuagaaaggauaaaagaaaauaaugggcuagugagauggcucagcggguaagagcacugacugcucuuccaaagguccugaauucaaaucucagcaaccauauuguggcucacaaccacccguaaugagaucugacacccucuucuggugcaucugaagacagcuauaguacuuauuuauaauaaauaaaucuuuguaaaaaaaaaaaaggaaaaaaauacuauccaucagagaaaucaaauacauaaguauuuaaaaucaagaacagaaaauauagaggagaggaaaucaaaagaauuuucuagaacuacagcauugauaaauguccaauacuguaacaaacauuuauuucauuuccaugaaauacauugagaacaaagaacuuagcagcuucacuggaacugaagaaaucuugagcuaaaacugugacaugucuaagagaagugauuucuaguuaaaauuaugugcucacugaaaagggaguuaaaaagaagacuaaagacacuuauauaaucacagaagcucuuaagccagugggaaaaccaagaagguauacagcugaaauucaagaaguacagggagagauaaaaugagaaaccaagguaguugugcagagaccccaggaugagcuuuguaccagguggagagaaacagguagguuagaaccccccagaaaauguaugugcuacaauaucugauauaucaaugucuugacaauuagaaugaaguuguagaacguaaucaagucuaaguauguagaaaaucaaacacauggaaaaaauaaguguuaauuucagagaaaauaagcaaggaagacaguguaguucuaauaugugcuccagaaugaguaauagcuuuucuugcuguuguuguguauguauaauacaagcacucaggacuggcacagcagaguuacagguuugagacuaauauagccugcauaauaaaaacccuguccccccaaaauaaaacuaccuuaccuuuauguaauaaucauuaugugaauguuauuuuuuacugaaauuacaacauuaauuauguagguggacuguacaugggaguauaugcaguauaaaguaaccaaauccuuauuucuguucaagaaaaucaauaaauaauauguuuaaucugugagaaaaaaaucauagaaaucuacugauggaauucacaugaaggaaaaaaaaguuaaaguuguugccuuugggauuuguaaaacugguccuuuaaacaacagaauuaggcuagccaacuuucucuggaaaggaccagauaaggaaauauuuuaggcuuugcaagcuauagccuguaauagcuacuuaacaguugaagcacaaaagcagcuguagauaacgguuagacuaacaguaguuaagcaaguauagcuguaugccaauaaaaauuuguagacauuugaguuuugacuuauacauacguuuacaugucguaaaguauccuuuuaaauuuuuagccauguaaagugaaauaaacagguauuuacuauacagaaacaacuuacuguuuuugaccuguaagcuaugacuugccaaucagugcuuuuaaaacuguauauaauuuuagugaaaauaaaaacaugggagaaaaaugaagaauugaaaagaauaauuucauauauguaccaaaauguauaagucuauuauggaagacuugagaaaacauucagaaaauuugcuuuuaucaguagucucauagcuuaaaauguuaaaauguuuuaucuuuaccaagccuuuucuuacuaucucuuuuauauuuggaauacuguaaaacauguaaaauuaggguccuuguuucuuauuggcauagagcauguccuauagaaaccauugguuugcccagaauuguagaguuuauaaggaauuagaauugagauuagaacucaauguuuauuuccuuuuauauacucauuucuuacugcaaacauaaugagugcuuaauaugaacucagagacuauggcagcacucauaggaccucuacaaguucaagccagaugaaaucccagcacugagaguggaaaguaaacauaguccccaucccuaaccauggaauugcuaccugcugauaaagugaaaaucagugagugucacuggguauccaugcccagguguagcuggccaauacaaaacuccauugguuuugguuuuguuguguuuuauuuugugggcucuuuauuauauuuuguuuuguuugggcauuuuucuaacuuuuuguuauuguuuugguuuuugguuuuugagagauuaaguaugagaacaugaaguuagguagagagcuggaaagaaucuagcaggaguuggggaggggaaacaauuaaaauauuuuuaaaauuuuaauaauuauauauauauauauauauauauauauauauauauauauauauauauucuaaauguguaaagcccuagguuugaugccuagcaccacauucagcagguggaaacaggaggaccagauagaguuaucuuaggcuacuuguugguucaaggcuugccuaagcuaugugaggucuggcaaaccaaaaaccacaguaauagaaauauuuagguguauucuuuugucuuagucuuagaaugcccuuucauucuauugcuacaaugaaacacgaugacaaaaaaucaauuugagaaggagagggcuuauuuauuuggcuuaacuuccaggucuuaauucaucauuagaggaaaucagaacaggaauucaaggagagcuagaaccuggaggcaggaguugaugcagaagacauggagggaugcugcguacuggcuugcucagccugccuucuuauagaacccaggaccaccaacuagcccagagauggcacaacccacaaugggcugggcccucccucauuggucacuaguugagaaaaaguccuacagcuggaucucauggagauauuuucucaacuugaggcaccuuucucugugaugauucuaucuugugucaaguugacacaaaaagcagccagugcaacuaaccccuugucaacuacacacaaaucacuauuaagcuacaacccuuacuuuccuguucauuccccaagaucuaaauaacuguaaaaccuccaaaaucuuuacaaauucaaacacauuaaaauuuugguucuuuuaaaguaucccaucucuuuuaaaauccagucuuuuacaguucaaacucucuuaacugugagcuccaguaaaauacuuccuucaagggggugggggguugaauucaaggcacagucgcaaucaaaucaaagcaaaaucaaacucuaaccauccaaugucuggaauccacccaugcucuucuagaccugagucauuccucuuccaaaggucacuucuccagcucugcccucugucgcacauagcuugccuuuuagcuuuggcugcuucuacuacugcugcuguucuuuugugaucaucccaugguaccaguauggccaaaacacuggagucaucugcuguaacugggcugcacuuucacaaauagcaucucauagacucucauagugccuagccucaacuucucugcauaaucccuucaguccugggccuucaacugcuaaugagcuguaccuucaaccaauggccuuccuggccucccagaauaccaagccccagcugcucucccugaccuuuucaugucuucaaaaccacuacuaccuguguaacucuuauacaguaccaaguccagcugcaacaugagguacaaccuuggaacacagcuucucugcacucucagaaaacacuucccagaagauuucaccucagugaugcugaucucuucuuaauccuugcuaaugucuuagcuccagcuaaccagcaucaauugucccaguaaugaaaaaguuccacuuuaguaguucugguaucuuguuaaucacagcugcuaauuguucagcuccagcaaaccagaaccacagaaucuuaaaucaaaauaauagucuugauagagucuuuaauugucccucugaaauuucacagguuaugccuccaucuucuacacuacucucaacauuuuuaucuuccaagcuccuacagaacaucccaaugagguuucaacacuacucauugucuuuucuaguuccaaaguccuucuacaaucuuccccaaaacauggucaggucugucacagcaauaccucaguaugcuggugccagcuugucuuaguuaggauuucuguugcugcaacacaacaccauuaccaaaaagcaagauggagaagaaaggguuuauuuggcuuacacuuccagaugauggaggaaaucagaacaggaacucaagcaggacaaaaaccuggaagcuggagcugaugcagaguucuugaaggggugcugcucacuggcuugguuccccugacuugcucagcuuaccuucuuacagaacucaggacuaccagcccagggauagcaucacacagcguuugagcccuccaccauugaucacuaguugagaaaauguccuucagcuggaucucauggaagcauuucuucaacugaggcuccuuucucugugaugacucuuagcuugugucaaguugacacacaaaacaagucaguucucuuuuuuaaaaaauuaaaaguguauauagucuuacgcuacuaccauggugggaaagugauguaugcuuaguagaaaccagacuucaacugguagagguauuaagcauauuugcaacuuacaaguauuuucaacuuaaaauggaguuauuugacauagccugguggcacacacuuuuaaucccagcacucgggaggcagaggcaggcggauuucugaguucgaggccagccuggucuacaaagugaguuccaggacagccagggcuauacagagaaacccugucuugaaaaaccaaaaaaaaaaaaaaaaaaaaaaaaaaaguagagguggaucuguauagguaaaaaauuauuauauuccuuuauuaugucacagucucauuccccuccucaugcauacucagaauugccuaaugcaaccuugguguuacugacuuagauuauaggaaaaugaguucuauuaagggaacagaaucaaaagaucuucuuuucuuuuccuuuuccccuacuucacuccagguucuuaaauuccuagcaaagugccguaagaaaaagaaacucuuugccucuuggcauggacuucaagaacucacugaugcacgcagaguugaacugaagcaacaaguggacgauuaugucaaaagacacccgguauguaguuucugugcugaaauacauguuacauuaauccauugcauagucuuuaucacuaaaguaguacagcauauauauugauuguuggaugcagguuccauagacuuaguagacuugaauucuucuuacaguuacaggauccaaagguauaacugguggugaaugggaacucaacuuaaaaauugguuauuuccuguacuauaccaacgaaacuugugcauugcuucuuuuauaauaguccuguaaaaucuugucuguuuugaaucuuuuaauaagaauauauuaauuaucaaucaaugggcauucauucuuaccuccauaugcucaaacacaugcauaaggacuuauauucacuagucuaaacucccaagacaguaagauguagaauuugaugcccuaccucuuugguuuucaaacuguaaugcugcugacaccuuuccacaacagaaacaugcauuucucugacuuugugugggcacagugauacagaguaggugcuuccugcuucuucccucugaguuucugaccuuacacuucugcacaucuuugaaggacauuucugucugucuugagaaggacucaaccauucuugauguuuccacacuugucaaauuuuauggaaaaacuaauaguuuauacauuuugaucagaauucuuacuuuccucauuugaaccaaccauucuuaguauaucuaaggacuacucacauuucguuaggauuaugcuaaugcuccuugugucugaguuucuuucuucccuuccuucccccuuuccccuucugauacaaacacaaauuucuacaaucuaaagucugagcucugaagggugauucacauuguuaauccuggcacucaggaggcaaauacagguagagcuuugugaguuugaggacagccuggucuacagagcaaggacagccagaacuauacagagaaaaccugucucaaaaagaaaaacaaaaacaaaaaaacuguagggugacuauguuaaagauuugauauaguauuuuauccuuccagagccuguccuccacaaaaugaaaagcagaauacaaauguaucucuguccauacaugaauuugauaaccauuggaacagagcaaugauagaaaguaaauuguauaacaauguuuaauccuaucuguauaagagguuuucaucauuguuuaagucuuuauagaauagcgcugacucuugucauaugcaccacauaguuaaugcccucaguguuuagccuuuaugacagcuauccauuucuauuguuguaggacuaaaguaacuauagaugaauaaaugaauagauauggaaguaucgcaacuaaacuauuuuuauugacuuguuuauuuaucgauugucuagaggucagaagacaaccuguagucaguccucucuuuccaccauguagguuauaaacaaacucaggucauuaggcuuggcagcacacagccuucacucccugagccaucucaccacugaaagcuauuuucuaaaauaagcuuuuguuuuuaguuugcugcucuuuguuuugaauaauaguaauaacuuauauuaaaauuauagucuuuguagcauacuaaaaaguaaaauauauggaaacaauaacauaaaagccaggagaagaaauacauguaugauuuaaauuccuguuuauaaauuagaaugauaucacucagaauuaaauugguaaguuaaugguacauaauacaaauccuacaacaaugaacagauaucaaaaaguaacaaaggaaaugaaaccaaauaaaaaauauguacuuuaauuaaucaaaaaggaaaauagaaaaaggaggaauguauaagaaaguaauaggacuaauaggaaaaaucaugguaagagccugaagcaugauuauguuacaguaaauauaaaaugguaugacuagauuuuaagaguaaaauuaaaacuaaacucugggcaggaaagaugacucagcaguuaugaacacuugcugcucuuuagaggauccauguucaguucccagcacccauaucagacaauuacauccaccuguaaguuuaguauuagagauccaacaaccucucuuggccuccgugggcacuguacacacaugguacacauggaaacagguaugguacacgcacauacauaaaauaacuuacaaggaaggcuugcauauauucaagacuuuugcccauuuucagaucagguugcauuuuuguugaugagcugaugaauucucuguauucuguuccuuaucugauaaaugauuuuauuuuauucuguggcuugcccuuuuaacuguguguccuuuaauacauaaaaaaaccuuuaguuuuaugaaucucacuuugccuuuuguuauacaauuuuagcucuuauuuucaguuuuugggccuuucuucuuucacagguacucagauuccuuuagucaaaugguauaguucuuccauauaagcuuuguauaucuguguauacucuuccucuagguuaccuacauucucuaaucaaaguaaagacaguguaaauugauguuugaguguauguuuuagaagguugugauguaugaauuuaguguauaugcaguauuuucuaaugcuuugguucuuuaguugaauaugagucuagaucucagacauauggaaggaugaguguaagucuaaugaauaccccaguuugucauuuuuuacuaugcuuugauaaggucuguggcugaaagaugaacuaucaacuggaacagaacugcauuaguauuuaauaaagcuauggugucagaaauuuuaucagcuuuaaggcuaagauuauuucauuuuuauccaaauuagucacuaacaucacccuuaaauuauuugaguagucuaauggauagggucuuuuagcugauuuuagccucucauucugugaaaccagcaccacuuagagcacuguggugagggugcauuuggaguaggaaugggauaagaaauaauauuucaaaugaaguccaaaacaaaaggaguugccuucacuaaaccauuuauacuuucauuguggucuccuaaucucagggucucauuacuuaccaugucuuugaagaaaugauguguggaaggauaccaaaaagaaacauggaggcccagagagauagcucagugcuuuagaauacuuguuguucuugcacagguuccggauucaguuccuaacaccaacgaaguaacucacaacuaucuguaacucuagcuccaagggaucugacacccuguucuagcauaggcauagacacacaugugaugcacauucauacaugcacacacaugugaugcacauucauacaugcaggcaaaacucauacauacaaaauuaaauuuaaaauuuuucaaaaagaaacuuguccaucuauaucauuauauaaaguuaggguauaaguuacuuuuguuuaaaaucugcuuuguugauuuaauggauucuuucuuguuccuguuguuagguuguuugcauacuuguucauuucucuuuuagguuuuuugagacaaggugucacuauauagcccagauugauccuaggcuuaagauuguccuguuucugcuccuguguuaagauuacaggcaugaauacucacaacuuaugugguuuuuaaagauaauuuaauacuugcaccaguguacaaguuagauaagagcuauaagauucuauugauaaaaugggagauugcuaaaauucuagcucugcuaugguggguagguaaagcauauuuugauacauaaugucuuuaugacaaguuuucuguccuauguuuccagugcucucagaugucagaggcggccagcagagagcuccaugcacaagcacaagaacgacuucagcacuauuuuaugggaagagccauagaagagcgagcccagcaacacagagaagcuuugauggcucagaucagcaccaauauugaacagcugaugaguaugcucuaccuccauccuuguuucauaaauggaauaccccuugcaagagauguggcauccaaacucuuuagaagaaaagugccacaaguagucuuuauucagguccucgggaagucuuacaucaucccaguuuucaacucuauaccuucuguuugugcuuguuauaaauucaaauauuucagcuucaucaaaauuacuaauuucaaagaaguuauaaucuucuagacacauuuucccaacuuuuaaaaaauguuuuuguauuuuagaauuagauaauaacaguaguuacguacaaugaacuugucaaaaauaacgauuaauaaauuuuuaucgaaguuucucucuuuaggcuaucuaacacaauuuaucauuuuucuuuuaaagcuggaaguugccagggauugggguuguugcuaucacccacaucuguaacuucacuagaaaccuaccuucauaguuagcagugacagcauauucaguuagaacccuguccuguccugacuauaaacagcucugcuguuuccaaguugcugcuugccuggcauacuuuccacuaacccauuuccuuucuguuugcugcagaggcaccaagucugaaggaggcagaaggaaaggaacccgagcaauuccuaaguagaucuaggccuguggcagccaaggccaagcaggcccaucuuaccacccugaagcacauacaagcacccugguggaagaagcuuggagaagaaccaggggaugagguugauguuccaaaggaugagcuuaguauagauuuaggaauguuauuuaucgguggaaccaaaccucccuagagaguacugugaaagcuggcaaucuuaccuuuuaagagauuguuaguuuugccucuggcaugcaggaagacuagggcuaugccaguggcuuuccagagcaucaucuucaugcaacacuuggaagcaaaaagcaaagcauugccuaccucacucucaauucuuuccccugucucuaugcccugucugugagcuuuaauugugggagagaacucaaugugaaauuuuauuguuaauauaucuguuuucuaacuaaaaguuguuuugguuuuguuuuaaaauaaauaguguuucuaaaaaaguugucauguuauuucaauguuuuacauuugcuauucagaauuucuuauuaauagucauauauauauaauauaaaaauaauauuuauuuauuuuugagauggguucucuguccuagaacucuggcucuguaggccuuuggccuugaauuccuggagauccgccugccucugccucccaggugcugggauugaaagcaugugccaccacugccuuuaugguuuugaccuugacaaaguuuagaaaaauaauugaucaauuaaauagcauuacauuaagaaagacgggagaagagaaagaaacaguaguuuauauuucauauauaauaguaaaaauaaugcuuuuguuuuuuuaaaaaaaagucucacuauauagcucuggcuggccuggaauuaacuagaccucacaguucuaccugcugcuuccucuuagugcugugauuacaggcauguaccaccauaccugaccacugcuuugcuuauuuccuuuuuaaaauggugaaauggaaaguauguucaauuacugcuuguuugugagcgugugugugugugucuauguggggguauuuacucaaaauauaagggguuguuugagcuugaguuacugguagcuaugaggcaccagauauugggacugggaacccagugaguccucuguaagagcaagugcucuuaacuacugagccaucuuucuagcccucauacacugcuuuucaauaaaaaaaaaaaaagccuuuaauuggccauuucuuuuucuaacuugugauuuauugguguauauuauacuugugguauauaugauauacuuuuucauauauauacaaauauauaugugauaguuacaugcaauuuacauuugacaaauauuugaauaaauguuaaguugaaaauaaaauauguuaucuggaagacaaauuagugagaggccaaacaucuuggaaccugccuccaucuuaaaaggaaaaacuuggcccccacccgaacacaaguugcaccuaaguaccaggaaggaccgaauggcuuguccuuagccaguuacccccuagcuacuuccuagcaacagauaaucaaagguuagucugauuguuucagauauacuuucagaccuuuagugguuguauacggucuugcuucagagcaccuaccugucggcuuacaauagacaauugcaugcuugcaaggcuggacccucccucacuuacuuccauuuccuauaaacccugucccagugagaguuuugcgcugccucaccaaaccguccugugggccgguggugaguaagcccaaacucgaguuuguaauaaagagacccuaaugugauuacauuagaaacggcuccuugguggucuuuugggguucacaaaugcuucuuggcacaacauuggaagucuugggaugucuauauuugguguaggggaagaugaaggaaggccuugagagggaacuggguaacagaaaaucagaagagugagaccauuucuuuuguuacaugguuuuauucuuugacaguucacacauguaugcauuuugaucaugaacacucuuauuuuccucagucccucuagaaaacucucccagcacuccacccccacuuuuaugucacuaaaagaaaaauaaauacauugaguuuaauuaggguugcuuucauguauauaggugagggauugauuauauauccugggaaauuuaccgauggugacaucauuaaaaaagaaugacuccccuccucucuucccuuccucccuccucaccgccccccccccgcccccguaaaucgcuuuucugucucuuguuggagcuucuuucucacugacuccucacagagcccgagcccuuaaaucuguuugcuuaucccagcugaagagccaauuccuuaggggaacguuucaacucuuaaauacugucucuuacccucacauccugagugauguccugugacgucagguugaaaucggaguuccguuacuaaaucgcuuucucccccaucggaaggaccaaguuucaggcucuacuccggguugguucucacaaaaucgcaaauacuagcagcuggcgccccuaguccaaagucuccucagaagccgaggccauaguccuuagugggaacagc

SEQ ID NO: 12546 - RNA, 7292 nt, Mus musculus
aaagcauuuugcacaauucugugauaaaaacaaaaacuggaauacaagguuaugagguuucugaaugggaaaagcugaccccaucaacugaaauaaaaagauucucauacacaagagaggaacucggggagaacaggguaaauguggaaaggcagggcuaaacgcauccaagggacuuguuaucucagaacucuucaaacacaaaauuaggauucuugacucucaaaaggcugaagagacugagcuucagggcuacagggaaagaaaccgccagaaacaaaccaccuucucccuagggaucuaauacagggucuucuuuugacccgagagaauacaaagcucuuccggccucuucuagccgcugucgguauucgagcuucucguaguuggcgggauuuacgccuuuaaagccguacauaacuccccaccagcagccagcaauggcggccguggaaucacugucuccaccguggaagaaggcucugugugcgagcuccuuccaggaaucccccgcggccaggagggcaucguaggcaaucaugggggcaucguguccgcugcugccaccccagcccgaguagcucacgucgauguagaacugaucccuuuccuucacaccaaagggcugcgggaagacgggagccgaguugccguccaaaauuccucuaagcuccagguacuuuucccauucuuucucgaaguaggaccuguggaggagaagucaauuuaaaaaauaaaacaaacaaacaaacaccuaaugucaaaaguuauauagacaaauaccaaguauauguguaaagagugaaaaguccagaaugacuucagcuccucacacuagugucauaaauuuauacugaaaaaaaucuaaauuaacuccacaagccauccauauaguuuuuauuaugaugguuguauaugcucagccuagggaguggcacuuucagaaggcguggccuuguuggaguaggugugucacugugggugugggcuuuaagacccucauccuagcugccugaaagcagguauucugcuagcagccuucagaugaagauguagaacucucagcuccuccugcaccaugccugccuggaugcugccacguucucaccuugaugaucauggucugaaccucugaaccuguaagccagccccaauuaaauguucuuauaagacuugccuuggucauggugucuguucacagcaguaaaacccuaacuaagacagacgucuucuacauaaaccagguauggacgccgcugcucaggaaggaaaauauguguggagcuaugggacgggaaguaaagauuuguuuuucugggcccagagcaacuucuuaccauuuuuccaggggaaagucuaauaucacaacuauagguaacuucaguaagagucucugagccuuguuucuucuaagaaagauaauguaagguaaccaauaaaaggggacagguggccuuacagcuuacuagcuccuggagaaaccucucuagggauuucaaccaaggguuuugaaauacuguuuggaacaauacuggaaaaacaaaucucagggaaguuggaaguaaccaagaaaagcucaucucagcacuggcuggucacaaaaauuacagaaagacauaauccagaauaggacuuaagagaggaccacaggugccuacagugagguauccacuuggcuguuucaggcaaccauggacggaaaggagcuugaaauacuuagcagacgccccggcagggucagguuagugagacugauggcagcugugaccucugaacccuagguacauguauggagccugugcacacauccucacccacaagucagcuaggacacacacccagagacucaccaguguugaagauucuccuucacaaaguagccugacugagugauguacuuuuuggcuucaggcagcaccuccauuagcccuuuuccccacugccauggugacuugccauucacggcauaugccguaaaaagagcggacgcaaggcugccgagguagcccguggggugguggugggucauccggccgcucucgaugcucacuuggaucagcagauccaguuggcuggggugggggaaccucagcccgaugcacauggcgcgcauggcagccccgcagccacccucgugacuguugaagggaauccuauagccgucggcccuguugggcuguagcagcauggcguucugcaugcaagcaccaccuaggggugagucggggagagcgaggggucagucaccagaacaacagacccagugcgagcacggaacuaaacagacucccagguuucucugaaaugaacggagagucauggacacaugauggggguggcuccucaauuucaaacccccaugcuggggcaugacagcuaguguuccuuauauauaauccucggugugaucuuaugaauuaacaaagcauauacguacacacauacacauucucacacacacucucacacacucacacacacacacacacacacacacacacacaccuaccuccaguuauuagagaacucacagcagcucaaagggaagcuguccuguauuaucuuuucuuuuugaaagacgagccuuccauauaaaccaggcuggucuggaauucucaugggaaugagaauccuaggcuggccgcaaacucacaguaauucucuugcuucugccuccccagggcugaggucauagaugugcacuaccacauauuguuccuuuuuaaauaagauucguaacuuaggaaacauaaccaagagcccagaaccagcgagucaguggccauggacacacacauuggcuccaaggcugaagcccucagcgugucuaauaagaaccuacugggguuccuggcuguuagaaagagccuagagguuccaaaaugaagcacugggcuuagaucaggucaacagacuguggcucuccccuaccugaugguguuagagggaggccggucccaccgaccuacuguagcggcggguagggcuacaaaaggagccgagagacagcagcagcgcaccuugggaugcaauacuacugcucccuuauugcagggcccuuauaaaccagauccgaggcugacacaggaaggcaaauaaagccuccuacacuaaguggauagcagaugcuaagacgggacgaacagggaugggccucgagagccagucggugggaccuggggugaggggaggcauucuucaacuaggaguuauuuuggccgaauuguguucauauguugaaaucugaauacauaugucgaaaccuuaaugcccagcggcuuaauuuggagacagagccuuucaaucaagcuaaaaugagccagucuaauaagaagcauauggacacacagacacaacggaugccauacacagagacagagcacguggggaccagaguugguguccaucuguaagccaaagaagagcaaagacacaccagacguaaugaugugugcuucgacuucuaguaaccagagucaugaggagaaaaugucaguuaccuguugggguaaaucuccaaccccaaaaaagcccaguucaagaaaucacaacucaauuaauuggaauacaagcuacacaccuagauugggcagaucuaccacuacacuacucuauuaccgucuaugagaucccauauaacuuacgguuucuccaagccacgugcuucugcuccauucuccucccaccaccacuaccuccucuccuccuccuccucuuccuccuccaucauccucccucccucuccuucucucucccuucucccaacuuuucagguccaccuucccucuuacugcccaaucacagcucuagccuuaauuugaaaaguuaagguggggaggagguucgcaaggcaccuguauaugugcuucacuccccaaagugagucacagccacacugagcagggcuggaaccaaaggagggucuccacuuuuuuuuaaguaauaauacuucuuuaaaaguuuuucuuuauggucauucauaacaaaaaugcagaaaauacaaacagaaggacaauuacagugaucacuuguguaacucagguagaauuaugaacauauuccuguguuugcuuccagacuucccucaauggagauaagcaacuguucuuugugugugugguguuugcacacauguccgucucucagucccuugaugcagggucuagagguagguuagggaccaggaagcuccagugacccuccaguuucugucucucuucacacacgggucacauaugugacauuuuaugugggugcugggggauuugaacucagguccucaccuccugcacuucccauacuccugaucuuucuguuuccaccucccgagugcugggauuucagauaugcaccaccacacccggcaaacucugguacuuuuaaguuacuuucacaacauguccugaaaccuauuuuuuuccccaauuucaucaauaaauccuuuccauaucucaucugcacaacacacagaacugugacuguggcaccaugaguaaguuacaagaauugaaauccacacuaguuucuguuucacugauaaugaaauguuucacgaaguuuuucuucuuuugauuuucugaaacagaaucucacuacggagccugggcugguuuugaaaucaaaguccuccuacgagugacuaauagacauauuacucuccaucuacagucuuagcgucccccuugggcccgcuucuccauccucgggaaccucccagagacuggcacucaccuggugcccggccauccaugucucccaugcagucccgguaauguuuggcuaguagggaauacagccgaggcaaauccggggacuggccggcuuccaugagggccuccgcuguggccaggugcaugacgguaucaucacugacucuccaucgugccacaucuauggcuuccaagucacccaucugggccaacugcugguguaucgucuccccaucccgaaugaacucccacuucccguugaaguagcccaagguaucuccagccgcgcucagcaccauggcagccacauaccucucaaucagccccccacccaugcugagcuuggcacaggcgggcuuauggggcaacggagacuccuggagaagagcagaggaagaugaaucggaaaacaaacaucuacacucuccccacaggcccugccuuaagccuaacccauucgaucgucuucuaugagggauuugcugcucgagggucuuaagcaagaguaagucagucaucguggagagaaugcagcucuguaaauauuaagagaacugaaucaggccacagagcuagcggggagggcugggacucuaucacagcccaaagcucgacuccaaagcuugucuccagcugugucguggucucucgaggaguggccagcccauuaaaacccacaggucaagccaggccugccaucuucuccaucaccugauauucgcuuuggaagaucucucucucuuuugugcggagagugacacuacagcuaacuguuuacagaugaggaaauggaagcuaaguuuacauaaucaauagguacagaccauggaauccgaccuaguucccugccgccagaaugcuucauauuacauggucugggcccuggccuuaacuuugggcucagguaaagugauaauggaaaaacccagauguguaaugagggaugaaugaaugaaugaaugaauuuccauaaaguacauagugagcacaacuuugugauuauuuuuauuauccaucuacaaccaauucuauaagcaauuuucccuuuaccagcaauauuuaaaaauuuuuaaaugauuuaguuuuauuuacauauucuaguuuauauucaguuuuauuuacauacucuaguuuuuuggcuucacugguaucugugugaggguguugggcccccuggaacuggcucugugagcugccaugugggugcugggaauugaaccugagccccucuggaagaacagccagugcucucaaacugcugagccaugucuccagccccuugucugucuucuauaugguaaaaguucuauagugccgggcugcaaaugcuauucccaccacaaaugaaauccuugcuaaagcccuggcuucccgguguacacauuuucuacucuacucaggccagggcuccaugacacccauuccguguggugauucaguguuccacugucugcccccuccacgcacccagccuccccaugaacaggggcaaacacucuuaggggcaaaaagaccuagcucaccccugcccucagcccaagcucuucccauccaccugucuuucuuccucuaaccgccauuuuagguuuaguucaagcccagguaccuccaccauccaucuagucacacugcucaggucuagggcacaggccagcagagaccuggagaagcaguuaaggguaaagaucuggcuuuuccaugcuugauccugauuacauguguguguguguguguguguguguguguguguguguugugugugugugguguuguguguguguguuuuauguauaaauaacggcuaggaacuagaguucuguagucucuuguguuagcucugugaccacuaacaauccucucacgcuggaguuucccaucuguuucccaucugugggggaggaaggccucguucuccgagguccuguuuuggcccagguuuucgaagcccuagcuuuguuaaccucugagaacuaaggacuaacgcccccaccuucuccucccaaugcuccagguucccuuuuugagcucuccauggaagagugugggaaccuacggaggaaguagccaguaucuuuucucuuugaaauuccuuuucaccuuggcacaugcauccauccuggcccagacccacccuucagaagucauuauuccuuaacccacucuaaacgggcacaggugacaaagccaucaaacuauacaaucaaagccgaaguacacuucgggauuucccauugguuuccuggccuggguagaaagaggaauagggagaggggaugaggggaggggaggccgcgaugcacucaggaaagucuugguggccacuuugaggacacuggccuagcaccagucuggaggugagagcgggaccgagcggguacuaaggucaguaagaggagaguggcucggggacuccuggcuguaccugcugaggcggagcugagagcguggggcgggaucggggugguccagagccgagggcaggauugcccgagcuggaggcgggguaccgggcgcaggaguccugcugugggcacccaagccaaaagccgaacaggggcggagccgcgggccgggcgggucgcu

SEQ ID NO: 12547 - RNA, 7292 nt, Mus musculus
agcgacccgcccggcccgcggcuccgccccuguucggcuuuuggcuugggugcccacagcaggacuccugcgcccgguaccccgccuccagcucgggcaauccugcccucggcucuggaccaccccgaucccgccccacgcucucagcuccgccucagcagguacagccaggaguccccgagccacucuccucuuacugaccuuaguacccgcucggucccgcucucaccuccagacuggugcuaggccaguguccucaaaguggccaccaagacuuuccugagugcaucgcggccuccccuccccucauccccucucccuauuccucuuucuacccaggccaggaaaccaaugggaaaucccgaaguguacuucggcuuugauuguauaguuugauggcuuugucaccugugcccguuuagaguggguuaaggaauaaugacuucugaagggugggucugggccaggauggaugcaugugccaaggugaaaaggaauuucaaagagaaaagauacuggcuacuuccuccguagguucccacacucuuccauggagagcucaaaaagggaaccuggagcauugggaggagaaggugggggcguuaguccuuaguucucagagguuaacaaagcuagggcuucgaaaaccugggccaaaacaggaccucggagaacgaggccuuccucccccacagaugggaaacagaugggaaacuccagcgugagaggauuguuaguggucacagagcuaacacaagagacuacagaacucuaguuccuagccguuauuuauacauaaaacacacacacacaacaccacacacacacaacacacacacacacacacacacacacacacacacacauguaaucaggaucaagcauggaaaagccagaucuuuacccuuaacugcuucuccaggucucugcuggccugugcccuagaccugagcagugugacuagauggaugguggagguaccugggcuugaacuaaaccuaaaauggcgguuagaggaagaaagacagguggaugggaagagcuugggcugagggcaggggugagcuaggucuuuuugccccuaagaguguuugccccuguucauggggaggcugggugcguggagggggcagacaguggaacacugaaucaccacacggaaugggugucauggagcccuggccugaguagaguagaaaauguguacaccgggaagccagggcuuuagcaaggauuucauuuguggugggaauagcauuugcagcccggcacuauagaacuuuuaccauauagaagacagacaaggggcuggagacauggcucagcaguuugagagcacuggcuguucuuccagaggggcucagguucaauucccagcacccacauggcagcucacagagccaguuccagggggcccaacacccucacacagauaccagugaagccaaaaaacuagaguauguaaauaaaacugaauauaaacuagaauauguaaauaaaacuaaaucauuuaaaaauuuuuaaauauugcugguaaagggaaaauugcuuauagaauugguuguagauggauaauaaaaauaaucacaaaguugugcucacuauguacuuuauggaaauucauucauucauucauucaucccucauuacacaucuggguuuuuccauuaucacuuuaccugagcccaaaguuaaggccagggcccagaccauguaauaugaagcauucuggcggcagggaacuaggucggauuccauggucuguaccuauugauuauguaaacuuagcuuccauuuccucaucuguaaacaguuagcuguagugucacucuccgcacaaaagagagagagaucuuccaaagcgaauaucaggugauggagaagauggcaggccuggcuugaccuguggguuuuaaugggcuggccacuccucgagagaccacgacacagcuggagacaagcuuuggagucgagcuuugggcugugauagagucccagcccuccccgcuagcucuguggccugauucaguucucuuaauauuuacagagcugcauucucuccacgaugacugacuuacucuugcuuaagacccucgagcagcaaaucccucauagaagacgaucgaauggguuaggcuuaaggcagggccuguggggagaguguagauguuuguuuuccgauucaucuuccucugcucuucuccaggagucuccguugccccauaagcccgccugugccaagcucagcauggguggggggcugauugagagguauguggcugccauggugcugagcgcggcuggagauaccuugggcuacuucaacgggaagugggaguucauucgggauggggagacgauacaccagcaguuggcccagaugggugacuuggaagccauagauguggcacgauggagagucagugaugauaccgucaugcaccuggccacagcggaggcccucauggaagccggccaguccccggauuugccucggcuguauucccuacuagccaaacauuaccgggacugcaugggagacauggauggccgggcaccaggugagugccagucucugggagguucccgaggauggagaagcgggcccaagggggacgcuaagacuguagauggagaguaauaugucuauuagucacucguaggaggacuuugauuucaaaaccagcccaggcuccguagugagauucuguuucagaaaaucaaaagaagaaaaacuucgugaaacauuucauuaucagugaaacagaaacuaguguggauuucaauucuuguaacuuacucauggugccacagucacaguucuguguguugugcagaugagauauggaaaggauuuauugaugaaauuggggaaaaaaauagguuucaggacauguugugaaaguaacuuaaaaguaccagaguuugccgggugugguggugcauaucugaaaucccagcacucgggagguggaaacagaaagaucaggaguaugggaagugcaggaggugaggaccugaguucaaaucccccagcacccacauaaaaugucacauaugugacccgugugugaagagagacagaaacuggagggucacuggagcuuccuggucccuaaccuaccucuagacccugcaucaagggacugagagacggacaugugugcaaacaccacacacacaaagaacaguugcuuaucuccauugagggaagucuggaagcaaacacaggaauauguucauaauucuaccugaguuacacaagugaucacuguaauuguccuucuguuuguauuuucugcauuuuuguuaugaaugaccauaaagaaaaacuuuuaaagaaguauuauuacuuaaaaaaaaguggagacccuccuuugguuccagcccugcucaguguggcugugacucacuuuggggagugaagcacauauacaggugccuugcgaaccuccuccccaccuuaacuuuucaaauuaaggcuagagcugugauugggcaguaagagggaagguggaccugaaaaguugggagaagggagagagaaggagagggagggaggaugauggaggaggaagaggaggaggaggagaggagguagugguggugggaggagaauggagcagaagcacguggcuuggagaaaccguaaguuauaugggaucucauagacgguaauagaguaguguagugguagaucugcccaaucuagguguguagcuuguauuccaauuaauugaguugugauuucuugaacugggcuuuuuugggguuggagauuuaccccaacagguaacugacauuuucuccucaugacucugguuacuagaagucgaagcacacaucauuacgucuggugugucuuugcucuucuuuggcuuacagauggacaccaacucugguccccacgugcucugucucuguguauggcauccguugugucuguguguccauaugcuucuuauuagacuggcucauuuuagcuugauugaaaggcucugucuccaaauuaagccgcugggcauuaagguuucgacauauguauucagauuucaacauaugaacacaauucggccaaaauaacuccuaguugaagaaugccuccccucaccccaggucccaccgacuggcucucgaggcccaucccuguucgucccgucuuagcaucugcuauccacuuaguguaggaggcuuuauuugccuuccugugucagccucggaucugguuuauaagggcccugcaauaagggagcaguaguauugcaucccaaggugcgcugcugcugucucucggcuccuuuuguagcccuacccgccgcuacaguaggucggugggaccggccucccucuaacaccaucagguaggggagagccacagucuguugaccugaucuaagcccagugcuucauuuuggaaccucuaggcucuuucuaacagccaggaaccccaguagguucuuauuagacacgcugagggcuucagccuuggagccaauguguguguccauggccacugacucgcugguucugggcucuugguuauguuuccuaaguuacgaaucuuauuuaaaaaggaacaauaugugguagugcacaucuaugaccucagcccuggggaggcagaagcaagagaauuacugugaguuugcggccagccuaggauucucauucccaugagaauuccagaccagccugguuuauauggaaggcucgucuuucaaaaagaaaagauaauacaggacagcuucccuuugagcugcugugaguucucuaauaacuggagguaggugugugugugugugugugugugugugugugugagugugugagagugugugugagaauguguauguguguacguauaugcuuuguuaauucauaagaucacaccgaggauuauauauaaggaacacuagcugucaugccccagcauggggguuugaaauugaggagccacccccaucauguguccaugacucuccguucauuucagagaaaccugggagucuguuuaguuccgugcucgcacugggucuguuguucuggugacugaccccucgcucuccccgacucaccccuagguggugcuugcaugcagaacgccaugcugcuacagcccaacagggccgacggcuauaggauucccuucaacagucacgaggguggcugcggggcugccaugcgcgccaugugcaucgggcugagguucccccaccccagccaacuggaucugcugauccaagugagcaucgagagcggccggaugacccaccaccaccccacgggcuaccucggcagccuugcguccgcucuuuuuacggcauaugccgugaauggcaagucaccauggcaguggggaaaagggcuaauggaggugcugccugaagccaaaaaguacaucacucagucaggcuacuuugugaaggagaaucuucaacacuggugagucucuggguguguguccuagcugacuugugggugaggaugugugcacaggcuccauacauguaccuaggguucagaggucacagcugccaucagucucacuaaccugacccugccggggcgucugcuaaguauuucaagcuccuuuccguccaugguugccugaaacagccaaguggauaccucacuguaggcaccugugguccucucuuaaguccuauucuggauuaugucuuucuguaauuuuugugaccagccagugcugagaugagcuuuucuugguuacuuccaacuucccugagauuuguuuuuccaguauuguuccaaacaguauuucaaaacccuugguugaaaucccuagagagguuucuccaggagcuaguaagcuguaaggccaccuguccccuuuuauugguuaccuuacauuaucuuucuuagaagaaacaaggcucagagacucuuacugaaguuaccuauaguugugauauuagacuuuccccuggaaaaaugguaagaaguugcucugggcccagaaaaacaaaucuuuacuucccgucccauagcuccacacauauuuuccuuccugagcagcggcguccauaccugguuuauguagaagacgucugucuuaguuaggguuuuacugcugugaacagacaccaugaccaaggcaagucuuauaagaacauuuaauuggggcuggcuuacagguucagagguucagaccaugaucaucaaggugagaacguggcagcauccaggcaggcauggugcaggaggagcugagaguucuacaucuucaucugaaggcugcuagcagaauaccugcuuucaggcagcuaggaugagggucuuaaagcccacacccacagugacacaccuacuccaacaaggccacgccuucugaaagugccacucccuaggcugagcauauacaaccaucauaauaaaaacuauauggauggcuuguggaguuaauuuagauuuuuuucaguauaaauuuaugacacuagugugaggagcugaagucauucuggacuuuucacucuuuacacauauacuugguauuugucuauauaacuuuugacauuagguguuuguuuguuuguuuuauuuuuuaaauugacuucuccuccacagguccuacuucgagaaagaaugggaaaaguaccuggagcuuagaggaauuuuggacggcaacucggcucccgucuucccgcagcccuuuggugugaaggaaagggaucaguucuacaucgacgugagcuacucgggcugggguggcagcagcggacacgaugcccccaugauugccuacgaugcccuccuggccgcgggggauuccuggaaggagcucgcacacagagccuucuuccacgguggagacagugauuccacggccgccauugcuggcugcugguggggaguuauguacggcuuuaaaggcguaaaucccgccaacuacgagaagcucgaauaccgacagcggcuagaagaggccggaagagcuuuguauucucucgggucaaaagaagacccuguauuagaucccuagggagaaggugguuuguuucuggcgguuucuuucccuguagcccugaagcucagucucuucagccuuuugagagucaagaauccuaauuuuguguuugaagaguucugagauaacaagucccuuggaugcguuuagcccugccuuuccacauuuacccuguucuccccgaguuccucucuuguguaugagaaucuuuuuauuucaguugauggggucagcuuuucccauucagaaaccucauaaccuuguauuccaguuuuuguuuuuaucacagaauugugcaaaaugcuuu

SEQ ID NO: 12548 - RNA, 10669 nt, Mus musculus
gacuggcaggagucccuguggccugcggugcaccguggaagagccaugucuaguaaguggcucguggucugguuguccagcucccagcgggagcgggguccuccgugcggcggugcagaugagccggcuggguccuugcgucccccggucagccaugccgguggcucuugucaccgguguccgcggcgcggcgaagcccaggggcggcuggccgugcgagcacaggccuccgcgcggggcguccugugcugucggagcuggucagcuugcggguuggguggugguguccaacucguggcucugacuuccucgccucacaaagcgguggauaaucacaccucacuccgcaguuccucgucuguaaaaguuuauaguugcacuguccuggcauauucauguaaauguuguucccguaauaggcccgucacucgagguguuuucgugcccuccgccccgacuuguucaucuucaaaaucauuaaucgcuuuccggagaaggggaagcaacaagucuugcacacggaggaccccaguggagggguuuuccugcguaagccugcagagggcgcuuuugcaccggccccuaaccugggucgggaccuuguccauauuggguggcuuuuggaagaagcuagaaacaaaacuauaguuuuauuauccuuuccugccucaggagcagaggcagucuaacuuccuaggguuaggggagauauuagugaguuucugugauacucuggugacagcucaaggucuguuaaccugaaaauaaugccagguuuugguuucauuuguuuuuauacagauucuggcacuguucaauuaagagguguuaggggcuaaaugccuuuuuuuuuuuuuucucucucaucauauuuaggauaagccaaggaaugagcgaucauaguuuuuauacuuuuaaggagagcuucggccuucuucagaagccagguuuugucaguguugucgauauaccccuuuagauugccaguaguugggucaaucaaaaaccauguucaaauacugccugauauccuguuugagaauccuggcccugggugaacuuagugggcagaucugaugacuuuuuuuuuuuuuuuuuuuuuucuuuuuuccccagcuuuccgccuggcccucauacagcuucaaguuucuuccauuaaaucagauaaccuuacccgggcuuguagccuagugcgggaggcagcaaagcaaggugccaacauaguuucucugccuguaaguaucagggcagccugcccauucuucaggagcuguggauccaccacaguacugcgugcuggcagugguccucuuaugucccaccuccagcaaugccuuuuggaacccuaauauuguuucguauuugucucaucuuucacaaagacuaguagcgaccuuuaucauaagaugucaaacgugguuacaaguuuugaacaagaucaccuccccuguucagacaagcaguaagaaauccauggggggcuuccuuaaagacucacucagggccuguacaauuacuugguaccuuaccuaagucaggcuuuuuauugucguguuuuaggucagaccacauugcuuuaguacuguucaguuuuugaaaaauugucucgagguuugaguugaagguuguaucauauuuggugguaaguacagccucggagauccugaaugaccagggaucaguuagcaaagggaacacuuugaggagccagaggucaguuccacaggagcagucuuacuuuguuguuucaaggcaggcuuucucuguguagcccuaguuguucugucacuugcucuguagcccaggguggacucaaacucagagauccaccugcuucugccuccaagugcugggacuaaagcccugugcucccacugucuaaccacucuguuuuugaggugaggucucucacugggacuugggacucacaaguaagcuggacuggcuagccggcaagccucggagagccucuccucacuccuccgcugguguuggaguuaugagugcaucuccucacgccgggcuuauuuuacaugugugcugagcaucuaagucaugcccucaugcuuuugggacaagcacuuuacugguugagacaucucccagcacaauccagucuuccuuuuuagaucacuguguagccauggcugccuggaacuuacuauauagaacaaaccugauguucucugugcaucaguuacaggacucaucuguaccuggcaccuaaccauggucucuuguuaguugauguuguugagaugaaguacaagucuaggagggaaagugcuuggaguuaugugcgugcuugcuuagcucgcugacucuugacaugcuggucauuuuuagcauaaugccugguacguagacacuguuguuaaaugcaaaaugagugaacuuaaauugauauccgguaaauguuuaccuguuguuuucugacaugucaaaggacugcagaaggcagacguguguuguaugcaaguauuagugucuuugucauuuuuggugucugugucccagcccugucuuuguuucauccucacccacuuuuccuauccaugagagacaucauaaagaugucauaaaaaugucagaauggaguuagaaacagcuuauuugcaguuaauaaaacaguuuaacuucuguggcuuucagaacuuuuuaaugcauaacuuuuauugcuuuacauaauaagugguauaauuuugagcucuagacuucaccucaggauucaaaaaucacagaguaaacaugauuugugauggaccuggauguccaagaacugguaauccacaggcuccaggucuagccuucugccagguuaccaguccccuguccucgccugggcugguugccugucugcuuuccauugaacguucuuuagcuuuaguugaaucuuuuccugcugguguuuucuccacuccaagccgaaugggcagugcuguguuucuacuuucugcagaucuuuaaaugguuugccugguuucccccuuuuuccuucucuaacaugacucuaggagugcuucaauucuccauauggaacaaccuacuuuccugacuaugcagagaagauuccuggagaguccacacaaaagcuuucugaaguagcaaaggagagcagcauauaucucauuggagguacuucuugcaccugguguaacaccuaaauauuaaaaaggcuagaaugacuucuguuauauuuaaacauuuuagcccuugaaaagaaugagguugccaggaguaguggcauacaccuaugaucacagcacuuaggaaagcugaggcaggaggauuguaaauucaaggucaguuugggauacacuucaagauauacuaaguguaaaaaaugcaaguuugugucuuaacauuucucaacuagggcccgugggauucaguuuuguuguaagacuugauggauuugagcaaugaggaauuccugauuuugcuuggaaguuacauauuaacugcugcucaauaucaugacugaauuucaagggcauuuugguuauuuuuuaaaccuuucuuuaacaucuggacuaguuauauuucaucacuaauuuggagcuuaaucacuguaagauauauuuaagggggaaaagaaugcuuagaauaaauguuauuauugggcccaaaugacuguuugccaggccuuuaaccuacucucacaagguuauuggcccauuccuuuuuguuacuguuuugugugacuguguauuucuucaauggaaggcuccaucccugaagaggaugcugggaaacuguauaauaccugcucuguguuugggccugauggaaguuuacugguaaagcacaggaagguaaguugugccgaucucaucgccuuccaguuucuguuucuugcaaggauagagauguaauuaaucuuuaagccacugguucuguauggcucaaccuuguugaacuuguugcucuguguaggaucucagacacaccguuaaauuuuaggugcucuuaggugggcagucguagcacaugccucuucauuugaggcuagccugguccacagagugaguuccagccaggacuacagagagaaacccugucucaaaaaucaaaaaagaaagaacguguccucgagucguuuccagucucagaagaaacauacucacuauuuuacucguaaauaugacguuucagaagugcuuaguaugacuacuagauaaaaagcauucccuuccuagagaguguuucugcuuuguuuugaaaaccaugguugguuguagaaguuuccuggguacaggcuggagaggaagcucagugguagacugcuuucauagcaugggcagggccuggguuuagucacugucguugccccuccccuccuccucaggcacagcauacauuacugucucucaguauauguccuugagaucauauggcauuuccuuuacuaaugugauaaguuacauugcuuuaucuucugauaucacaacauuuguugugcuugaaacaaaaaaaucuuacuuuagcuaggcauuugguggugcauaccuuuaaucccaacacuugggaggcagaggcagguaguucucuugagcuggggaccagccuggucuacuaugugguuuccaggagagccagggcuacagagagaagccuugucuugaaaaaggaaaaggaaggaaggaaggaaggaaggagggagggagggagggagggagggagggagggagggagggaggggaaggaaggggaagaaggggaagggggaaagaaggaagggaaggaaaugaauaaaucucauuuggaauuguuuugcaaaauuuuaccuggauuuuguguuugucuugagacagggucuuucuggguagccuaggcugacuuugaacuccaguaguccagacuggcccagaacuuguggcaguccuccuuucagagcauccuuaguguuagaauuacaggcaugugccaccaugccaacuuacuuguuucuaaaugcugcacauuccuuuugcuuucuuuguugauaguguugguuuguguuuguuuguuuguuuguuuuuuugauaugggcucuauguagcccuggcuauccugguagacugguuggaccucagacucagagauauaccuguuucugcuucccaaaggccucuucuucuuuugccaguuuugucaguuugaugcugauucugagaaaucuuccuuagcauuuggggugaauaaggacaacauaaugcgucuaccaugagccugcacauuuuucacaucuggagacaacagggguuguaaaagccacaucauuucaccauuuuccuguaguagaaaggauaggcaaaauuguuaaccuguuucuucagagacugaaaacaagauaaagacaccaauuacuuaaggcccugccugagauccuacacagagcaauaaaauaagugguuggauguagcuaguuguagguacaauauggccaaaacuggggaugauguuugugcugucaaucuuagagcauguccauaucugaccaucaagagauaucugccacuacugcucuugaggccagagguaaccaaaucaauuauuuaugaugcagauccaucuguuugacauugauguuccugggaaaauuacguuucaagaaucuaaaacauugagcccuggugauaguuucuccacauuugauacgcguacguaccagauaaguuugccucuuacaggaaucccagagaagaggagcagguguuuucccuuuuaugucugucuccaaguuuuucacacauucauauuaaaaguucagaauuaggagaguaagcagucagagaucuagaaagucuggggagaauggaacccugggauuuugacauagcucuuccauuggguuacagccucuggaccauggcauccaggguguuccugugggccaccauugacacauuguacuuaauucauuacauuaauacauugcauauuguucagaaggaaguugucaaagcuauccugaggcugacaguguugucuuugaacgaugucccaguaggauugaacuuacaccuugucuguguaggaguccuggguuaauucuuucuagucaggguuuuaggaucagagcagcucuacucccccauucuacaccagagguucacuuauuugugcaucguucuuuuuggaaauagcuuacugcaaagugggccugggcaucugcuaugauaugcgcuucgcggagcuugcacaaaucuaugcacaaagaggugaguuagggccacagauggguuacauagcugcuugggguuugauucugggguggugucuguggcaugaagauagccccuaacaaaaguugcucaaaaaagcaaaacacaauaaaugugcacagaaugucgaaaauacaguguuaaugucucugcauccaguacuuccacagcagcucgcuaaacaggcugagcaugggauacuaugguuacaggggugaggguaugugugaucucacacacuccauccauaguaaaagcuuuguucuggaauauucccuuuacccuuugaggguaaauaucaugguauuuggaguuacauggggccagguagaaaugcagcaauggucuguacucucauggguuucaacacucacauauauagucaguaauauuuugauuuggacaacuuacugccuguaaaaaaugagacaagucagaaguucugguagcacaugaacacucauuuugccucucuaagagggugugguucccucagagaacugguaugacagaagauggagagaauuuacaaacuucugaugccauucagcaaauaccaguguccuuacuaagcuaccgaaaugacugacacuuaacuaagugcuauggaugauugacagcuguuuagcagaugaggugcaugcauucugggcuuaagagugucugaaacuguacugccccaaaucgguugggaagucacaguguacaucucuucacuauguggugcugagcaucugaggccaagugacauuuugauaacaucauucuuuuuaaaagugaaguuugacaucagccauccacugcacuuuucuuguggucguguuuuauacguauaucucuaaaaacuuaaauucagagccugucuuacuaggcugaccucuuuuuguguguggaagaguuugaguucggcucuauuggaugaggaauaagggagggaguaacugagugcucaccguugcacuuucucucuccccucuggaggcugccagcucuugguguauccuggagcuuucaaucugaccacaggaccagcccacugggagcugcuucagcgagcccgguaagaaaggaaccaagcaucucagagcugauacaucuaucagccuuagauggagcccugccccuugucugccugccuucccuggcacccagacgcacuuagaaaggaugacucugcacagagagcucugcuagguacugucuccgaugccauagcaguucccucaagagaugcugggguuaaaggcauucuacaguggcugaaugccacucuauuguacguggguuuuaucucaauaguuaauagacacaggauguuuguuucuuguuuccugugauaguccaaugcuggguucacaugucuuuccaugugcuguuucauuuccuuuggacuuguaccuuuuagugggauuucuggaccacauggccuguuuuaaacuguuagaggcaacucuacugcuuuccccaaacucuugcucauuccaauguacagaggccuuuucguguuuacuucuaguguuuucguaguuugccuuuuuuuuuuuuuuuaauuuuaaagaacuguauaaaggucugcaacgugcaauguauuugcuuucuguugacuacagggcuguugauaaucagguguauguggcuacagccucuccugcucgggaugacaaagccucguauguggccuggggacacagcacuguuguggauccuuggugaguaugucuuaggcugagcucagcuggaaguugaaagaugauacagggucauuuuucuacaauuccuacccuuucauccauacacccggacaagcauaagggaagcuuuuuacuugcaacccacaugauaagaaagcggauccugcuugcucaaguguugucaucuuugcuugucuagguaguccugguagucauacaaaauaaacaaggcagcagcguaggcaagcgguugcuuuuaggaagagaucucagaauucuuaguuugcaucuggcuaaaauuuaggcugagugacugguucaagggcaggaaugagaagcaaggcaagaguguuacuccgcguguaaugauuagagaugggggacuggguuaaagcagugguucucaugcugugcgucacaacuccuccacacaucagauauccugcauaucauauauuuacgugauucauaaucguagcaaaauuucaguuaugagguagcagccauaaaccauaauuuugugguggugguggugguggggucaccacaccaugagggucauaccauuagcaaaguugagaaccauaggguuagaagaaacugacugucccccgugaaacggcaaagaauuuuaccacugagaacacagaacaucacacagauguuucuccauggacauaucacacgguuggcaacuguauguguaauuugacauucacauauagaaucucagucagacacauguccuuacuagaacuuuggacuucaaaaguuggcuuugguccaggcuacuuguguauacacacacaguauuucuacaauuucagaauaaauaaaggguccuagaaaggaguguccccuguguguaugauucucaguaguugcacacaccaggguuuaugggcauuggagaaguggguuaggcuggauucugucacauuccuaucuagauguuggugaaaggcuccacagccaguucuccugguggcuaccuagaguggcuguugcagaguaauuuuuguguguuauaugcgcuuccuuuuuuuuuuucccugaaggcuuuugaggccuuucagccuaugacuuuaggguggucggugucugggugggagugacauuagagaaagaacuuugaauuugccaggacagaugggugggaauuaggauucaaucaaaugaaauuaaugguauugguauuucauccuugcugagagucuguggcugucugauaaguacagucaguuaauugugccagaugguuuguuuugacauauuuggaaauuaaucauuucuccagauagauauauuauugaggcccugcacugggccaaaaggcugguuacugcaaaguuuuccagaauagccuucaccuggucguuugaagggcuguugcuccugucagcacacucuuguuauucagacacuggguaaagucuuguccuccaauccgaaacuccaaagcauagggagccagggaucucagccacacagguagaggguucuuguaaaucuggacccuguauaggcccggccucauuacccucagaugugguugcaguugggagcacaugagggacagacggagaccuuccuuaggaggggcuuuuuccuguugacucuuggcagcucuguucccagauacuuauaaucaugaaugagcuauggcuuuccaggagugugcaguuuauuaaacauaucccacuuuccuuaccaagccucacaggacuccuauuuccacaugaugugccacacguucuuaacauaaauaacagaaccagaauuuauacuacuuuuuuauuuuagaucuuagaaucuuuuuuuggccugguacacaaggaggaaauauagagaacuugagguuggcgaauccccauucauucucuggauuuucuucagggggcagguccuaaccaaagcuggcacggaggaaacaauccuguacucagacauagguaagcuuugcccugcugugguuaugguuucuggggcucccacugcucucaggccagucuguggcugacuuggaaggguuccguugugcgcugcucuucuauccuggugauauccugguguugagggugagcucuggggcuuugucucacuagguuuuguuuaguuugaacugacccaggaccaacuccaggucaccagcauccagacaaggcaaauguuccuaggucacuugcugagacuuuggucuggggacaaaauuuaauugcuugguuaaguaguugcaaauuauuaaucauguguguuccuguuuuugcagaccugaagaagcuggcugaaauucggcagcaaauccccauuuuaaaacagaaacgagcagaccucuauacaguggaaucaaagaagccuugauaucuguuucaaaaaugucaccaacaggaugaugcucugucagaugaucaacucuacuacaucucuuuuuuuuggagggaggggggaacagggccauuucauguuaauucuaucaaugaucugugccacaagguccccuauuuuaauuaaaaguuucaucuuuaauuaaaaugugcuugguaacaauguucuagcucuuaacuagucugaugguuccuaggcauuucagucccaagauccuuuugaacaauuaaaaacugaagccucuaagcauuguuuccauguguggugggcuggucccaucugucugagaaaauguacauuuaccagaacacuaauuuucauggugcuaauaucccaucaacaugacacuuuuaaaacuuuuuauuaaaaauuguuuucauacaauau

SEQ ID NO: 12549 - RNA, 219262 nt, Mus musculus
cuggaguuauuuuauuuaauuuauuuauguaauacaguguagaaagcuaucauggcauaagcaaugauucuguacaaucauccugcagaaaauuaauuuuuggagaauucuugguaauuggagaccagcagaacacucccuccccccacccguaaaagugcuuaugaugaacagggauaauuuuuuuuuaauuuuuuuuuaucaaagauccaaagauacauggacaaaaaaaauguucaaauucucaaugccuaaugugugcacauaaaacaggcacaaagaaaucaauguguauccucuuauuccuauaucacaaagagagcagaagcagcaaucuguacaguaagaugcagucauggaaaaagaauuuucuaagucauuuggaauacuuaaaaaaauguucaaaaugcauagugaucaggaaaagaauacguaggagaagcagcuagacgcccacguucacaagaagcaucccccaucgauuuuuaaagcauauuucaaguaggaguuuuuuccgggccacaaaccacaagaauaauauacaacgggcuaaggggcuauguaugugauaaauaauuaggagagaaucuauucaugcacuaguuugauacagcuaauuuuuuuuuuuacaguacacaaaacccaugaaucauguaauguagagaccagaauguaaagagagaaagcgagaauacauuacugauuuguauauuaauucaaguucaggcaucuacuuguguuacagcacagcugucaaaagccgagggugaguaaauaaacggaaggguuuguuucuuuccacguuauuuuauaaaugaacaccgauggguagugaagcaaugguuucgcuguccaaguucagaggccgcugcuguggcgcggguggggcuuaguucugcauuugcucaaagaacuuguaaguuggauucucauauccguucugcugcaucuuggagagauggcgcuccucuggggucacggcggcgucgaccuagaaagcagguacagagauccggguuuaaaauagaccgaggacuuuaaaggagcacaguacucguaggcaguaacaggacacggugugcaguucuuuucuuugcccccaaaguacuuaacaaccgugauuuaucagcuuuagccccaacuucugacaccacguggcagagccaauggcuuacgccgaugcugcaucuggccacuagguggugcugaaauucuugaggcgaguacucgggucugcacagggcacauuggcugaaacagccagcacuggaguuugugggauggugaaggagaaagaacaucucacaaagccgcacugugaaugacugugagugacgcuuagaucugugcagaauauaacacuccgcuuuguggggccccagguaucugcugccauuucgaaguacauuuaucucuguagaaauguuaaugagaguuuugagagccuauuaaauaaaagauacacacacacacacacauguauguauaugucuuuuauuauauauauacauauauauauauauauauauguauauauauacacacauacacauauaaaagggguauaaauaaagguaacauauauggauguaugugugugucugugugugugugaguguauguauauaaaagguguauuaccagggguaggguauaggggacuuuugggauagcauuugaaguguaaaugaaaaaauuaucuaauaaaaauuugaaaaaagggggguauuacuugacacaaaaagggaaacuguauagacacacuauccuaauuauacauacauacauacauacauacauacauacauacauacauaucugucugucugucgauccauccuuccauccacucauccauccauccacccaccuacccauucauccuacacauacaggauuuguaguccuggggguugcauucaggccucauuuccgccaggccagagcucuacagcaggcuucagcuguaagaucaggucggcacgguaaacauaaucugccucagccauugucacggagagccgggcagguguuagucucugcagacugugcggggcacacaucucucuacaguagcuaauggcuuuucuuguuucuauauuuguccuaccucucccagugaggagaagaggaggugcuugcuugagucugcuggauuaauaugagcuccaagccucuguaaagccgcguuggaagacgagaggacucuguccguaugcacauagcauaaaccauguuucccacagaaaaguuaagguguguucuaugggauucauuucacagggauauuucuuauucuguccuggacugaauggagcuugcagccucauuuuucagaggucucuaguucccauugcugagcacugucaaaugaugucuggcaauuccccagcuuucucuuugucucuguccccugcccccaccccgccuacugccaguguggcacaguucagacccugcacaacugucuuacuguuaugguggcuccuaaaacaacaaggggggggcagauaugcauggugccagugcugcccuaccuaccaggugauggacagacaugugguaugauacacauagaucauaugauacacacagaucacgccuagucccaccuaaggaguaauucagguggagagccuuguagagaugaauuccuucauggccauugggugugaccccacuucagagaacuaguuaguccuuuuuaggcugggcacgagacagacuucaggacagacuucaggacacagucaaaggcagugggaauaggagcugcccugcccuuagguccugggacauuuccuucugcucauccgcccugacuccucccaucugcacgaggugggauccagaugggagcugcucgcaucuucccuccugugagaguugccugcaguccagucuccaggucacuccaguaagggccuggguguuuuccucuuauaccaaggccuacccaggagcuagcacucagagaacacugcucagcaucacugccccuugggagaaacacacagguguuuuucccaucuccuccuguuugcugugaucugcucugcugucaacaaaugaggucaccucgauuuaauuggcgacaggcuugcaagcuaaaaugccuucucucuacagauuaacuccccaaagugagagcauucagucacccuccuguucggcuugcuagagacaagccugucugcaauccugugccacuugaaccuggccauuuucuccacucucuaggaccccauaacugaaaugucaaauaagggaauuaaaaaaauaaauaaauaaacuugcuuuggagaucaagcauguagcugcuguuucuuagugugucuauaccucgaggaggggcagcggcucucgagcugccugccaacagucuucugcauuuuccaagaacagcagagcaccuucguguuuaguacuguuauuuaguuuucugacuucaaacuccaaaauaaaugcucaagggagccccaccggagauccaaggcuccgagagcggacucaguccgggcaucucaauucccugucuuuucuugguuugcuuugcgugcuaauccuccaugcccuuugcugcugggaagcagaagggguucacgauuccugccauggggacagcuuagcccucaguguucacagggcucugggcuuccgaauagauugcuuuuaaaggcacccgaggagaagaguccaaauggcaucuuuuaauccccaaucgucuugaauucuggaagugaauauucaugucuggggagaaaccuccggcuaaacaaagaacaaggaugagccuuccuccuagcaagggcccucaaagcuaccucgaggacugugccaaucccucugugaccacugugugccucuagcaacagacugaaauugugggcauguucaggaggcaauacucaagggccaugauagcuguuacuaaaguaggaagccuuccuggcagaaugaaccuuuggcaucauguuaagcaaaucguuaaauuaauauuuacuucuuagguauuaaaaauccaaaccacaaggaguuacaaaguuuggagcugagacgaaaggauggaccaucuagagacugccauauccagagaucuaccccauaaucagcuuccaaacgcugacaccauugcauacacuagcaagauuuuaucgaaaggacccagauguagcugucucuugugagacuaugccggggccuagcaaacacagaaguggaugcucacagucagcuauuggauggaucacagggcccccaauggaggagcuagagaaaguacccaaggagcuaaagagaucugcaacccuguaggugcaacauuaugaacuauccaguaccccggagcucuugacucuagcugcauguguaucaaaagauggccuagucggccaucacuggaaagagaggcccauuggacuugcaaacuuuauaugccccaguacaggggaaugccagggccaaaaaaaugggaauggguggguagggaagugggggggaggguaagggagacuuuugggauagcauuggaaauguaauugaggaaaauauguaauaaaaaauauuuaaaaaauccaaaccaacugcucaugccugauggcuauuuacuguaucaaaaauaauaauaaaugauaauaauaauaauagccacuaggcuucuuugaaugcccacauuucccuccacaguuuuccuaggcuugcuacuuugugacccaugggagucuuucauugugaggacaagagauacucaggagacacaugcuuccaccaugcccaggugauggaaaaauacaaagacguggccuugagugaccgggacacucgguccauucguugccccuuuuuguucuuacugacaugaaugaggucugcucauccaugaaggaaaugaaguagagccgggaauagugucauuuccacguacgugcagcguuucuucagcacacacaggagauggguuccaaaaccaaagaggaagggugcuuaaguucuuugcuuaauaacgcaugguaucugcauaugaccuacacacauucuccccuauacagcauggcuacgcacccccagaugacugugacauauaauuccaaauacaaucuaaaugcaaaugguugucauagugauuauuuauggaauaaucuguucaugcucaggugcauuauuuucccuaaauacuuuugaucaguuggggcggggcggggguggggagcucaaccuguggcuguggagacacuguggccgagugugugcagcgcuccaaagucaggcaggagagggugacauccacccugcgcauucccgagguacucaaagaugaagggcuugcugaagcccauggcagcgugcuucaauacugacaccccaggcugaagaguagcucucgguggccuaguucuaccacuccagcuaaaugacaccuccccaagggcaggguacaggcacagcaguacaagugaguucuauuucaacccucugucccaguguggacucaauacggagcuggaccaagccucgucacggacagaaacacagacuguuaaagggaaagagauuucagacucuccacggcaucccucuccaggacaaagugagucuauagggaaucaagugaaaaccaagaccauuucuugaguggcgcucaagaagaugccacuuggauacgccgagcagugacccuuccaggaugccgaaguuucuuuagaaucaacaugucaaccucuuucccucugucauucugaagaggcagugucucuugguuacugcccaaaagaaucacucgguccagguugcaggaagguguuuaagagggggcuuagguuaggaggugaggggguaucauuuuuugcuacccaaagccugccuaaagaguaccucaaagcagucagcauuaguguguguuauacugaagccuucgagaaaauucccaugucucagcgugaauggaguucugguaagaacaucacaccuuuuuuuguuguuguuguugcucaguguuguuguuacuggguaucaaugugccccuaucaaauccaaggcuucagauuguggcuauaaugacuacugccaaaugaagucaugugggcagacuguagcccaguauguccuuagaaggaagagaucaggacauaguaagacccccgggagaccaugggagaacacaaacaucuacaaaccaaggagagaggcaucaggugcaaccaaggcugcugacagccuggucucagacuucuaaccuccaucacuggucaggaaaguacacuuuuguugugccauccacucugucugugguucucucugugguagccuugguaccuugcugguagacucagcaagcagagacaggcucuggcuugugguaucaagaugggaauuggcagacuuauuuuccucccagacagaagucccagcuuggacagagucauuccacuguaagaccauuuaaauugaauucuauuaaugaaauucaaaggaguuuuugaauuauucgcauaugcaaauaggggauugaaguagggggaaaacagauuucauuagaaacgagagaaagaugcauuggagauaauguuuuacaguccuugaagaacaaaacuuaggugccauuauagaaagaacaaaaccccaaauuugguaucugugcauguguguguguguguguguguguguguguguguguguguguaugcauguacacacacaugcucuugcauguggacaugugcaugcgcaggccagagguugauguagguaggcauuucucaaagcucuccaccuuauuucuugagucagggucucuccccgaaccuggagcuugucgauuccugcaaacccuuggguucacgugucucucuccaguacuggcaucccggguauguugugccugguguguugugaggaugcuacagacccaaacacagguccuuacauuuguguggcaaacacuuuacuggauaucucuccagccccagaguuauugcuuugagaaaaaugaaacaaaacaaaacauguuuauacucuagugugugaaauuuucagcucuuucgccucuugcccccucaguuuccugggccucacccaacacacuggucuuuaguauauccacaucaacuaggacaggaaaauaaaacccacaguaauucccaugagcauccucacgaaugaagugucgagaaucuaaggaccaaugaaugugagaucucuggcuuucuuuagcuugaguuuauuaaacugucccugccuuuguaugauuaaggauggcuuagagcacuuucuucggguuuaauuagaugcuuacuuaacacuggccucugauggaaaucaauggguagaaugggggaaacccugacuguauuaagcuuggcacugugcgguucuuuuuauuugaucgacuuuucucaccuacaaaaugagaucugcuuggacucggcguucuuuggguucuagaugguuuauacuauuauauaucuaaaaguuaaucacacagggaugcuuuaaaacuuucccgucaccacaaauauauuuaaauguuugugaaucuaccuccuuucacucuuucuuccccgaaucaagacggggaaggaguuacauucgaguccuguacuuuuuugaugacguagcacugacuuuugugguaagcgucccugcuuggcugcucugcgggcagaaagaaguccagcauauaugcagugugaagggcucguguguaccucaucccacacucccugugcuucuccacuaacuccgggaaacuacgaucucugcucagguggaaguucagggcaacagccugaauguuccuccaugguaaccacgcaugcuauacugagcuauucgcuacugggccacuuccuuccagaaauuaaugcuaggagucauuacugaaaaaaaaucaguauuauuuaucaucaccugguucuaaucagaggcccaaacaaaacaacaaaaaauacaaaucagaaaugaacgucuagguuccguuuuuugacuucugauaccauuuuuguuauuuaagagaaaccauacauguauuuuuaaagcugagcgucauaauuagucuuaguuugguuaauuucaauacaagucauaaguuaaaaguaacaaugcauaauguuaaugagagcacauuaaauucauggcacccagggguggaugcaaaacagcgagagagcagcugugcccugaguaccacagagggauguugcuuuucuccuaaguggccccgggccagugccuguacuuccuggcuugccucccacuugcagacaagccuccagguuuaccuaccuccaccacgccaugauggauggauguguacuguuucuucuucaacaucaccagggugaugacaaucacgguugcuaugacaacgccgcccaccaugaguccgaugauggcgccuuuguucgaacccacaucuucagcaaagaacaccuucgaaaggaagccgagaaaaaggucuguaagcgcaagaggcaacggauguagcaaaguuucaggggacccuccgccauagcucagcgaagcgugaguuggugggucccuaggacugagcguccucgucucuggaacaaugagcaacagguggcuucccggguucugaagucaauuucucuggugcaucaugagguagaagucugcagggaucugaagcccuuuaacagguaagcauuugguaaaaaccaaauagagguccccgccauuguucuggaaacaggucacuccguuccugcccacagcaggugacuuugcccuuagcuagguuucaaaccugcaugcuuccguuucuuugaagggacauguucuauaugggucaaaaaacguucugaaacacaggaguuaaucagagagaaaaggacagccaagcuaccuucuucauaguacaauaguacauagauucaauuaaccacagaacgcauacucuccuuuaaaagcgccauguuugccaagggaagcagcaguaggcaaagagaaucucaguguaacaaacaagucauacuuuauccaguugccccuagaaaccaaaauuggcaauauugcuuuacucugguuguuuauauugaacauaaaaaagaauccugagaacgugacaaagaagaaauguauucacggugagaaagucucugcaguguauacauacgucuccacgcucuuuugaaaagcaagccagugguucccagcuuuaucuacuuaggcgaaauaacacauacagacugcacuuuaaucaucuuguuauauaagagaugaucuuauaugguggguuaaacgagggagggaggggcagcugugccuaacgaucuagagcacauuuguuauguaaguuagugccaacagcucccuaaauaauucuuuccaggcggcuucaagauaggugaaugaccgauuuccaucgcuaaauccaucccugcugcaguuugcaaaggcgagguaaacuagagcagauaaaauuuuucuaaguggauguuacucacagcgcaucugcggcaaaauuagaaauggcucguaauuaauccccucgccaaccaaaaaugcuagcucaacacauuuauuaaaggagaucauuaauuaacuaaugauacuacagugaggugaucgggaauaaaugugagucuggauauaucccuccgucuuuaaggaaauacuguaauucuguaauauucauugcacuaauuauaguacauuaucuuaucagcuagugcaguagagggagcugauaccccuaauugcugcggcugucauuagucacugucgcauuauagaaguucauguaauuacugagaagggcgucuaugacaccagcucaggaaaacgggauccuggguacucaucuuccgagccacgccccgacccccagccagccuuucagcaguuaccccagauuuguuuugaaaccuugcaguuucagccugcucaggagugccucugguuucacaauaacaaaacagcaauaaacuuuccaacgaaaacuacauuucagaaggcugggugccuuuuucugaauaaaaaaaggaaaaaaaaauuaaugcaaaauugaaucccaagccagcuuuagauuugcuacaauaauccagaauugagaagcccaacaguaaaggcccuuucuuuuggagauucauacuaggaucuacacauuuuauuuacaaacacugggaagauacuuuacaaaggaaucaggcugcagucucccacacuccacccaaccacagagcuggaguucuuaucaagcaccacuauacagguauuuucuuaccguuuuuaaaauucccacucaaguccuuuauugugauaacugguaacauggaaggaacucuaacgaucuggaauuuggcuuauuugaauuucugagguuuugguagagaauuauauaaucuccgccuaccuauaaggaagacccgugcuucucuacucauucuaauucugacauuaggaagaaaaccgccauugucuuuagagaaacugcuaucugccuugcccaagauuucugacugagaagcugaggcggcaaagucaccgcugggcuucacucaccuuaaagggucucugcuaacuuucccuuguaagccaaagaaauacugggagguggggaagcaguaggaaggaggagggguuggaauggacugaaauuauccauuuguagaugagaacuuaaccaagcacugcgagagagcaucccuacaaccaaguacuccccacaugcuuauuuaagaccaauucuucaaauaaaacuaucguggaccgagaauggucaugaccaaaaggguuucgaaaaucuugauuucuaacuuuuuuuuuuuuuugguauuuacauaaugagaccaucuuggaaacugggaccaccucuaaaugaaauucacuuaugcuucccccacacaguaauaucagagccucauggacuugaauuucuuguuugugguauccugccuuccaguuuggauauugggauuagauguguuuaacccgaaaaaaccauuuuccuaggaagucagcucacguagcugcaacguuggacugaauuacacuuguauguuccgccugggcucagcggcuucugcucagcaagaacuaucaacagagccccacuuccucuccuuccuaucuuugugaagaucuaggcaggcauuuugguuuuauucccaguaguccuucucaguuuugacacaggacaagccacgaggugccacguauuucaucuggccagacgcaaucucggggagaggcaguuuauuuuugccuaccaguuuuugauggcggacuucaaauccugaaucauguccgaauucugcauccaucuucacuuccgagaucucuuccgucuugauguuugucagcccagaaccugcgucaaacacaaaguaugcagggccauccguuagugugaccgccagccacaaggaggcaaaaacugccuuaaaguucucucuuggccagagcuuuuaggaaaaacggauuuagggauuuuucucaagaaaaaugacacccuagauuuaaaccauuaaccaccaccuagcaaacaaaaagacugaagaacgcugaauauguaaugccuguguggccaaacacaugccauaauuaaaaggggagggagggaaaggggggaaaaaucaaugcugguuaagaugccagguuaaauuguaccuaagaaauguugacuugguuuuagcggcuuguuguuuauuaugugugcacuuuuuaugggcugggacugcuuaaagaaaaacgaaaugcacggcuuuggaaaugaacuuuaacgaccugggagaacaaauccauuacuuuggagcuuuguucuaauugcaaguaaaucauguucauauuucucugcacggcgguagcacugucagucacauaauuuguuuagcucagcaucccagcucucuagcugaacacgccccguggaaucgcuucauccgcugacucgaaaggagcacacaaugaacagagagcgucucugggaucaauagaauucauuaccuaauuccucuuucucuauacguggcugcaugguucuuggaccaauucuuacagcguuucaugauucaacuauucaucugaggcucaaaacuaaaagguaaaauauguuuuagaaauggaagugaagacagacagaagggauguccguuugcaucaguugucguguuuucugaagugauccuacugaaguagaaucugaggcuaugaaggaagggcuuuuagagccaccuccuccaugauguuuccaauggaggcagguucuuagcaccuacgugaauucaaagguagaggucaguuugcauaccagagagaaugauuuuguuuccuacagauuacugcaacacggucucccuguaaccuacaccgcagggccugguccuauuucgagugagccaggcaucuaucugugacaccagguagguuugagcacgugugucagacauuaaaggcaaggcagugaggauuccuuucucuggcuacacauugugaauucccgcaacuccugugggaacucauugccucuucugggucuaauggcucuuccaaucuuguccaucaaguauuggaaaacuugucaacccccugcugacccugaaaagcacaaggucauaagcacugagaaagcccgucagccagucagcauggcuucugcugagagugaguauaauugacagaccugggcaguccaugcugggugugacucaucaccaccucuugucuaacugcccacaacgcuucccuuggacaacccaccguaaaccaggcucaugaugaaugccaaucugcucacaguacaaugcugcucucccucgcuucugccucuggaucacacuuccccauuuccuucuagcugggccuuccuacucuucuguucuaacucucacaaugacuagccacuguuguucaaguuccucuucauguguucuuagccuggguuguagggaacuguacuugucuacauaugugaguauacaacacacauuuauuauuaauaaugauuucaaaaaaccagaacuuuguucuuuuguucuccggagcaggggaugauaugguaucuauguaaguagaacauggcagaacugaugccuuauaaaaggcaccaaagcuucuuucuuauucccucuauuguacuucuuggugugugggaagccagcugccaugggaagguaccgaaggcuccugacagcagccaagagagugcuugaucucugucagcucuagccagaccuucaggagaccacagcuuuggcagugucuucauugugauuucaugaaagagccugagccagaaccagccagcucugcccuaugcuaaaaugcuggcuggcugaaacugcuguaaggagcuaaacgcuugcucuaugaagcugcuaaguucuggggcuacuuguuacacagcgauaggugacuaggcaacgaauacaaaggcuuagcgcuuucuuuucucacgguguucuaucugaacuuuaauuuccuuucaucgggagaucauuuuuauuaauuuagacaggaaagacacaacgagaccuguaaguccccuuucuguuucaucucauuagcucugcuuguuuucauucgacagcccuuguccuuggauacuacuugaagaacugcaaccuucuauuuuuacauuacuuaaaaaaauuaccuuuauuuuuuucauauuauaacucacucuguucucuguacuuccugacacuauuuuuuuuucuaauguggcagugacaugaaugcucuuuaaaucaccccgguugcuuauuuucaucuuccuccaaaccuuuauaaaaccugaccuacuuccucguuagaucaacagugauuucuuucuaaugcagccuucccucaccacaugcgaguaguaacacggcaguuaaaguuacuucugagauuuuagugaaaacuuguaaguagucuucccuuuuauaucagggggugggggaggcagagagcacagcauugcgaugaauaugucaauuauuacguccccauuuaaaaccguauaagcuccugguaugguggagaggacacugacaguguaucugaugacagaaaaaggcaaaaaaaaaaaaucaaauucacgucacaugcuagcacgacuggcaauguucacaguucaguaguguaagacucagcagaaagagucccucuuucacugcuguucagcacguaauggcauuuagaagauguucuacgcacuaagcaauauuauuacagagagauuaacaaaacaauagaacaaugaaauaaaucaauaggaaaauaucucuuggggucacgaaacuagauuguuaggccuggagaaggaugggacagggaauaauggcgggguagcuuaacacaccaagugaagagacugcugauguguuuucuuauugucugcaagaguccaguuuuugcuuggaaacauuccaggaagagugaguagcugggauugucacugugucuaaaaaucggcaucauuauugcuguggcuugugggugacacuaucuucuaaaaguuacaauauccugguuuuucagauaagaaagaaaaucauucucuucaucauggugaugugaaacagggcauagaaaggacuaagccaaaacucacacccuugauuucuuuguuucugagugacaagaaagauuauuaaagagcaaugguggagggcaauccugggaagggcaucuaagaccggaaaagucuacagaugcaauguggcagaguccagaguguggauuccuaacagguggcuguagaguuauuggaacaggugcacagcguaggaagguaucagucugaauaugcggcagacucauugccaacacagaaguacagaugauagagccuacacaacuccucagacacggugagcaaauuccaugcucauaauugcagcuuagcuggcuuccgcaugccugguguauaccaucuuccucuucgguggcuaucuuuggaaggauguggauauauggauacaggucuuacaaggacaagcccaggacaguuucuaaucuaacugauuuccuccucgcccuccccugggccuuaaaucucccacuccccucucucuguggaaagcuccuuuccagagaguucccuggauaacaugcucugucaccaaacgucuuuguguguccucauauauuccuguccucccaucuuucucuaaauucaaagugaguuguuuuugauuacaucucaggcccccgggagcaagaaccuuaucauuuauucuuuuugaguauucacagaauuuacaacauugaugucucaugggauaauacuguuguuauuguaggcuuucccuguucuguagaacgccauuaguuucuuuucucaaaacagaugacuuuuuuuugccaguguaugaaaaugccuuuuacauguucaguuuacauaaacagagugagaagaugagcugguugacugugugagugcuggauuauuugaacaggaacaaguacauccuuauauaauagaggaauguaauaaaaucggcuggauguacgccucaauauuacauuuuauguuuauagauaaaaaauaggucaucuuuaaaaaaauaaaacgaguagcgugcuauuuuaaaaagucuaggagaccagcuugagcugguuguagcuguggugaggacucacuggacuuacuggcccugccuugggcuucacuggcuggcagaacagcaugggaaggucaacugcugguucccuggacauuuacuuagugacacugucauuaaagaggacaugagagagcccaaagaguguacaacuuauauaacucaagguucuuuuaaaagcacuucagacaagacguucgucagaucaaugaggucagcuguccuccgacguaucacucugcaauuucugcucaggugcugaaccacaucaugggaucagugugaugccagaaggacucucaaagucuuucccuaggaccauggcuggcagcagccaaggcuagagauuugaauggcaagaagaggggcguggccauaucuggucuuacuggggauaccucugaaccaggaagcaaaacuaccucccuuuagugauguccccaagggauguuaacauugcucuugaguaucucaugggaucugggcauaaagaaaguaaacgugggaagguaugugcuauuuggaagaaaaucucuccacaauacacagaucuuccaauucauugacuuuccccucucugauucacuuugucggucacuaucaguggggugaggcugugcaaggaguagacacaagcggguucuaugucucuugcggugugacauuauucuuaagacuuuaaguuuagccgggggcuaaacauagaauagggggucgaaacccauuucuuuuuaaucuugggaaacuguauaaaaagaaauaucuauuuugauagugaagaaauuuguaagacagaaaaacaaaagggcuucucugcaaaauuaugcauauccaucuguuguguuacuucagccacuggcugagcguaagcauagucaauccacagagggcacuaaguauuucuggagcuggagaaauaccaauaaugauauuuuaaggaaauugugucuauguuaguaaccaacaaaagucugaggccacucaaggacccccaugaauacuaaacaagagaggaaggagaugucuucagcaagaaucaauuucccacugaaaucuacaccucccugggccucuaccgugugugaggacaggguccacaucacacucuucauuuauuaaaaaaggaagaaaucaagaaaaagagccccacauuugaaaagacucucuuuguuucagaaagaaggcucagaaacaaacaaacaaacaaacaaacaaacaaacacuagaucacguaggaacuugggaaaugaggcauaaggagaagccaagacucugaaaucaugcuuggugccuacagucguuuuaaauucuaucccguaacacgugcaacccagagaggcauguuugcugaagcgcacagugcugagagcagaggcgaaauggggcgagucagauaccuggucgaguggucaguccucggucagcagcggggcgggcgucaacaggcucgacuggugcaggaagcaagagacagagagcaaaggagacaaaucaggaugguuaagucguggcuucugaacacagagcaagggaaagcauuugcaauaaacaagucaugaaaaaggagcagcugggaaaaaaaagaaccuuugugagcuaauccugggcaucaaggauggggagggguaccacuuccaaaggcuuagcgccccugacgugccaacgugucuccuuaguguggucauagagcacucaccaggauguacaauaggaucaaagacggaggcuggggaagguagacuuuccucugggcuagguuagagaugguuucuuggcuuuugauuagaaauaaaauagauuaugcccagcccagcaguaaacuuaaaagcuaccuccuccuacagcuacucaaucuuaucuucuuuuacaguuaauuaacuacuaagggauuauucaauugccaggggaaaugcaaauaugaguuuaucggaagagcaacgcuuuuugccauuuagugaagcaaauuccuucugaguuuaggguagaagaaguaacccacgggcucccccccccccccguuucuccuuugaaauggcuggcuuccucucuacagaugacauucaucugaauugugugaaaugagaccauuuccugucauaucugcugacagucacaaucauccuuuuguacgcguucugggacugauccaaagaaaacaacgucuaagcgcgguaauccccacggugacucugcaccgccuggcauucccaaggcgguguucugucccuugucagaaaacaacuucccucagcucagacuggauuuugaagaaauaaggaagggagagagagggcaaccaagcuuuaaggauuaacaaguggcugaagggcagaugaaggcaagggaggaggaaguccccugggucaggucuggcaaguguaaaagagagaaagaaaucugagcguagugguggagggaagccagcgggaguuugaugggagccuuggggacccacaguuucaaccauuuagcuuacagaggcucacaggccaaguggucgaaagugaccacaaccccaaauccguucugaauggauggcacaguugauaagaauggcggcagggaacagaaggacagagaguugucuucauaaaaugggccaauugcgcuucugagcgcauuaagagaauugggcgugucaggaggcugaagcgguccugacuuugcugguguggaaacuggcaacguggucuagaaagaaguggaggaauggcaucgaagaaacccagaaccggugucaaggugugugacuguggccaaacagccaccgagguuguuuccucuuauggaaaaaggaagguaacagcaccuggucuuuuuauugcaguaaggacugauuguuuugaaaauucacuucagaagcuucucgcgauauuugauugauuacauugauuacauugaagguucucaugcuguaugcuuccauuuauugaaugcccugucuguuucaacaaugacauggacaguuucucuauaucucauuucucaccgcaaauaugaaccgugauuuuuaugaccccuguaaaauggaguuagccgaagagggugacucuacuuuuuuaaaugucuugaugccgaggagcuaauuggugcagcgguugcugguguggccaaacgaagcuccccucgcuguugacagucacaccucagaaaauguacguuuggcucaggguagcaccuguaccuguggugcacaggcaagguguacagcugguugccuccucacccacaaguauuaugcuaaugaugaaaauuacuaguguguagagagacauuauucuaagugcuauucauucuacugagguaagaacacaauucugacaaauuucccugacuggaaaauuuuguuuuaugauauuguuuacgguaugaaaaaauucuguuucuugucuaccuauauugccuuucagaauuugggauauauacacacgcugugcuuugaccaaaguucccacuccacucccucauccccaauuccuccucuacccucuuccauucuucccucccaacuuccuguguccuuuccuucagccauagaguccacucagcaccgccagcgugcacauugguggagagccaucuacuggaccgcggaccgcaucuuuggagagaacugacucccuggcucgcagcagccaucaacugccaaaguucugagguagggcuggcacguaugaucaccucuucacucgaugcagauccugugcaggucucgccuucugaccgucucaacgucugaauccauuuguguaaguaacugcccugacguguccugaaaauacucucaucagagccauccacauucuuaacucuuuuuuuuuuucuuuucucaauguaaaagaacuaaaugaccagguaucuacuggucuugacucuuuuuuuuuuuuuuuuuuuuuuugacucuuuuuguugaagaaaaucaggcccuuucugguaagcauuugaaucuaugcugggaagggccucauggacaaugaaaggaaauccuuugagagcuguagguauuuuuaguagcucaggguguguguaggggagaacagggaacauggggaaugcacagcaggaacacuguaucauaugccuuuauuacuuauucauuugaagggcauacuguuuaggcgcaaggugagccaucuggacagagaaugaccacgccgcuccaacaagacccagcuccauugaaaagguguuuuaaagagcucuccacgaaaauguucucaaacugccuuuaagcaaggaacgaagauacagauuaucucaggcuggacaguggcuggagaggcucagucacgugagcagucacacagcagagcuguaauggaacgucagaccugaccauuaggagcccuggcuacucucccaaggggaaugugguguuuagucccuagacuaagcaaagagaggcaugacugccauuuagugggggugaggauccaggucacugaaugccggaguacacagggucacugcagcaacccacacccuacacggcucucuaacuucccacuggauguaagggguuaaugguaauguaaauccagaacccacuucagcucugaauuuaugaauucaguauggcuccauaguguugugugugcaugucaugaaugguguguacacacaggugugccugugugugcacuugguugguccaugcacacugcagagcaggccuuagcguaucucauucuagcacugcaccuugcugccuugagacagggucucucacugagccugggcuugcaguuucauauaggcuggcugggccaugaacacucaggaucugccuaugucuguuuccaauacaggaguuacacauaugauauaugcugccaugugggauuuaguuuuggggggcaaaaggggaaucuaccuauguuugcccccaauacuggaguauguauagccauuuuuuuuuuuuuuaaugaaaguguugaagauucaaagucaggacuucauguuuggagaacaauucauuguucuuauuuacugaaccaaccaaccccugcaguucuuaguguguguguguguguguguguguguguguguguguguguguguuacugaguaaauacagggagggcuguauuauuucaauguugcuauuugcaacauuguugcuauuugcaccauuguuguuauuugcaacauuguugcuauuugcaacauuguuuuuccaggaagaccuugccagucccauuuauucuaagaugaacugucauaggcuggggggcuaccauccauaguggaggucaggcuuagcacccacaaauccuagguucaccccucagaccaucaaagucaaacaaacaaacaacaacaacaacaacaaaacgaauuaauuguugaaaaggcuuuucaaaauaccuguucuaauggggcauuggguauauaaaggugagacccauacuucaagacuuagagaucaggaagacucaugugcccuggggcauaaagcuaagcuggcauuguugcagacugaauagauagaugguucacauguucugcauaagccuuuguaucgacuagauuccugcccucucuuguuacugcucucauucugcuguuaaucauuagcagauuugcgugugugcuuguguguauguguguguacauguuauuugcaccaucaccuugaauuuuaagacaaggucucuuaguggcaaagaacuuaccaaguaggcuaggcuggcugggaaacgcgccugaggggucuaucucucucuaccuuuccagagccaccaagccuugcuuuuuacauaggugguggggauugaacacaggucuucaugcuugccaggcaaaaccaguuuccugagugaucuccccagccccaguagcacaccucuaacaagaaagccugcuuuggauguuaaaggcuaggcuacaucgcacugaguacugagcauacguccagacucacuuaaaucaaggcucugccuggacaucuuggcaauugucaagaguaucagugacugugucuguguugugucacaugugcuugucacaguaugugcuuuuacuaugaagagccaaucucaugugcgcugagcuuagaaaaugaggcuguacauuuuuuuuuacauacucaucuuauuacagauuauguacgggguaacaaugacuuuagagccccaaauguaucuauauaauaaccaugaggcauagaaaaucaaaugaccuacucuuuuugguuuuguuuugguaggauucuuuuaacaagugggaaagucaauuauuuauaucccauaaauaauguugaugcuguauaguaucuaauauaauuauaccuguaaguugccuuuguuuuuucagauuaaagaaacaaauuggguuguuaugcugugaaaaaaaaaaguguauacacagauuuccgcagccugucuucaaaaacugcucacucacggggcaugguggcaacucaccuuuaaucccagcagaggcagguagaacucugugaguuuggggccagccuggacuacaagugaguuccaggauagccagaccuacauagacagauauugccucaaaaaacaaacaaagaccccaaaaccaaaaucaaacaaacaaaccaaaaaccaaccaaacacaaccaucacccuguuugcucagugcuuuugcacugugaggaaaaccccaggcagauacuguugccuucuuggaaagcauucuuagcuucaagaaaucaagguaauugugugcaugcaauuuguacugaacauggaaaaauggcaaaauaagcuaacagguuauuuuguugcuuccuaaacagguucuucuaagucccuguacuggcugguuuugugugucaacuugacacaagcuggaguuaucacagagaaaggcgccucccuugaggaaaugccuccaugaaauccauaagguauuuucucaauuagugauuaaggcucggagggcccacuguggguggugccaucccugggcugguagucuuggcuucuauaagaaagcaagcugagcaagccaggggaagcaagccaguaagcagcauccuccauggccucugcaucagcuccugucuccaaguuccugcccuguaugaguucaaguccugcauccuuuggugaugaacagcaauguggaaguguaagcugaacaaacccuuuccuccccaacuugcuuuuugguuaugguauuuugugcaggaauagaagcccuaacauaauccccccugaaagaauuacaucacccaggugugcagauucguugaucgagaaaucauuucucuuuaguucugacguaaacuugcuucauucacucuacucauucuauugcguucgcugcauucuuucaguaagaaucggcggcugaggaggauuauuucagcgucugucuacuguacaaggcccugucaaaccuucucucugggggaccaaguucugcccuuaauuuggucacccuuuucauuaaagguggacauucugggccaaaagcuuagaagcgcaaaucaaauccugguuucauggaagagauaaaauaacucccagugagaguauguuuaaauaauuauuucccagugucuuaaauucccaaacauaggaggaggcagguggauuucugggaguccaaagaugugcgucucuaguucugugucucugucuguccuucucucugccaccccgccccccaccuccacagucauccaugaccugaucuauguuuccuuaugcacuuuuauuuugagaugguguuucccuauauuguacaugccagucuuggacaguugguaggugugugccucucucuauguaaauauguauguaaauuuacaaagggaaaggagaaauaaaaaguacuaguuuauuuuuguuaccuuuuuuaaaauguagagaugaagacggcacauggggcaaucacagcauauacugugaguccucuaaucuauaggagugguaucccugcgggugacacagaucucugccacacaccagguccuucucucaaaaguacucuaggcaacuguuaccauggggaccuauaacauaggccacacccacccagaaggcuuuuggcuccagguagggacucuuaccuucauuuucgguauuggcuggcacagaguccaccccaaaagggugccacggcuggaggucauccaggcugaauuccccauucacgggaaggagcuccacgguggucuugguuuccgucagcgaaggcaugagagcgucguuuccguagcugauucugggcucacugaucauguuggccaagacaucgucggaguaguucugcuccuucugaagcagcucaucuaaagaaaagccaguguguccucgguuagcguacgcuuacagcggccauuccuacugacuacaugccgugugugacgaggugucacuuggcaccaccuaacauguaaaaaacgaagcaccuuaaggaaagucagagcuuagugguugacccgaugggcugcucugagccuguggagacugcucugagccuguggagacugcucugagccuguggagacugcucugagccuguggagacugcucugagccuguggagacugcucugagccugucgagacugcucugagccugucgagacuggcugaucuuguugcugauucucuucuccagaggugaagaccuggagggugaacuaacugccuuuuccuuuccacagacuccccauguauccagugaucaugaaggauucuacagcaugcuaugaugugggaccgggguagaguguuaacagcaggcauggaggugcagucugggaaccaagauauagcgucugucuacccccaccuccgggcagauguggaugggugagaaaauauuacaaacgggccuccugcuccauucagucaccgugaccuuugcucugaaaacagcugccuuccccagaugcagcagagcuacaaacauacacuuuguccuucaaggcaugucacugaggacccugaagaaugcucacugucugagcuaaucuccuaucucuuccucucaggaucauauaagugaccugagaugaaagucccugaauuuguuuucuguagcuucuaucuuccccgaaggaaaaaaaaaaucaaccuuauggaauauagcugaucuacccaaagaucugagaguccaguaagaaauccuccaauugcaccuuucauuauuaaaaaaguuuaccaggggaacagaaaaacagaauguaauauaaugaguguaguugcuaccaccaucaccaaaaccccccaaaacagaugauuugugaaucuccuauuaucuuacaaaaaguuccccugacauuuuaucuauaguuuuuuaaaaaucagaggcccauugaucauaugguauuaauacuugauuaauuaagugugucauuacugagucacgccugugucaguuuacugaauuauauuucaagcccaucacuaguuaauaucaaugcuggagaaaauaaagaaaauuaaaccuggauuuauacuugacuuguaacauuuuacuaucauccuuucaauccucuuuuaaguugacaaaaaagccaauuuacuggaaaaauuaauauuccgcucaaauguguacccauuaaaacaauuugaagggacagcauuaaaguaugcgauuaauaucuuccuguagagucaguuuuauuacaagagauuauuuuaaaugauagaaccccuagcaaauuaguccuuuugaagucuaauuugaguuauaauauauaccuacucaguguggcacugaucuaaaauucaauauuugaugcuugcaaugaccuuucccacacagauaaaaggcccucauuagacuucuccuagacuuuuucaugucuuaucaagucacagguaauggccaguaacuuggccaaagucugauuuaauaaauuaagugggcauuucuuuuauauaaaucuuaugcuuugacugguuagcacuuaauacccugaagucaagauaguuuggaauaauuaucgaugcccacacguccaccuugagaggcaagaaccaggagggagcucuuggaugccugaggucucuauggcauuuauuaccacgcuuuuccuggacuuugaaacuuuuucauugucuugcuguucccucauaaugucugaaaaugucagccgguccuuaggaagagagaaaggaaggacgggaggaaggaaggagaaaaaauaagcaagcucugugcccuuaaccuuuucuucucacauuuccuucuccaacuuucuccuuugaaaaugacccaugcuugaagguguaaagaucuccuucauguggacagcauugaaaugguauuucuucaugacugacucuuuuauucugacaacguggaagguauaugaugcuugagccuuccucuuggacuacagacuugguucucuucgcuccugccuucccguggcaguuagcgucgauacauucucagccucagaacuauccacgauacauacuuaacaauacugacaacauucgaauguccgcuucugaaucgucucccuguucugugaccuccccucaguuuugcuuugaugaaguguagcuguggacuuacugccugcuaccauaugaauaugccucaaaauucacguauugaaacuuacuccccggagaaguaacaauacacaggguugugugggguuuggggaugggauuaagugaaggcucucacugcuauuaauggaguagggcuuguccucucuggagggcacaacaaguccccacucugaaugaggaaaguugaguucucuaagacacugaagcuuccagcaucuucuuaaacuuguaguuaggucugcgagaaacaaaagucuuauuuuuuauaaauugccuaguuauaaauuuauauaaaugugauaaauugcugguuguugguuuuuguuguuauuguuuuacuugaagacaugagucucauaucucauggaauccucaaacucuauguagcugaggauaaccuugaacccauaaucccccacugcccaguucuaagauuacaggaauguaccaccgcaucgagcucagauauuguuaaggcaauaugaacugacugaucgcugcucuuuaccaaucugcauuugacugccuucccuagauccuucccagauacugaggcaagacuccuucucauuucaauagucuccacuguguagugaauuaauccaagaugcuagggcccuucagugucccuagcucccugcauaucuccagccuuguggguugcaacuccuucccgucuccagcaucccucuggagcugugguauugaacaguguggguuaccauccugggagugcuuauuugcggagcagaucaaacauaagccuugcaucuggagagguugauuuguaaccauaccagccuuauagaguggacauugccucccaccacugcccacucccaccccaaaagggguuucucagacuagagcagguggagagagagagagagagagagagagagagagagagagagagagagcgcagaccagaccacauguccgucucauaggaagaucuuauauuuggauacauuugcauacagggucccggaaaguucaggcaaagacaacguggcacccuugucucauuuauccuuaaaguuguuggcaagauauuuccuccaaauagacacaagacacauagcccacugcugugaacagcacacaaauucacacgauggggacggagcuguggugacggcucaguaguuaagagcacugguugcucuugcacaggaccuggguggaguugccagccccuacaugguagcucacaaccaucuacaaaucuaguuccagggcaucagauaccuucugaaacauauagugggcacauauguagugccaauacauagaugcaggcaaaacauucuuacacauuuaaaaaaaucaucugcaucaccucaaaacgaacaaaaaaaaaacuauuaggaaauuuaugugaaaaguugaaaucuucaagaaaagcgacauuuucagcugagagaaaaaucucuuagcacaaguagcagggauccauauuauuaucuuaauuuaacguagggaauuuaaaaauaaccacuuguggcaaugccauuuagaacaaggaauucagucugcucuuaagggcagagagcugaauaaauucgaaaggauugccauuaccacgguaggacucuacuuuaugaucauaaaauguucaagacagccagcuacucugugauuaagggcucaggauuuuaccgcugggaaaugcacugacgcugggcaauugugccuguguccgacaaggcagggaccagagugacugugucacugagcuuugaucccauggugaggcaaagccaccagaaaccaucuucuacuguguucgugguggcucaaauggguuauacuuuuauuugaauuaauuuaauauuuuauucuaauuugauggccuauauuaaggaccaucgaagccuuuaaauauccaagcuuaccaauugcuauauuaaucuaagagacaacauucauuuucccaagacucccuuuuccccuucaggacagcaccuuguuaccaucuaacauuucaucagguacuacuccagucaagaaucuucuguaauauccagacacuuggguuuuucaagguuaaagcaggaauauuuaauuaagcccagugaugguaauguuucacuuaugguuuacauaaugggugugaauucuagcacacacacacacacacacacacacacacacacacacacacacacacacacacagagugaaccccaucacuuuccucuuucaaaaacgcuuugaugauuuaugugggcaaaucaaacuuagaguaaacaggaaggugggguaggggagggcguuagcuauuguggaaaacauucaagauacuucaaagagagcaacauuaagagagagucacagugauuucaucuucaaaugauuucaaacuuuuaguuuugguuugguggacacuaaagauguccauggccauuuguuuuuagcgaaagggccucaugaauaaaggucugccagaggagggaagacacgaauccuacguauuccaucccagagucuccuuauaacuauuaaaugacacaucagccaaauaaauuucaaaaucuuaagggcuacauuucagguuucuaaaaaauaaaauuuauagucauugagucaaucuuucuaacaaguuucauaauaacugguaauuacagacugaugccuucuguguacuggacauacugaguauuuuuuauuuuuuauuuuucauacaagugaggaguuaucuuaaccuugucaaacaaggcuauuaaagggcuaguuuagaccacugaaccagcgguuugucaggcuugcucuguuuuucuucuaggacugaaucuuuauugacauuauaccugucuuaauuuugauucuuugucucccugugaaaaauuacugaucucugaucuccaccaaaaugggaguuucuuuuuaauuuuguuuaacagaggauucuccuaaaaccgauuuuaauguuuuaaauagauacuuauauaucugccugcuacuucccuacacuguccuuuggcuccaagugcacuggaagaaggucuguaauuuuuccccaucaaagagcuugacuagaaaucagccaucauccauucuaggcauuuugcccauacuagagcuaugagaucagauuuaauuuuccaaccagagccugugcaugucuaaccccuggcucagucuauuaaugugaugcuguuauuaauguccccguggccucugaaacuccuuaagccuguauuccuuaucuacaagauuccagguugggugacagucucuggcacuccaucacuuaaauucuguuauguaaacucaaucucgggacauagguguccauuggggaucuuguuggaaguacagaauuguccuacagguguccuaaagcaugcuuauaauuccagcacuugggaggcugagacaggaggauuucaaguauagggcuuaccuaggguauauaggagguuugaggaucuccuagguuacauagcaaacuuuugucucagaaagagaaaagacagaauccucgugccccuuccacuccuuggauacagguagcaaaucugcauauuagagggcucccaggugacaacugucaaaggcuagucaucacuuguggugaagucugagaggaccggagccauaagccaugcagugcagaagcaagaauguagugaccucaguucccgucaucacagacagaccaguuuucggagagugugucacacucagcuaagcaccaccacugccaggagaagacgugcgcuggaggacgccuucagcaaaucuuaguuuucaaacccaacacuuggcugccuuaaaacuaacguucaagaucacauuucuguaccaggauagcccaggaaaacugaaaacaaccaugauuuccuucuuggccaaaucauuuauuaagcaggaaggggaagcacagagauguguugggaauagguugauguuucuuagucuccaagaauaagaacguacacacaagaaagcaccaggccacacgucauuccuggcuccucccagaaaggagagauacuucugcacuguggacacuucgcagaccagccuggcuggacagaccuggcuuggcuuugugaggcagcagcuaauagagaugcugacuugcagggacacauggaaucuuccuaugguugcuguauucacucugacuacguacaaaccacagcuaucuccaaugccaugaccaguccaccaaguacucaaguccugcuauaccuugggggcuggggggggcccacuacccucccuacacuguccacaucaguggccuuuguagcuacucacuggcucauuugguacccauagcaacccccacugagaacagaaugcacaaacauccauucucagaagguuuaaaaucaacaaacaaggcaugugcuagccccacacuugcaauacuagcacuugggaggcugaaacuggagggcuauaaguucgaugccagcuuggauauguagugaguuccaagacagcacuacauauggagugagaauaugccucaaaaauaaauaauauguagauaaauacauauugaguagcagaacugauacuauaacugaaaccugaggaccccaguuccuaauguaauccucucaucagcccaugagaauuuucauguuauuuagaaagagauaauuucaaugauuauuauuccccccccccccaauaaacuuaggccaaagagguuaaagguguagcucuagaggcucauuagggaagugugacagagccugaagcuguuguccaucaguucuguuuggauuuuccauuuccaacaaugguuucuuucccccaggaacacucacugucuuucccuucuucaauguccaucucaugaaauacugugggaacugccauaucaacguggaugaucccgcacagccucauggaccugaacacuuagcucaucgcugcuggugcucucagggaagagucaguuugcugacucuuggaggugaagccucacagaagaaggaagucagucccugagggugggccuugaacacuuaacagcccaguccuacuuccuguucccucuccugacuuccugacuuuggaugcuaugugaacaguugccuccugccaccaggcaugcuaucuccccuuaaacugcaagccaaaccccaucccuuccuccuucaaauugguucuugucagauguugucucugcaaggagaaaaguaaccaaucuaagaggaggcuguuugguugccauaggaacccccacuaggcuucaacacccuacuucacaguuaagagaaguuaaacaaucugaauuugaguugggcucugccccacaaaucuuuucugugcccaaaugaaguggagugaucagguuaccucaguggcugagagagaaugaucauuguaggacuguuucccaaacuggggggaaaaccucuauagacaucacuuagcaaugagcucuccccacaaaccuccgcgucuagaaaauuaaggcagcucuuuuaucuggagcuacacuaucaaucucgagaauugcccagagucuaaguacagacucaugucuagaucgagguuuauuuuuguguagaaguuuccuggccacagaguuucaaauggggguguguuccguccacuuaugguaggcaacuguccccagagaggacucacagaaggcggagcaucacuugugaaaacuacuccuuauugcaagugacauuuuccugaaauaccaucgucuggucuagacugaaguuucagaagaagugccuuucccuugaagaggaguuuccuuguggcuuucaaacuccuacaucaaacagcuccguucuaucaaccggcauuagccagaaaucaagaugaaaacacagccaggcucccuggccuuggcaaaaggauuaaaaagcuucccuuuccguguuuauuuauggaacuugggccaaggucccgaucuuauuuccaaccacuuuagggggucuuaaucccccugggaugucagccaccuggggcccugacugcagaguuuucacacuacagcacuggucuuugaaagaaaguucugugggcugaaguucuaaugcucauacguguaaauuacacggauguacuugcuuggaaaaugaaucacacgguggaaaaucuagcacuaggaggccacuauacauuuaacucacauuuuuauuuuucauuuuugucuuuuagaaauuauuuuaucuacuuauuuauuauuauuaucaucaucauuauuauuauugaaucuuuuuuuacaguccagucauuagcuccccucccaguccacccucugacuguuccucaucccauaccuccucccccaacuccaagaggaugucccgucuuguuuucuuauuuaaucuuuauggcuguggccauagagaaugacaucuuugagacuacuauuagguuuggggacauauaaauauggacuuauggggaagaaaucuuuccaguuagauccuuaauuuucauuuuacuggggcucuuuggaauacuugguguugacguauauuugcuuaaaaguaaaaggucagaauauuuauaauagcaccaucuauuauuaugaaaaacuaauuuuuaguguggaccaauaaaaaaacaaacguagaguaagagaugaaaaaaaaaauuaauugagcccggagucccguggcuccuucucggcuccuguaggguguucugggcaucauuacuugggguucuuucauccccacuugagcuccgagccaccucugagacagcugguaaggaaaucaaccucucuccuuacaaauggacauaacauuuucuuugaggcgagugagucacaugcacagcccaugacuggcucugccacacgugcuuuggacuucagcaauggugugcgucuucaaacacaucagagagagaagcaggggcggguggccaugcuggcauggccacaggacugcuguucauggcugugcagcugcagacaacucuucacugugguuuccaugacugcuguccguuauagcaggguccugugcgacuuauacaacuguagcuaugcaguggcccaggcucucaagugcucucccucagacuuggaagagaacccugccuggccugcucaagaccacagcagauguauggaaugggaaucacacacugcugggccaggaagagagcucaguacaguuccaguugaugagggacggacaacuacuauauucagggggaugaaaaaacugggucaaaagauggugagcucgugguagaaaggaagaugccaacaucuguagacaauuucauggggagacccuaaaagauaugcugauaaauaagggcucaguguggaaaaugugccuaaauacacaggucaucacaauggagggcuauguuccuuauacacaauacaucucuguaggcaugaccgcucauuuaaaugcuaauguaugcauauuuuagaaacccuaaacacauccaguaugcucuucuguacacuggccuguuugucuuuaacgaaaucuugcuuuccuagcuauggcgauggcccuuucucuccagcagaaacucauucacauggucccuuaacgaggcccaggagacugugaugaagaauaacgccaacuggcaacuugauaggcucuggaguaaccaaggagacaaaggauuauuuagauuaaguuagccuccaugccugccuaggagggaucgguuucauuagguuaacagaagguagaccuacccuaaaugugggucacaccuuucucugcuuggguccuacuaggccaaagagggaaauuaacaagaaccgaccaaucaccacccuccacuuccucguccuggaugucaagugaccugcagcuuuggcugcucugcuuugauccauuguguccuuggacugcaagcggagauagagccuuucucccuuaagcugcuuuggucaggguacuuuaucucagcaacagaaaaaguaagauagcauccaagccuggaaauggcaagugcuaagcguuagggguuuggccagggguggaaucgaccugccuucaggaaggcacucagugcacagaggugaggagugggaagaaaucccuguaagaaucuggaacaaggagacucaaacgaguuacguggugagcucacugauacucauuugucgauauuuccagaccagugccagaaauaacuaacucaauuucuucgcaugcaaagaacucaaggcugacaggaaaggacccacacaagcacuaggauguccuauuccucagacacuucucuuuccaucauuuagggcccggauuauaggugcaugcugucauuccugcuuuugacacggcccuggggaucagaacgcaggucuucacguguucauagcaaagacuuuauccacuaagccaacucuccggcacucagaucaaaaguuaaugggaaaacacucacugugucuguauugaacacaaauagggcuuuuaccaugcuguuuucaaaacauuacaggguagugaguguugacugagcaguggcaauggauuagguuuuaugagcagcacacaagaagaugcucaggaaguacacuguagcugucuucagacacaucagaagagggcaucagaucucauugcagaugguugugagccaccauguacuugcugggaucugaacucaggaccucuggaagaguagucagugcucugaaccacugagccaucacuccagcccccaagaagaugcucauaaguccuauacaaauacaaacugucuauauaaggaguuggagcauccaugaauuuggggauuccugaggugggcguguccuggaaucugguccuaaacucccaacacugagggauaucuacccaguucauaggagauuauauuccaaucucuucaaacugcuucuaguaucuguacuucccagcuuuaauccaggacuucaccuaagacucuuugggcucucuugaaaauacacgacucuagaaaucuaucuauuauuuauuuuuaaagguuacuuuaaaaugcuguuuucaugcccacacaguuagccucuccucaccucacccagcucuccaaauaguucaacuugaaacagcagccugucccuaaauaaacacuauuagccugugaucgucuucaggaacauguaauuaauccacuuagaagccuacgccucauaauuaccgcagagcaucaguagcccucugaaacacgcaugcgcuuuauguuguccucacucacacacaccguaagcuucaacaauaaauugaaaaaugacccgcauuacugugcauuuacacaccucuuuucaucgucccagugugguaaacauuaauuaacccuggcuaauuaacccagccgcaguuuacaaauucacuccuuuaucagccucacaggaaggaaaggcgcuuaaaaccuuuuacaguuucguaauauggaaauuaaucuuuuuuuuuucacguguagggugaagauucaagacauguagcuguuugauuuaaacaugggaguauuugggggaagugucugcagauucuucaagucagcaggaaaauggaguagccucauucaagcaccucguacacagcggcuaugucacuuccuuccuggggagccggagaagcugaguugugccuggcaccaagacauguggcaaauaccaggcgaguuuuagaucuuacugcacucagagugaugacaccaccaucacagaggcaggagaacugcacucugcacucaagcccagggacuccauuuagagaagccgggacagcuggaggaagccgugcaauuuagccugaugauuucaacuuagggcucacacuggacaaacugggucugcacaaaacuaucuucaaaaagccugaaggucaugcuguuguuuuuauaggaugacuagauugggccauggagugcacgauuagcgagcagugcuggguuguuugugacucucaggcuucauaacauaaaaaaaaugguggccagaguauuuauuuuggauuugaagaggagacuaccaaccuaagacugggguagcauagaaggggauugagggagggaugcugagagggguuggagaauugauguaauucuauuccaauucaagaugucaaaaaauuaaaaauuaagaguacuacuauaugucauggcuucuguguauagcuuuuagaauaaagagcacaugcgcuguaaguggcuaaaggguaagggucaacagagagggaggacauuagaccuagccaaaggacugacccagcuaaguggugugggcugaacuggauccccgaugaaauccauggaggccuuagcccucaagggcaucaucuugagaagagccauuuaaggugaagacugacgcuaaauauuaucccagggugacuggaugcugaggcuggggagaaaccagagagauugcuccuuccaagacagguuuuaugggaagaaacaucaagaucagcacaggaaagcaaccgauggcaggaagacaaccuccacuuccuguggcuguaugugaccaaacagcaugcacacacagaaaaccucugugaucuccuaagaugggggaaggugggugcuacacacaugaucuaaaaaggcucaagaacccaggaccguuaguguuuugaacuguggcccaccuguguccaaaucucucaaaguuccauccugaaaauggcuuucuuuuucuuaauaaaucaugucuuuuucuaccacuguccacgugucccugggccaguucuuuguuccagcauagcaggaacuccccaggggcagccucuagaacaucuggauccuugcucccaauacgaugaaacaaauuguaucauggagaaacugagaaggccuuccuaaauacccaucaucuugaauuuacgagcuccaaaaaacaugagaaaagucacuuucauuuuuaagcuauucaaaccacuguauuuucuugagacaggaucucacaauguagcccaggucugcccagaacccaggaucuuccuguuucaguaugcugaguggcugaaaucauaaguuugcgccauuacccuaagcuugaggcuguucuauuuucugucauaacugaggaucagagaaugaauaauuuauaaaggggguuucugcaggggcuucuucuguuucugucuacugcuuucuucucaguguacaaaacaaaacaaaacaaaacaaaagaagcaaaagccauacaaauccuucucuuucuaauacauaaaaaaaagagagagcaggguacccguauguagcaagggaucucccacugggccaucacagagcagaguguccacggcaagcuucuauaugaagaucuuagcuacacggaacccaauccuaacugccacccaaagacugcaccucaaggcaauuaacacauacacuuggggauucuggaaaguuccacugacccuucuguaagcccauguaacugaugagaaccacagagaccagaaacucuggaaggcagcaaguguagagcuuugggcccucaauagccccugcagcagucauguacuguucuccuuuauaccugacccagcuccuuuucgaccauuagguaaaucccuccggauguacaaacuagaguuagccaaccagucagcaagcuuagaaugucaucagguggcaccugaggacuacaggugggguuucucugcucuuccucaaccagucuacccugauauuuccaccgaugccuuuacggagugucuugacuuauggcuuucuuuguuugguuacuauaagaugcuuccauguaggaacauggaauuuggagaaaauaaaucuguguuccaggccacugccagacgcauuuggcuucagaauaaacuaucgcuuaugagguaacagguggugugugugugugugugugugugugauguguacgcacuaucaauuuuauacacagagucuggagagggcaaaugggaacagaacucuaacccaggucacuacugcaccuuucuagccagacugaggcaaaaggaagagaucuaaaugucuucucuaagggauucuguuuccuuucuucucuguguucaagaaaggugacagcugcaggcugaggguaaauuaauccugcucacucuggauacgcaagaaaaaggcuuugaaaaacauacuucuuuuuguuucauuuccuuugagacagagucuuaauauguagcccaggcuggucugggacucacuauguagcuagccugccuuugaacuugggaaccauugagauuacaggcaugugccuggauaucuaaacagggagaaaugaucguacauccccuucacagagaagacaaggaaaugauuuuaauuuuuauugcucucuucuuaagcauucuauuuccacaugccuuguucaccacagguugaaggaaaauagccaaugauagcuuucccacauuucuggagcauguccaaucagguggucuauuuguuuguggaauaaaagaagagcugguauuugauuucuaguccaugucacuucaggaaaccacaaaagggguuuagaggguuuuccuauguaaucuaaaauauacacaugugaccgugugacacagugagcucccuccuggggacuggcaucuaguguuggcagccagcauagcuuuucucguguucuuguuuuguccguucacuaucggacacauacuuccugagcggaugcuaggcugucagugaacuguccgagauucggaugaauguccucuacaaugcuggucacccugggcauagcauuaaucuucucuuuugccucugaugaaguuaguaucaucuuggauuugaaggccaccuccauggaguauuucuaugguggaaucagugauaggagagcgaagggucaggacugagagaggaaaaggaucugucagagagacgagcaggcucugaacuuccaaggaaagcagcaucuaggcaagaaguucccaccagccccaggcuuucacuguucacugucaagagcagugacugagguuaauaagugguuaaguuggcggguuuggggggugugcgugggucaggagguaaggaccugaguuuuguggucagaacacacagacacacagacacacacacacagacacagacacacacagacacacacacacucacacacacacacacacacacacacacacacacacacacacauacacacacacacaggaucugaguuguauggauauaaccuguccugccccccaaaacacagagggggaagagggagacagggagauagcugugugugguguuggguuuauaauuucagaauggagacaggaggaucuuuggggcuccuggcuaaucagucuaguccauuugggugacuugcagaccaaagagagaccuugccucaaacagaugguguaaagagcuaaggaacaaaaccuuuugcuguccucuggccuagacaugugcgugugcccacacaugaacacaauaaaaacaaagagaaaaggaguuuaugccagugacuuggguaaguuaagcgcaaccucaacauuguguuacuuaacagagcuguauucaaccuucaaaguaaaugucaucucccggaaguauuuuaugcaguggccccuuggaaauacauguguucuuucaugaugcgaauauagccucaugguccuuccacacaacauuccuagucaaacaugccacggcugcaccuaguccacugaacagcagagcucaagaugagagagugagggcuauuguugauuauuaucuugaucaugugaaacuugacacaagcuaaagucaccagagaggagggaaacucagcugagaaaaugccuccacaagauuagguugcacacaugccuguaugugggagauuuucuuaauuagugauugaugggggugggguggggcccucccugggcaggugauucuggguucuauaagaaagcaggccaguaagcaacaccacuccaaggccgccacaucagcuccuaccucuuuuugaguuccugucccgacuuccuuugacgauaaauagugaaguggagguguagaucaaacaaacccuuuccuccccaagcugcuuuggccaugguguuugagcacagugguaacccugacuaagauaaggaccugccacgcagugcuguaugcuggcaccacauguagugacccggggacggauuaugauucaaaacacauuacuuucuccucgcuacaaugucagaaaaucuuguaagucagaacacuguaaaucagagacugaagggaaagacuggucuaacuucauguaggauacauuaauaauguuuaauuuuuuaggucaaagauauauacaaauacacucucaauuuucuacaaaagcuuguauuuuuacuagcacauauaaacauuaaaccuuuugaauuauucaagaaucauuugaaguagaagaugaguugauuucucugagugugaggaagaguucaagacccgguauuuuaaacaagaacuccuccacauuauacuuuacuuggucccaaguaugcauugagacacagugacuuccaggauaccaauuuccacugagaguaacuuuucuuccuaaguggcuucugaaugagacuuucagauuguugaaguauuuacagcaacugaaguaagauccugaaaaauguagacacuguuuacugucagcggaguaagggacagacaugcagaaaugacaggaugaacucccgagggaccggaaccugccagcuuagaugcucgcuucaacucguggcaagcuccgggcacaaggcuguguuggacacaaggccguguuggacacaaggccauauuugaacacucugaugucuacaaaggguuccccauuccucguggccacuuuucuuuaauggaagaaaauugucucauuuauucacaccccagguauuuaaaacucacuuugauuucugaagaacucuggcaagaugugaagaagcccucgaccccugaccaguuuuagucucugauuuugaucaaaucaguuaaucacccuagauccuuaaucugcaaagcuggaggguccggcaccacuuucaaguucccuugaagagccucuuagcagcaggguagaugcagacccgagcugaaugugggaaaggaagccagcuuuucucucuccacaucaaagagaacagucugccaaaccucucacauuuucauacaauguuugacuugcagggcgaugccugguuuaucaaaggacagacuguguuuugagcaauccacagauugcuuaaguuuucccuccugcaccugaaggagguacuuucugcuuuagguauaagaaggcuucuccuuaaggugggagaaaacaaaacacucagugcaagacacuggcucccugccuaagggaacgagggaauguaaacacaggcucagcgcuaaccgcacuccuauaggccugaacacauuacaaagcccuucccuuggcuuccaccucuuuuucuugagacagcuuucucccauuuugcucaggaucacagacauugccagcagcagacuggaaacggcucagguuggucuucaguaguaaacgugaggguuacuguugcucucugauauauucugaauaccuauauugcaugggcuugcucucagacucuacaugugggauguucugaaagcuaaagcuuucaaagcauuccgaaucucagcucuuuggacugaagaugauagcuaguuauaacugguagcguugugccccgaauuugaaaaauucugaaaucugaaacauuuccaaucccaaggacuuuggauaaaagauuccggacaaaguacagagaaacaaacagaaacucaaagaauugguugaacccauuuuaucuggcaucaccuacucuaauaaauccgaggggaagaugguagguagcacauuaggaaauaguccucucccuuuacccaguuacauacaaauuaagagcucuaagcucacaugagcacguguaauauccuggaggaagaaagcagaucaucucacacucauaguucucuuaggcccaaccauuuccaccgguaguuccugaacuuuaguauucacagccaacaccuuguacugcgguuguucuaaagucuaaggacacugggguaggcagccuaaaggggggucugagagagagaacccgagucuuugaauaucuuccauccuuuacagcucuauaguuuuacaggcaacaucacucaagagagaguauuaguauguaugauguauguacaugugcuuguaugugaguacaggcauuuauacaacuugguguguagguggaggucccaggacagccucaguugucagucuccagucucugcuuuccaaccuguuugagacagggucucuuguuuauugcucaugcugugagcuuccagguuuuugugucugccucccaucuuccuguaggaguauagggacuacagaugaugcuauguccauuuuuacaugggaggggagagagauucaaacucaggucuucaagcuugggcagccugugauuuaccuacugagucauuuucccaauccaccuccccuaaaaaagaucuaacaauagcaaaaacaucucucucugaagacaagcuguguaucauuuacauccauuacuauaucuggaccuuggaccauuaacauagucuagacugugcacuaucacuguaggcugaauaucauuacuauaauacuaaguacaaucacuguagucugaguaucauuacuauaauacuaaguacuaucacuguagacugagcaucaucauuguaauacuaacuaagcacuaucacuguagauugagcaucauuauuauaauaguaacugagcacuaucacuauagacugagcaucauaacuuuaguacuaacugagcacuaucacuacagacugagcaccaauuacuucuagaucuuacauuuccuccaaagguccauguuuuaagggacuugucugcagcccaaguugguaaugaguggcagcaggaucuuuaagagaugggaccucuuggaaguuagggauuugucuuuacagagaauucucuuguuucaguucuucuucuucccaucuuuacuuucuccuucuggucaccggaaacuaagaagcucuucuggccauaauauaguugccacaaacccaaagcaauagggccaauggacuauagacucagacuucugaaauauagauauauuauaaaauaaagcuggucuuuuaaguuuauuuauguuagguauuuagccacagagauaaaagcugacacaucuauuccacacauagcuggauuauuaggcugggaaugaggccaaggaaugcacacuucuaacaauuucucauugaugcugcuguugccgguccaaagccacaugaugagaacuguuucuauuaaucaucccuuggcugugggcauauuuuuuugugaagagauacaaaugcauauucgaccugaaaaagucaacacuguagacauaagcagaacauaugccaguguauccagggcugagagcaggacgucagcuugccugcaaugucagacucagcaagagaagaaaggaagacgacuaccauguuccuuagcaccugagaugcugaaccagggggacugcgaaugagagcagccuggcauacacaggccuguuuccaaaacauauaaaguaauaccguaauaaaugacgggaaaagccauacacuuugcuuaucaaggauuuuuuugaggauuaagcaagacuuagggagacuaaaaaaaaguuugugaucaaaaugaagauaacaauaauagaaacaaaaacauauacagagcuuuucauuaaauuaucuguuagccuuucuuuguaaauuugaguggaaaaaaacaaaccaagaagcgaucugcucugcuggcaggggaggccacuucaugggucugauuuaauggccagcaacaauacaccacuuccaugcuguuugccagaagucucugaccauaaacauuggcaaagcccuagccugcauggcuggucccggagaaucaauggugaagucaucauggggaauuaugauaucaugguccacggaacugucagcgacucauacuucagcauaugaguuccgaucaaauggagaaagguggcauggcccccaaguccuacaaaauguuuaacacaucaacagagauguaugugugcaaagcuguugagacaacucuucagugcguaacacguucagugaaaggacgcugaagcugcccauauuauucccagauucagccuugaauuugcuauuaucacuaagugagugccguuggaucaagaccaauggaacggguuagucugcaggcuauugaccaggcguuagguauggccuuagauuauugaccacaugugauguauggccuuaguugaaccuauaaaauaacguggcuugagcuguugaaaagcaagcuucccucuugcuuaguagucuucuugaggugguuaggaggaagggugguuauuagacaagaccaccucgugcuaucagaucagccuucaucaacugccucggugagaacagagccuugucuuggcugaugaucugcggucucuaagcaaauucuaaauuauucuaaguuauuugaguaagaaagacugugccccgaaucuuuaacagucccagaguauuguagguauuuaacaaacaauucacugaugcugaauauccuugcuuaguucuuggaucuucuuguuacucacaguggcaaaugauagcgguguauguacauggauagacauuuuuuuuaaagacaguguuucaugccuagcuguacuaaguagccaaggucuuagauuugucugucuucaucaccugugugcugagauugcagguauuacaccaucauaccacguuuugugcaaugugggaggaggaaaccuaggcuucauacaggcuaugaagcacucuccuauguaaguaaguaagucacacccagccuuccuacaucuuauuuuuugaaagucauauaaaaguauaauaauguguauauaugugcauauauauguauauauacauaugcauuauauacauguguguauauauauaugcauauauauaauguaaaauguauauaccuaaaucaucaaagauuauuuucagauaauaauaaugucugaaaacugucacucaucuaccucaguggcaacacuaaacuuucuuuguauuaggcaacagauauuuacuauuagaaaacuacacuuaaaacuauacuagcaacuacuacauuucacaaauagaaacucuggagaacuguuuauugguaucuuugacaacuucuagcaauaagcacuucauuuggcuagaguuccuagggaaguuuuauuguaacaaagaaagaugacacaaugauucauuuucaugccacaggaugccuauaucacaggacaaguauguguagcaaccuuccuuuauagagaagauauuggcuaucaucugagaacucucaguugcuuccuaagacucaguaauuaugaaaugaagguugcuauauuuaaagcuaacaauuaacuuugaauuuuaaaucacagacuuucauuaggaaacauguauggggcccgagagaagcuucggugguccugaguacucagugaucuugaagaggaccagagcucaguucucaacauacauuuggcaguucacaacccuccaucaccucaguuccaaaggauucggcacucuucuggccuccucaggcaucaggcauacaugugauagacacacacacacacacacacauaggcaaacagucacacacauuaaaaaaacaaaccaaacaaagaggccuccacacccacuauuucagaaugugaaacuugguuugcuuucacuguuuccuaaauaaaaacauuauagaaugcaaguaagcaugauccuaucaacgugcuacacucucguuuacacucuuaacuuugcacuacuguacuuggaagcuccuucuuaaugaggcaaggcugcaagaggaacccaggcaccugcaaaacuuccgcuuaugguuacaaccucggaaagaggagacacagcuggugugccagggcuagaagggcucaggcuaguguuuguaccagaaugaaauucuacccagcuugcuucccuuguuuaggccaaagaugugucugguuucacaacuggccuacuuacgcagccguacagaguucaguguaauaggggacauugcagacuuagggacacagccuugucucaggacgggaagacacaucuaaaugcuacacagaccaaaagcaaaggcagagauaggguaauuucauagaggccaggugcuuuuuuucaagcaaaagauguagcuaacaccuuuaugaacaaaugccagucagcaacaacgaguucagugcaccaaauggcuaguaaauucuuugucuuugcuaauacaucaucuaucagcaguggcugaaaugaacuggacucuacccacuaacaaaggcauugcaaauacuacuuguuuauuuguuugcuuguuuuuaaucccuugucuuuuggagauaggauuuccugguagagucaaggccagccaugaacucaaguugcuccucuuucagucucccaagugauaagguuuuugguguauacuaacauacccugaaugaauagugucuugacacauaucaaaauacuguuucucuggacagcgcucauaauagaauagguuaauugguuguguuggcauuucgucuaggccccaccccacaguucccugguaauggccaugugugccugauucacuaugaaagggacugcuuguccccuccucacuuucuucucuucuccucuugcucuuguucccuuacccucuuaccccucucuccccauuccucuugccccucuccccccaccucuccaugugcucauggccugccuucccuccacuccccuccccuccgcuccccuccccuccccucuccucccucccccauuucucugccuuucucugucucaacuccccuccccaugcccuaaauaaacucuauucuuuuuuuuuaauuagguauuuucuucauuuacauuuccaaugcuaucccaaaagucccccauacccuccccccucccauuucuuggcccuggcguuccccuguacugaggcacauaaaguuauucuauacuauaccuuucuguggcugguaccucagggggaagggaugccucagcaugggcccacagagccacccccuuccacagacaccauacugugccuccaccaaacucucucucucucucucuuucucucucucucucucucucucucucucucucucucucuuucucucucucucauaaaacacaacagguugacccaugaauuaagaauauuaagucuuguguguguguaugugugugugugugugugugugugugugugugugagugcacucacguguguucuugugugugcauggcugugauggccagaagagggcauuagaucgccuggagcugguguuacagaagcuguaagcaguccaacaugggugcugggaaccucuccugggaccucucuaagagcauuaugugcugagccaucccuccagcccuguugacacacccucccuguuuaugauuuccuagcuaacagugucugcacaagacacacuaccuaagagcuauuaauaaagaauaaugaggcuuccucagugacuacauugcagaauuuguuucugagaggaacagcaagaggcaaauuacauucguucccaacucugacucacaugcaaacaagcucaucucaucuccaguuaauccuuguggaagcacacuucaaaauuaauuuggcuucauuuccauauucuggguggcaaauaucucuacauuuuuuuucccuuuuaaaaaaagaaccuugaaggcagcugcuugugaaaaauagaguaaccagcccuuguuaccguccaaaaucauugguuuuucccaagacuguagaaaagaaaaggaaucaggacacaucuguugcaguguuucgugccaggaaaccaucuugccaccgcuguggucugcuuucacacccuacucaguuuuugcuagggcuucucuuuagguuuuguuucaaacuacagcacauaagaguuggggagcugggaaaaugacuccccgcaucuucaugagaaucagcagcuuggggugggagaugcugccucaagccucacccaucugguagagaugcuccuuacugcaaaguaagugacugugugaaaacggacagaagcuacugagguaguagagacagcacaucuugacaagaggacuaccaaaccuuuggaauuuuacuaaaauaauagcgugaaagccaaaagcgugaauuccacuaauuuuaagaacuugccuugucacagugggccucagcuagaauccucucacggccugcuguagcauccuguuguuuaauuaauccuuauuuaaaacuuuauaacaggagucuggggagaugguucagugcacaaggcuuucuggaagugugaauggaguuugaauucccaggaucuaaguaccagcgggguggagagggcagcccuacagcaacaacuguaaauggaguagaauggaggggaaaaguuggucagcaucagcugccagccuccacauguguacccaacauguguguauaaaugcauguacucacgugugggccacugugccucaaacacauucacauacacugaaaauaggggaaaugugauaacagcaauaauucccaaacugaucuauauagagagccauuauaaucuaauuaugaauaguauugucagcuugauagggccuagaaugaccuaggagauaaacuuuggauaaguuuauaaggaaguuucuagauugaguuaacugggaugguaaggcucaccuuacaugugggugagagcaguucuuccagggcuggaauauucacaggaauggaaaggccaaugcaaggugggcaccagcgauugucugacacugcuuccuaacuaacuggggauagcagugaggccagcugccuugugcucccacuaccuugggaacuuuccagccaucaugaaugcauacauaugaauugaaguaaaccccuuguacuggcuaguuuucugucaacuugacacaggcuggaguuaucacagagaaaggagcuuucaguuggggaaaugccuccacgagauccagcuacaaggcauuuucucaaugagugaucaagggggaaaggccccuugugggugguaccaucccugggcugguagucuugguucuauaagagagcaggcugagcaagccaggggaagcaagccaguaaguaacaucccuccauggccucugcaucagcuccugcuuccugaccugcuugaguuccaguccugacuuccuuggugaugaacagcaguauggaaguguaagcugaauaaacccuuuccuccccaacuugcuucuuggucaugauguuugugcaggaauagaaacccugacuaagacaaauugguaccagcacaguggcauacuccuguaaaaaccugaccauguuuugggaggacuguggaaggauuuuggaacuuugggcuagaagauccauccauucauuguuaagagcucugucagauguuguguaggagcuuggaagauaauguggaguacagugcagaagauggaggccuggcuugugaaauuccagagggaagauuaaagagucuuuucagggccauugcuauuuugauugugaagauucugugguucugguuagcuggggcugaagaaucagcugugauuaacaagauaucagaacuacuaaagcaaaaccuuugcauuacuggaacuauugacuauugauucugguuaucuggagguaagaaccuaacuuuaauuaagaagagaccagcaucauugaggugacaucuccugggaaguguuuucugagaccacagaggcuguguugcagagauagccaaggcuguaccuugugcuguggcuggacuugguaauguguaagaguuacccaggugguacugguuuugaaggcaugaaggggucaugcagagcagcugaggcacggcacugugagaggccauggaaggccauuggugaaggugcaaccucaguugcaauugauggccccggacugaaggggucaugcaaaggaguugaggcuugguaccaugagagccuauaagaggcuauuguugaagccaaguuacaguggaagacagcaguguuuuuggagaugccaguaccauaagaugaccaccaagaacagcagcagcagcggaguacaggcagcuggagccuagaagacaagccaugugcuacaaaggaaaggaauggagaagugacccaagcccuuggaagagcccagaagaucaugaguggaucccagaauuuuuguuuuugauugugacugugcccugauguuuuucccucuugaaggaagcuuuuuaguggagcccacaguuaagagacuuuuaauuguaaaaagucuuuggauuuuaaaagauacuggaucucugaaagggauugaacuuuuaauauguaaagacugugggacuuuuaaaguuauuuagaucuuggggaugaauaagaaacuaaggguugaggcuuacuagugauguguuugugugucaaguugacaaggggucaauuguacuggcuaguuuugugucaacuugacauaggcuggaguuaucacagagaaaggagcuucauucaguuggggaaaugccuccaugagauccagcugcaaggaauuuucucaauuagugaucaagggggaaaggccccuugugggugggaccaucccuugccugguagucuugguucuauaagagagcaggcugagcaagccaggggaagcaagccaguaaugaacaucccuccauggccucugcaucagcuccugcuuccugaccugcuugaguuccaguccugacuuccuuggugaugaacagcaguauggaaguguaagcugacuaaaacccuuuccucuccaacuugcuucuuggucaugauguuugcaggaauagaaacccugacuaagacaccccucuuucaacugcucuuaucagauaacuugucuuagcaaugagaaaaaaaauacaaacccauauucucuuaaacaguccugagaaaaacaucacaauugaaguagaaauucaaaaguaacuagaauguucaaagcaaucuuaaaacaauaacaacaaugaccaucaccaaaaaaauccaaaaguacagaacccauaccugccaaucucaaagcuuaaccacaaagucacaguaaucaaaguaguguagaaguauggaccgaagaauaggcaggaaauugaggguauagaagucuacagucaacagaauuugcacacgguacaaugucuuuuaguuaggaagaaccucuucuucaucacaugguaggaaucuguaaacugagacccuuaacuaguuagugccccauacaaaaugaauccaaucagaauucaaguggcuuugucuaucuauuaccaaagcaacagugcaaaaacaaaaaauaaagaaucaaucugcuagacuuugucuacaauuaaaaaacagaacaacuaaaacugcaugucaaaacaaaacaaaacaaaacaacaacaacaaaaaaacacguguaaagauaaaaacagcaaugccuggcaaauacagaaguggaugcucauagccauccauuggacagagcacaggguccccaaugaaggagcuaaagaaaggacccaaggagcugaagggguuugcagcccuauaggaggaacaacaauacgaacuaaccaguaaccccagacagagcucccugggacuaaaccaaccaaagaaaacacauggugggacucauggcuccagcuucauauguagcagaggauggccuaguuggucauaaaugggagaagagguccuugguccugugaagguucuauucccuaguauaggggaaugccagggccaggaaaugggaguggguggguucgggagcagggggaggcagaacgggauaggcuuauuuucagaggggaaucuaggaaagggaauaacauuugaaauguaaauaaagaaaauaucuaauaaaaaauaagcaaaaguuaaaaaacccaccaaaacacccauugaauggggaaaacauuugcagguuguguaugugauaaguuagugccuagaauauacaaagaacgcacacaacucaaccguaauaauaaaaaagcaaagaaaccaauuaaagugguucaaggauuugagaagauaacacuuuaucuggaaaaaaaccaagagauagaucgguagugagucagcacaauguggaugacguuuaauucagcugaggacugccagcauccacggacaggaacacagcuccaugcacugcgcugcauucuagguuucagugucaacaauuugccuuucugguuagacaggggagacugauugguuaaaaauaaaagccaaaccaauagaaacaccaagccuacgcauuuguucuuggacagugcacuuucuggguguugcuaguauagacuggcuuccccacuauugugcacuggaaauaucuaugugagaaucaugcuagagggauguuugacacauucaugugaccuuaucagucacuuuaacagaucuuccuaaagacguauaaucuauugaucuaauuuaacuccugagucagacaaugaaaccuuauacuauaugauagccaggaauguauauaaagaacagcacuuggcaguuugggcgaguuuaucuguuaaaggccucuuccccacguuguaaagaccggcugggacucugaggaggcuaaccucucugucuggggacucgucaacccagucucacucugucagaaaacugggaauaccaucuaauuugaaggcuacuaucuucugcuggggauuucugcacuagcccagacauuuucaugcguggaacuaggggcuuuauuuugaaaaaaaaaaaucaaaaaacaaaaauguugucuuuuuucagggggagucaaagauacccauuuaaauaaggguggcuacaagcaaggcaaacacucaguuaaugauacugggaacaacagauuggcuuugagacuauaaugaagucaccaaaggaagguccucaugucugucugaaauaugaacacauguuguuuuugagugccuaauucagcuguaagacuuuacaugugaguagcagucacuuuuauuaaaaaucaaguaagaacagaauaaauuaaauagugccucugucuuauuuacuaacaauuuuaucgucucuaucucucugguucccucacucucaacaagccaggaugucuagcuaggcagccagguuggucuugaacuccaucuccuggggcgucacacacucucucucucucaguaauguucucucuuuuuuuguaaauauuuuuuauuauuacguauuuuccuuaguuacauuuagaaugcuaucccaaaagucccccauacccuccccccacuucccuacccacccauucccauuuucuggcccuggcauuccccuguacuggggcauauaaaguuugcauguccaaugggccucuuuuuccagugauggccgacuaggccaucuuuugauacauaugcagcuagagucaagagcuccaggguacugguuaguucauaauguuguugcaccuacaggguugcagaucucuuuagcuccuuggauacuuucucuagcuccuccauugggggugcugugcuccauccaauagcaaucauaaaggaacucaaaugauauguacucacugauaaguggauauuagcccagaaacuuaguauacccgagauauaagauacaauuugcaaaacacaugaaacugaagaagaaugaagaccaaaguguggacacuuugccccuuuuuagaauuggaaacaaucacccauggaaggacuuacagagacaaaguuuggagccgaaacuaaugcucucucuuaacugacaaguacccacgggaugguaaauaauucucaggcaguacuaacucacucuucuauuuugucagacugagaagaguuguaaauauucgacuuuaaacccaauuuggauuuguaaccagcuccacauaggcacagacaacagagacacugucccugaaauagacaugcuggauuuuuuucccuggaggcuggacauuuuuaucaagaggccacagugaaauuguaauaaaaagcaaaguuguaacaacaguaagcacucuuccaugaaaguggcuuucuugucuccuuggcacaucauuccauaccagccccacuaaccacggauuuacccagucaccggucuuucugguuuuuaguauuucacuuuuuuuauuaauuuaaaugauaaaccagugugaaacaauuagagcugccuuccuccuuccuuccuuccuucuguuuaacucauaaauuggucaggacagccuugugugagacagacaucucggaaugaaaugcugcuacaguuuuacagccuugagguggcugcaaucugaagaaucuugagggacaaugauaaaaaaaauuccucaaugccagaaccaauuuagcaaggacuuaagggacuuaagggaaauuacaagggacaaaaacaucuaauggcuuagaauggcaagugggccaaaucagcguugagcugaagagcuguggggacugaagugacgacgauuugcaugggcaggaacucugagcagcugcauuucaucagaacgguaacucagucaucacugaauugaacagcacauuccuagacaggauuuagaagacguaaggcaauguccccucuuuaucaacauuucuuacaaccuuucugaacaagaaagcuucauaauuuacaugcaaaccuuugaaaaagaaaauaguaacuaguaugugugcuuugggacuugugaauaauaauuuaagcuggacuaaaaacggcaagauaauaaaaggucagccuuuuguaaaaagaacuaacagcaguuuagacaauacuuaggagaaccaaaucagaugcaugguuaaucaaccaaucaaccaaccaugugacuguguaaacucuggagaugaccacaggacacagugucaaggcugcgacccaaaccuccuuauacaguguuaaaaaaggguucugggaaaucugcuuuauucuuuacuuugcugccacugcccgaugacaucauucuguuggguagaucaaccauaacagcuuuagggaacauugucacagcagaaagggagguacuucgugcaauggguaugggaggggucaaggaaggagcuuagcauggagguuugggcauuaucaagaaacagaucaucucauaauuuaagggacagcgaccucaaagcgugacgguuugccucauuccuagacuacagcaacggaaaucucuaaagcacaccaggcugucugcuagaaccacagucaaagaccauggauggcagcagagcucagcggauuggacauugcugugauagaaacauagaaaucaacacaagcuagaguauggccucccagguuuaaacccuauguguagacccuaagguuaaagagaagagaacucacggugcaagacaaugggugccagagagaacacagaugugggauucaggcaagacccuggccucagagucaguuuuauuccuccacuaucauccuaaguggccucucuaggauccaguuucuucaauuaugagcuggagauacugccacagaauucuucaccauugauauuagcccguaugccgccuuugugcaaaauacaagaaaaccuugcugaacguggacacaccuaaugucugagggaccgagggcccggacuccuccccuagaccuccugcuccuucuauaugcgcugguccaguacuccaaggugaccuuucacaauauaccuagacacugaugucaugggcagacccgucugagcucaucaaaccauugcuuccugcucugcccucugagguuaucggugaagacuuuacagagcugcugaggcuuucaguuggauccugagggaugcgacuuuccaaggacaggacaccuguccugcucaggccauccagagggagaauuugggugaggcggccaaugcgagguaaaggcucagauauucggccggaaguuccugagaccauggaagcaggacaaggucaaaugugugguuccagagucuaccgaagcugguucucaaacuguggguugugaccacauugcggggguugcauaucagauauccugcauaucagauacuuacauuauaauucauaauauuaaauuacaguuaugaaauaggaacaaaauaauuauaugguuggggggggucaccauaauaucaggaacuguauuaaagggucacagcaucaggaagguugagaaggacugguccagagucucucaggcacacaagaugcuggaugacggaaggccacccauaugugugugguuacuagaacuaccgauuugggauuuacuagagcuggcuguagccuaaccagaugggcugccucagggaagcacaaugggguaacaugaucagggccagaauucccuggcagcaugauuccuagucaguaugguugguuuguuuauuuauucuuucuuacaggcuugauuccaguccccaccuccaaccacacagcauaacuucuuuguaguuaaggcccccuucucacccauuuuggccuauaauagagauuuaagguuggaagcauaauucacugagagagauacaccugugucauuaaagaaaaacugauacuggcagauccucagccuaaaacccuuuacucagaaagcaaccaugaguguuaagcaguagaaugcugcauucuuuccaagcuguagacugaauugagcuuauccuaguugaggugcacaaaggcgccaacguuuacccaaaacacacgagcaucucuauauuucccaucucacccuucugccaacugaaguguggcuuucuccuuaucuauaccgaacugauucaaaccucaaguuugauaacuuagggaaaaauggugggugaacggaauccacagacgacugugucuacuguaaggugccaaucggaaggacucuaugagguucuucuuugcauuggauaacaacaaacaaaucacacuuucauuauggaauacuucaaauaugaacaaaaguaaagagauuaaaauauaaaggauuuugugagcagcauacagagccgauuuuggguuugucugcaucgaugugauggagaguuuuacuggcuguucauuugcuuguuugugucacaguucuucaggaagcccacuaaggacaaccaaggaagcccauuguccuugaagaacucguaccucaagcuuuugugucaggagcuuaaagggcacacaggccuguaguggacaggcuguaauguguucauugcagcaagugguuuuuccuauguaaacaacuaucuuaagaugauagcauccaggauuccaagagaaagaucuuagaaagauuuucuguaaguauguggucuccaguauauguagaaugacaggaaucuugugugugugugugugugugugugcacgaaggcugauagguugauguugggaugccuucuucaauggcuucuucuccuuaucgacugacacaggugcaguagcgcuggccagcaagccccugcgauccaccugcuuuugccccuacaguaggcuuacaggcacaugucaucaugacugacauuuuuuuuuaaauguuggugcgagggaucucaauccaggucuucuaaacguccaguaagcacuuuacucacugagccaucccuccaguccuaguuuuuacguaauuguuccugaucuacccccauggcaguuucuuacuuuauugaaagaaagaacagaaacccaagugugauucuaguuaaccaucucucugccacugagauuuuaaguuacuggguggucccguucuuggguauuuugcagcacugagggauuugagucgccaucuguccgacucacuuguggcuaauauuuagaggagcacaaugccaaaugagaagcucuacaaagagcaaauuagaaaccagagagugccaacuguaauuagcggguuuagguacaguuccuuucuaauggcuuauuguucuauaguuugauauugcuaaugcuaccuuaauguaagucacacaggauaagagggugacgcuaaccacaaagcacacucauuuaaugcacacaucuagaaauuuuaacuucaauucaguaagauuaugaguuauguuuugaauuuuucucccuuguggagaucuguuuucauuuauauauauuuauuuuauuuuuaucuuuuccuugagauagguuucacuguguauccuagacuggacuugaacucacuccguaguaccagcuggacuugaacuugaagcaauucccuguuugagccucacaagugccacaauuacaggcauggauuacuguacccaguucuugacuucuuauauagaggacuuauuacugaucucugucuuccaaacauaacugaaacgugcagucacaagaaauuuaaggaagugaaaaacaaauggggaguugagcucucgauacacaggguaggcuaaaacuacugugcuuaguuauaaaguagagaagccuagugaguaucuaccuacaagauuggauaaauuagaauaucacuguugacaugggauucaacaacugauucacugcuugaagacuucaaggucuucucuauaccagguuacaucuuuaggucucacaggcauugaaaguuaagagcugaagcagcagccaaggugagauucacuguaagaggcgaucuggggcuagagagggcagaaugggcgagauugccugcuguguaaaugagaggagcuaugcuucaacccucagcauccauguauaagcauguggccccggaaucccagcaccauuaagggaaaucacggggcuuugcuggccaccacccaagcucuagguucagauagcaacugucccaugagaacggggugauagaguagaacaccuggugguaucuuccaacaccuaguaucuuccaacaccugguaucuuccuuccccugguugccaugugcacugaaggauuuuagacucauucacacacgugugaaacccccccucccuccaccaacccacaaaauguacuguacaacgcguaggcaccugggcacaggugacagacacagaagacucucagcccugauguguucuggggguaagccuaucucucggagaacauccgaaggacagcucacuuaccgacuucaucuugaaucuccucagccaccgcagggacauuguagagcagggacagagacugguucaugcgcucguagaucacacggaggugugucauaaccuguuagaagauggcaccuccacaugaacaaucucugcuaaggaaacagugacaaagaccacgcccaacacacacacacacacagcuggaacacugaaguaaaggggcuuuugguuucuuugccucuuuuuuauucucucauuccucaguauuuaccaguagccugcaugcuuguaacagucgauuucaacgaccacaucagucaccacacuccgaccacugaagcuuccuaaauacccuagucccuacagaaauaccuuugaagauuuucuaauacauaggaauauuucaauuugauuggauauuuuguauagaaggcaaaugcaauuuuuaguuuuauuucauuugagaaaauuuaaaaucuuagauuucuggaggcagacccuaguuuuucaaccucugggaaugagaaagcagaaaauaauuacaaaucuucaucuagacucuagcaacccuaaacaugguaguuacaauggaguuugccaggacugggcauaguuuacugauuagaguacacagcuuucuguuuacugaguuaucauuuucuccauuuuggugacuuuauucuuuuauuuuuuguuuauuuauguauguaugugugcauguaugaauguuugcguguuaacugaacacguggaugcacacucaagugggaguguguagaggcuugaggcucacacugagaaucuucuucuacugcuuugcaccuuguucacugaggcagagccucucagucggacccagagcucacuaauacgacuauguuagcuaaccaacuuguuccacggaucccaucugagcuuccucagugcuagaauuacugguggguuaccacacucaguggcauccaaacucugguucccacuuugucaacugugagccacuucccagaccugguggcuagcauuaaaugaugaauggcuagcauuaaaaauuuuggcugcucucaacacuucagaauuuauauuccauauuacugggggaaacuucgaaaaugucaaggcacacaguacuaaaacacccuuccuuuuguagaagauucagcuuauuuauguauguguguauguauguguguuugugugcacucagauauuugugcaggaaccagaggaagccagaagauagugucauauccccugaaccuagaguuuuaagugguggugaaaugugggggcugggcacuaacuucagguccucagcaagaagagcaagcacucuuaacuggugagucaucucucugcuucucaccucuuugagacagcaucucucucaaguagccgagcuggccuugaacuauccauccuucugccuccacauguuaagccuuguagaacuguguguucugaagauuagcuuuuagaguuucagauauuaaagaacucuugacaaagagauacaacacccucaccauaggugcucuagagggagguaauuaucuucccaacaaacugaggaagcaacaacuggacuguaagcugcagaagguucccccacucagggcuuaccugggaccggaucugagcagcuuucuugggguccaccaugcgcacauguucaaaaugcuuuagggugugcugucugucuuucugcuccgcacggacguacuucuucagcauguugaacacaugaugaggcugugaggaaaaccgcaagaacauggguuucaagugugagcaaaacaucacuucuuccacuagcauugaguucaagggucccaugaugugugcacugcaagggaauucucccaauucuucauaaauggauacccagccuguuuuuccucuuuacgaauuauaugcguguuuaguauuucugacacuguccuaaaucagcacgcucuuucuaaauagcugcuuucugcuguagagggagaauaagcuuuggauuucucaguuuucaguaagauccuucuauuuaaccacagaaauauucauggaguguucaugagauuacauuaccauguuugugcacagccccaagaccagaauuagugcuucccaaauaauccuuucauuaguaacuuacaguggugcaauaaucaaaauaagaaaauaacagacaaucuaacuacucuucaacugucgggcaaggaaugccugauaagccccaugaaacauuaucuuuccccagaacaaaggcccucauugaacuguaguuauguuacuuugaaauugaauuaagcucuuuucaaacaaucagaugcuaaaacucccagaaacaauuaaguuuuuucuuaggugcuucuuggguguguuuuuauucuaacugguucuacuucaauuuauucagguuuuacaugaagacauuuuuuaaaaaggauuuaaguuuccuuugucucgagcaauucugcugcuguugguauccugccuaggauuucagacgaugaugcacaaggguauacauccuucacgaagacaugccaggaauguuuagacaaauacagcuauuaaauaauguguguucaacaccuagagaaacaguuggaugguauggaacuuauuaccagaaacuauguauguuaaguacauaugcaugcguauaugcauauaugaaccaguauaugugcuauguacauguuugcacaugugaguguauauguggaguaaauaggagggugaauuacaguguuuuuauuauacuauauauaauuuauaguauauuauuaucauauauuauuauauauauuauauuauauaaugcuucaagguuauauauagugacacacacacacacacacacacauauauauauaaaacaugguaaugugauauauaucaaauuagcauguuuugugcacggccccaaaauguacacuguguauuauaauuuguauauauauauauauauauauauauauauauauauauauauauauacacauauauauuuauuuauuaagcauauauauaacuuugaggcauucuccuggcaauucuaaguggaauuuggugcccuuucucuguucuaccuugaauugcuguucaaaacccaguaguugcauucaguauacuccguuauuaugcuagaucccucucuucaaagugacagccacagguccagauuagaucucacuuccugucuaucaggagcuccaucaggagcuccgauccauggugcccaacccggcauuggugcucuguacuugaaauaugcgggguacaggccacguuccugugccuuagaauacaaacagagccauacacaauggacauaaaccguccccaggggggugggggagagagagagagagagagagagagagagagagagagagagagagagagagagagagagaaggggaguaggaauuucaggaugaaaaaguuucgucaguugacuaguuggauguuaaugcuuggccugaagggaugauguaagggacacacaaguccagguggcauagacacuuaguguucccccaaaagcugucugccuccauagcucuguacccuuggccacuaugugagcccaucuuagaauuuaacaugauagauuucuaucaaggcgcagauaggcuugacaaugaugcaacuggagagugaaaaacuguucugggaguucucaucugaauuccuaguucuguaaacucagggacagguaccgauuguacauugacugugcuugguacuauacacacaugucuaugaugaagacugauuuauaaauuagucaguaaaacaccaacacuccccaauaaaacaacagcaauauggugaaauaaaagcuauuaaaaacuuauggcuggcacuuggaauuuuccauuuaauauucugagacagcgaugaccauaagaaacuaaaauugugcaaaaaugaaacuguggccagggcagauaacaggacugaauuuguggagcacucugacugcaguucuuuuuaacagaggagaagaucuggauuuagauuacuguaucucauuucugguccuaggcucuuggcaggaggcuguacuuugcuaaaggucugaagcagaaaggagaaauagaagauaggaacguccccugucaaucucauuagaagauuacugaaaagugauucaagguauuagguacaaguugggcuuuuaugauauucaugggucugccuucugaauucauccuuaucuucuaauaagccuggugauaauuaaagaaagaauguguucacaugguuucaagcucuuaucucgcuuaacaccacuacuucuuuguguguuuuggaaagauauuccuaacuuucccugaaaaucccccagagccugauacagagcaauagcacagcaggccucgaggaucccccagcccuagaccuguaugcgccgugagcccugggggcucagaaugagcucugaccucaucauccugugagucuggagacccccaugagcaaagccugcugacaucagauaacucugaagaccguaagaugcuccuagcugcuggcuucugcuugguugcucugagcuggcaauuugcaaggaucguguuuagaaaguuaaaaaguuagauagaucaaucucuacguuggagaacaagcagacaaaccacuuaaaaugguguguguccggaccucauagaggacagacaguguguguagauaaagaauuaaaaaacaagcagcauuuccccacauuauuauguuuucauuuguuacaaagaaaacggcuuggcuuuggcauaugauucaugcgcauuuccuucaaaaaagaaaagaaaagaaaagaaaugaaauguaaagagggacagcccucuuuacaacuuucagccacaauucuccaagguggacgauaguuauuucuagagcuauauaauccauugucgaguaaugagcaaccaucguugucuagggaucuucauuugauuaugccgggacaaagaugaauuugguaaauucuaauuaaaaaaaagaaaaaauguccacuuaagaaugguagaaaaaaagaaugccugguaucucuacugugucuauauagagagcucacaaguaaauugccuuaaaguaauuguuguuaauaacuguuagccugauguuacucacauucaaaauggaauuguucacagaacaagcaaaaauucaguggcucauuauaaauauguugauaauaaauaauuuaauauucauuaacauuaagucuugaaauuuucucuaacuagugacacacacacacacacacauauauauauacacacauauuuauacacacacacacaucuauaugcaucucucuauauacacacauauacagacauguauguguguuugugcauauuguuugugugugcaauguaugugcuguauguguguacauguauguguucauguguauuuuacuuggaaauucuuauuucaguuaaguauuaauacugcaauuugguuauacuggcaaugggugggaucuaaaacucaugguuaagaauaaagaaacagaucugccccauugggaccaauuauacccagcccccuuauuaucaucuucauuguuucugugugcaucuuugucccguaacugcauucucucugcagcugauguggcccuuucaauugucaccuccuucaccuugggaucacacugccuuuuaaaagaggcauuuaaaaauuaauuucuggaaagaugagggauacgcaguaaggaaacggauuagaugacguccacaaugagagcacagaagacaagaacucacggcaaagcagaaugcacacauucugagauaggaacaaaggcauggccuauuccugccucccagcauaguuccuggcucaauguagcugcuaauaauuuacuguuaauuaaacugaugcgugacucagagccaaguauaauuucagcaguguuucuggccuguaaacuauccuuuguaucuuauucaugcaagugaauaucucucagaugagaaaaacagucucccaauguucauagaccacacugaaauuccaaacccacuugguguauuuacucaguauccccauccauuuaagaagguguuugaaguggucaaucgucccagaaaauaccuaacagaguccagauauauccaauuuuucucuuaaugaggcucauuucacuaauuccaaaagauaucuauccauugucuuuauaacauguugauaccaggcugguguccacaaaauggaaggaaaccaugaccugucccuguuuaaauaguauaaaaacccuuucugaaacauuaaauugcaugcuaauggcuucugaaaccuugaacuuuagcucugcaggaaaaaaaguaacuuucuccuguuuuuauaaggccacagauuuuugcagucuuaaucuuagaguacaaaaaguauucagcauaugacaugaacuguaugaaacaacuguguggugguuuaaagacacacuugagagagcuacaccuugugcugucuccuacugaguuugauucccgauuuugccaucaaccuuguauacauauucucaaugucacaggagaagaaauccagaaggagaccccaggaacaugaacgcaaacaaaaauaaaccaaggaaacaaaucaaaaccgauuggggaaacuuacauugcaaauuuuagaaaauaagguuuucuuuugcaguuaaguuuagugauugagugaaaaaauuuaaagccugauauaaaauguaucuauaaucuuuuucuuuagaaaacuaucuagguaggucaaacacaaauuccacugaguagagaaaauggcaauagauuauucuuggaggcuucuuucuguucagauaauaaugauguguuacauggaaagguuuugcauaaucugucuuuugugcaggguucacacugcuagagcagacaugucgcacaugcaaggaguuccgauacgucaucgcccauuggcuccucuuuaacuaagaagcaaaccuucccaacuggacagucaccaaagccuccauguguuccauaccaccucgcagaccccuugggaaggaagacaucuuuguacucucuacaguccugucucaaccuucagugaauccuucugguuuugaauuauggccagucaacgcuagaaacacgcuaguugcuguuucaacaauguugaaaauuuaaccccgauuugcagacuggggaggaagaauuccuuuguuaaguaacuugucccuaguuacagauuaaauggcuaucuuggccauuaaacacaggucuuuauauaacaccagaaccuuuggaaaacagacugauugcaguccucucccacaaaccagcgaccuuugucaaugacauucgguuuagacugagauuuagcccuugcccacagcucugcgaugaagcccaugccuucagcuaaauguuagcuguacagacacuggggacagagcuaacccccuccaaccccacagcacugaaaggccaggucugauauggacuucugcaucuuuaagccuuguuuugucaaaccaaacagaccgaagcucuccggggauaaacaggcuuaauaacacaacccagaaggcagagccuacagaguaagcaugaauuagucaacaaaagauguuuuaaagcaacacagaccccgggaaagguuugccaagaggucuggccauccaacaaaugccaccugugacauauucuugacuuuuuucagggugacuuacaacaaucuguuuuaauuuugcauauucgcauuugagauccucugcucuuucuucaaacgcucucuaaugaagcaacaauccaagguugaaugaaccuaggcugcuuaaacuacauucccuccuuuccaacgccuacacuguugugaaacaacggaaaguucuuuucuguuuuuuuuuucuuuuuaauuaaaaacacuuauauaauaaaacuaaaguaagacuucuuagaauccaguuauaacugaugaguuuguauggaacagacuauguacaaaacccuaaccuucuacaaugcuaaaaauuauuuuaccaucacuaauacuucucccauuaacuugauuaucacaaucauccaaaaaaauacccugaacaaacguaaccucuuauagcuucuuaguaagucuccuuagccuaccacuguuaucacaaaaacgacgaaaauggccuaaauuucucaauuauguuucccucagaccccucauccacaccacuaaucauucucacagcuugguuacuaccacuaauauuaauagucagccaaaaucauuuaaaaaaagaaaaaaguuacauaucagaaacuuuauauuuccauacuaguuagcuuacaaauucuccuuaucauaacuuucucugcaacugaacugauuauauuuuauauuuuauuucaagucacucuuauucugacacuuauuauuauuacucgaugagaaugcauguuaaauuuaaacaagcaaauguaccccuggaaaugguuuuaagaguggugugugugugugugugugagagagagagagagagagagagagagagagagagagagagagagagagcgagagagagagagagagaaagagagagagagaaagagaaagagagagaggccaucuuaccaacucccugcucucuagggcaaacucugguaacaaucacuuuucauuugugugcaauaaaauguuuuuaaguaucuaaacacuuguaauuucauaguaauuuuuucacuuucaaagauaaaagaaaaaagcagauauuagcaccccaggaaugguccacagagcaucccagcacugcaggugcggacagcugcccgugaagacgugcccagaaggaagugccggagggcagcuccucucuggagggaacauguuaaggaauacauuuugagaaacaggaaagcuuccaagcuuauuccuuaauuuucuguuugaauuaauuaaaacuaggacacauaugccccuggucacguauuucucacuggucuugaggaagaucugucuaugaagcuuggcaaacauuuagaauaagauuaaacuguuuuaaaagagaaaaaaaccuuuugacuuuuaauuuuguguucaaauagucagcgcacauuuaagucauauuucucaucaccuguuauggcucugugguuguuauaagcagcauauccaaacacaguuuguagaucgaauuacaagauuuaaugaaaacucuugauuuauaucuuuuuagagauuugcacaaaggcaaucgggaagagagaguuuucuaacaccuuucaaaaauacagagcuaucugcaguggcugaguccaaauuuaaauaacucaaggucgguaacuuuaugcacaggagucagugccccaagacucaggccugcggcuuaaaaaucuaccuagcagcucuugccuggacaaaugacccccacaacucuccucaccaaagcaugcucucuaaagaaagaguaacccagaaccuugucaucugcaaagagauauaagcaggauuucacuaaguacugccugggaaagacagagauugcucacagaaaacaaaaugcuaauauagacaucuuauugucagaagcuguuuguucagggaggaagugugacccagagaagagacacugcagcaggcaacugacucucagcuuucucuguccaugacuacugguaucacccugaaccagccaccccauccuccgagaucacagugaugucaucaguacaaaagaaccaguguccucucgauacccggaggaaugccaggagcuccuuaacugagaaaggacuaucaguguggugagggaaaucagcacaaguggguggguggaguuuggguucccuuacauaauguggacaaaucuccacuucuggucaagaucugcuaagaagaccaaaauuucacccuccugccagagaaaaggaauagauggacuacauaacaggaacaguuucugcagaguacggaccauggaccagagaggaagaggagauacacaaggugagguccuacaacugucagcaaccauggucccugagcuucccugacuguacaagguagggcucucaggcaguggaccccaagaaggaaagagcauuggaaacccagguggcuagacuuuacaggacaggugcucuauaagagaucugcagguuauccuacuaacugacuguagcugaggacuauucagugccugcugguauaagaaacagaggcuagagguaaaagguacccagaagauuagagguaauagugccugaagucccacagacacaugacugccugguucuugucaauccaauuugaaacucagaguucaugguagacuauuaaggauccugauuugaaaauggaaauaacaaguuacaagaagagucacuccaccuaacauaucuaaaaagagcaaaaugcgaaagggugaagcugcuucuaggaaaacuagcuagauuucaaaucaaagucugaauauauucauaguuauacaaaaguaccuagcaccaacaacauuucauaguuuaugauagccaauaaaaauuuaugcacgaaaauaucaaacauaaucuuaaguaugagaugaagggauggucauaagagacuaaggacagauggaauuccaucguuuuacauggauaaaauagcuacugugaaaagagaaaaaccucuagcacagccagaucaaacaaaagauuaucuguagaggugauaagaauggucuguugaaaacagcaaacaucauuaaaguaguaaaagaaaaucacuucgacugauaauucuauacccagcaaaaauaucuuuuaaaaccaaugguaaaguuaagguguuuuucaggcauaaauaaaucacuagcuuauacacauuguaacccaaagaauucaaacuucauuucaucugcacuugaaaacauaaaggaugcccaagaagaaaaaugauacaugguaaaugugaacagagaauaugacuaugaaaacucaugacuauauuaggcaaaaaaguauaauaguuccucauuagauaaaaaagauuuuaaaaaaugauggcuuaaagaaaaauaagaaugcagcauggaaaucaguauaaagguaacugccaaaagaguuaagagagggagggccaacacuggucuauuaccccaugucuuuaggauacaauguaccuaagucacaucuacaaauaaagugcuuguggcauuucuccuagcuucuucccugcggccuccagucuccacugucuggacaccaucauugaugcugugaccugaagugacaaaucaauaugacuuacccuugggggcaccgccugcagugcagugauguaauucucgagggccaggcggcggcggucauugagcauggcuucaacucuggccaugugugucucuacaagcugcugucucucauuggcugcuuccuguuccagagauuccacuuucuccuggaaaugcugauaugauaaaaacacacacaaacauauuuguuucuuaacauaacgauuagugcaaagauaguuucucucuguuuguacgaggucauguguagacuggguuuaguccuaaauuccuaaucucacuuaaauuuuccaagguuacuggaggagcugaaaacuucagucucucaaaagauguaucauuaauggaaagaagauugcaagccauagaauauauuuggggugauuaguucuaauuuuaaauaguuggagaaaauguaagggaagcaacuuauuacuaagacaagaagugaagaacaagugaaggucaugaaaauauauaaaacagggguuuccagcagauuccuggagguccugauggcugagaguggcauguucugucugguguaggugggaccgggguguuaccuggauaacggccuucuugucagcuuugggcaaguucuuggcuugacgcucugccucuucccauucucucaugaccuauaaagaggacauaaggcaauaugaaaaucccccauuguccuuucaaauacagauuuaacacaguggcuuauacgacaauauguuuccuauuaaaaaaacaucacaugccccucccaaugugacuaauauuuguccuacaagaauauaaauaauuuaugccagcgguauggugaauauaaaugccuacauguauugcagucucccgaaauaagguugguucaucuuuccauuuuccuugagaacugucggaaagucauuuuacuugacgugaguaaacacugauuacccauaaaaggcguaugccaucugagcgaagucucccaucaauaaacuaagacauugauuuuaaccuuuuacgacaucaagucaaagcauuccaagugguauguuuugggaauguguauguguaaaccaggaauacaaugccaaagucuauuccuugcacaaaugaagaguggacucuuccuguucaguaacuaagucaugaguagcaaggggauuauuccaaauccacccagaaagccccagaaaguaugcauuauaaucuccugaauguggugaaagguaagacacuaguugaggaagcaggccagccugcuguaauguaagccuaauggaggaagaugaagcaauauacaaaguugauuacagaguagguccucguggacuuuuuaauccaucucccgaaucugugaggaaaaccaggcuuauaaggucuuauccgaucagcacgugaguuggauuuuuuuuuuuuaaauuaguuucuugagaacaagauacauggaaaauguacaaacuguuccagguacuugaguauuucuauuagcuaauaaagggcagcguuggacgaaaagauauugaagagaugcuucgcuuuauagaugagccugggaagaaaaauguuucaauuuccuguauggaagggaacguucccgaguggcgauguucuaaggagaauuccucaggcaagacaucucaaaauuaguuugagauagaaacuaaaugucuuacuggggcaugaaaaccgauuccccugcauuauguaucuuugcuaucaucuuaucuuagacauucggaaccuggaucacccucuuggaauugcagauccaugaaauaauuaagauuuaccuagguaauguauugaaaauaugcauuacuauauaaaugaacuugaauguugacuuuucagaauaauuuagcaaacaucuucuacucucacacauccauggccuaugucgucacugaaggacuacuuacagacacgcuguaggcagaagauuuacccccuuaaccaguggcuuuuacuagggugcacugguaauagauaauauuacuggguaaagugcuuuacaaaaucugucugguuuaauugaugccugauuacagcaggcucuguacucaguaaucuuacucuacagaccuguuuaagaaagcugugagaguaaccaauggacgaggagugaugaugagccuacuauccuccuggcccagugugcugcugcagaucuaucuacaggcaagucaagggucaguaccaguagcugucccuaagaugccacugaauauauuaaaaaacucagcaucgggcaaguuuuuguuuugaaggacuucauucugcaugcacacuaaauggacuagauauagaaguaagugugaccaaugaucuugcucgccagccugaugggauuuagggaaccaagucucuggaaaugucaggggcagggauuuucuggauuagguuaguugauguggggagacucacccuaaauuuaagaagcacugggcuguggcugggguuucuggacaggaggcaaaggagagagcaggccaugcacucugcugccugacugcaggugccaugugaccugcugcugccucaagcuccugccucacaccaugcucacugugucacucuggacuguacccuggaauucuacacccacacaaaggcuuccuuucuuagguugcucuucucagguugcuuggcauaccaagaagucacuaauacagugaugaagcgcuuggguuuugcaugugugcuuaucugcaucugacacaugccagucacacuguaaccaagaucuucagaucaccaggccaucaacaucaauacaaauaucaucuucccuaacccccugccccugcaguggaaagagaugagguccauuauuugggggggcuaacccagaaaacuaauugaaagcuacaacaaaagucaaguuggaaggcuccgaauuugaaaaccugaaguucucugaaucugaacuucagggcugcacugugggucccuguccagcaguuuuucacugugugcagagaggcaccaauucuaucaggauuuacaguucuuuagaggccuggcuaugucaugcagagaaaaugacgauuacuaaguagagauuuaagagacagacaaguucaaagucaaaaagucccuagaauugagcagcagagacuauggugagagauggcagcuaacgcuguaacacuggggacuaccaggugcauucucugcucuaggaaugacuacagcuaaguagucccugaucugggaugugaagauggagaaagucucccggaaaucuaugaacuaagcccuggauuaaauagaugcucaccaguguucuuauuuccacaacauaucaugucagaagcuaacacacuacuugaaacuaauuuucuuaauuacauaaaaauaucuuggagaaagugaaaauauuuuaaaaaaugauucacauggauuuaaggaggaaauauaaaguugguaugccuuauauaauuuuguaugauuuaaaaggaauuagaguguaguagaacauaugauauagaaaccaccaauaaguaaacuauuauauaaaucuuuagaaucaaauaaaagguucgaguaaccacuugcccugagucaagcaagaugugcagcagcggaucugcugagauuugugggugggaagaagaagaagaagaagaagaagaagaagaagaagaagaagaagaagaaaggcacuucuaaaguaagccaaugucaagagcaaagugaggccagagaggagaggagccggagaggggaggagcuuccagcuggaggcaaggcuggcaucagggugcccuggcaggggcuggaaacaucacgggagcgcucaguguuuauuacacuuccucuggccuucugccccauuaugugcccagggcagccucugaaagcuucagaaaaugagaucagucuugagucuaaaaaggaaggaauuguaguaauucccaauuccacaccuuccuaaaugacuuuucuuguuucuuuuuuuuuuuuuuuucuuucuuucgagacaggguuucucuguguagcccuggcugucuugaaacucacucuguagaccagguuggccuugaacucagaaaucugccugucucugccucccaagugcugggauuaaaggcuaccacugccuggccuaaaugacuuuucuaaugaaaaaaaaaugugaaaaguucuaguuuuccagaggauugcuuuuaguugccuguuccauucaguuggcuuucuagcucaacuggcuuucaggcuuuccccaugggcaacugguaggauucgaaugauagcucauggccaacugguaggauguaagugauaguucauggccaggauuauugugguucaguguaguuguaaaaccuuuucucucaggguuacaacugcagaguagggccaaguguuauagcuagucaucuuuuauugcuagucgucuuugaagaaauagcaaccuuguccugcuuuuugagauacaucguuaguucugcuuaaaaugaggguuuucuuguuguuugggaugccaacagcccaggagaugaguucuaugaagaagacucaaugauuuacagggacacagggccagggccaaucucaggcagagaacugaugggaggacugacgggaggauagacgggaggacugagcaacaccuuagaauguauuuaggggcaggaguaaagacuugagguaagccagcuuaggaauaacuaguuugguuggcucagcugggcaguaguucuauggcauggggagauuucacaaagcaauagugccuguugcaggguuggagccuggaacccaaagccugauaaagaaguuagcuaggauuuggcccaaggaauaaggcauagcuuaaaggugucgguguucuuccucuaguaccucacacuuccugggaaacggcuuacgucauggggcuggaccucuccagacagauuagacaggcugccugucuucugcccccacagcccuggauuaaaaacagaggccacaaggucuggcuuuuuaaauguguguucugggaaucaaacucagguccucgagcuuagugggcaauaggaacuaguuuacugauuugaacuacuccuuuuuauucuuuaaguauaucuuacaacgcacauuuaaaguacacagccuaucaugagacucacacacaagauaaaguuuccuacaauguaucaauuaacagcccucaccucaccaucuucacagaauuccucucuuucgcagagaguuggaccugugcuucaaaauccucuuguacuugccuuuacuugaugugaccgugcacagggauagauguggggggaaucuguggccuugcagcaaacauuuaaauuaaacuuuaugucuacccagcugaggcagaggcgagcgcagauuucccuauauaacaaaacaacagaggauggaagauuccucccuaccugggacauucucucucggugcuuggcuuccagccucucuuuggcuuucuggaaaugggcaugcucguucucguccccgggugucuccagguacuugucgacggcgucgggggugcuggcugcugucgugggaacuagaaaggagaugggaggcaaguugagaagagacacagggugcccaaccuuuguaagaaagccagucauuucccaggacagagaaaucgugugaaagaggagcacacaguagaugccaaugcagccgaaagaagcacccagagacauuuuaccauggcaggagcaaguuucaccucuguagaacauagcaagaaaagcacauuuaaaagcuauagcauuaaaaaugccuuucccagacaggcauuccuccagcauccacugcuuaauauggccauguuucaucaaauccucaugcucggcuuggcuauuuuguaaucugcagaauagcuaaugguaucaccagcaucauuguaaagucccgcagacacaaauggaaucugagaagaaggcgaucgcaaaaucgaggcaucucggcgagaugggaauuccgcacauuguguuuuagacagccuaauuacgacgcuaccuuucaugagagagcuagaacaccacaggaagucacauaaacaucaacaagugcaguuucgaaaccacgcaaggacauucagccuucacacacuuggcaacagucuguaauucaucgcaagguucgucaaauagacagugauuucucuuucaauucaauacugccaggcaguaucugaauugccacacucacugugauguuaccuggcaacggggaugcuccgaaaaccgaagacugaacuauaaaacaagaauauucuaacucacgaacgaguagugguuugcaagaauuggaaguauuuaagcgagucaagaaagacagagaggaaagagacaguuuuuaaaagguuucccccuuaucaggaaaugauaucauccuucucaaaucacuuucaauguucauucaacaauaucaaccacuguuucgcauauucucuucacacuguucaucaaauucuuggaguaaagaggcuugggaugcaguaucuccaauggcaaauagaugagaagucacagcuaggucacauggagauaguaccuugucuauauauuuaagaaaaugacuggcauuagaaucaaagguuugaccauguuaacagaaaccagagugcguuucaauaaacacgagaggcaugcauucugaugucuuuccuuuuucuguggucacugguuaaucauaacuuuucaaaaaccuaacagcagccgagaugucugcccagguguggcuuucgagcagaaggagggaggcaaaggcuuauucuuggaaccucaaacaacuguccucaucuagcugauaaaaaagggaacacuugcccaauggcgagagggaaggaagguccacucaggacuuggaaauuaggcccagcuaggugugaacaauguuuuuacaccagcugguacccagggcaagugacccgagcacucugcaucccaggauuuuuaucuaguggugauaacaugccuugcauccuacaauuaaguguuagucacacaggguaacuccacgcacgccggugccuuuauugccuaccauuauguccuacagaaaucuuuuaugcuaaccuuggggaaaaaucagauauauuuacuucuaauucacugaaaauaaguuagaacacaggacuaugcaaugucaccuacaggaaaagcaacacauuuuccagaaaacaaacaaacaaacaaacaaacaaaccccagaaaaauucaacuuauauauaguccacacagaacauggacguaaauaaaauauaugguuucuuauccugaaugacugaaaaaugaucugcaauuuuaaguacugucuguaacagaaaagauaccaaagacaaauauauuugcuuugcacaaccucaagcaaaucaauacacacguguuuccuaaccgccuuaucaaaacuugcuucccauggaccuaaccauuuuuucccucuuacuggcagagugaaaaugagaagcuacaguaaacacuaguaaauagaauagcaacaggcggaggugaccaggcaaccugcacuuucuguuccauacggugggaacgcacaggcacagacagaaucugcuguaaguacuaucugauuaugguuccccuuagcaaaaccugccuugauugggcuaagugaaaauguaggccugcaaaaauaagaauaaaauaauaaucaggauacgagcaagugggguauguuuacggguaucaggguuauuucaaauagauuucuuacaggaacauggaaaugaacacaugguguuauuaccauuuacucugcuucaugaagguauagcgcuaugcuagcucauuucaugugccaauuugaaugaguuacagcgugccagagucaaucgucauuuugguguaggcaugcaaggguguuucuguauaagauuggcuacuggaucugaagaucucuucaggcgcuucuccaagagcuugaaccuaacaaaaaggccaaaggagguaugugugcuuuuggauucuugucugagacacuggucuuugcccauggacagggaacauucugauucccauggcuuggagucaaucguguacuuaccaguauccacaaacaucacagaaguaaauuccucagaguagaauucuuuauauaaauguauauguauauguguaugcgugcuccugcgagcgcuaacacacacacacacacacacacacacacacacgucuucugcagucucccuccucugcuggucacauacacgaagggacacgggugugucuguuuucucauaauaaaacuacgcuaccuaaaccuaaagcccaggaagaugaauauuaugagaguaaguuucaugugagaguccauuucaccagugcuggucacaguacccgcuguacagucuuaggucuucuuaagauccacuggacgucuauuuucugguugguggggaacaggcuuacuucggauuucugagucuucaugaugcauggucucucacaaaaaacacuauccugagaacacgacaccauuuucuguaguugcuguccccugggaaaggccuuacuacgugaggaacuuacuggaugcucacagucagcuauuggaugggaacacaggacccccaauggaggagcuagagaaaguacccuaggagcugaagggguaugaaacccuauaggaggaacaacaauaugaacuaaucaguaauccccagagcucaugucucuaacugcauauguagcagaagauggccuaguuggccaucacugggaagagaggccuuugaucuugugaagaucauaugccccaguacaggggaaugccagggccaggaaguaggaguggguggguaggggagcagggcagggggaggguauaggggacuuccgggauagcauuugaaauguaaaugaagaaaauaucuaauaaaaaaacaucauuaaaaaaaaaaagaaaaaaaagugaaacccacugagguuccugggaguggcugaagucacuaugcagcucagaggguucacagacaggcaugaucgagcccgacucuucauacaccaauuucccucacugugauuucagcucccugcaggcuaacugugccugggugugugcagaggcgguugguuccaggguucgcuauagagagcaaacuccaguuugcccaccucccuuuuguauauuuguauauaguuuggaguaucuaaugucuacacuguccuuuuucagacuguuuauauuacugaagauaaugcaaacauuaaagggagugguuuuucuuccuguauuguuugagaaacgagaaaaaaaagcuuguauaugcucaguacagaggcauucauuuuugacucaugguugcuugaaugcauagauaaggagacugaggacugacugggcuccagucgauccucacaccgacaauuaagauauuaaaaaaaaaucccuacaguuuucauauccauuugacuccucaauuugcaaggugacaccauuucuuuuaauauuaguuuuagauuuacuuauuuuguuuuguguaugcuggguauguguguuaguguguguguguguguguguguguguguguguguguguguguguguggugggggucagguguaaugcccuugaccaucuaaacuacaacacaagggagugauuccuagacaaaauuccccacggauagcaucuauuugauauaucccccaccccuggcagaaugcagcuuaucuauacaacaauggcaagcaaagauaacagugaagacuuauguaacucacugccuuaucauugaaaauucuauuugauugagagcuaguaaugcggucccuugaaauggcuacgaguuaugggcuaugacagcgugaguaauuuauguaugagugaacuguaaaccuauaaagaaggacuuuauaggaaauuuuaaucuccacgugacaaggcuuucaaacugccaucuccacuuaaaacauuuuuuuaauauaaaguuuccuucaucucucuaauuucaaacuagcuaaaacucuuaguacauuccacucaaaaccuaaauagcggccaccccuaccaagucugaguuggaugaacaggaaaauagaagcgagugaucuuucaacagcacacuggauuuuaaagagguguguucuugagccucucuucuuuuacggccaguucgaacacaguugcuggagaacacuaugaauguccuacguggacagaaggcaauaaaaauguaaucuacgcucuguuuacucuucaccagucaagcuacauuucuuuuuuaugucuaugaacuuguacugacaugggacauuuuuuuuuaucagauaugugcgaugaauguagaagaaugaauguuagcauaauuuuuauucauagcuauauucccugcacuuaaaugcuaucuuuagccugaauacgaacaaccaccaggcagaaagacauaaaaugagaguaauaguaacuggaagucagacucgcuuagccguaggguguuguuucuucuuaguuugcuggaagcuuccuugacuucauuagcaguggcucacaaagacaugaacagucauaacuacucaauauuuaacagaugaguucagaacgccagucuucacuaccagucguaucacaaaaacucugauagugagcgcugauggauccuuaacuucuuaaagccuuaaagauacagcgaauguaaauuuaccacagccuuccagagcaaccuuucccaauucacucauaugcugagauuuaauccuuccgaccacaucucugauccuguaaguaaauuacugaauguggccugcuuacauuauccugccgagucucucaagaggcauagugguagcauucucacacucugggcuaauaaaaguaaccucucuguguauuaaaguagacauguugcugcuagcugcuuuccauuuuauguagauguaugcaaaggcuagaagccacuguaaggugccuuccucggccacucccucuuuuauuuaccugcuuguuuguuuuuguuuuuguuuguuuuaaaggcaggucuuucacuaacuuggagcaagcccauuggcuagucuggcuucaccauucuacccuagcaccaggguuccagacuccuccuguguugcaguccccgcauucgaaugcuggggguucaaauuuucaaauucagguccucaugcuugcauagcagguacaucaccaacagaggccucuccuaggacgcuggcugccauggcaaccacacagucaugacuaccuacuaauuuacuaucugugguugcagcaguguguagauaggauagugacucuacggccugacagaaaagcacgcccaaucccuuuaauaaaauggaugcacuuccaugccuuuaucaaguagcugauggaaggaguacauaucugugcaagaauuauuuaaacaacaauaauaauaauuauuauuauuauuuugaaauaggucccauuauauagcucugacuagccuggaaguaacucuggagcccagcuuggccucagccuugcagaaauccauuagcuucuuccucuugaguucugggguuaaagaagugcgccaaccaugccuagccaaauaauuguuuuuacuauaguuuggcagucuaagagaauagcauaguuccauuauuaguauuccaugaugugcuaacaaauugauggcuauuauuucacagcuagaagaacaaaugaagaauaauuuaaaacaauagcccaaaacuagccaaggacaauggcugaggguaacacugguagacccuauucauguuggcaugagucagcuacuguuugcaaaucauaaccuucugauacaaaaaacuacuucgggacuacuggaucacacaauguguggacaaagccaucucuuccccuguuuuaaccauguauggggccauaucucccccugauaugcuguaaucauggaccuaagaccagaaacacaaugccaagauagagguaaacaagaagcaagggucuccagcaucucuacagauagccagguuaauggaaaccaggaugaaacaaacggggaaguggggagggguaugcggguaaaccaugauuaacagagcuugcuggucuaccuucuguauccaccguagcuuacaauacauuagaaaaaaacacugagacaucugaucuuguagucaaagaacaacagcaucugggaucuaggaaguuggucuaacagggucauaaacaucugcggcuucaggcauccuuauacuuuaacaggaucucccaucugugacccacaaaucuauauaugaacguaguuccacucucagucaggucaggggugaagagaauacuagacuggaacagagguacaucuugguacugugguauacugcaccaugguggaaaagugggagcgccugguagaucccuggagcgcucacucacugagguucuggguuggauucccagcaagcaugcagugacucacagccaccuuuacugggaucugaugccuucuucuauccugcaggcauaaaugcagauagagcacucacauacauaaauaaauaaguagcucuugcccucuuguucucuuuucuucuuguucccucucuuuccccuugccccuuccguccucucuccccauucccuucccccucucuccaugugcucauggccggccuccacucuucuacuucucuacucuuucugccuuucucugccucuacuacccucuugucuccccuccccaugcccugaauaaacuuuauucuauacuaaauaauaaaaauaaaauaaaauaaaauaaaaaauaaaucagaaaaaaaaaugguguaauguucuuugucuucaucauggaguuuaucugccugcuuuugaaaugaggucugauggagauagcacacagacaggcaacgcucuccucaccuucgaaauauaagcuggucaaaucuuuaccuaauaacuuuacuauuuuacaagaacugcauugagggccuggaggugaggccuguguauuaagucaaauagaugcagaacugacguccgaagcugcugagacacaggagguucuucaccucagauggaaaggguuuucaaagagauaggaacccaugguuaggaauaagaccacucuucagucucaggccucucgcugucccuguggugcagaggucucugggagagcagucacgacaaauaaguguccugaaaauuguggugcuuuucaguguugguguuugugggggagaaguuaaaaucuagcagugccugguuagagcauuaagacuugucaggaaaugauucaugaugcggucccagugcacaguucucuguauguaaagucuuaaagcaguucaguggaagggccuuuucuagcuuacuuagcauuuauucucccacuagcagcacuucagacagagcaucuguagaaccaaucaccuccgagcaaagagaugccauucaauuaacucuaagugggugaagacgccgugcauaagccuggguuuuccaguggaacaggcugccugcuccucuucucauucugcacacauuuccucagaaucgaggcugcgaucugcauuugaccuccaggugaccaugacuuuuucaauucaaauguguggcuuagcuauaaauaaggcaggcagcacaaccacacagcuauaaauaacuagaaauuauaugcuuucucccguauguugguacuagcacugcaaaacccuucacuugcugugauugaauagucucuguagggagacaagaaauaaagcugacaaaaaucaccucauccccccgggauggaaggauguuagggucuguaccacaccgcagaugggaggagaaagggacgccuccaggaucugucuggaaaaccuuauguauacuuuauaaaaauaaauuaucaaauaauguuuaauucuaaucaaugaagaagagugaaaaccaacagccuuuuacauacugaaaggaaauaaaauggaagagaaccaauuaccaucguuuucaagacaggaugagaaaugccuacuauucauacgugugaccuuguuggggagguauguuagcauuuuccaguuuugugugguuucuuauauuuuuugaaaaugugcuuucugaaccuuggaaacugucuaaccuagaaaaugucagaacccaguguggagccauuugguguggagcccagccagagugcccuuagguuucagacacggcccucugguguuugaugccugcagacaacgcacagagagcguuaggccucggauuuucucauaggcaccaaagaugcaaggaaaagguacacaagugugucagaaggagaucugcaaucuuugaaaacccugggaacaacgcgacacacacacaaaugauguuuuccuagucuuugggugugacgcucggagacuuucccuaguccucuaccacccacuugccagacuuaagguuuuagaggaacaauuucacaauaucaggacaugggcuuauugugucaauaaaaaaacccacaucuuucaaauaucaucccauuauuugaauuaacaguaauaucuuauggaggccccugaagaauaacaguauaggaugauguaaucaucuacacuacauuuuuuaaaaaucauuuucuuauuaguuuugagguuaggauccccccauccccuccaggauaaucgugacaaaggcgaauuuuaaucaucucauuuccaacugaaauuggguuuccucuucaagccucaguaaguaccaacaauauagaccaucccuggagaggggggauccauuucuaaauacagacugaauuuuaaaagcgaauauggauguguuagauaugacauuugaaaaugaaauuagacugauugggcaaccagaaagcaagacgcuguuaagaccaagaguauauuauaugguugaagcaaugucuuuuuauaggaaauuccauuaaguucccuaaguggaagaccugauagcacaccaaccagugugcacucugggagggggaggaggggaguccugaaaucuauguggcucaccuuucaccucccaaugcugcacaguuaucauuuaacacaggaaccuugaaaugugcacacaaaauugucuugaauaagcaauauuacauuuuuagggaggggguuaccuguacuaucaaauaugauuucauuaaauuauggcauguugacagcuuucgggaaauuaaaaaaaaaaguucugccaaaucaagaaauacucuaugugugguauuucacagaacaacacaaaucagaaaggaauuuguucagaaguguaaaugguuuaaguagaugcucucugcccaacaucugaaguugccuaguaaaaaccggaugaaaugacacgcaagacaaugggaaaauaguaucuaucaaaagguuccuggucaauaaucacacaaaacccaugccaagcagaugaugcaagggaaggacacauucagucaugcaacauagucuuccccuugccccucccccaagucagugacaacauacguuuaucaggaucuuggggaagagguucacugguagucuugaguaaacuuuggguugcuauggagaaaacgagagaacauaacuaaaaacaaaacaaaacaaaacaaaacaaacaaacaaacaaaaaaaaaccccaacaacagaaaggugggaaugauggcagaaacacacccacaggacucaaaagcaaucaaacaaaauugagggcugggagggaaaucaugaaacuaaaauuaaaaccuaaacaaagaaccaaggaaaugcaggugagauuuguuaccaguaaagaucaguauugugaaauugcugcccauucugccacugacaggacacugggaaaucuacaggaggacuuaggggucucuuuucccucauuagcaccaaugacccucauuucucucugcgccuuccucagcaguagcuccgcauaugucacuuguucacggggacgcuucugaggucuggcucagauaugugaugaggcuuccauucuucacuauccacccgucuaaccugaccuucaacccuauucuucccuuuccuucuuuuaaaaguuguauuacugugcguaguguauguguuuguaaugcuuaugugcacaggguuacacauucaugcguguggagagcagauagaucuuuuccaaccauugcucgccauauuguuugagacaaaguuucucagugaacauggagcuugcugguuggcuacaguggcugccuagcaagccccagggaugcuccugucccugccuucuaagugcuaacaauaccacgcucaacaggugcuggagaccugaacgcugguucucuugcuuuuauugaaauuuucucuuucuuuuuuuuuaaaagaagacugaagcaucucuccagccuucccauccccugccuuauuccuccaaagguucugagaaucagaccagagucugguacccagcugugccuuugcuuccuugauaccuuguaacccgacucuguaaaaaugaaaucaggacuacagaccuucucucauaagacccuguugaaggcacuggauuuuuacaaauccaucuauaaaguguaugcaugcuccaaccccuggugaagguauauaauguuuuauacucccugcacagaguaaucaaguggaagggagaugagggggguuuacacuaggguggguaagaagacaguguccaaaacuugaguugaauuguucucugcuaauaauauaaagcaaacuuccugaucgcuagaauaugauauuccagaaacuaacccuaccuuagggaaagggggggaaaccugagaacuuugccaggaaauccugaccuagcagcuaaacccuuuagagccgagguaacaaaggcccuuuguuccaaaggcuccaggcaccagacuccuuuauuguguuucaguuaucuaacccaauuaaccucuaggugaaaaugagcuuggguaucuucaacuaggagcuacaaucauccaauugaagucagagccucuccacuacuaguuuccucagaguacuuaaguggaguuaucuccuaggagaccaauaagaccuuucuaggucccaaacagauauuagcuaccucacagugugaggucuuaagagagcaagucuuuguuuugcuugguucugggauuugguuggaaaauugccagaauguucccagauauccagggaaagggaagggauaugucucccugcaaauucaagaauuaaaaugcaagaaucucucaagaaaggcaugcacugucacuaagacccuugaauaauucauauagccaacuugugaucaagaauaaacaaauacaacuaaggacuuugcuugaaaggcuacuaauagaagcagauauuccauauaucugagacauggcuucuuggggacugacucucugcggggaauacuucauuuuacacugaagucaucaggacuucacaucauuaucucccacaguagagacaguuggauguuuccugagagacacuguaaguuauuuccuucagccuugugccacugaaaguugcuagcauuauucuuuucuuugugugcacaugaauguacacauucaugugugacacgccacggagcccaugugauagucacaggucacaagcuuucuaccuuguuuggaacagucuacuucaacuacauaggccaggcuagcuggucccagucuucaggugcuucuccagccacugccucccaucccccuuugcaagugcuagcauuagauaggcacagacugcacauuuguuuuaugugcauucuggggacuugaacucagguccucacaguugcauggcaagaguuuuuauuaaauggucccgaucccuauuucucgucuaccuaauugcaugagaaaaaaagaaaaacuuggcaagaauaugugcucgagguucauucagggaacagcaugggcacccauaguauaaugguuugaaugaaaaugggccacauaggccccuacagaauggcauuauuagaaaguaugaccuuauuggaguagguguguccuuguuggagaagucugucacugggggugggcuuugagguuucagaugcucaagccaggcccaguaccucucuucuucuuguugccugccgauccgggugaagaacucucagcugccuguccagcaccaugucuaacuaugugucccaugguucccaccaugaugauaagggcuaaaccucugaacuauaauccauccccaauuacauguuguccuuuauaagaguugcuguggccauggugucucuucacagcaaugaaacaccaugauagcaccugaggugacaugagcucaauucaauuaaaugucauuaucagaaugaaguuaaaaaaaaaaaaaaccaugaugaaauaagaggaauucucuauagcaaucuuaucaagacagugccauaagccagcuaccagugagaggcuacugcccaugugcacaugcagaaacacgaagacauguaagaacauagacagacacagaugucuaugcaucugcaggaaggacugaagaagacaaaagccacucuagcccuuguguaaagagaagcagucagaaguuccuaggaguugaaagaagacucuaugaugacuacuacagaauacauccaaggccaugcuuuauuagagauagacggagagauacgcucaugacuggacauaccgugguggaggaggcuucugguaauuagagaaauugacaggcaugugguuagugguagcaacagugggcccauucccaagaacaagagggaaacucgaucuguuacaaagagcagagccaguggcgagaaagacaagagguggccaggcuggaggaaggauccacuuacacacgcugccacacaccgccaugcaguacucuuccgugucaaaguuguuccuguugccgccacauccgccguaaaagaaugggacacacuucccuucagugacaucaaaguaccagcgggagaucauugcgcggcauggcccggucucggcuuguucagagcacaccucuaaucagaggggaaccacauuuagcgagaaaagacaucuucuggcuguucacauacauacuuacucaacuuaagcccugauccucccaguggugaccugggcugaacggaggaagcagcuacuuuaagucuuccuugagggacugaauugacccacucagacuucagagucaccucuuccacaaaacaagacauucucggcuuguuuaauguguaggaugcaguagcagcuacaggauuugggcuagaagugaaaagguuguuuucucaauuuaaagauaaaaagucucucucucugcacaucaaaaauuucucuuaaaaaaaaaaggcaucuucuaaaacaaccuugagucaacucugauguuuaaaaaaaaaaaaaaaaaaaaaggauuucucgggaugugaugccaaaauuuacguucucuccaacuucugacuguuuuucuuaguaaaugaucgccuagacucaugcauaaguaaucacauuuauguuuaauguuuccagccuguccacggacuaaaccugaaaacguacguaacaucugcaagagugacugacagucaaccaugguaacucuaagaaauuaucuauucguguauuuuuuucugacccuuagcccgucaugcuccaaacaguaacauauacagcuaacacauucaaauuuauuaauauauaccacacauuaucuuacauuaaaacacaccuuacuugucagucuaucuugccccugucuccccaaaucaguuccauauccccauugguuuaaaaagcagcaacccacucacuugcauuuuaaagguuccucccuauuagaagguagagcucuauagacuuuccacaugucuguuuuuguugcaaggagaacaauagcuccaucucuuauuuggggguuucuaacccuggagagccucaaacagaacuccaugggaauccacuccaugugacaagcaucugaaacaauucugacuuuuccaguuucuaggaggaaucacgugauuccagcauuccccacugguauuccuacugugggccuccuccuguuccuuuugagggcugggacuguacaugcuuuauagcacccucguuuguuccuaacgugauauuacuuuucaguagucucuucuucgguuuuaucaaugccaagauuggacagcaguguccugcacuggguuuguaguguggccacaagaggaacagaaguuuuggauccacuggcaccaccuucagucaacagagacugucagcaaaauccauccuugucggcucugguacaaggggcguguccucagagucucucccacucacugaauaacagagccagaacucgggcacaggugagguaauggaauuaaacaguggcaaaugcauaaugugugggagaggggaugggaugggucugugugagccuggaagaacuggacaaaagugagccccucccuuuagcauccggcagacagccacuggauggagcgccuuccgauacuaggguuugauggauaaaauuaggagaugcagauucucagaaugcggagaaaaacauucccaaagcaugauuuucuccauguucugugaaacaugcuaaauuaaacacaauacagagacauacauaauauaaauguaccucuuuuaaaaccccguuuuuguaauuuuagucucuaauuguagagaacaaagacaaauacagcuuugcuaucuaacuuaacagugaaauaaagcuuaaaagguaaagacauucaaguuguacuacaguguguugaucaucaauacuucauucaaauaaauuguggucuacauucaaccauaauaauggaaaacucugaugucaguguccuuuaaaacaaccaugaucaagauguggcggugaauacccgccaauuccaguaccugggaaacagagacaggacuauauugacaggcucaaggcuagucuagucuacagagcaaguucuaaacuaucagcgacaagaagaagaaacaagcaagcaagcaagcaaacaaacaaaagaauuauauuccuaauaaaauaagcaugaaaaaacuauuuuuuaaaaaucccaauuaaguuauugcuacaaauuuaacaauugcaauauagcaacauuccaagagccuaauuuaucugaacaaaaacuauauucuauagguaaauauucguuugguuuucauagaugaagcaaaauuuaaaacaacacauuagaaaagugguuccuuuuuuuuuuuuuuuuaaagauuuauuuauuauuauauguaaguacacuguagcuaucuucagacacaccagaagagggagucagaucuuguuaccgaugguugugagccaccaugugguugcugggauuugaacuucggaccuucggaagagcagucgggugcucuuacucacugagccaucucaccagcccaagugguuccuuuuuuaaagaacguguuaacuccaaugcuacaaucacauacuucuagcagaaaucacauucaucaugcauugugaaugcuaacaaguagucauaaaaacgauaagaaaauuaaucuuuaccaggaaauaaaugaucaaauauuuauuaucuaguaaucauguugugcuaaauauaaucaugcaaauuaggccagcaagcuggagaugaaaucucauguuccaaauacagguugaaauaucagcaaaucacacgagcagcugugcacauuauugaagucauagacucagaaggacgaugugugugaauuuuuuauagaagucuccagcacaaugguccucaguguuccuaaggcugcauuccuaauggaaagcuacaaccuuuagcauaguucuucauguuauggugaccccccaacauuaaaauuacuauuaaaauuauuaccauuaaauuuacaaccauuaacaucuucauugcuauuucauauuguagucuuugccacuguuaugaaucgcaaugcaaauaucuguguuuuccaaucaucuuaggcaaccccugucaaagaguuauucaaaccccaaaggggucacaaccaccagauugagacccaguguagcagguagccucaagcuggcugggcuuuguauugagaugugcaguucucugucauuguaauuacacuugaccugauucucacaccucccuaugcagaaagguuucuuauaaaauagcaccugaaggagaugggucuguaaaauggguuuuacaccagucagugccccugagacugcugcaaucgagcucagagaccacuaugaugcuucaagaaccuugacuuccugucagcugugguuaauuggacacacaacauguuuucaacacguuuaaaccuagaacaggguaaggauaaggcguaccuugugucauaggggaaauauuuucuuuucuaaccgaaugagauggaagaauuugcuuuaaaaaauuguguguaucugggaagauaaauacauuguagcauuuggcuauuuucuagguaaaacucccacgacugguauuucaagcuguagugguuaugacucccaaaauuccucacuacaguaauaauuaguuuucacagcccaguagggaucugacagugccacaccaggaaaacacaggcacgaauggaaagcuaccagaaaaagaaagcuuuccccuuaaguuucaaauuuccugucuccaugcccaaauccucaaaacacagaaggcaagaaauggugcuaaaauuucaucaaaguacgcuccaugaccagccacgccucucucucucucucucucugaccagccacgccccucucuccuguguaggcucagugaaagccauaggugccuggagaagaacugcaaaggaugcuaagcaccuugaaaggcuguagcgagugugggaggguguggcuuucuagccuguguuuagagaagcaaggucacaugacguggcucauguacacaguaaaccccuaugaucaauccuccagucugauucccaaauucaaagacugcaggugugugccaccaugcccaacuaacuuauuaaauguaguugaaauguguuauauuaaaaauauagagacacagucgcaccuuaggacgagaggggaggaacugguaaaaauuggaaaacguuugguucaugugggaaaugagaagagucuuagaauaaaaaauacagaaagauaacagaugaacuguuuuuaaacagauugccaauacauauuuuuccuacucuauacaauuaacuguuuuuaaaaacaccacaacacuucugccuuaaucaauacugagauaauaguucucuuauauuuaaaccuauaaaaacgucacuucucagaaauaugaccucuaguggcccucuucgacuuccacacuacagcuuuuauuuucauauuauauuauuauuauuuuguuauuuugaaaauaaugcugaaaaaaauuuuuaaaaaaucaaggaaugaacuaaagcaaacuuggaaccuaacuuuucacagcguuuuccugggaagacauucgagauggcaucaacacuuuugagaacaaaagaacacuuccagugagcuggggucuggaaacacguuucugucugaggaagacagggcaugcccaccuuuccacaguggcuggcuuccuuccauagucucuaacagagaagaauuaagauucaaacugagaacagcaucauuccuacuuaaagucugucccaugaccaggguuugccuuucaccucaguguauuagggagaauggauuccuuuggaagaggaaacacccgaucagagaagaguuuccuccacaugucacugcuuacauaguaggagugucaaaccagggauggugcaggcugcugauccuagcacaagcaaccaagacacagagagaucaaguuuaaagucauacaaugagucuuuuguguuucagcauacauaaacacacacacacacacacacacacacacacacacacacacacacacacacacacacauugagacuuauucagucucaucucuucuggaauucuccguauucuccuaauaaaaacacaaaaugauagacacgcuacucugauacaugccuggaagucacagacggaucuucagaagggcgggauugcugaaaaccaacagaaacagauauuuugguugcaauccaccccacuuuuaaaguucuggacacuuauauuaagggaacuaaauauuuccacgaagaaccagagcuuuguuaccugagacaacaacacucugcuggaguuaaugauuaauugaaaaggcgaaaauguauacauacauaaucauguuaccugcucucuaauuuguugcauuacauuuuaaggaacuuauuuuuuuguuuuuacgauauaaacuguuaaguagacacauaaucauuacuuaaggcacaaaaauuuucuuauggcaaacagaucuuugugaauuuacuaaacuuugucgauaggaaauuaugucaaugaaguucuuacuaaaacuaagaaaaccacauauauguauacucucucucucugucucuguaaaccucauuccccaguccugugucuuaagcacacuaauugcuacaguaggcuuuccagauuaggacaguuaagcaacaguuacauggaccccucagcccaagcaaagcaugcauggaauggcuuagaaucagugacuguuaugccacagggcacaaaauaacaggcugccaccugucaccuacauggccagugcugacaccaguuuucccgacauuaaagggggugccacaccuugguucgaaugugugaaugcauucucugccuuaguuagagcagagguaaaagccuauggcuggcucuugaagaacgaacauacuacuguucuuuuuccuacccccucaacccccaaacacacuuuagagcuuugagcuccuuggcacacucacagcaagccauguuuacuguuucuccggagucugaaaaagcugagcaugacagacaaagcaagaacccaugaguuccaggcugcuugugucaugccuuuauugagccauaccaauggagaugggggagaaacauaagcuucgucucuuuuauacccuacagagcaacauggcuuuauuuaugaagcuuguuagaugcauuacuucugaugcucugucagugggucaaaacguccacaggauacggaugcccuuuuccacacagggugaaaagaggcuacgcagaucuggauggacagaccugagcuaccuggguucauaucccugggccccgagagaauaaugcugugcccaguguguaaaugugccucaucacuguuggggaugucuucaugucaauuccugauacuugucugcugcuucucaguaauuauccacagaggagcaauaacuucacaagaucagccagcuaacauaagccagccaggguuuagaccggagauuuuagcuucacaaacacaaguguuuaaaaagucaccuguguccgugucucucucucuguccccuuacugaugaauuuccucccacggggcauaaaauggauggaaggaauaaacagucgaucuugaaacgugacauucaguaccaucuuguucaauuugccgcuagauauaaaguuuaauugcaaauaucuugauaugugggaauagauucacacacaaaacuauuuuaagcaggagacccaguucaugcugcauuuuaaugguaacagaaugcugucuacaaaccccagcucuguuguaccaacaguucagagaugcaucacacugcaauuaaaaugucaaucuguugguuuaccuuuaauacgucugacugguaguaaacacuaguugucuaauguucugaaucuaccaagguauuggaaugaugacuacaaccgcagugaccacacgcuccaggcugaggacuuccugucugucagaaacugggcucaaugguucccagggguuacuaggagccacuugcuucucacagaguggcuagauaucaaccccaguuuuacagagacauacgaggaugcaggacuacuugcauugcugcaucgugcaggauuuugcaguucccaggcugcagggcuaaguaggauucaaaucugagcaaccuguacuugagcaacuaagucuaagucuuccuagguaagcgcuuaucauagaucauguaaagucacucuuaaaacaugcaaggcaacgucagcacuuauguuaggcaaauaaaaagcagguuacucgacuggcccaaggccauaaaaugauaaaugucuccaguaaauacuacagauggagcugaggggagggggauggcuuaguccauaaacucuuugcugcacaaacaugaagacccgaguucaauauucacauuaagaaaaagccaggcaaggcgggaccgcuuaccauuccaaacauaugugggacuuguuggucauguagccuagucuacuggaucaguucuuggccagugaaaggcccugccucccaucacugccuaaagucuagaaacaagaaaaggugguugggaccacccgaggaacaacacuugagguuguccuaugauuuuuacacacauauuugcaugcaugaaugagguuguccuaugaguucuacacacauaucuacaugcaugaaugagguuguccuaugaauucuacacacacauccacauguaugcauauguaccugcauacacaugggcauacacacgcacgcacacacauacacacacugaaaucaacuugauuuuaguaaguagaauucuuucuuugaacaauaucugagauuaagaaacaguauauaccuuggucuuuucugacaguauaaucuccuuuguaauuauccaucuccucagcucuauauucugcuuuuauagcgugaacauagccagagacaacaucuaaauaagugggguugagugucucccaggaaaaccuuugucuuaaaaaauagguaacaugcuacuuguggucccuggaauauauauauaguauugugaccacuagucauguauuacugaucauugacaccugaucauuacuauuguuuaauuuaaaaacagaaaauuccaggaauguacggcacagaaauaaaagaugcauccauguccauagcaaaugaacaggcacuuacaggaggugcaaguuaaacagaagaguauguauuuagaaagaaaagugaaaauaucauuugggcauuaacgaaacugaaauagccuagcucauguggacccaaauccuggcuucaucaauuacuacuuauaugacuaauguauguuuaaaguuucccuaagucauaauugcccugacuucaaauaggggaaauaacuuuucuacugcauacuacagcuauaaggcuuaaaaggagaauuacagccuauacuggcugguuuugugugucaacuugacauaagcuggaguuaucacagagaaaggagccucccuugaggaaaugccuccaugagauccagcuguaaggcauuuucucaauuagugaucaaggcugggagggcccacugugaguggugccaucccugggcuggagguccuggguucuauaagagagcaggcugaguaagccgggggaaucaagccaguaagaaacaucccuccauggccucugcaucagcuccugcuuccugaccugcuugaguuccaauccugacuuccuuuggugaugaacagcaauguggaaguguaagcugaauaaacccuuuccuccccaacuugcuucuuggucaugauguuugugcaggaauagaaacccugacuaagacauggcuuuaaagaacaagggaaacggugagccagagcacuucuaaguucuaaagaacuccaacguggaugcuucuagcagguggaagccugucugugcuagcccugcuaugcuuucuacagcagcaaagacuuuagccagcagcagggcacaaagaauauuuacugaauaaauaaccauaaggaaaacguuuuucuggacaggcagaauuggguucaaaagccaaagcugagccaauuccuacaacauucacacuucagaaaagaaaacccucacaucucggacuuaugaucugaaaaaaaugagaacaagagucuaagacuguugcuucccuuaacugguaacaacuugaggcauuugacugauauccaacaucuuccuaauuagcaaagcuuagcaaccagauggauuuugcaguaacgagcuuaccuccaaagaauugccuucucucugaacucaguaaugcagaacaggcagcugggguuagaaguucuaugaucagguaaaaauaucuucugcuuccuucccucugcuuaguccucucaggagccaaugggcuaugaaaggaccgaguucuuaagaagcccaguaaggacucggcuuaguugccggagucuugaaauggugaaaugauuuuucuuucuaugaauggugguaaaucacauucauguccuuucagaggcgaaaacauugacguugauaauaagagugcaauacuaaucuguucucugcagguaguguuugcuucccaggcacggaagccggcuuugcagggaggguuuuacaaagugugcgaucggcucugccauugcuggggcuccuacuaaggagaagaauuagcagucgccuucuacacuaggaauacacagggaagggucgucugccuuaauccuacaucugcaucauuaaugagcauccucuaacaucucggaaagauuugccugaauuuaugucguuggugaacuccauaagccuuacauagagugaaugugcucacauuuaaaaaaaaaccuuuuuauagcauuaauguguguguguguguguguuuguguguguguguguguuugugcauguguguguuguauguucgucuguauuuuccagaauaggauguuggaugucuugcuuuaacacugucuuauuuucuccacacagagucuucuacagaacauccaacaauaucccccaacaaacuuccuguguccucagcucuggguugcaggcuugcauaaccaugcuugccuuuuuacaucgggcucugaggguuugaacuaagcucuuccuaccuuuguagcaaguacucuaucuccugugccaauccccagcuccugcuuaucuuuaaaauuagugcuugcuuuagauuuuucuuauaaacaucuugcuuagagaucucuuguaguucucacuugaacuugaggcuuucuagagaaaaauuccauaguguucaugucuuuauauguucugucugaagaucuaaaaauuacaccuuacauggaaaacuguauacuaaaacuaaacaucuaaaauucaaagguacucgugaaacugagaaagggaagaacuaauucagaaaaauaacaagacuugaaaguuaacgagaucacagaucucgagaaaauuccaucuugauuagaauauaagccuaagaucaccacuccguguuccccugugacucaugacggucaaauucacuccauuucccaucauucucagcaucugucccaacccaguuuuuccagauucuuuuccacagaguaccaacuaguccugucucccaagcaugccccuuaucuuccaccagagcacaggguuuguuugcucuuuccgacugacugugaugugugugcgucauaacaaaauuuaccuggcgacacuuccccugccuugcuuaaaugccaucuacuuaagaaccuuuguuagccaaccuggaagcuuguucugaaguaggcucuguguucuuaauuuacagaguagaagguuuugcauuucuuuggcuuugauuucauccuagaucucagcgcucauggucaucaugaggcuguguguggucuucaccugugccauucagacuuacaggcagccaacaaguguccucuacuucugaagaccucacuucauugcagauuaucagucacugugaugugacuccaagaaaagaaacccagaguggggaaauaaaaaaaacaaaaacaaaaaaaccaaaaacaaacaaaacaaaacaaaacaaaaaaacaaaacaaaaaaacaaaaaacaccucuuuccuugcugagaaaaaucagggcuaaaaaauucauuaggccagaucuaccagucauggccuccagagacauuugaaaauuucuuuggaaaaagaugccuugggcauuugaagaagagcauuucauucagaucaaggauaccucuauuugcacaugcugucuuaaguagggaaacgauaaaacuaaaccaucuaccugaaacuggacucucuuccuaaacaauauagaauacuuccauuagaucuaaguguucaauucgucacuaaccaaaaacuccaagugaaaaacagaaaacacuguuaagggacacaagucagccauuaagcugugccggguacaaccucaguuauggauuaaguauucagagaaaggcaacucaauggaggccaaaguagcccagccauuuaugggcaugagcgaggaccaagucugugagugggcagaagggaucucauuagggugcuggaaggcccugggcgagauuaccgugauauuaaacaacugaguaaauuuauuaaagucacucucuuauauauugaaaaugaguuaauauuaugauauauaaaaucuuaccucaauaaaguucuuuaaaaugcagcaaagggagagggagggcuaguaauaauaauuagcgauguccuuggguuggacagugucucauauuaaacucuaaugagcuguaaucauuacaccauaaucaaaaaggaaggaaaucuuacugcguuuuuaacauuuguggacgaaagcuaacaucaucugcauuacacuaaaaugaagucaacccauguucacucagucuagaucuagaggcagauuuuacuguggggaaaaaaaaccaacacauacccauuuaaauuccccaacccccaaacacacuaguuggcauaacauuugguuuguuuaacauaaucaaaguauuugcuuucacuuccuggagaugaaaagucuucuucauuucuuugguuuacaacauucucgggaggggcauucgcugaggcaugggaauuacaccuguuuugaagaaggugccgacauacgucccgauuaaacaaguaacacaaauugcccauguugaacuucacagcacgaaauaaagugauucuuaccaaaucauauuaaaaguuugacucaguaaacaaaaagaaaauagauuuaguaaaauuaguaaaaucuaauaaaaagcuauucacacgagcaaacuucauuggaauugucuauaaguccagcacagugaaugacccaaacuacaguucuuccaaucaaggaguucccagucucagggguccaagaugcaacgggcagugcugaacaaugaaggcccaccaccagggcaugauucagcacuuuucaaauuugaugccuucuggcuagguggggucuuauauaaauauagucuaggacuccuucaacagcauacacaaggcauagaagugacuaugcaagcgagauuuguuuuaguuuaaauggacugcuggacggcuuguuauagcaaccaaaccaacaccagcaauaaaccaagaggaagaagccuugugauuuugggggaguggugggagggaggugagggcagggggcuggagaagggaagcacugauugaaaucucuuaucccagggcaguuaaauagcaauccaacagcggcuuaccucggaccaccuccuccacggacucaguggugguugugguggugguggcagugcugguuguucucucgguggccucuucguagggcuccucggccuccuccuccaccucguccccauccuccacauccucaucaucaucagcuuccucuuccucaacaucagccacuuccuccucuucggcgacuucuacuacuuugucuucacuggaagaacagauaaaaaaauagcugugagagacucggcugaaugaaaguuuaggaaagugaagaagaaaaagaaucaagggacuuugguaaugcgugagggaguaugggauugaugaaaaaacacuaggaaggucaaaaugcuguuaaguaggaacucuaucugagguccacaaaauguuucacaaguggacauagcucuucguuuaaugguugcagaaagaagauacucugacuccaauuauaugacgcuucggucaaggcaaaauuauguagacuguugagagauaauauggcuguaaacaucuauguaccaacacacacaggucagguagcaauuggcaagauaaaaucgugaaaggacaugucuaggacacaauuuaaggaacuacuaaggaaccugugcggaaagcaacuggcugccaaugccagcuuggccaagagcacacggaugaagauaaaagcagggagagccuacccuguauugccuacugggaaaggacagagacaugcuggaccacaucaaaaagccaacacaagacaaacagcugagacugagacucucuggcccaguugugucaaaugagaagcacuacacaagagaguggaaaagaggccauggccaggucaguguccccaccaacaaacagggcacacggaaacuaucaccccgaaguggaguguggccagcaagaaggagugugcuuuuccauugggaaaggcaauggaaaucuggagguuguaugagcugugacaccaugaugcucuggauguguugaggaaggacacagcucagcucuaaaggagugugcguccagugucauagacuguaucaugugagcuagagacuggaauggucccagcugugaucucacaugcuuccagagguugaaagacucucacagucagugucugacagcguagcagugagaugcuguccugaaaaugaaagggaaaggaaauccaaggagauggauguagcaccaagggaccggugugguuuccuccaacuccagggauacuuuguacagguucuguaaugaaugaugcauagcaggcccuugggugcaagcccaggaugcaggacuugaaaaaauccuauaaaacuauguugggcucuucaaggggacauuuccccaacucuggugaaauacgaugaaaaacacaacauauucugaaacguuugacuaaaauguacagaagaaauuauuaagaugaauaauuuagugaagugcuaaugcauaauguguugauagguaggagacuauaacugauuuucacauucucaucaagaccaugaagaaauaggugagaaauggauaaucagauaggauaagccuccaucugccuagauauaaauaggguaaacuaauugauuucuugauugccugcacaaaacucucugugcacacaucuagcaccgauggcguauuuccaaacuaaaccuacagcuggcgcagauuugacuuggggucuuuuacuuaaucucaaggcuguuuuucuagugaagggugguagauuccugaauugauugugucuggaauccccucuuuguccaaucgaaucagucacaauucccuuuguuucuccacugucagugguaaugcaaaagcaauggcagggagaaaagcuaaguccaggccaggauucucuauaaaccaugaauuacccaugaucucacuccaugacuguugugacaguguucaucacugguauacaguccaggauuugguuagcccugggcugucagguagggugaagcauauacacagcuggauucccugaggugucuauccaucuuccguuauuacguaaacacugcuuuuaaagcuccaaacggaagccuuggcugagggaaaagcuguuuaagacaucugcauucuggugugugcuuagccaggaaaaagaagaaauuauaugcacaucaccccucaccgccucugucggcauaauuuacugucauaauaacuaagaacugagaugcauaauaguucaacuggcugagaaauuaaauuacuugcccuaagagaacucagguccaguucuuauugcuguggcuuugauuucuggaauuaaauuuaggcggaccugaauucacuuaucuauuuggacacuauuuaaagcagaagcacacaauuguguuuuaaugaggcugcaucuucuccgagaaucuugaacgugucccucuuacgacuucuaauuggagcuuuuagggcuaacaggaagcauuagcaggcgggaaagauguuuuucugccaccagcugaaaggccaguuaguuucuucugugauguaagaaaggugagauggguguguaaagcugagcacagcaacagaaaacagaagggcggggagaagucugugaaaaugugaggcagagccauuucuucacaagccgggcaagaaacagucacagaaagaugauaagauggcagaacacucucaucccaucccccaacugcaaaggccgucagcuuacauauuaccaaugcuuucucuagguuuuaaagugagaaauacuaagaaauacuaaggaaacaggagcuccuggccauccuaagaguaucugagugcagugaggaggugcagugagucaccagugacacagugaaagguuguacuuugcuggaggauaaaggcuaccaugaagguggaucgccauuucccacgaggcugaaccugacauaauugcauaugaugcugccaccugggagucuccuuaggcagcaggauucacacaccagcuuucauuccuuguuuugaaagucaagcaaaguguuuugccauuugcauucucugacauuccauguacggccaaaggcuggaguaaaaagaucaguggcugugggguggaggcucagggaggagugaacucacaguucauugaggguccuuuggucugugaagcuauucugcaugauaggauagugggggccacauguauuccucuguugggcacaaugguagggguuugaagucacgaaguaagggauaauugaauguguugguaccuccugcccaauuaaaugaauaaaggaccuuuagaaguuuuauuuguuguuucacagccuguaaacauuuaguuuguuuuucuuucuuccugcuaucauagaaaccggagaaaagaaauggcagagagauguucugauauucauggguacgagaaugcgaucuacuaucuggccuccacuucagcagugauaaaaauaaccaaaagccaguucccaacauguugugaccaauaagaggccagaggagcaugacugaaaaaagauggggcucagaccuaugcaugccgauguacgggaagaagaggaagacagaagcgucugugagagauucccagaaucaaagugagagacacagagaaaauacagccaugaagacagaaacaacaaacaaacaaacaaacaaacaaacgccaaugcaccaauaacacaagaaaacaaccugagaugaacagauguuuuccccuucguuggauucagaguucuccaacugaguaagucaguguguuccaaagaaaagcaaugucugagaucauuguuguuacuugcagagaacaugaagaaacacggaagaagguaagcuuguuuucugugguccccaggaaaucgucaacaaaggacagcccaaggaaggugaagucaagaacacucccauuccaaaaguaaacacacaaggucacucuuagccuauuucuuuacucauuuguuuauacugguuugagagaagguuccggucagcagccuaagaugaccuugauaucauuaggaaccuuuugccucggccuccuaaaugguguccuuacugacaugaaccaugucccacucacuuacagaaacaaugaauauaggcaaauguucaagcagaugaauucaggaguuguaggaucuggugagaagaaaccuggauugcaggagaggguggcugguaaggguagguguucugauuuagacuaucaggucauuuuugguuuuaaaaauuaggcaaagcuguagaguuguguuaugaguucuuuguuaaugcacaccccuuuuucagaaaaaaaaaaagacuugaaguagauuuuccuaauguaacaaacaacuuuucuuauaaauacuuguggguugaucuggcauaaaaacucucaguagcaaaacugccauuugagggccugcaauuugcaaacauauucccucuuccaagaacccuauuacaaguacaauaaagguaauuauaacaaaagaaagcaaaaacacggcuaugacuuuucauaucuauaguaccuuuugucauggcaucacugaaucagguugaacgaggcaaauuauccucuacacugauuacuucaucaauucagaucuacauacacaaaaagucuucuuuugacuauagacuuaaaauguaguuccuauuuuauucuacaauacugugaugacacucugaauuaccuggucaaacaccgucuaaaaaacuaucuaguggaaaauccagaaacaauucauaaccuuuaaguaauucuuaguacacuaucguuaugaucacuccaucuuuuucaugaucuguugauaaucugucaaugaccucuuucuguggaugagugcacacucuacagaaggaaagcaacaaaaaguauauacacaauguagugaugacagaacccuauaggccguaucuccugcagauaggggaguaguugccuuggugacacaugcuagcuagcaaggcauaucaaauuuucaguuagaaguuuuccaaaacaaaauccgauguauguuucccuugggaagaaagcauaaacuccuuguagcagauacuguguaaguuacccaaggucauucucaaguccuuccuccccucccuugacaggagauggauaagaaccaaauagcccauuaguccacauugcugcaucccuugcagcuagaaggccuugcaaccggcaauuucuaaacaaccagaagccaggcuacaugccuguacuucauggagaagucacauccagaugaaaagguagccccugugucuuuguuucuuugccuuguuacuccuagcuucugugaccacccgaaaggcagaagccccugccagcuacgagcggauggcauuagauuuaucaaaguggaccaucaguuaagcacagcucacuggaaagacucugaaccaauccuggcgauuuuugacauuugcagcuaaaguauuccuugcugaggaaggaucucaaacccagcuggagccuuaacuuaaagacugagacaucaaaacugcaugacucaggcaauuaagagugagcugccggucccaaccuugguuugaaauuggacugagucgucaucacacauuuaguaaugccuauucugggugagagagucucuacuaauggcucagugagcaacaggggacuugcauaacacucgcuucagaaauuccaaggagaaagugacuggcacaggccagaggccacugggcaguugggaugagucaggaauaugcauucauuaugcaauugggaacaauaugcaaauaacgaugaucccaacaaaaguucacagggacacugaguuuuaauggagaggaaagacagaaggaaaccagggcuuuuuccuuagugguuaaauguggauguaaaugagaucuaggcagguucaauguaaauuaaugaauaaauaggcaaugcagccauucauccaaccuugaaugccuccauuagacuauacucuuugccauucaguaguuauggcaucuucugacuugcucagggucacucauggacacugcacuugaaauucucucauggucuccagaacacacauccuaccugcucauuagcauauuaauacuucacauacccagagacguuuuuuacuuguuugaucuugcuaauggaguggacaacaggcaggaaggacuggaaguucaaagguuggacacugcauggggugucggguaggucuaugugguguacagauauacaugcagguaaaauacaaaaaccaaaaacaccccaaccauaaaauauuuuugaaaaaaaaaaccucuguuguuaggaaggaucuguuauauaaaaaauaaaccaugaaaaacaguuuagacaaaucugugaacuuaguacuuccugguaucaauuuuucuuuuuuuauuaauuuugugggugagaggguaucaguguguucugcagagcagcaguuuuagagauguacagacauauuuaguuaguaugcucuuaacugaacuuuucuuuaaaauauuucagcaucauaaaaaagugugguagaaugauauucuggcaaggcuucuaaaucuggacuauaauuacaguaaaagacuaaagugcuuuucuuccccccaaggcuaucuuggaaguaagaaaagugauauauaauauaaaguacauuguccugacagcuuuaugauccgugcaggauuaaguagaagcaccugcagugagaaagaaaaaaaaguccuagaaccauucuaaauucuugaugugagaaaacaaaauccugguucaucagaggcuaugccagaaaccucugaaggaacaaauuccugaagaucagggucuuggugaguaugggugaccgaccgugugcagauugcaaauggagaucagggaauccaugaucucuauccauuuggacaauaggcuucauacuaaguuugggggcauguucaaaaucugggggacauugcgagaaacaaaucagagaaugucucugcccuccugguacgcacauccuauagaccaaaaaagacuacgaacugaagaaaugguggucuacuggcacaguccaaggugaugagcacaaaaggggaacugaacucaggaacacuaucuaggacaggcagggaugacuaagggaugagcauuuggacuguccaaagcugugcuauggccugcgugagaggcauuucccaaacacucguguauggaacccuugguuccuaggugguagcacuguuucaggaggccgagaagccuuaagauuccaccucacaccagucagaauggcuaggauaaaaaauucaggugacagcagaugcugucuaggauguggagaaagaggaacacuccuccauugcuggugggauugcaagcuuguacaaccacucuggaaaucagucuggugguuccucagaaaacuggacauaguacuaccagaagauccagcaauaccucuccugggcauauacccagaagauauuccaaccaguaagaagaacacaugcuccacuauguucauagcagccuuguuuauaauagccagaagcuggaaagaacccagaugucccucaacagaggaauggauacagaaaaugugguacauuuacauaauggaguacuacucagcuauuaaaaacaauaaauuuaugaaauuguuaggcaaauggauguauccggaggauaucauccugaguaagguaacacaaucauaaaagaagucacuugauaugcacucaaugauaaguggauauuagcccagaaaccuagaauauccaagauacaauuuccaaaaacacaagaaaaucaagaaggaagaccaacgcauggauacuuuauuccucccuagaauagggaacaaaauacccauggaaggaguuguacagacaaaguuuggagcuaagaugaaaggauggaccaucuagagacugccccaccuggggguccaucccauaaucagccaccaaacccagacacuauugcauaugccagcaagauuuugcugaaaggacccugguauagcugucucuuaugauacuaugccagugccuggcaaauacagaaguggaugcucacagucaccuauaggauggaucacaggguucccaauggaggagcuagagaaaguacccaaggagcugaagggaucugcaacccuauagguggaacaauaugaacuaaccaguacccccagagcucguaucucuagcugcauauguaucagaagauggccuagccagccaucauugggaagagagaccccuuggucuugcaaacuuuauaugccccaguacaggggaaagccagggccaagaagugggagaggguggguaggggagcagggugggggaggguauaggggacuuucaggauggcauuugaaauguaagugaagaaaauaucuaauaaaaaaaaaaagaagugggucuuucacgggaagcuuuagguuauagccuguccugguguuugcucccagccgugagaaaaguauugaaugaaggcagcuggagaagacaccaugaacacaagcaucugagggacacugugcccagucuucucuucugcuuucuuuuaacaagcauaaaacugcaggugaucugugagcuaaaugcuuauccagcuuucuaggacugucuuaaagugagaaacuaaucaagccucucucucucucucucucucucucucucucucacacacacacacacacacacacacacacacacacacgaccucggaaaggagaaggagaaagggaagcuuccugcuuguaugaaagccacauugguuucauacgugacguagccauaggaaccugcaacccuucuucuaagaaagggcagaaccccugggaugcugguugcaccuaugcucucaggagagccuuuccggaaagaccagacaugucuuguugucucaucccggaaaaaauagcaagaaaggaagcuacaccagggauccucacauaccccacuucuuuuuguuucugaggguuugaagugaguaagggagucuuuucaauuggauauaaacuagaggugauauaaauuuaagccuaucacuacugcaucaugaaaggacucgguagccagaaaacugaggaaugcguguuuagauaggaaaagggcuuuuccacuguggguaauuuuuuuuuuccuuuaccagcaaggccaguuucuugccuugauaagaauuuucucaagaaguaucuggaaaacucagagucagcacacaggacaccaguguuccuuacacagugcagcaaggguagauggagagucacauguagugcgcucaguguggccacaucuuguguuuuaggugaagucccugacaacagcugcuucugugagugcuuuguucuaucaggaagacagaugacacuaaguacacaguaagucaccucauuagauguggcuucaguuacucuccuucgggucggccucggacuuaaaauauuuugugaaaaguuucugagagaaacaauucaugcauuuugacuagcuuuuauugccacaaccugauauaauggcccuguuuuacuacuaguuauuguucacccuauuuauuaucaguuuacuauauaaaucaaacauuuuuguuucuauauauaaauaauaaauauaaacauauaaaaacaauauauaaaacaauacauauauaaaguauauaagcaauauauaacaauuuauaaauauauuugcauauauauagagagagagacaagaucuggagaaggcagacuuaagaacagaaucaaaauauaauaaagugggaagcaauauaugaguacgaagcuacaggaaagagcacaugggaaaggggacaacagagggccaagagcucuguaggcugcagaacacgagugaguguucacagaaaacagaaggcaggccauggcuguacuaugaaagaguuuguuuucaccggcugaagacucaucuggauccuuaugcacaggaacccagcguguaauaaacaaacuuuaagucaaaggauggaagagcggucacacaucgacauucgugcgcuggaagcggcaugggggucagacaggugacagagugacaggggcuguguggagaagguucaggagaagcacagccaaggaggcugagaaaccaugagggguuucagagaauaacagaacugguggccgucuggauggggcgggguuagugggaagaugaaucuugugcuucaagauggagaaaggguagggaugguuacuaauggcaacgggauacagcaggaaggcccaguggcaaggagcagacguuaauggauccggcuuugaucaugauggauuugacaugcugacagauacuauuggaaaaggaucaucaacagacagcuagaaaugaagggccagaaauuugggccacgaauacagucuguuugaauuggccuucuuaugacucuuaaauacacagcauugaaaaaaaaaugaagagguacaauuccugaaagaccacugauaguggagcagauggccccucacuuugugcauggcuaacauggaccauuuacauuaucaccuggaguagaaacagagacuggccuucugaagucuaauuguacagcucuuguuucugucccugaucaacccaggaacguauuucacgacugcugucaauucagagaucuaugagaaagauuuugagaugccuuauagguuuuauucaacaguaaauaucccauuuuauuaauugggaacaauguuuuaaacagcauuaugugugaggagacaucccaaggccccccagagggcuccuggaacuguagagagcacugaacuccauacauauuauagauuuuaucccuugcgcacaucuaugucucauaaaauuuacuuuuauaaaccagacauaguaagaaacuaauaacuacaaaaagcaauuagaacaaugucccauaauagacauuguaugaaucuggucucuuuuccacaguauguuauugaacaguaccuuaugugacgguguaagaugauauuuuauggcuucucuugacaauaaacaaacaaauauaaaagcugucagcaucaucuuugcccuuuacaaccauuauuaaacaaaugcuuuuaaaaauccauaagcauuauaauaccacaacuuucgguugcagaacugagacaacuauuaacaggcaagacccauacacaguguggaucuguugggaaaggguggcucauguccugagcagaagggagcagauggcgccaaaugucaccaugcuacucaaagcagcacgcaacugaaaaguuuacgaaucuuauuuuuagauacuuccaacuaauauuuuuagaucguggaagccaaaaccacagacaauggacacaagaagauggauaacguuagccgguggauaacgugcgcuagaacuugagucagauaugagguucccaaagggacaaggagaguaaguugccccuccucauggugcgcauuccacuggaggagaaaaagacaaggagcaaauaaaaugcugaagcgcggggucagugucaggacacacagacgggaugccaagacugaaauagugaagccuggaucuucugaaaagggugacuccuuucauuucugugaaacaaggagcugauauccaagacaaaaacaaaacaaaacaaaacaaaacaaaacaaaacaaaacaaaacaaaacaaaacaccaaacuggccaugagccugucaggggaagaggacuacaggcagggagacuugucuguuccugugggaggggaguggggcuaggucauauguagggagaagaagggagagggaacagagaucagcugagggcaggggcgaucucuaggaagugccagagaccuacgaugggagaagccucagagggucuaagggggcaacucuagcugugaauggauucugauauugcuacuuccuguaacuaggcaacuauccccaguggagggauaggggcagcaacucacccacaaagccuuugacccaaaauauguccugccuacaggaugugcagggacaaagguaacagagacugcgggaauagguaaccaaacugccucaacuugagucccaucccaggggcaagaaccaaucccugacauuacuaacuaacugacauuaugcuugcagacaggagccuagcauaacuuucucuaacaggcuccacccagcagccaaugggaagagaugcagaaacucacauccaaacaugagauggagcuugaggagucuuauggaagaguugggagaaauguugggagagccacagaggacagagacuccacaggaagaccaacagucaacuaaccuggauccuugagagcucccagagauugaccaacuaaagcaugagcacaggcuggaccuagcccccuucucucccccauacauauguagcagaugagcagcuugguauucaugugggaccccuaaacaacuggggcagaggcuguuccugagccuguugucugcuugccugccuauagauccugcaucccuaaauggacagccuuaccuggccucagugggaaaggcugugccuaguccugcagagacuugauauguguggggaagugggggguuggggaggaaauagagggcugacacccagaagguguuucccucucaagggaaggauuucccuccucaaaucccagcauauguauguaauguuuacauacauauauauguauggcugggaauggugcuccacauuuauaaucucagaguggggagguuaggaucaaaugaucucuggggcucacagacuggccagcucagcuuauucgaugagcucuacgccagugguagccugucucuaaaaacaagguugacagcacuugaggaacaauagccaaauuuguucucugguuuccacauacauaugcacacauacauucaccugcauauauacaacaggaacacacacacacagaaucauagauuacaugagggcuuggcacaaaaacaaucucuguaacuguauccacuuacauugcuucaagcaagacuucccugcauucacccugcauauuggcucuuuaguauguugggaacucaccaaagcauguuggggaguucuacaucaggguuauguauucacguguuccacacuguagcugcucuauagaggcuauaagcuuucaaucuguauguugaagaaguaugaaugcauaggagaaaguuaaugauaagacuuuaggaggguacuaauuuugguugucuuuuaagguacuuuagacuaagauuguauuuggacaggauaaacagauuaggugaagcaaaccuggcagaauuugcagaaguaacagugcagagcccugggcucuaauacuucaaggaguguuucuaaagauagaacagauaucacggaacccaacuggggcugggggccagcagccaauaacaacacccguaugcacuggaauucauuuaucuguaaaauaacgaggucuuccaggcuacagaaguaagucuugaacuauuugccuuaacuaauauuuacaaucaaagacaaaaagagagagcagguaguuauaauccaauaaacaaaagacccaaucaaugccuugacugaagagcacacaagaagagcaggcugguaauaguaggauagguaagucagauauggagaggaaauaaaggauuccaaggaccuucuaagcuuuccguggucugcuaugguugcucgaacuccugugcccacagaugccugggccugugugugcauguacugguaccugacgguuaaaauccagggaauccaaggaaaagccugucacuuguguugaugacagagaaaaaaaacaaaaacaaaaaacaaaaaaaaaaaaaaaaccaacaacaacaaaaauccccauucaauguaggggguuaaaucagagacuauggaugucauaaauguguaucuaaaauggcuauauggucaauucccaauuugcauggguagaaacaauacugucaagcugaagggacuuagaaggccucccgguuucagaugcucuauguccugcauugcuaagggagugucagcaugaguauugcaugaguauugcaugaguaguggaugggucuggagccuugugggauaggugccuggcaaugcugugucaauggacuuaggaccugcauacuccucaauuaaaugaggugccgcugucccaggaauacccuggacacacauuuucauaaagccaaagucuuucauuacuacaucugauacuuguacaacucagcuccagcucuaacaacacuggcuauaaaauucugcugaaggccgauuaacaugacaaucaacgguucuacaaugggaagccgaugaacagcauauuccagggggcagaagauuaaaaacuuaaucugcucuuacuugcaauucuucucuauuucggaaauauauaacugagauauaaaauggaagguuuucagauguggaaauugaaaguuuaaacagucauuaaguuucuauuuaaaaauauccaagagaaccaaagucaaccacaacuaauuuaaugggcaauuuccagucauagggaaucuuauauuuugguccuuuuuuugcaucuuuaaaauaauucuuggauauuuaagagauaaaacaggcauauaaaaaaggaguaucaucacucgcuugcuaccaacagcugcuuuaagauguucucagccucaucuaagacaagaggucugagaugugcucaucucucaguaucaguuacaacagugacaaagccuuaagagucgacugagagaagaacacaguauacuggucaugauuauugagcagauguaggacacugggcuccacaccccgaagagugcuuuuauaauuuggcagaacgagacaggguuggggugggguggucuacagaucagcuccauagggguuuaccucccuucgggauccagucuacacguuauaaauguguccguacauuagucaguagaccaaaaagcacugugauacaaguuaucuaacauuaccccugucagaggaaagaggcgcaaacagauaugcuaggguuaaagcauguuuuaaaaaaauguauauuuuaaauuauucuuugagauuuucauccauguuuauaaugucuugaugaaauucagaccaucuuaccucucugcccccucuuaugucucuuccuuccaaagcuaccucacaacuucaugugcuugcuauuuauuaacauauuaaccaggcagucuagcuggugcggugcugcugguaugugccuaagcauagggccagccacuggugcaugggcagccuacccuggccugcaccccugaagaaaacugacacacccucucagugaaguuuuccauugucaauagcuguucaacuaggaguggggcuuccugaguccuuccagucccuacauuagaguucugacuggcuugaucuuacacaggucuucugcauguagucacagcugcuauggguucacaugggcagcgaagccuaugauguccaaaggaacccuuucuugaaguagugcucugcaaccuuuggcucuuauacguucugugaugaucccugagccaugggagcauggcacagaugucauuuauggcugaacacuacggucucuucuucucugcgauucgccccgugugagucucucugucuaagggucaucgauugcaaagccagacgaucuuauuugcuaacagggcuccccuuuccucaucuacuuggacacacucauguccuggcuucaacaaaauugggcaugcccaccaucucuaguuucacaauuaauuucaccgguucccuuaaaauguuaguucauaaauaugggaagugagaggaugugguuucacacuugccuaaagacugacuuccuucuaccgaacuacaugcuuucacauuuugcugaguuucuuacagaaagcgauuggcaccgcuucaugccguguaguucuaguaagagaaauaucuuuugccauaacaacuuaauacguaaauuaaagauuuuaaaugucaugacuuugacaugagacggugauaaauuccauacaaacaagggauuuuacucuagagaugacauuaucuugaucccagcuucaucaggaaauuagcucuugugggugcgagucacuguauccagucaaaacaacaagaaucuauaucuucuucucuugucuuacucucugaccguggaccacgguccugaaaucaccaucacugaauaacccagcccuuaaaauaacacuuccaagaguguggguuaugucaucagaugacuuucuauuagugggcaccuugugcucaaugcaguaccaacuguaccucagauaccagcagccaaguccuauacaggaaaaacgcucuucucucugccaucuccugcucagaaaccgaaacaaaccccacuggcuuggccucacaucgucuggaauccggugaagacuauuaacgugauuuguuuuuuuuuuucugaauguauaugcgauccaaguuuauuaacuuuagagacagcauuucuaauaaggccuugguaguggcggccaguguccucaagggcaaguacaagucucugcaauucuccucgucaucauugucaaguuaguuccuuuauucagaccagaggcagacagcccagcccagcucuggaagcugccaagccagcacugugacagucacaucgcaaagccaugcgcugcuucaucgguuccauucagacucgacucauccacugacaaagacuccagaccuucguucaucauuugugugauucacuugguguccgucuaacauccgugguguuuucuucucccgucagccuugaguagccuuuucuuaaagcccaaggcagaaacugaacaagacuauucuaagaacuuggacuccacagauauaaaggagaagauagauggucaaauaaaacuuacucuauaaagucauguggcuauuaaugucugagaggaucuugggguacagaggccauaaugacagugauuuuucagucacuauaccuagcagagugcugcuuuacaaacaaguccuuaaugugaacuuccuauccugccuacaaggggugauuaaggaagaguucauggaagucugugcucugcauugaccaccuguguaacaucucacagugggauaaaaacagacgaugaaccauaauaaacagaacucaaggaguaaacaguaagacuuugaaugcaaaguacaugaugguaauacuuuaggauuaaaguuuuuguuuuagcuauaaguaaaucuauauggaccaaaacuuacaaucagaucaaaccauaauaauuugccccucaucugacagcuuuaaaaaaauucaaauggaaugcaauggucauuaagauucucucaugcuuuuuuuuuucucccucucucaugcuuuuaaaauucacugaauaucuuaagcuacaacacccccucccaaaguauaaugguaguuuacaguagcaaaacugagaucauagauucauaaaauaauuugguacaaaugagaagucucaauaaaaguucccugcacuuaagcacauuuugaugacagaauuuuaaggcugcagcugaggcuaggaagguuuauuuagauggauggacggaagggagggagggagggaaggagggaaggaaggaaggagggagggagggagggagggagggagggagggagggagggagggagggagggaaggaggaacagagggagaaugggaaggagcagggagagaauaggaaggagagaggaagaagagaggaggaagggagggaagaaggaagggagagagagaacgaaggagagagagagggagggauaaaaaaauccccaaacuguacuuuagaggaagacucucaagguggguagaugguugcuucuuuguccaugcagaauuagaggcagagccuugaauggagaguagguucccuaaaaguuaaaugguaaacaaaccuucaaauagagguuuuccccccccuguuuuguuuuguuuuguuuuguuuuguuuuguuuuguuggauggagucuuauuaugcagucuuggcuggccuagaacaagcucuguggcccagguaaccuugaacucccagaaaacuccuguguuugucucccaagcgcugggucuauagguaugaacccugacacuuggggaaaaaaaacugguuuuaauuuagauugauauauauuuuucuauguguacaauguuuugccugcauguaugugugcacagcguaugcauguagugcccauggaagcuaaaugaggauggcagaggcccuggaacuagaguuacagaugccugugcccugccaugcggaugcucggaaccaaacccaaguccucugcaagagcaacauguacucuuggccuuggagcaucuuucuugccuccaaauugggggcccuuaaccccagcacacuccacaaugucauagggauguccuauacacugugggauguuuggcagugucaucaucccuagcccccuugaugacaaugacauuucucucacacuacccacacugugacaacucaaacugccggcagacauuuccagaugccccuugagugaaaaucguucaccauugggaaauacugcucuucacugaaguuuguuucucaaaucacagaaugcuugccaacagcugguagucccaugcauauaacuuguauuuacugggauuuuaccuacagguuuuguuuguuuguuugauuuuuuuuuaagcacuccaaguugacagaaacaaaaggaacuuacugauuccaaaggaagaaguuugucuaagaauggacuucaggagccagugugguugcacagccccaauaauccuggcuaauccggaagcugaugcaaguguacagaaagccgaaggcucccuguacugcagagggagagucugucgccagcggaaauuaaaaacaaauaguaauaaaagggcaaaugcugaacgucggugguaaagcacccccacccuagcuuuagguacaaugguugguccugccaaacacacaaaccaaaccaaacacaaacacaaacugacuuuuacccuagggucuaagaaaaguaaucuugucuuuauuucuaacuuuaucacacuuuuuugaaugagguauucauguaggcuccacauuaaaggucauuaagaaaggauuaauuuuccuuuggucucaguacauuuuucaauacaauuucuagcuucagggauuucugaugcaauuucauguaaucauugccuaccaagaaugauguuccucugcuguuuguuuggguuuuccuuuuucuuuauaccaaucacuuuguguauaugugcugaccuuuggugacaaugacugcgccucuguacggauuugaugucagggccacuccaauucuacucaaauauuuguugagcaccuaauguuuacacaauuaugccagguguuuccacuugccaagugacaaacucucaggaacugaugggcuguuaacucuuggaaucccagcacuugcuaccuuucugagcaguguaaguaacucuaagaaggaauaguauuucugaacuuuaacucuuucuuggagaaaaauaauaauaauuaagcaaaacucauuuuauuguacaguuaucauacaaguccaccguaacguaucguacauccaggacacaugcaggguccugaccucaguuuuccuagguuacgacauuuucuuauuuugacaucccaagaaguaugucaccgucauucgcuaacuauuccaaauaaaccccagaaaccuaaaaauggagcagugaugggccugccgagaaggaugggacaguacgagaucaccacuuucauuggugugcucccaaaauaaggaagggaguaccagagaauaaucauuccagaaagagcagguuuagagguaaaggagguggagccagugagauggaaaggguaauggagggaguuggggggugggggguaaccaggaauccaggcuagaagaauaagggacaggagauauuuagguagcaaaggagacuugcacaugaguguccaccaaaugccagguaccuugcucuagacauccacagagguuagcuaugaaagggucauagauacagcaaggaagaaaggugaugcuagggaccaaggcaguugguuuggauugauggcuugguagacgaugaucuguccucaaauggggacaguaaucaggagcauccagaaacauuaagguuucagcugcuguuacgacguggaaucaaccggcucaguuacacaacucgauagcucaggaaauucggaagugguuacaggaagaaguuaaguuuuccccggcauugagaacugaccaaaauauauuugggaaaugugaacaucucugcaagucuaggaugugugggguauaugugagugguucagucuguccggauugaucaugggcaaaagaaaggaaaggucgacggguugcaugcugcugcugugaugaugagucugaaaggcagcaagacccggugagugguucagauguaaugguugggaauacuaagcgugcaccgucuccaagggaugagggaguuggaacaugagacagaauacaaaggaagauaauuaggagaggagccagcuugcauuucaaguugaugaugaugacagggugaccauauuacccacgcaggggguggcuggggucugaguguucucucugguuuagauaacauacuauaccccuucucuaggagguagcauagcacauucaaacacagcacauucaaaggaggaaaacaaaugucuccuagcuugggaguuguaacagugagaacuaaaagaagucauagacucagagauggguaucaagaagguacaauuacccagugacguggugaauagacuagagaccugggucagaaugcaaagccaucugccgggaucaguuuccagcagcaggagaaagggccacugauaccguggcaauggugucaguaucucagaaaaaaguguaggaugaaaagaucaaaaccugaggaaaacuggacccaucuuaaaaagaagguuuuacgaggcauagaacaugucuuacauguggaagaagcuuggcagaggcugguggcuuucaagaaaauaaaaauaaucauuuuaaaauuuaaaaagucccugcuggggcugggagguagggguuugauuaaaugcuugacagccugaguuugagccuuggugucuaaguauaaaaaaaauuagguggaggauaguugagaaaaacacucaguguugaacucuaaacucuacacacacacacacacacauacacauguucccugugacaucagcacaagguugaugguuaacaagaugguuacaaauacauaucuagugccuuagaguuuuaacaccagccauggaaguuuccaaguuuaaauaccauucugcauacuuucucaauccauagucagguuacucacuggaaauuagcaaaucaaauauccaguagcuuaugaaaacagacaacguccaggcuaaguaacuagauuuuccuuuaggaaugcugguuguacugguucugugaucagacgccuaaggaugggauuuguuuccgaagccucugaaacguucaaaucuagauguggccaaggaggguaggagugggcuuaauaagggagaacuaggccaccucguuucuaaaaagagagagagauaauuaaguuuaacccauuccugucccacaugugguacauagaacagaaguauaggggguggguugucaagccauuauggggaaccccuaacucauuagaugacagaaaucucagaagcaaauucugcuucccggagacuucuugccugggaaacacgagacuuaugcauagguggugaacuuuuacaucaccgagaaguaucugaaaaucuuuuuuucaguuuccuuggcucuaugucaagcuagaucaaauguaauuauuuugagaggugggggagcaagacaauuaccuggauguaguaaguagugcaagccuuuaauuccaacacccagaaggcaguggcagcuagagcucuuaguucugggccagccuauucuacauagcuaguccuggccagccagggcuacaugcagccucuauccuguauguauccucucuauguagccucuauccugacucaaauagauagauggaugaaaguaaaugguaaagaggggauauaaaagacuguaacacacgcgcgcgcacacacacacacacacacguccugauaaacucaggcagcuaguacuaaaaugaagccucaucuuacugauaguaaguuuugugauuuuugguugguguuccguuugagcuagaaaacccugaggaacagcugagaggaccuuggcaggaaagcccgagccuuacauuucagggauaggauagccuggauucaucaacaaaccgggucauaggucuaacucaaaaauucuggcuucauagacuuaugauuugaauauggauauuugugcacaagugaaaagagucagaaaauuaacgaagggguuaagaucccaaggaaaaugaggcaaaaaaaaaaugucaaccagcaaucacgcaacuggagauaguuaaagaacuuccgcaaacauuuauuaguguugcucacuacacaaaggaaaaagaugguugaggggaggggucuacccacccauccaaaaccaaaccaaaagcaaagaagaaggaaauccuuaagaguaaauauacaaacacaaaccaugucuuccuuaaccaaaaauuuguauugaguucacgaaagaguguuuaaaaguauuuuuaaguacgguauugaauagauagggagagaggccagucacuaaacccagacacuauuguggauaucaagaagugcuugcuaacaggagucugauggggcugucucgugacaggcucugccagugccugacaaauacagagguggaugcucucagccaaccauuggacugagcacaagguccccaaugaaggagcuagagaaaggacccaaagagcugaagggguuugcagccccauaggaggaacaacaauaugaacuaaccaauacccccagagcuuccagggacuaaaccaccaaccaaagagcacacauggagggacccauggcuccagcugccuauguagcagacuauggccuuguuggacaucaaugggcagagaggcccuugguccugugaaggcucuaugccccaguguagaggaaugacaggacagggaagugggaguggguggguuggugagcagggggaggguggaagggauaggggguuuucggaggggaaaccaggaaaggagauaacauuugaaauguaaauaaagaaauuaucuaauaaaaaaauauuuccaaauggcaggacaaaauggcaugccagagugcugagcucaaaucuacuagcuuccugguagaccuacugaggagcagcucugaguggagucugaucaguauuccugacauucaaacgugguccaaugacuucaugaagguuuaucaguaacacuaacaguaaguggcauacaagaaucagagcagcccuucaggguuagauuuuucugguauuaucaaauauaacuggagugagaggucucuuuccacugugagacagagagacacacucagagaauacaaaaacuguaagagacgagauggcucagccaaucugagacccaucucaaaagccgccuuacccgccaucagcguagucuguguccgcuccaccccaccagacaucagagucauccuccucugcauccgcagaauccacgcugucgcuuuccucggccaacgggcagcauacaaacucuaccccucggaacuugucgaugccgcagggcagcagcaugccauagucgugcaaguuagugcucuucucgcugcaugucuacaaaaggaaggaggagucagugugggcacagaggcaagcggaccgcagccgcagccaggacaauggaaccgcagcaaggacagucggacuacagccacagcccagacaaucgaacacagccacagcccggacaaucgaacacagccacagcccggacaaucgaaccacagcuagaagagucggacagcagccaugguccacacaaucgaacacagccacagcccgggcaaucgaacacgccacaguuggaacaauagaacacagccacagaccagacaaucgaacacugccacagcuggaacaaucaaacgcagucacugcgcagauaaucgaacacaaccacagcuggaacaauugaaccgccgucacagccaggaaaaucagcauggacagauagauuuggagccuacuccagaagguaagggcggcuugcugucugaacucguuucuaacccgguguucagcaagggcugccugguauucuaucuuuauauuguuuucuugguaggugggguugagagauggccuaagugguuaaaggcauuuguuguucuuguagcagaccccugacccaugguuuagaaccguacccaccgccagguccauggaucuaauacccaauuuugacucuggccuaugggcaccagccacagaccugugcauauacauauaugcaggcaauauauacaauauauacauaaaaugaaauaaauauaccuaaaaacauuuuuuaauguauuauguuuacaaaguaaacaugaaaagaaagcagguuccagaaagcuaaacacggggacaaauaucaggaaaugauuuacguuuugggcugugauggcuuuucaggaauugaaggcuccgucuacauuugccuauccccucuuuucucuaccccagauauagaauuuuuuuuuauaggcaguuaguugcaucuuauucuggaaauggugucucuuggcucauaucucagagucccagucccaggaaggaagaaacugcccuccacagcccugauuucucuuucaguaucuuuuugauugccugggaucuguuaauuuugcagaaaucggcacgaagagaaaaacugagaaacuauuuccccgugacagagaaaaaaaauuaauaauucaacaugccuagggaaacaguaaaaguauuauagaugcauuuuaaccccacaggaaucaccaguuuguuguuucguaguagcaagggagucuuccuuugcaaacucagaggaagcgcaaagugagguuaucauuugggaagcugggcuucaaaggauguagucuacuguaagcucaggcagcuauuccacuuccaaaaucauuuuuagauaaagaaaguuuuguuuuuacagugaaucagagcacacucuuucaugaaauauaaaagucaaguuaaacccuuuuucucccuuuaauucgucaaccaacguauuugauauuuuggacuaaauuaauuugcugaggagccaggccuagugcaucuagucuauaauucuggcuacuuggaaggcuguggcaaguucauggccugauugaauuauagugcaauaucaagaccaaagugagccccuuagcaagacucuacuuuggaucucagaagcacuuuagaaacaaggccuuggauauagcucagagggcuauuauagcucagccuccaugggauuaauguggaaaagaaacgucgccagguggagucuacccuguuccugggaggguuuuuagcuguuggucuuugacuguuaccugccagugguagugccucuacaggucagacaagcaaaaauguuccuaggaaggaacagggguacaaaacugacgcugguagugaacuccugagcuagauaaaggacccuaauucuagaacacuggcucccccaucuugacauaacuacuuaggagaaaagcauuauaauuauauggaggguacagugcgguucuaagggugacgauucacuacauucuauuguccuuaauauuccacugacuuagcccaaagcagaggcuagcaaagggcugcgcgugcuaccccagaugcgcucaccguggaaaggaagguggcaggagaggguaugacuuuaacgacuguggccucagguggccuugaacauguggcuuccuuguucuaccagcucauucaccaguagcuaguuaaauuaugcaaaccacaugggacaagagcgaugguagaaaauaaauagagaaagaugcucaauguaagguuacauaugccuauuaaacaugacagcuuuauguucaucuguaagauguagcccagagauguaucuaaugagagcuauugcugaccaugagggcuguucauggauagagaagcacaaacguguacagacaugguucaggguagcucauuagacuuucuguucaguggugaccuugccaaaaaaauaaaauuacuuuaaaaaguaaauucaguuuuaaaaugcuugaacauugcuuccauaaagaacuuucugccaccgggcaugguagcacucgccuuuaaucccagcacucaggaggcagaggcagguggauuucugaguucgaggccagccuggucuacagagugaguaccaggacagccagggcuauacagagaagcccugucucgaaaaacaaaaacaaaaacaaaaaaccaccaagaacuuacugccuucaacaacccucuaaaaacaucuuuguauuccccccucccccaaggagaucgcucugcaggaaagcgggcacagauugguaccucuuuggcgacggugugccagugaagaugggucucacaaacauccauccgcuccugguguaggaacuugcacuugucgggcacgagaagggcgucgcucacaaacucaccaacugaaagagaggagaguggaccuguaucauucgcguaugacagcugauuucaccauggacacacacgggcucgacggaggucagagaacuuacccagaacuuucaaugcacgaaaaaccccacaaaggcuacacuaccuuuagcauggugggucagccucuuuaaacaaccgacugccuugcuaccaugaagaccuuauguccauacauucccuaugcaugcauccuugauggcuguauguucccuauauauucccagugccuucuccuugaauuaauuucaguuucugcauccauauagcagcugcacaaguagccacugacauucguugucauuaaggauuacaguacaaaaacagauagcuuuaauuugagcacugucaacaccaaugucuguuucuguauuuuguaaauuuaaacugcuugcaaauuguuagagacugcagcauuuuuaaauguuaagcuccaaucuguacauacacaauguguauuauauauguguuuauauaaaaacacucuggaaagaguaauucauucaaauuauggaaucuuguuuucuuugaacuuacaucucaugagaaaggcuccuaagccugacugguacuccaggguuaggaauguuacauaucacccuuccuguauacacauacauacauguucaugcauguucauacauagucaugaggguaaaagauugacagugaaaaauaacauaagcugugaaauuaguugcucuugguuuuguccauuguggcauuccucugcuucagcacaaagucugcaucuacuagacaaugaaugucuguugaagaaugaagagauuucuuuucauaccagaaugaagcaaguccuaggucaauacagugaaugaaucugaccgggugcacaggggaaugucuucagguagaaauaucacuaaagguuagucuaaguggauggguagaguaggucaugaagauaaguuucacaauguauggacagcaccucauuuaucaucugauuuucccugcuguaaaaauaaaaacucucugacaaauaugaccuaagggagaaagagcugacucugucuuaggauccaagggcacauaggguccaucauggugggaaagaaagacagucucucacacagcugugacauccacuaccaggaagcagagaauguggaauacaacaggcuccucugcuccccuguuccacacaugcagcacaggaucccggcaagggaauggugccacccacagugggccacuuguuccauccuaguuaacauaauaagauaaucaaccacaggcaugcucauaggccaaucucccaggugauucuagauucuguggauuaaugcuggccaucagacuauuccaucccuaccccugacacagcucuggcaagcaugcuuguacuggaggaagggaagggcaaagggcacuucaaaacuucccacuucugcagcugcaucaugcaucuuacuccacacagagccaugaugucaucuccuacaaauccacuucccuagugagaaaccucugcaaagaaaccugccuaaggcaguguggaccacaggagguuguaaccuaguuccagagcuaaacagauaccaucuaugaggaaggaccguucccaggugaacuacucaggcugucugaggaagucagguaaccaauccuggcggccaggaaaugccuauucacugagguauuucaggaaaauaggguauaggaagacaaaagugaccacaacccuuaauauagccacccuccuuaguuaacauggucagccauauuugcaucugugauguuuuccuguuucauaaguaauuauuggacagauuaaaugcuggccuauuauuaaaugcugacuguuaauauugaauccauuuuuagaauaucaaaagaaaacauaagauguucugguccauggccuaaaugaguucuuggggguacaaauagaaaaacuggugccaagaaacaaaaucaaauccaucgguuuucgucuguccagggcucgaugacagugcugagccagucacugagagaugcuuacagucuaacaacuguucauucuauuuuaaaaggauacuggaauuuuuaauuugcaaauuauuuuacuuaacuguaaguugcugguauugccuauagcuaacgaaaaauugcucuagcaaaggauuaacacgagcuacuuuaaaaggccucaggacaaagggcaaaauggaagcucacugugcccuaucauuaaagugaaauuuaccaguggacagccuuucuuaucguccccugaggguugggaaagcauauuagaaugccacucaucaagaagguuagaaggcuaaauuauaaaaaucucucccagagagagagagagagagagagagagagagagagagagagccuggagagauggcucaggaguuaagagggcuacuguuguugaguucagucccuagcauccaguauguccugcuccguugcgacccgacaccucugacaacugugaauaucugcauucgugcacagauuguccuacugagaauuauccacauaauacaauuaaagauggaaauaaauagcaaaaaaauucuuuaagaauugagaggauugaauuuuguuaaaaauuaauuuuuuaacaaagucuaugcuagaacauaguuuaguuuuacgggaaagauggauguuuugauauagacugagaguaauauguaaaucaaaauuuauugauuuuuuuuuuuaaaaagucuaugauagguauaaccugggguuuccauacacaaggaugggugcuuuggguuuggaaauaaaccuguuuauguggacucaugcuucaagagcgagcauuucuuaacagaauucagaugaaggcagccaauguucaaauuaaacagagaaucggaaggagaagcugugcucaccgcgucuacauauugugggaaauaaggcaacguuuacucuaaacagaaaaauucuccaauacacacugggcauguuuuuugguagccaugcaaacuguuuuuaugugaaagaaaaaaagaauuucauauuuaaagcacauaugcaaauuucagaggagagaggguuuuuaaaguagauaaaaugcacacuuggcugaugucuuggcaagaaaacaaagauguggaaaucaacagggccccugcaggcgugcagugcuggcucuggugucggggagaacagaccucuaaccugaauuaccucauuuuguagaugggcaggaagaagugcaggucagugguucgcucacagggccagcaggcagcagagcugagcugaaauuucacgugucccugcucucuggccuuccagagauaccuugacucauugaaacucgggucaccaugguuuacauggccaaucucccuuggcuuugauauaagaaaaugauuuauccuaagcccgugaaauauuuuaauguuaugaucugaucagucuggccauuagaaaagaaugagacuaaaauguccagucauccaaaugaacgggccgggaaugcauucugcugcaucaguuagaacccaucgaacagugacuugaacacagugcgacugugugacaccgggcucuguagucacaagauagacuguccaugggaaccuauaaccucacggucacgcucccggcggaauggagcaaggaugggcgguuuccugcucugcaguuucccgguguuaccagggagggagacucucccuccaagugaucccccgccaacgggcugcauuuuuacccacugucuuagcugcucgaauugaguugcaauggaagugagcagaaaguauuugccagugagcuuacuguauaagguucccuuacacaagagaacguuugagaaaaggagagggaaugguggcuaugaaaccugugaaagguagauucugcaguaccgugcauucaagggcagggaugcacuucuaauuauuauauugugacuuuacagaaaaaagaucccagcaaugagguaguauuaggaguauaaacauccacuaucagaaacaugaggggacccccaccaguucgccccacaggggaaaauaagaaggaaccagugugagacaauugagaaauuuuuuucucagaacuaggacuguuuuggacagucagaauggguuuuugaauaaaaugauuucaaaggaaaagcugcaagcaagagaaccacguuuauuauagcuauucuguggagcucuguggagccucacagaugaaguggugcguuguacauuugaacaucacguaugcuagauaacagcuccgguagagcucugcagagggaggcagaggcccaggaugagagcagugagccuccaagucucacgaugauggugguucuuaagagaagucuggguaucuucaaacaccucucccaagaaccucaguccaccccuaacacaagucuucauugcaaguuauuuacauuucuccuagggcugagaauccaggaaaccgacaagagaugcaauaaaguagcacucuagaggaacaugauaauaagaaagaaacuguuggcuggugagaaauaugauggagaaaaaguggaggaacuggaguagggacuaaucugagagacaagguggagaacuuuacugggucgugagagcgaauagguugagaaugcgcuggagaaagcgagaaaagggaagagaaaaacauccuacguugacagaagacauuccagccacagagcaacaggguacagaagucccuagcaaacgcaugccuaugaauccagacaaaaacaggagggggugaauucucagagaagagcaauuugcaugagcucaugggugggugagggcaggcuacacaguguucagcuacaaaucuggucagcacuuuugaggaacacagggagaugggcauguucgccugucauuagcaucauagcugacuaggcuggugcuguugaccuuauccacgggaaaagugacaccaccucagacuaggaugaagaguuuagaauggaagucaaacugaaaagauccgggaggaaagaaacaaagccugccuacuccugccucacaaacuagaagccacuucacaccggauggagaugcccaggaucagaugugucucacauguccccauaaauucgcaaacguacaaauacccacucuagauuuaugugcgcuuuaguucacacugcauauguacauaccaaagugauagcuacagaccgaagaaauguuuacucauauuuacuuggaaaauuuauuuaaauauauauauauauuuuguuucagcacguuagauggacugacgcccuauaaguggcgcacgcugacaaccagcuggcaaacggcuccgggaggcauuuguguggaaagaauguuuucagaaguguauuucaccaaaaugccucucaacuggcucggcaugaggcagaguuuugcuucauggugagggucaccucuggguucucaggaacacaugaguaaaugacucgguucuguaaaguggcugugcugucaccccgagugucaccguaacuauuacaauaacagcuggcagcuggguuucuucagagaacaauuuggcagauggcagaagcugagugaauguuucaagcaagcugcaagccaagaagugagcacuaaaaguuuccuuuaagucuuucagacucauucaggugaggagaguucugccucacauacauaccacacgcagaugugcucacguucgugaacacacuaaccgugagauggguguucaagagaaacagacuaccuguaccucucuguuaacaauaauuguuuugaaauaauaaugauauuuuuucaaaguauagugaucaacaauggcuaacaauuuuaggauuuuuuaaagagcuuucacaauuuaaaguacuguaauugugauguugucaucagagcauucugaauuaaaugguggaggcaaaggaagguggguggaaggcagaugcucacaguggggugagaguuuacagacaagcacgggaaguagaacaguccagugggugauagagggaucaacagggugagcuccuagggaugcuaauugagacacagagagcuacagaaauaucuacaggaauccauacuauaagaucgaggaguagcaaggggacuuccucgguccaucagcaacaaagcagacacuucagcagcaaugagcacacaaagccuagauauuggaucuuucuauuauucuccaacaaaaggaaacaggacucuggagaaaugauugauucuuagauuuguggagaagauaaaggacaacccuacagcaucuuguuggaaucacaaaguuuuuauagggguuauauaaagugagcaugugugcuugugugugcacacauacacacacacacacacacugugcaggacagaauuaaauaucgacguauaauaggaaaauucauuagucuaagugaugaaacacugggaaaaaaaaagauaaucuccuauucagaagaauucuaaauacuuuacacauauaaacucuaaccuaggaaaaguggggcgugauucuccaucccagucgugggcuccguguaaugacuuucuuuaaaaaugaaagugugugugugaguauauguguuauauuucacauacaguguacauauuauguuugugugccuaaauugguccaccuuuagcuauugggaguugucuccuguacucaucgggcauaccccccugcacagacuuuaugauucugacaagaugcuguagggucuucuuguuuaucuacugcccgguucuuaaaauuggccacuucuccagcaauuuuaccacauuuuuguuuuuucaguaucuugaauacuccccccuccugucucuacuuccagaaugcugggcuuacacaugaggccacacugacccucugcaauuccuuucauaguuuggacaagaaacaaguuuuuacaguauaggauuuuccauuuauggcaggauguggcaucuagaaaguccccaauuaugaagcuuuuggaauuucagguuuuaugauaagaaugcucaguuuuucauaguggagacacucuaaaaaaggcuuacuggccagagaaauucaaagaguaaugaaaauaaacaucgaaaucuaacaugaugugaugcaauuuuaaguggcuacucaacaucaguggguaccacuaaaugcuaaccuguccuggagcuguauccguagaagaugggagaaaugaggcauaugcaagcagugugcaccaagagcagucaggcccaacagaaauaaaaaguagcucacauaugugguuucaggcacauucuaaaaagcaguaugcauuuuuccauacucaauauauacuaaauucacucugggaacauauuuuauuuaugcauccuauauuuugucuuuucaacgugaaaccauugcacaaauacuuauuaaagcaugcuguauuuuccuuugcuccacgguuugccuuuauaccugcaaagcugucuggaguagcugucuucaguauuguauggccacuaguggcugguggcuggcagugagcacaagacaccuuccauaggauuuuaaagaucgggaauuucuuuugaggacccaugagcuaaauucggacagguagggguuuugggagaacaugugaagcccaagacagggguuaguagaggaacaggagucuggaucugaaugcaacuguccacugauacugcacgguuuuacuaugugaguauacuguucaucgugugagcguaaacggcauagaugcugagagaugcgccuccaggauucgcuuuguuaccacccuaaucagugcuuaccauaccugccuuucucccuccuccacuuucgacaguucugcuguuauuauauuuuguauuuauaggauaugugacuagcuccgcuauggaaaccgaaggacgucgguucccaccaggccucagccuccuuugguuaaacucauucuuguuuccuaggagcuaaaaaguggacccugcagagacaccguccuauauuacauugucuccugaaacacaaauauccucgcuggccgcuuuccccaaacgcuuuucuuuuucugccucauuaaaaaaauuuuuuucaaagccacauagauuaaaaaaaaaagauguaauuaauuagaguuauaugcggugcuuuaaaaaaaaggaaagagaagaaaaaaaacccacauaauuacuuacaaaacgccaaccaggcugagguacagugaggcacgacaaccaccagucauuagcaaaaccugacaucacagugggaagaaaaaguacacagcccggucuuccaugugccagauccagaaaccccugugugaggcaggcuauaaucaagacaggaagaggcacuuagagaguuucugcccgagcucuaguccguccgucauucucuaaaccuugccggaaucuuuccgauccuuuccacguggcucagcacaugacgaucgacaacaguucguucaaggucaacaccaaaugcuuuggucucaguccccguguucccugaccacuccaucacaccaccgucuucuuguagcuucaguccucuccucccgcuucuccgcaagccagaccgcucuuguucuccgcuuucugugugaagcucacucucagugccgcccccccacccacuuuuuaacaguccugauugcacaaagcucugcccucugcucauuuuccacugucacucaggaauaccacucgggccuaaggauucagucacuuucucuacucuuccaaggcugaccucucuuuuggcauuucuagucaccggcuagacacauagagacgucaugguguccaaccagcuuuucaaaucccauguacgcaaagaaaaauggcccauuucucacugggucaaauaucuuauggggagaaagaagagaaugggaaaaaaaugucacagcacuuaacaagucaacugcaaagaaaugaggccauaccccuugaaacuggcucagcuuuuaacugggcaucagagcacuauggucagcuaucagcacucacucucuuaaagcacucgcucucagcagcacaccuagggaugagcaacacaggagauaauagaauuaaaaaggaagcagauuaaaacaugacccaucaaggucuuuuagaaauuaccuauauccuuuccagccguguuuccacaaacaugaucuuuucaaagggggugagccccuagauaaauucguacccuccuccugucaccaugccaguccagucuucgaaagugccacucagauuuguaaacaaggcuuaguuucauuauugcaaaucaauuuucuggagcuuacugcuccucagagagcugaaauaauugaauuccuggacuuguacggagaaagguuugggcaagaaagaauuauauggaggauucaaaagguagaucucuaacuaugcuuuggcagcaaauuccccuggaggguucugauccacuucucuaaugcagacuuuuaugaugaacuacaccggcugaugcaaauaaaauggaagucagauggggacacucugcuaacagaacauaaaggcagcaguuaagcuuuuacagcugauaagcaauggcuuuaaaguauaaggaagacauagaauguuaauaugugacuaggacuucucucugcccacaagcaccagaaauaucuauagagaauuaaauauauaugcacaauuugagacuuuugguuggcuucaugcucauaaccuaaguaaguauuuucaaggagacaaaagucuagggucacauagcuaaaugagaacaaggcucuuccucaaccuacuaaucuccuaucaccaaacagucgaugguagauguaaauaaauggagauuucugcucccuucgccagauuuucugcuugguugaauuugauaaugaaaacgucuguuccuuucagagggagcacaagugucauucaguuuucacucaccaggcagggaaugaaugcguuugauuggcuguagaaucauuugaauaugcaaaaucauuuaaauaagcauccuuacaagcugaggcacuuccauccauccauggaugcagcaguuuagaguucucucccucaguaaaucgaggcaucaaaugaagguguacucaugcuucaaacaucguuagacuccacccacccucccccuuugcacauggcucagucacgccuuccuuuccaggcuggguacucaaccagaaaacagcgaucagugccaaagcccauuccauuaccccgaagucuuccaggucaacgauccagagucacaugaaaagacuaacuugaguuuaccucuccggggagcagauauuuugaagagcaagcauucugggcaagcagagacuaagcuuuuaaaugcacuuaaaucauuucucaaaaauagaagauacaagcagaguuuuuggagaacuuacaucucucauuuuauauuaaacaaucagaaggaggaccuaugugacuaaggcuugaaauaauuaaaggggauacccccuuucagaugguaugauuucugccuuucuuguugacgaacaugcauucaagcaaaguuaucauucagaucugaguuguuuuaccccaggaaugugguguaggaaaaacacugaggcaaacugacaauacguagcagaaucuucuggaagaagugugagugaggcagcccuuccaacagcauccacuuuagcagacuauaggaguucucuggucuaagcuuaaaguuguaugaagugugcccuugaggucauucaucagaaaggaaaauaaagaaaauaaaggcaaagccacuccuuccucuugaccucaguggaugccacaugacaucugcacgaucagcucgucugggguucuauucaagcuauauggcuaucuccaagccuagacacaguagcccaucucuccgagaaaauagagcugacauucgaaaagccacguagaguacaaaggacaucuuugauaaccagucccaucucaacagaauauucaacuacaacaauaaauaauaggucuuaucuguauuuuccugaauuuuaagcauuugccauuuuuuugauucauuaggcaacucuaguuagcauucccucagcaagcggccucugcauuugcuugcagaugauuuaacuuucgucuuuucagcucuaauuuuaaauuucucucucucucucucucucucucucucucucucucucucucucucucucucucucugugugugugugugugugugugugugugagagagagagagagagagagagagagagagagagagagagagagagagagagaauucaagcaaguauauguagaggucaaaggacaacucucaaaggucauuucucuccaagaugugggcccugaacucagcuuucccauccuaugcacaaacaucucuauccacugagccauauccuuggucccuagcuuuaggacaguccuaaauucuccucauaaaauaacaucauucuaaacuagagaccacaucuauauuuuuaaccaauacuuugcaaccaaucuuauauuuauaccgaaguauuccaaaaugcuuuuuagaagucaaaauuuaagaauguguuaauuacacaguaccacuuuaaaauauauuaaaaaucaggccaugaaugcuugccagguauuggcagcaggacuccuaguucacauggacuuaauuaguucuuaagcaaggaaccaagaguccuggagacuuugauaaaagaaaggaacaggcguaggggguguacaugcacaaacacccucccuucuugcuuucuccagcccuucucaaucucucauaacuaccccuucucucucucucucgugaguauguaccacacacaugcacacacacauauacauucaugcaugugcacagauauaccuaucugcauaguuuucagaaggcugagaauaacuauacuccucucuuaugacaaauuguaaucauugcaaaugguauuuagcaauaaauuaagugauaaaaauagcauacuguuuaagcacgguuuaaucuaaaaaucucaaauuuaucaucuauuaguaguguuucauuuggcagugcuggagcucgaacccaggaccucacucacggcaggcaaaugcucgaccacugcccagcauuucuucauaaggaacuggcaucuaccgguaucuccugaaauguccaagaaagcuaugugccaguacuccagaggucacaccaaaucugagacucuuccuagagaagaaaccuugccuugggcaugauaacucaggacggcuauuagggaaaccacagcauggauggaauuuucuggcaagcaugugaguuauacaaaaugaacgaccagggagaaaggcuguagaaaaacaccaguaguuaggauuucugaagucuacaaaaagagccugugauggaaaacaaugaaggaaugcacagaaggaacagcaaggcaaagacuacaaucaagagaaucugugcucagagcaucagugauuccacagauaaacggagcuggagacauggacuccugaugcugccugacugcaaaagagucgaaggcuaacaggcccuccuaugaccucuaaccaccagaucaggaggcagaacugugaaggacagacagcaaagaugucugcucaagaaaugcaugcgaucagcacacugacacgaagccaagaguucucugaagaacaaagaaagcccgagaagccuacacaguagugauaacggaaaucaaacgggccguggggcaaaggucuucaucaagucaaaagggagacagaagacuaaagaacaucucgaggaaaauauaugcacgcaggccugcaaggccugcucaaggccuagcucgugagcuuaaaguguuugccaugcaagccuggcgacucgauucucaccaagaaaccuagguaauaaacaaaaggggagaacugacuccagaaaguuguucucugaccuccacaguuguaccaugacacaacacacacgcgcacacacacacacacacacacacacacacgcacgcacgcacgcacgcacgcgcgcacacaguaauauuuuuucucuuacaguucaaaaaacauuuauuuguuuauauguauauauauauauaguaucuaucuaucuaucuaucuaucuaucuaucuaucuaugugcguaugucugugucucugucucucugucucugccucucugucucugccucucugucucugucucugucucugucucucucucugucucucucucucucugucucucucucucucucucugugccugaguguguguauguguaccagugaagcacaugcgugcaggaaugcccagaggcccaaagagggugucagacagauaccuuacaucuggaguuacagacagcaguaagcugccaaaaggguacugggaccugaacccagcuccucuggaagaacagcucuuagcuacugagcuauaaucucuccagccccaaacaauagauucuuuuuuucuuuuucaaaaaauacaaggaugcauuugguacccauacauuuuaaacucaacuucgaauucugacuacaaucuuacuauaagagccauggcgguugaugaaaacagcucaaaucacucaacugguaaacuccaagggagcuucuuggaaggcugacuguagucaugcugcuaucagcauaggcugacauaaggacacugaugccugcugucaccuuaggaaguguuuggcaggagaaguuccacucccugucuucugccuuucaagugaugucccuccuucucccugucccucccauucguuuaaaccuucaguucauucuuucaauacauggugacaagcgggaacuaaggggcugugacauguucuaagcucucgggaguuuucagugagcgaacaaaaguccuaaucaccaaagagcuuauauuucacacagaaaccaauuaucuccgaaugcaaaagcauggcgaggaagcauuguuaaucuucugccccaugaaguauuuauuccuaauauagcccugcaauuauucuuuucccuaagcagauucgccaauucacugauguaauacuuuccugacacgaugcucucacaguugacugccauucaaacggggagaugagacauuuucuuuaaugauguagccacugguaagacucccgucaucaagcccugauccauacucgcacaagcaaccccagugaaagggaucuauggggguccacggggacagguuagugcuggugacuuggguaaggaccugcuuuagugauuucuccacuuuaagucuccccaaagcgggaggugauaccaccucuuaagucuccugccuucucuucacaccaacguuaccagcguagccucaugugguaccuuccucaagacaggcagugaagaucacaucuucaacgucucuccaaugagacagguacuaaaagggguaacagaaugcuugagagauggagccuggaggugagaggagguuaugugauugguggccuugcccuccaagagaggugugagaagccccuagcuuccuccucucccauuacuuuuuauugcuggccaugagguaauccauguauuccuaucaccaccuuaccucaccauaggcacaaaacaauugggccaaccaacucugcacgcgcuaaacuaagagccuuguccucggagcuccacagaaagccuaccaacaacacagaugacauagcuguucacacugaugucuguguguuuuaauaaaauaacuuuuugcuguauuuauuuauuuauuuauuuauuuauuuauuuauuuauuuauuuauuuuuauguucuguguuucguuugccaaaaguaguaagagcccacacuuuaaaauuugcuucacuuccuauguuuccucggcacuauaccuuucccaaacucugugagaggacucuaaagccacacaaggggccaagcugggacucuacagcaggucauccaucagugucaucucuuccucaagagccccacuucugggaugcccuccacucuucugcaaucuucccucguugcucuccagacugcugcugcccagcugcugcguugggacuuuccuucucuguuagggaucaaagccaaagcugaagacucacaggaaaagagaacuaggaagagggacagagaaggggccccugggacacaucauuggggauaugaaauucaucaagggguauguaaaaaaacagaauguuuaaucagcuacuuggcaacuaccaugaccuuaaaaaaaaaaagaccugaauuucucuccauuguagagaaaaauaaugagagccuucugcacguaccuauguuuaaaccaaccaaucuuccuuccuuccuuccuuccuuccuuccuuccuuccuuccuuccuuccuuccuuccuuccuuccuuccucccucccucccucccucccucccucccucccucccucccucccucccuccccccucccucccucccucccucccucccucccucccucccucccuccuuccuuccuuccuuccugauucuuuguuugagaaagggucucacuuugcaacccuggcuauccucgacuucauuauguagaccagguuggccuauauuucacagagcucuuccugccacugccuacugaguauugguguuaaaggccugggccaccaugcugggccauagcugauauugauacuaaacugucuuuuaacuugaacuuuagauucacuguuaugucauguuaauucuuauauucuugagguuauuuuuuagauaaugauuuuaaaagccuaucaucuccuacccuggccagcaguauuuuaucagucaaguauaauaucuucauuaauucaauuucaguaaucuugauaaaauucuuaccuuuaaaacaacuaaagugguuuuaaugaguacuuuguagauucauuaucaggaaaaacgguaccuaauuucuaauuuaucauauuaaaacugaaaaaaaauguuaaaucuauaaauucucuggaguccaacauuuagguuucuggacauuuaaaggauauuuaaagucuaaaacaaauguuuuuccauccucuuuccuacuuucacacuuugguaacauuuuuacucuuaaacauuuuaccauuggcuaauauguuuaaaaaaacaaacaauaacaacaacaacaacaaaaaucuguugagcauaaguugacacaucuguuguacaguuaucuaucaaguaaacaaauacacacuauuugaccuaaagaagaccaagauggcuauagaugcuucagagaagcagccaucuaggaacuaaggcagacuugucuuauaauguuauuaaaccuauaaaauucaaaaugcagagaauggaaccuuaauuucucauucugcacaaggccauuacaaccugcaaauuugggguaucuuccuuagcaacaggggcauaccgcagugucgccucguaguuccucaacuucuaauuccucuuuuggauuacacuacuaacugcacuuuggcccuguaaaagcaacagugauuuaucuuaggcaacauacuguggcacuacuagucagacacaagugcagaagugugccaacuucaauagugcauccauuaucccauaaagagagaagucacugaaauggaaaagguucgaaaaagcaaaaacaaaaaccgaccgcuucccugagggacgaugaacgaugugcuuuggauuacacauauggcacaugauaagauguuuacuugaucaagucagauccuauacucugcuucuggaaguaugaaaaauaaaaagggaaaggagagcuagccuuccuucccaagggacggaagccguccauuccaugggagaacggugccaaagguaacaugauacacuuccccaucucaccagcaaagagagauagugcagagcuaagagcccgaggcaaacaccccuauagagggaauucagcucaugccauucugguccuucaucugagacaggcagcggucaggaggucacaagccaggaauggcaggcgucucucuccagauuuguuuugaauuucaauauggcaaugucuaagacaaucuuacucuuguuuuuaggucacgucuuugugggaauuaacuccaguaaaacucuccuuugucuaaaauauauauuuggauacagcgggaagucucagagaguuuguagauuagugcuaaacaagaauucuuuguuucagaagcaaauuauagagaaggaagucacugacuaccucuguaauuaucagaaaaaauuugaacucccaaucauuccuuaccaaagguccaaauugccaccuuuaucaacaugauaucuacuguggauuuuaauauuuauugucucaaauucacaaccuuucuugcaugauuugaauuaacaaaccaaguggacaguuguuuuaauacuuuuuuuuucuauguggcaggcauugagacaagguuucucuguguagccuuggcuauccuagaacucacucucuagaccaggcuggccuugaacucaagagauccacaugcuucuguguccugguauuaaagguacacaccaccacugccaggccuaauucuuuuaaaaaaauuauaaagaauacagauaauaagaaaucaagaaauugugggcucugguccugaucugaacacaucauggcugugugacuuauaucaagaaauccaacuucucuagcaaugaacacuuauacucccgaagggaggccaacagagucaaccuuaugggauagccauuccaauggaugacccaugccaccaaugacaggacaucaagaugaaggacagaucaggaagccaggggaagagggagggaaggaaugaagacaguaggugaagaggugcaacuuacaauguucaugcaaacaauagacaugaguuauauguguucuguaauuccuuuuucucaaaacugaagauacaccacacauacacaucagcgcauuuuauaugccuuguguaacauaucugagacacguagaaauuuugccacugccuaagaaauugacaauguucacauugcuuaauucuaaucuaagcucuuuggcaaagcaagagacagguaugcucugccugucaacugacccuuuguuucagauccaaugggaaaagaccagggacuuuauaggagaaacacaauaaaagauucaaacaggccaaaugccugcugggaguaucuaaugaucaucuagucuauuagcagucaggaacaguuagagucagugugcugauuuagaucagaugcugccccagacccgggaaauuuucuaaacaugucacaaguggccugccuccuugaauuauguacuucaacaucaaaggagcucagaaucuauuuagaagauaaaagagaaaucugguccuugccgaagacagaggcagcagggaauucggucuuccucauuuccucacaggaucucuuggacaauuuugaggcaccucuccacuuucucuuaccccugucugaccuguauggacaucucuacaaaccucaaccagugaaaaaucguucucuaacaguugagggaaaagcagggggcaggucacuaauugguguuugcuacauaaacuaggacuaaaaggcaaauuagugaggcugucccugaaugauauaaugagguuuaucauaaugaaaacuaagauuuugauaguuccuaugugcccacaguguaaaaucuggcucuuauuauucucuuaugaaaucuugacuucucaaccauacuuaaagagcuaauaagggauuaaaggaauaagggaguguaagagaauacacagacuaucaaauggucaagcaucugguucaacauugucuucauuguuaacuuacugaauaugaaacacaggugagaucuucauucuaauggcccauguuuucuguugaugucucaaauuacaugcgcaaauaagcagacgucagcauguccuugaaagaauauauaaaaauaggagugggaggugcauuugagcgcaagugcccuugaagucuagaagagggugucagaucuccuggagcuagagcuagcuacaagcaauugugugucauccaaccugaguaccaggaacugaauucagguucuucagaagagcagcaagaacucuuaacugcagagcuguuccaccagcuuccaguaugcucuauggaauccacagcuaaacaaaacuauacaaguuccuagagucuucaguauuuaucuuuauuuacaagguuuugauuggagcccuuguagcuaaaguguuggaaugcaaacucaccuccuuguaccuggaaggggaacggugacucucuaaaaaagauuucuuuuagacuuuauucaaagucaucacuauccauauaaagaucuccauucuuacaaccuucuuauuaaucaauaacaauggaaacauucaagugggauuuaucacaucaaacagggcuagcuauggcaggcuuguucacaugaaaugccaggaagaaggugugacaagauugaaaauggacuuaagauggcuuucucaaaagacaaaaaggacuccauuuuuuaagauaaaaaugaaaguagaguuuucaggccuuugugaacacaugguuuccuucgguucgaucugaauaaauauaaaaucaaacaauccagcaaacauacuuccugaucauuuucaacuguaggaacaaggggugcccuagggaagggcuuucugaggaauuagcuagaguguggagaccucacauuauagucuuccugugaaauccugugaggaaauauacaaggccugccauuuguaacacuggacaguguaaacgagaaucccuugcaagucucugggguuucaccagcagacacuuuccacucagaagaccagggacuggcugggagacaggaaagcuauucagaagcagagagcuaaggaaugcuggucuuguauuaaaagaacacagggcaguaccugcaccauccaaacuauaguaguauacacucccaugguauuuguggggagggagggaggcccuuucaugcauuguggacacuaaaaccucaagccucauagaaaaugaguauucuccuacagccuacauacaagugcuuacaaacuuuaacucaccucccccaggcuugggauacacauuauuaauagaaugcucaccuaaccuuuauaaaguccuauguuuguucucaaucaccacacuaaauaaugaagaaacaaauacaucgccucuccuuacuuccaauaucuaaugcaauuuaaaugaaacauaaggacagacacaggacuguuuggaguuugcacuuccauuuuuuuuuucccacccaucuuuggaugaaucugcagauaugaaacucaaagguauggcaccaacaauauguuggcagugacaugcugauaaaaugugcaugcaugaauaugaccuaauuacaacauccuccccucagcucgagcuguggggguggcuggcuaaccggcucaccuaggcaacgguaaggaaucacgaugugggugugugucuugcacugcuugcggccccgcuugcaccaguucuggauggucacuggcugguuggcuuccaccacguuugugaucugcaguucaggguagaccuggggaacacaggagaagaggaaaugauuacucuuggcaaagccuggcuggcacacagaguacauguugaaccuucgcuguuauucaaagguuccguuauucucuaagagccaaguugcucugcuucuggccaagcacggacacugauacaaaggaaaaugccugagcggcuguaccuaguauuccacuccaaggugacuugcaucgagcugucuuuucagacacuguccaggagaguuaaacuagaaccaugggaaagcacagacucuugaaagcaugaggucauuuucuaugcaaaauaaaccgcuagggaagaccacagcuuguaguauucuaaagaaacccugggacugauauacuuaagguugucaucucuacuuauauucaacucacugcuaucugaaaaauacuucaugcacagagcauggcacauagaugguuuccacacacacaaaaaaaucagccucuguccucaaaacaguuuacacaaaaauauuuuauuaagugcaucuucaagagagccauuuaaaggacggcacucaggaauucuccuccuucaguaauaaacuacuuaucucugucugugaugacugcugcucaugaaucaugcuguuugcugaucacuuggaacgaaaugucaaacucaaucaaccaaaauguauuugugaaauaucaaaccacuucuauguaauaauaauaauggguuagagauuugaaagaagaauagcaauacacaauauggcucuaaagugagccauuuugcgagauaaauaaccagggaaauaguuuacuaaaggcuguaaggaagcagauaguuuaacuggaggugaugaauccaggaggugaaggugagaacaugaagggaauuggacacagucaaaagguuguaagacaacaggauucgaauucuggaaugggcuaaaggguuugguguagacauauuauagaaagugagccaggaaggacuagugcuugggagaguuugggaauuaaaauuaggaaucugagaaagucccaauuauugguaaucgcaaggaauauaaauauggccaucaaagggaguagauaauuaaaacaaaacaaaaagaagccaaugucccugaaggauucaugauguggguuugagaaacggaaguaccagagguaucacugacuccucccagauaacuacagccuacaaaaggguuguaauggaugacaggaagccagaagcagaagacuucaaagauugaaggugcguaccacaggcuaguagggcucagggucaacuccauccauagacaacaaagacagucuaggcugaaagcacuagaguucauagacagguuuaaggguuuuggggggagggggagggguguggagcuggagaugcggaacagacucauccccagcuucugcgcacacugcugagaaaaccuaggaaccugaacuagagcaccgugcccaccugggagccguggauacgccgcgguacuuuguuugugauugucagagugacccugucuucauuuaagaugcugacaucuuguccauugcaguuauggggggaggggggcaucuaauugaaauacuauaaaacgauauuacuuaugccuugauuaccucaccuuacuuugugagguaaaagauguuuguaaaagaagggaggaagggaggaagggaggaagggaggaagggaggaagggaggaagggaggaagggaggaaggaaggggaaagaaaaggaaaggaaagaggaaaggaaaggaaaggaaagggaagggaagggaagggaagggaagggaaaggaaaggaaaggaaaggaaaggaaaggaaaggaaaggaaaggaaagauaaggagaggagaggagaggggaggggaggggaggggacgggaggggaggggaggggacgggaggggaggggaggggaggaaaggaaaggaaaggaaaggaaaggaaaggaaaggaagaaagacaggacgaugaaaauggauauuuaaaaacuacauaauuacauuguggacacagaaauauuuaguauccucuccccccaaaaugauccaucuagcuaagaaaauacacagagggaacugaaauaaaugccuaccauuaaguggcagaaaucaguguauaaaggauccauacuguuaugacuuccuauaaagacaugacagucuauaaagacaauucucuacacaggcagcaaaacgaucagugucuggacaaagcacucgccuaugagccagagaugaauccccuguaacugugcauguugggggcucauguguaauuacagagcugggaagauggagacagccagaucccugagacucguugagcaguuggccuugccuaagagacccugucucauaaaacaaggugauaagccuggaaggacaacucaggcuaacaaaaagcaguuauuguucuugcagaggaauuguuugugauuacaagcgcccucauugugguuagcauucuuaacaucagugucaugccaucuagcagcccuugggaccucugugggcaccggacacacacacacgguguauauaaaagacaccacacauggugcauaucuauacaggcaaaacauucucacagacaaaauaagauaaaucuuacaaaaaguaaaaaggagauggcucuugaagaauagacacucaaaguugguguccaugcuugcccauaucccuguagguauaacccuguacacacacacacacacacacacacacacacacacacgccuaucugacccauaggagcuacaacaccaagagcaagcccuaagaccaacuauagacugugagcgacaaagcaugacaguguggguucaugccuugucagggcuggcucauucugguagaauaucuucaugauaagagaaaucuacugcaucucucugccgucuuuuaugcuuuuugguaaauguaugacuucucuuucaaagaaaaaaaggaacuauauucucaaauaauaaaacacaagguaucaaucagaggaaucauguggcuaaacaaauacguaaguacccaagucggggacagugagauggcucagcugaugaaggcaccggcuggccugaguucaaucuucagcaaucaccuguuggcaccugugcacccagacgcacucacaugcgugcacaaacaagagaacaucaaaauguaauaauuaguuucgucuguaaggcagagcccuguucuucaaacacgaccagcaguuuagcugcaaagggcacagcuaccuucgcuccauuugguuuugugcuuaaguaucuccaacccgugaguacaugcauuuaaggcccgggcaaugcuccccuugaaaaugccacuaaaaauuuaagagccccauagcauuauucucuauaauggagggcagguagcguuguguacagaaauauaauucucccaccuuuucuuguuuauuagaccacaaacaaacagcacuugugagucauaaacucgauggcaugagaguuugcccugggggauaggacuuuaugugcagugaagugugaguuacugcaucuuucuaaagggaacccagcuggcacuuuagaaaugcugccccuacgagacgcaucuuagacgucauuuuucuauaaauuccucuaauacagucacaccacauuuccuuccuuuccauuacaaccaaggaauugaguuuacaaauggaccagcaggagaaggggccuccuugcucccauugcucacacaccaccaucagacuccuaggauaauaucuggugcagcggaccaguaaaucuuucggugcccagugucugugcagagaagauggcaagcugacagaccaaaccugugaacauguggcucucccuugagauuaccagagcuuugaauggcgaucagccagacaauuaauuuccaauucuauccagagaaucuaggacacacaugugacucccugggcuucuccaccucccuccaugcucugacagcaguguucauaugcagaaagaugagagauuauaaaacccgaacugcauaaagcccaugcaguuugucuaauuucccugauccgugacauggaugcagcaacuucaaucugacucagucacuuuuacucagagaugaaggauuauuaauuugggaucgccaaagagaauaauauuuugccauucuaaauagcaggaaguuuauuuaaaggggaaaaagaugauuuaaaaaaaauuaaaguaguaaauuuccuuuugaaguacugaauggccagcuagguaaugugaugacuuugcacagguacaaaccccaacaaagcaaugccagacaaacauacacaacgaaacaccuauauuuuuaaaaauuacaaaaaaaaauuuaugaaugcuuguuuaaguagcuccagaagaagucuauagagacaauggugcauuuuuuguugauagauuagaucacauaaugcacugucuuagucaagaauaaaaacugaauuaucugggugugguggcacacaucuuacaucucagcacuugagggcagaggcaagaggaugucuaugaguuugaggcuagccugguuuuaggacuaccaggaauacauagaaagacuugucucaaaaaagcaaaacaaaacaaaaauuaagugaauuauaauguguaaauaaccuuguaacaauauuuaauuauucaucauauuuaaucacaagaaacaggacaacauuuaauauuuuugugacacaguaaauuuuaauaaaggaagcaaagaugccaugaguuuuguguauguguguguuuaaguauauauauauauauauauauauauauauauauauauaauguguacaggugcaguccuguaugugacugcuggcauaugucagucaugucacaugcaguuugucugauuucccugaucugugacauggaugcagcaacuucaaccugacucagucacuuuuacucagagaugaaggauuauuaaucuggaaucgccaaaaagaauaauauuuugccauccuaaacagcaggaaguuguuagaaguuaaagaaaaacuuuggacauuaguccucaauucucacaugcauuacaaauuacauguaauuugcaaguacuuuacauucgaaaauaugcuguuagugggacaacugucacuaaugauguauguaccagaacgcuaguauaacagacauaaaaaauccuuguuugugguccuuucuuugcuacguuuuguguguacgguugcuuucuugaugaaaaucauggacuugaugggugcagauaaagauaucucagcaguuaagagcacuugcaucuuacaggagacccagguuccuuuccuaguaucaacaugguagcuggaaaacaccugugguuccaguucuggguauucggggaagccagagcaaaggcggggaagccagagcaaaggcggggaagccagucaucaggaugacaaugcuuuuuuucaaaaagcauaaaagcaaguagcuggcuauaguauugggcuugguggauagguguacggugcccagcaggagccagggcaauccaggggagguaaauaggaagaggugcagagagagaagcugcagaagagcaccgagccuccgaaacucaaaacaagggcacucagcuucuaggaaacaccccuuuacaguauaucucccucagauacauuaaaaccuagugcuauguuccuuucagcugaguagaaauggaccccuuuauuugcugguuucacaaaugccccuccacgaauccuucuuuuucuggaacaaggccacuucaugccauggcuauuaucacugacaacaccuggcaacugaccguguccuaccuccuagacaccugcuggaacauguccuucuugaaggcaagagccaugcggugcaguuggaguccccacccaccaccccucccacuaugccagcacaguaaugucugacaaauauuuaauguuauuucugguuaaguccugauacaauucaauauggaaaugguuuacaugucuuacacucuugcugggcaucacacaccuaucugcuaggcccaaugacuauaagacagcuacuugguuuuaugcuuuuugagaaaaauaauucucucaauguuguucuucuaaacagaggugguagguuauacuucuaauaguaucuuggguugaaauaagcuaacaauaauacacagcugaagaugaacuguuggaagaauuaaauccacaauuuuuuuuaaaggcccauuuaccugguccuagaaucaugccauaucauuaaaggauuaaguaucagucuauaaaauuauuuuuaaauagagaauugaaaaaauuccaaaauaccaaaagccagaaaaauggucauguagaaaccaucuuggguucccuauaaaaagugguagcagcaaggugguaucacacagcuuuaaucucagcacucaggagacagaggcagguggauacccgaguucaaggccagccuggucuacagagugaguucuggaacagucagagcuacacaggggaaaccuaucucaaaaaaaaaaaaaaaaucaaccaaaacaacccaaaaagaugauaucgguagucaggguuuuuauucuuaaaauaaaauaucuuaaaggaugcaguacuaucuuaaaggauguuucucuaucauuuuuuaaugucaggaacuguuaagucuguacaccagaaccccauauguaaccugugaugcuuccuucaagacauuuagcucacagguaggcauagcaaacuauggcguccagaacugaugugguccaugagguugaaccauacgaagagaaugcucaagaagaaaauaaaaccagaucauaauaaagguuuccccaauggcagacaucacugcaaacaucuccugggcagcaugucacagcggauugacaacuaucgcaggugccuuuucuaagcacacggagaccacauuaacagcacgcgcuucgcugcuuaaacuuugguguguguaagccaagacuggggugugcggaagagaauacauuucuguuuccagauuuaagugacacacuuuaaaguuucuagaaccugaugaaaaaacugcaucuuaaaacuguuuuccgccucgauucugcuaaugagaggggauauagaaaacagaacaucuaauucaguugagaaagagaaauggaagccgaaaaguggcggcugcucgugacuuaaugaggugcugagaggcacaggcagcugaugaaacacgucugcaaugucagagagaggggagcagagugggcccugcucucacaaggaugccuugcacgaggcagaaggcaaagcgcugcaaggcaagaguguguuucccaaccauuuggcccaauucugcaugugacacugcauauuaauguguuguucuagccgcacauucacacuuggugcgggaaggcacggaggagccugguuuggcugguaugccgcugccuuuccaaagcacucaugagaaaagcaaagaggggaugccuagcguguaaggcacgucacagaugugaaaacaaagacacaugcguacacacauggccucauucagacaucaguuuucucucugucaguucuuauugcuaacuugacacaaccaagaaucacuggagaagagggaggcucgcuggagggauugcccaggccugccugacugacuggucuguggggaaccaucuugaauguugauugaugugguugaugcaaccccagguaggaaagagguccuggguugucuaagaaaguuggcugagcaccagccagggaaagcaagccggcaaacagcgauacugcaugguuuuugcuucagguccuacugaaguuccugcccuaccuaucuuccuucagugauggagugggaccugggaguauaauaucaaauaugcccuuucuucccccuaguuggauuuggucaggguuuuaucacagcagcagaaggcuuacuaagacacacacccucacuauaauucuuauguuacaauauuuagacugacuucaucucuuuuagcccuaaguuccaaguaguccuugaauccaaauagaccaucgaugcagaauauacaccaguacucauauucaaaaauuaugauccaccgauucaaaaaacugcuuuacuuaauaugaauucuuggaccuuuuaaguaucaggacuaugacgcuuaugaucuguggguuaauuuugagcacauaaagugaccagagagaaacaacaguauauagaauacacuccuauagcaucugcuauccauuuguaacaaaccuaggaacuggaaaagaaggaacuuccacuaaagaggugccuccaacacacuggccuguaggcaugucuaugggcauuuuuuucacuguuaaaugauacagggggacccuggaacugugggcaguaccaucccuaggcaggugggccugggcuagacaagaaaaguagcugaacaggagccuggagcaagccagccaguaacccauacuuuuccauggcccagaucugcuucaguuccuacuucuagauuccugccuuauguuccuccuaccuuaguuucccucagugauggacuguaacgugugaacugaaacaaaccaaguuuauuucggggaugcuguuuaucacagggcaacccugaaagacaguuagauugaugaggacaaacuguuuuugucuuuuuaacaauuuuguuuccuauuaaugaagaaugacaacagaaagagaaauaacucuuccugggaaucccacauuggguuauauaauaaauuuuagaauagaaaguuagggaaaagaaagagcuguuuucaauucauauagccagcuuuuguuuguuuguuugcuucugcacaggacuacuuuguuuugagggccuguuaaucccaaagaaagcacucaaauagaggaacaaggauaaagaaaucacagacauugucaugaauauaaaggacuuacuuaagaaugugugaauaaucuaagaguagaggaaaugcaaaaagccaagugcguccaucugacuaccuacacuugaaacuuuucccauccucagccagccuccacaggcuggcuccaaguggaugcucaaagagccaacccuuccuucaggaagcuuugccuagcaaaaguccuuccugugugcuuaagaccagagggggacagaggaggaucaaggcuguauaugauuucucauaacaacuggcuuucauaacaucugccugucccgguuacacaggaaggacacagucugagacauuguuuguggauugcccugaaucaugguacuucauacacuggaccauggggucacugacagaauucagaggaugaucuuucacauccauuuucccaccucuguuuguaaaauaaauucucuccccagucagcccaaccuuugaaacacacuacugaaaugucucacuaaaagcacucauacuaacacauccccuggcuuccaucucucaaaaccuggauccagagucuccacaucaccaucaagacccuccuugcuaccuaccacugucuccauuuucuagguuuuauucucaaucugauggaacagagcauguuugcaccccuuguaagccaggaaaggcauugucugacacaaagcccuauccucgguagucuuuagcuacgcuggccaggguugccuggcuuaaaaguaaagaaauaaagucuugagacguggaacuaaacacacccugaagccuuugguguacaugaaacaauauauuuuuuuuuuaaaaaaauaucauuucaccugaaagccaugcaaugaaaccuaauaagucucauuuucugacccuaaauuuuaaugguuuuugaucucuuauuuuuaauauuucuacagcuuugaguguguccauccauuguacauggcacucagaugcauaaagagcucucacauaaguuuaaacaguacaaugaauauauucuccuccauagcuuucccuaccuuacccuacccuauaccacccacugucaccucuuguucccuuagacaucucauugauaccaucaugucauauagacagacaugauuuuaugaaucuauacaaugcauaggaaccacaaauagaaaauacauaauauuuguuucucugaggcuuuuucuauuuugacauuucuucagccauaacauuugccaugguaccccaacagcucauuagcacaaauggcuauuguuauauuguuaaauuuaugaaguuacauuuaaguaucuuucuccauguuagcacucugcuucuaguauugaucauagaaaaggcuauuuuccuccaucaaagagucacagacaauauuaaagcauuuuaaagcuacacucuguguuucucucuaagguugcagguccucucauugcacuuuuuguuggguauauaaaaugaggccaaaucugugcaaucccaugacucuugucuaacaacuuuaaaaccaggaacaguagaacagaauggccccucaggcagaaaccacaggugcuccugcagggaacucucccucaggauagacaaggaugccucugcccauccuacuacagucucaugcuaacaaagucauccaccagcauuaccaaauggccaccagcaugcuucaguugucagauaaaaugcuuugugaaucaugacccuaaaaaugucacucucuguagcaccauggguuucuagagccuuuaccuacaggagacauaaugggguccugguggacaugcuacaguaaaauaccacacccugggcaacucuaacaauggaaaucuauuuugucacaguucaggaaagugacaaaaccaaguccgaaugugcugcugaggacauuuuucuauuuucacacugcauccucacaugaccccuuuguaugaggaaguaaagagagcuggcucucugcaguuucuguaagggcaucaauaccaucuggagggcucugcccucaugacgucaucaauacuagucaucucugaaagacugugucuccaaaaccuaucuaaagagaguuagccuaaccuaugaacuuugggaaugcagaauuguucaguugguuaacagcacucaauaugugcuugauaaggagcugaagaaaaacuguacauggagcuaauaaaaagcauagaaauaaaagagagagacauguacuucaacaaugacuggguagaagaaaaacuacuaugacuggggacagaaggaaauauauagacaucaaacauuuggaagaccuggucaacauguggcuaaaacaaacauacacauuaggucauacaaucaaaacuauuuucucaaucaaacuucauaaggccuuauguguaccuaggaguagagguaaaauauucagccauuacuguuucuccucggucuuucccuugaccaaggauagcuccaaaggaaccaaagggacauaaaugccacucuuauagacuuccaaaucaagucaauagcagggaagauaagccaagaagagugagagagaucagaggacauaaacuaguuaauaccuaauuccccauaaaaggaucaauauuaagauaccacccugggcuaagcaccagcaaacaguuaaaggcaucuauuacagauauauuuagcaggaaaauucaguugguuagcaaaaggucaaaaugagguuauagucaugaguucagcuccuccugucugcccuaggcucagacugcuaacagcugccucucugacucagcagauugcuucuaaaacaucugugucucagucuugggagguuagaguccaugcauaaaauaaagucaccauuacagggagacaaaaaaccauuaacuguuuaguccuguuacugguaauaaguagagaucauuucuggugugugugugugugugcucaugugugcgguggccaaaggacaacuuugggugucauucaucacaugccauucaucuuuugauuuuuuucccccuugaaaaggguuucucauucuccuagaaugcgcuaaguaagauagguugaccaguugucugucucuggcuccccaacacuaggguuauaauuguacuucacauguagcuuuuucuacaaugaguucuggggguagaacucuggucucaggguugcaaagaauucuucaaaggaaucugugcaaugagagauggcaaaaaggagaucaccuuuaugguacuaagcaaaauuauugcaaaugacuaauuaaggcaaaagucaucaaaauaauaauaacaguauaacagccuaauaaguaauacagaaauuagaacauggcuggaagcauuagcucuaaacaaguccuguugaaaagaaauaucugacaugggaauuccugcaacagaacauaccuuaauauucaaccuuaaaaauauaaaaauauuauaauuuagcaaaaauuguugaguauuauuuuccuuuucauuucaugcaaugagucaaucaaugucacuuaauauauaaacauaguuaaagaaggaauaaaagcaaagaaauguauucuagcaaaauauacaaaaaauucagaucuauaaaucagagcuauuuauuaaaaauaccaggaguagcuacaaugugggaaguggcagggaaacacuaaacacuaaacacuaaaacacuaaugaaagaucuuguaggcaaugucaaacuacauuuaacggccccaaguggucaucuccagccacucugccauuuucucugugccaguuaaagucaagacccaauguggaucccagccagcacuuucagccaaaagaacuacccagcucugucgccacuguacacagggccacagucauuccguuuuggccuugugcauuucucucccucuucugugagcagccauucuuccaugccuuguggguugccagaccacacagccacauggguaaguacccuggugcaggcgccaaaucuuuguguggucaacacgaagccacucagaaucccuucucccuggaauuacaauacacaauggcaaacaaaguugggaugccacucccagaagcacuggcugccagcuuccgaccuuccugagccccaaggggcacccaucuuagcaccagaagaggaguaaaggcagaacaaagaacggcauuaacaggagaaguagcacuugggaauaguucucugcuccaacacuccaacacaggaccuaguccugcuuccucccuuugaaagcugccuucagcccaggguuuuucucuauguaggagaaacccucuuccacacacaugggcuguuccauugguuuugucucugggcaacagaaccuaccuaguuaaccguuucuuggaaaaaggucauucuuugccauuuccaaaacucaccagauucagcggagucuccuuucaccuucagaucuuucggcucacccuacucucucuuuggacacagaaucucacaguguagccaaguauggccucugacuuuuaauccuuuugccuuagccucccagguacuggacagcauagcuguguccaaugcaauaucuagccuccuccucugcacacaccugagauuuaugauggacaacuaugcuucccuugauuuggcuucagucuccuuuggcuuaaguugccaucauuaaaaaccaaucaaccaaccaaccaaacaaacaaacaaaaaauaaauaaauacuaaagcgaagaugguuuccuuugccucuguucaccucaagcucuuuaucuagauuuuuuuuuccucagagugauaauuauccucgccacuuggucaugucauauuuguagcaauuaggcuugucucuauuaaggguaauguccuuugucaaaauuaauuuucucaaacaaaaaggaagagaaggaaggaaggaaggaaggaagaaaggaaagaaagaaagaaagaaagaaagaaagaaagaaagaaagaaagaaagaaaggaagaaagaagaaaagacaaccuuucugccuaauaaaaggcaguauccagccaguaaaaggcagauagauguggcuguccaguacccaaagcuagucggagaaagaugauuugauuugagggauacuguuuuagaguugaguggugauuuuauaggcuuaugggcacagacccugugagcaaugucaaugcuuccuagccuauggaaauaauugcuggugaucccuguucacauccaugcaauugaaacgugcuaagaaucuaccccuauccaagucaaccugggccagucugaaaagcuuacacucuucuccccuuaagaagugcacugaagaccugcuuuuggcauguggucaguuuucauggaggcacacgcugaccuugcuaaaaaucacacuucagucgcucucauuuuugaccauacuugucucaucauuuuucucuguuuagcaauuaacuuagcuugucucccagcacaugacacaugccaguucugguccugucucuggccacuucauagcaucucuuuguuccccuuaaauguugcauuuccccaaggucuauuccaaggcuccuuuccagaagugucacuaaguggguuaaagggacagaagcacuuggcccugaggcugaggcuuuguuaagaaugaaaagggauuacaaguggugacaucaucaccucugcccugucaauuuacagcacuaagaccuugggucuggagcugugcuccucuuauguuaauuagugggucuacacggagaucuuaccauccagaggcaaaugucucaaagaggaagacacuggcucuuauaucuucuccacaccuugaaacauucuaguaagaugauuuucuuucuuuuaaagauacuaauuuauauuuauuuauuuuuauaucaucuguguuuuucccacauguaugcauguguauguaugugcacccacaugggugccugcugcccaugcaauccacaagaggguaugcaaacaucaggaacuagaguuaucuauccuugguucugagccaccaagugggacugggaaucagaccagcauguuuugagagacggacaagugcucuaagcugcuuugccaucucucuaucucccucugccaucucucuaucucccucauuugugcuuuugagacauuucauucuauagcuaaggcucagauuugccaguguaaggauuacaggagagagccaccacacccagauugaacaaugugauuuaaaggcuuccaagaaccuucugaguggcaaucuguggggacuccccagcucauuucucucuuaugcuucagaugaccggauaaugaauugauuacgacccugucacagugacacuggacaagccgagagcacugcugaguggaaauacaaacaaguggccaguggacauucaaguuuuuuuccagcuucaugaaaaaaacaaaacaaaaaaaaaccacaaagaggugaaaucaacuuuaaccccauauaguuugacuguaacauccuuaugacauccuuaauaacuacacacaauauagucacuucaaaaugaaaucuauguuguaugccuuuguugguauuacauuucugaaacaugacauuuaucucaacaguacagaucuaacuggccacauuucaagugcucaagcuguacaaaaagcauagggacuggaaacuccgucacaugggcuugggaccaggugucuggaauguucuacagugauauauacuggauaggguugacucugaaauuccaacguagucucuccucuucuucaaaaauuaagccaacgaauggcuucaguggcuuuucauuguuauaggaugcggaccaaauucaugaaaauggcucgcaaacccuugauauguuagcccuuucuuguccaauggacugcaggugaugagcaaggagagaugaaugcuacauuagcggcagaaagaagaaaucugccaaaaggcuuuccccugcuccucccccauggcuacccgcaagcaggcagucuggaguggaaagaaccagucuguggcucaucccugcacaagccacaaacuaaaacagaaaaugaagcuacccaggcaugacugggcucagggcagcaggaagugagggcucuucccagucaaggaaaauaaucuuuguaggaucaauauucauaggcuuaaaaacauguggucauuuguggaaaacacgggcuuacgggaugauccacagguacuaacaaccauucacauagaaauucagaaggcaccaucacggacaaagcguguguccagccuuccuacuggccucugcugaagucuacuggaauagucagucacugcuagcacuuuggaaucaugggaaacuuaggguacagacagguagcuaccugaagagacagcuuccuucccaugucauagagcggcaggaaaaguccuugacaacuguggcuuacuuucaaaaagggcuagugagaaaggcaaagaagacggaaacugagcaucucugguccaaacacaggacauuggaaauguuccaaaaccaggcacuuuuuggaaagcugcucugaaucuauaugugggaaauuccuaccugaucucaugggacaggcugcaguccaaaaggagcucaaacgaaaagcaccacagaaaaugaccuuacaguugugagugugagggauacaggaaguagauaagaauuucauguucacuugggucccauccacaaagcagcucaacaugaccuuucgaauacuucaaauucuauaaaauccaaaauacucugaacacaagcauuucagaaaaggaaacuucaauccucccuccaagcccccauaugaaagcucacaacuguacuuugguaauuccagucccaagagaugugacaaccucuucuggagccuccuuaggcaucagccucacucgugguacacagacauguacccaggcaaaacaagcauccauauacaagaaauaaaaauguacguuuuaaagaauaaaaauauucaucagcaugggaugaaguggaagugaccuucuguauacuuucuagaguuaucagcauaaauguuuacuucaaagauacaauauuacaggagaaaaaaagcuagaaaaauaucaaguuguaguuguacuaaaauaugucaaagagguugaacaaaaauaaauaauuaaaucuagcacuuuuaauuccuuuaucccuuuauuacacaggcacaguagaacauaguaaacugugaaaacuuaaauuuuacccaguuuauugauggucauagcacagagcaguauguaacugugugaacugcagaguaaagaaaaacuguaugaaagguauaguggaucauuaggaaccaggauuuuuauuaugagagaaaauauaaauauaagauguaagaaaguaaauacuuuuagugaaugccggugaugcaccacuagggacuuaccucuuggcaguacugcaagaugcccuccuuggugccaaugcagguuuuggucccugacgggucugacucccacuuuccauucugcacauucaugugcauguugaguuuaccacagaacauggcgaucugggguucugccagcagcccggcguugccaucaguggguaccuaagagaauaaguccuaguuaguaacagaauccacagcuccacgaagaacagaaaauaugauggugaugccuagugcucuucagucacacagcaacccggcaucagcauuguugggcuaauauacaugcuacagacucagaaaauaaccuacggaagacagcguguucuuuaacagaguauuuaaaggaaggcacuaagaguauugaaggacauuugcucauucaauaauucuuuaguuuugccauagaagauuuugcaguaucuguuggaaaguucuaacaauaaagagggguuucuaacauaaauauaagccccguggaagaacccacauucucauaucccgcagcugcucacacacagcacaaugccagucccugcuugaugacaaggccuagacuagaggugacagcaugaugucaucagagugccucaaugcugagccacuggcugcauugaguuuuuguuaguuuuuauguuuuguuuuauuucgaaacaggaucucucuauguagccuuaagcuguccuagaauccacuguguagcccugccuggccuggaauucacuguauagaccagcgugacuucaaacucagagaucacuugccugugccuccugagugcugggauuacaggcgugugccacuaggccagcuuguaucugaguuuucguuagaaaauuccacuggagaauuaaccauuuugaaauaaaacaaaacauacaaacaaacaagaacucccuucgauguugcggccgcucaacucuuccacaggaggccccugucaucucccaccaauccaggaaacuggaagucucauucuccaccagaggcaaaguugugucccaaacagaauguucugugaacuugaucuuagccgcucacccgagaguuugaaggaaauucaaagcccggaucuuagagaucaaaauguacaucuugccaauuuuacugaaauaagcagguggguaacagggcagggaaguuaaagaaagucaaaucauagucagccaccuguggggaaaucccuggcguggaggcuaagggggggcuuguuuguggucacugcaaaccuuauugugagcccuacucugucccaaagauuuccacgguuagcacaccuugccaucuuaucccuaaccaaagaggaguuacagaacuuucacuggaaguuggugaaucuaucaucaaaagaaucccauccucaccuugaggaccauuucccucaguaagagccucacagccucuucacucccacaggccaggugagcucaccaccucucacugaacgcaaaugcaggagagacuguuuccuucugcaaagagaauuuaaguaacaaguucucuccugggauagucaaagcccaagaaagacgccacgauccugucugcuuccuggaaaucacgaccuugggcaguccuuucccauaaugcauuagucugucuaugcagcagacaaugcuugucagaaauggggaugugcaaguucaaaaguaaggucaugacauugcggcucacucauuguugggcaaucuuaagugauagguuaucucugcugacaaaaagagccaguucaagccaaauuaaaguauaaaaauggguauuggcagggcagcucuugggugaguucacuggccccaaggaaugaagccagggaugucaccauuuauagggagauagaggaggggggggggggaagagaaagaaucugugcaugcagagagggagggagagagggggggggaguggggagggaaaaaaggaggaagggauggagggagggagagagggaaagaaggauggagggggaaagagacugaccaaaauaucuggauuguguagggaagaccuccuucuggggggagagcaagccccuccccugggcuggaaaguucagcacagaggcaggguaugccagccaugcccuguaauaaacacggacugagggauucugggagaaucuggaggucagguccacuugguuaaauaugcaccucaucuguuuguuccaggucugaaucccaagaauaagaagguccgaccucguucagagccacaccagcaaguuuagacauaagccacaccucagugacaccaaugacaucuggcuacagccaugggugaccauaagaauguggcuuugaagcaauaccucuccugggcauauaucuagaagaugucccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugccccuccuuagaagugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuaucaaaaggacccagauguagcuguuucuugugagacuaugccggggccuagcaaacacagaaguggaugcucacagucagcuaauggauggaucacagggcucccaauggaggagcuagagaaaguacccaaggagcuaaagggaucugcaacccuauagguggaacaacauuaugaacuaaccaguaccccggagcucuugacucuagcugcauauguaccaaaagauggccuagucggccaucacuggaaagagaggcccauuggacaugcaaacuuuauaugccccaguacaggggaacgccagggccaaaaagggggaguggguggguaggggaguggggguggguggguaugggggacuuuugguauagcauuggaaauguaaaugagcuaaauaccuaauaaaaauggaaagaaaaaguuaccaacacaggaaaaaaaaaaaaaaagaauguggcuuugagagagauccagaggcagagcaccuagaaggacuccuaaguuccucacucacagaagcugaaauggaaccacuugucguuuuaagcuaguaaguuugaggcaaccugucacacagcaagaaacacuaacagcucuugcucugcucuucaacagccucugagcucuucugcugaacacaccaaacgaggaacaaacacuuccucacuuuugcccaugcuucuacagucaggggucagagagcucccugaaaggaccggcuaguacguauuuaaggcucgugcuauaggagaaagggccuuuaacaacauucgaaggaaugaaggcuuucccccauccagaacuguauguacaaagcaggcaguaaauccgacauagccaacuccacccuguccguccgcauauuuuuuuuccacuggucacaaacuuuaaaucaucuugugauuuuaaacacuggccgcuaacauuuuccacuugcuuuuuaaaauuuuuauuuauuuuguguauguugugaggauaagagguguguggggcgggggugguggacaacuaacugcccuggcgaauauguugaaguuaaagaacaacuuguaggcgaaaacgauuucucccaucaugugggucccagggaaucaaacucagguugucaggcuuguuggcgccuuuaucugcucagccaucucgccgguccauucacuuguuccuuaaggccccuguaaccugguuuacucaucucacccugaccugucugccucucaaagguuccauaugacugcaaugugagaaaccaaagaggaugcccuuaguaccuguguccccacuggccuuauucgcaacaugugaauccuucuuccuuagcagucucugccuuuuggcuucugucaccaugaaaugucacaguuguucccuaaucacccccuuucugaguccuauccuccaauuccacccacagcugaggacauccuaaugacagagcuguuguucccuuccgccuaaagagcccuucccuuuucugcacauacacaauuacgucagaacaacacuagcuggugguguacuguggggaucaaggaauucaauggaaccaucagaagaguaauuugagguuuuuguuccuuggauuuguuuuuuaauggacuaaauuuguucuuugacacauucacacguguaugaagugucuacugcuuacuuucaucuccuguggcagcuugaauaagaaugguccccauaggugcauacacuugaacgcuuggucaccaggagugucucuguuagaagaugcggccuuguuggaggaaaugugucacugggaguaggcuuugagguuucagauacucaagccaggcccagugacacacucucucuuccugcugucagacgaaccagauguagaacucuuggguccuuuaccagcaccgggucugccuguguaccaccauacuucugaccaugaugauaguggacuaaaccucugaaccuggaagccagcuccuguuuaaugucuuccuuucuaagaguugcuauggugauagugucuuuucacagcaauagagacccucuguaaugcuccucccacuccuguccuuuccccuccucucuacaagccccuuccccacauucaugacaguuugcuuugcuuuauuccucauugauuuuaagcuaucccgggccaucugcauagcuacaggcuuggaacuagcuguagaagcccauuggucccauagucugaugcacaaccgaugacaauaaaugaucuucucuuucgcaccucacgcaauccaaugguuaacaauaggucagcacaggaggcuccucacauccaugacacuggugacaagccuaguauuguacagguggagcagcuaaaaccagucaaguccuuuccacaacugucauacuaccugaccuuuuuuuuuuuuaauuaaaccuaucaaauaaauuaugcuuuauuuuccuaagugugauuccugaacuucguuuuucugucuuucauacuucucuaugccacccucccucuuaccuuuaaaauuauuuuaaugccaucuguuuguagaauacaugugcugacaaaagguggugaucuuuuccauaucucuucaaagaaacugacuacggcccuguagucuucugaugauguugugagcucagcaaagugaguuuaaacuagaaaauauaugccuauguucccuucggguuuucugugcaaggggaguuaauguuguagugguuaucgucaucaucaacuuggcugcauuuagaaucuccguggaaacgaaccuggggugugucuguggucaacuugugaacaaucuguguggguuguuccacccagguuuaacugaagaguaaagacccucccugaauaccaacagguucaucguaugggcugggaccacaggcauaguaaaaaaaggagagaacaaauuggucgcuaggauucaucucucuccucuuccugacuauguaucugacacaaccagcucuucauccuccugcuuccaugacauccccaccaugauggaugcuacccucagagagagagccagcuugccuuacuuaaauugcuuuugccagauguucugucucagcaacaagagaagcagcugauacaaauauuaaguaugaaagccaauacauagauagagaagguuuuaaacaacauauuauauuuccauaaaguagagccaguuugggaacuucagcucuagucccuccaaaauuauaauagauuacugaacuaggaacagcagaauugguuuuauuuaacauuuugcuaccuuuuacaaauguguacuuaaaaggaaaaacaaaagcaaaaaacaaaaaaccaugucucuaauggaaaauucuuuuccaaaucagcugcagcuggauauugaagaagcaauuagaucaaacacacaaagugaaucagaagccuuucaauccuuccuguagcccgccuaaguuaaccagcacaagacaacucucagcauccucaccugcaucugucaacaugcugguugcuauaagcaacccagccucagaauccauccaagaagagagcagcagcaucagacaauggggccacacagaacguaagauuuuccugccucacggccaguccgaacagguuuacucaaaccucuuuuccugaacaaagucucuaagaaaaagcuuaauaaaucccaugcaauguucuacucagagccugacaguaugaacguucauauaauugaagucuuucuauccuagaacauauuugcugucagauuccucuucuccucucaaugucaacuggaagaucuacuccucgcuucuaaaaaauaucucccuacuuggaaaagcaacagaugccgcuuaguaaguggagaauuaugaucaguggaauaaccacuccacugaaccgccgugagagccaaagguauguucuaauuacugugccuaagagauccauuaaacaacaaugccucuaaccuguaagucccuugcccaaggacagauccuugcagagaggcuggaagcaacucccuuaaacaaguuugcuugacucaacugcaccagaugcaugcagacaggaauuaucucaggauguaggaccuuuggcccagauuggauggauguagguaggagguacacaagcaggaaguacgucuggaccuacacuugcucuggauggcccugaugggaaacaugguggccuguugggguggccuuuucaaaccucugcagaagguuacucuuuacuguuuccugggaccccaagaauggaccccgccagaguucaucauccuggccaguauuuaauuaaaagcuugcuucaaauuuggaucaaaaaauucuuucaguggucuuaaucuccaccagugggauuagcaccaccagguuauuuuuuucagaaauguaagucaacagugcgggcuagaacccauacuguacacagguggcucugcgugguucgugugguuuuguggaggcugcguaugaaaauaaccuguauggauugcugccgccauccugaaacuggagauauuuuucccaugggaaaacaguguucggugccaacaaacaaaacagccagcugaaacaguagguguucagccauggcuucaaaagcaaagaggcuacuuaaaaaaacgcugagcuagagccacggaaauauuacucuuaaaaacacggcuaaccuuuuuggaaacaaaccuuugcuaucagggaaaacaaaaaaguuuguuuuuuuuuuuccuugagccacaacacagagagcaaagacaugccauggacuuuccucaugguacugcagcuagauguuggccuuaaaucagcagagcuaaaauaaagguaaacauauggacuugacuuggacccaucugcagagggugaauggggaagucuaccccuccaaccccuaccauuuacaaugaagggaagaggcagcgucuggaacaagcucucuuucugccuuucaaacagggcgcuccuucucuccaggaacuuucucuccuuuucauuaucaagaucagaauuccuuauagaacggguuuggcagcauucuucaccccagucccagcuaagaggggcuugaacaaggagcucucuguuuuccugguuaaaaaggccagcuuggcaagacggggcauggauccaucgcuuggccccaucaguggauuuaugucguuuuaagguuucuggcuaaugaagaccaucugguuucuacauccaagcaggcuucucacuggccugaauaauucucucucguaugguguaguauuugguauuuuuuucuucuuuggugggauucuuguauaagcucuuaaaaaaacagacggauucuauuucuauccuauccuugguuuuccuugcauaaauacuauuugcuugcucauaaccugagcacaguucaauuacauuacuuacacacacacacacacacacacacacacacacacacacacacacacacacacuguacacuccaaguuucuuuuaaauucaacccugaacgccuucuccccuuucaaaggucaugaacugauuuccguaaugacaaucuaggaaguuugccugugagcuccuuuuaaggaugaauaaucacuaugagcaaauuuugcuacuccaaccaaaagacaagacucugcgagggagggucccucuaacccaucauccacagagaacauacgcagagcaucguuucgucaauaacaggaaacuagggcuuaaauuacaaucgaggaaaggaaagaaagugcaaagaucauuuaggccaacuugaagcaggacuagacuaagauuucauccauggcuagagugucagaggcagagagaaguuggccacugucugucaaaggcagaugcauauguguguggggacaaaggauagaauugcccaccaaacacguacagaaaagugaaccacgacggcuguuagaacccugcuccucaaauuacccacaugguggucacaguaagucacaguaccuuuacaguauagccauguccagccugaguuccagccuagaaggaucuguuacaaaagugaguagagaagggggaggggaggggaaauaaccgcucucacagacuuaauguagguaguuuucacaccuggaaacucgucauucuuuggagucacuugcugacauagcuucaaauuacaacucagcgcucuuagaagcuuuuccuggccucuguggaugccaugcucugcaaaugagggccacacagguguucuccagcugaccccaaaacucugccccaucucaaggcuacugaagcaugcucccugcugaugcccagcaggaaaccaagaggucuauugaaagcagcagcguuuaucauucaacacccacgagauuaauaacugccgcugaaagcuugcauuauaggaaggccuagcaaagacuggcaggcagacugcugcuuaaccaacuauaaauggauuagaaauuggaauuuaaaaaaaaaaaacaaaaacagaaguauuugugagauaacccaaggauuagguucaaaguuaguuugcaauccaacaaaugccuauuuagguccccacuacccuuuaaaaaaaaagacuagaauuugaacugcucgaugcacaggaacauuccuggaaagcaccucuguacacaggcugauaacacugauaaaaacuucagugacuccauucaguuugcaacgcugcugauucaacacgacaauuaauuauuauuuucaggcuaucucaagcccagcuaaggagccaaaccuugcccaucuuuguugaccuaggaacuggaguagcaaaucaaaucuuuuggaauguauuaaccuaauaaaaaccuauccuccaccuauggaaagacuuugaaugcuaucuaucagguuggacugggagguuguaguugagagucuucggcuggcuuuaacugcucuccuaacuuuucuacugguauauuuuuuaaauaccuuggauuucuaacucucuuuguucuauaauuccuagugcauucuugauggguucucuggcccucgcugagcuguuuucaggauuugaguuugugguuguuguuuaggacagccucaagaaggacagauggcucagcacuuaagagcacugacugacccccucuaccagagguccugaguucaauucccagcaaccacaugguggcucacaaccaucuggauaugggaucugaugcacucuucuggugugugucugaagacagcuacacugucuuacuuuaucaaguugaaucuacagugaugcauucacuucagagaaacacuacaguuagagaauguaacggucauaguuugggucuggaguguccccuaaauguccaugucaaaggcuuggcugccagccuguggcacugccaguaaguagggaaacccuuaacagguacuaaaagucaagucauucaauaugccucugaaagggaaaagagauacaauagcaacuaguuaagacuugguucuaccccuuugugucugggucgccaugauguauugugucaacacgucuauagcaccagauccaagacccaacauaaaccuuacccuccuuugaaguugauucuugaagguaauuugucaaaaacaauugaaacucuggaggcaagccauuuuuuuuaggagacuauaaugaaaauaagaguaguuaauaugaaaaaacaagccacuucaaaagagacugauugcauaggacguauaugagguuagcauuuucccccaaagucaagccuucuaagauaaaaccuauaugaaccccaccccuguuuaagacacuugcugcuggggaaccucaauuucugccgcaccuagccuauaaauaggacucaagggacagugacggaggcugagcuaggcuuccuuauagagcuagcugugaaaugcuuguuggucuuuugucuucacugaucuuuguuuugcugagagaggcugagaacuuuugcugguguuccuguuggccuuggucccuccugcugacucaaguggagguggaggccuggcugucucugauagguagugccaccacugcugauucgugcuugcuauaccgacuuugccaaacuauacugcugguguauccgugaaguguuugugagugagucaagcugcccuguuaaccuguaaacugaacugcugauugcuagacaacacaaaagggacuuguuccaaagaaccauuucuaaacagauguacuucccccguaucccuuuccacuauaucugguggguagagggcuaaaagggagguuaaagcauuuaagaaccaucauuaaaaguaagccugggggggggggagggggagaaugagugucacaacuaaaagucaaaauauuacaacagaccucgcuuauaaauagacuuuugcuugaaaauaaacaacaaugaagacuuguguugggcaaauuuaccuucagguuugcuucccaucuuuucuaucagaccuugggccucacuauacacaguaaauaccuucccuuggcaagugaaaaucucaacuacuagccgcauugaauagcagccuucuaagccagaagugccguaaacguccaguaugugaugcaugacaggacuuaggaccagcgauaguguauggaccauaugaugcugguucuuacacacagaucuggggaugaaaaaccuaaguagaagcagucuuguucuaagcaucagcacugaagccuauagggagaugucaaucaacugcuaccaaguucuagcucugacuaauuacauagcccuccucugauucuuucucuuugagacuucugcaaagacacgauuuagccaccugaugguuuuucagcuguauauauuuuauuuuggccaauacauacuuacaaggaaauauuucaaauguggauacaauguuuaucaaguagacuauaucucuacucacacuuuaccuagagcuauaugaauaggaaauccuguacuacuuguggucaguuguguacagauuucaucagcaaacacgucacuauggccacgguucccaaggugaaagcaauauaugcucaaauggguguggcauacccagugaggguucuugccacacauuauucugagaagcgcauguacacauucauguaaagauaccaagagaccagugaccaacucagacaggacugaagugaaucuggguuuucacuuaagcaacaaucuguggccuuaggacgucaccuuucuauguguaccagagucacagggaaugcuucaggaugaggacgugaaacauuuuuuuuuuacaugagcagaacaaauauuuacauuuuaucccuugguuuaauucuuuccaaagcuucauaacauuggcucaucggcuguuccccugcguuuauaacucucaugguauuguauuuuuaccacaggggcacuggguguagcagaaacugccuugugggcacaagaaagacucagagcgaauacgggaguccaugugaaaauuggugaucacuuaaaaacagcauuccuguccauuguuccagucgcuuucuguuaccuuaucucucuuaggguaagccaagauuauuucuucuccgggguuguaaagaauacucaaagguuucuguuuccagcuaugugcuugauaagaacagggagacuauccuucucaaguaacuuagagucaggcacuaucaaagaugccucccuuuucauggcccccagccauaccaaaaccaaaaagcaaaacaaaaaccacuuuuucaaauugccauuccuuuggcaacaaaggcucucagaaacacagugcuggggggggggggggguggggugggggcuauaauuuugaaagggauauaacaacacucuauuuuguguuagggggcaauuugaagucaaaagugauaagagcagugaagucuuuacugccagcuagcauccagcuaagcauuguaagugcagagcgaaggcuuguguuuaguuuguaaaguacaaacaagauaaacgcgacuccaccuccugugacaacuuccuugcucucuacaacaugccugccucccucccacaauaaauacaagagcuaaagaaugcccggcguaaaaaaauaauaacauuaaaaucaaaaugcaaagaacuugucgauauuaacaaagcugugcaacgauauaaaauaaaccccgacuuagggauauauaagauuuucgcagugggagccaauggagaaaagaaagcacagaauucacucuuaggccauuaccaauugcagcugaacuuggccugaccucgggcucuuccuagaacauucuaaaggcaacagcucaaaacgcaagggggauuucugagccaggcagcucgguucacuuccuggugcucgaauagcacauuccugagaggaguaacauaggcuugucccacugggcuccaggauugcacaaacacaguggccagccauacuuccugaaugaagcacccaaucagcuacuuuguuuuguuuuaguucuugcagcugagaugccuucagcugcacaaagggauucucaagagauuuccacuccuaaccuaacacuugaagugaaagaaaggcuagugaacuagugaacagaaaauacuuucaggaugaugcgggaaaccaaccgcugacagauaagccaaacucaaacucggugcugauggcuacggagcccuugccacuuccaguagacaggacagaauugucucggucggucggaggcgaaguuucagggaaguucugguuuggugacuuaggaucauguaaacauuuccaaggcaguaagcauagccacagaaaaggacuguggggagauccaacccagugguacaggcucagacaaggcucaccucagaacagaaagugcugaaagaauaaagaaagguaggaugguggugucucauuggacacaccacaggacgggggcacuuguauggauuaggcacggugaugacugcagcagcuaagaagcacaggagagugugggaaggagucacgacaucucaggacgagcagcuaggcagccuugaguauauacuaaaugaagacacauggaacuacugcccuagccaaaaaccagaagagaaggacgcucauugguguaagaggaugagcccgccccuucucagccccuacaaaagugaauuguauugcaggagaaggaacguaagaaaggaaacuggcagacacaacugcuccuagguauaguagaggagaaaguuuacuguaaauaugagggagagcauagccagagauggaaacaucugggacagcccagaguaaagaugaggccggcagugugaggagagccauaaagggagagggaagaucaggacaacaaaaggacaggaggccacaaaaggaccauuggaucauacagaaaagagccagaggagaaggguagcccagccuuuggacuggagaguucagggggagggguaugccagccauauccuaugacaggcggggggugggggggaggaggagaaggaacuccacugucaccauguacgcccuguucuccagggauguucugacagaucuauagaggcuaaguccugaaauggagauggagaugugauauggggcucaagcuacaucguucucuggaguauaagaggugauaggaagauuuaaguccuacuacacaaucuauccagagaguguucacacacacacacacacacacacacacacacacacacacacacacaccacacugauacugauacagccacuuuuguuugaauaaaccaaucaaaaugcacauagcugugauuuuuaaaaugauggcaccauguauuacgauggcuccuucuuuccuggggcuauucucuacaugauucuauaucauucuaaguaaaaaaaaaauggaggcaguaauuagcaagagcauccuucucagacccucaggaagauggcuuuucaguucucacaaacacucgguuuuacacccacaguguaguuuucagugaaggcuuaccacugcuuccacauguguaguucaaccaugcaguggcucuccacuggcuaacucacaugguucugaagucauuuugcuuccagaauuguuuccaugugcaaauccaaggucauugggauaguuggucaucacaauauggguggcccugcuuguaccuaccaugaagacgucagggaucccccacaggccaccuucucccaggaaacccuuccaaauagagaauuaagaaguacuuggcuggaaaaucucaacaguguguucguugaaauucugaacuaagcuuuuaaaucuuuaggagaaaacucauuuauuauuuaccucuguguuucuaagagaauacaucaaaauuggccuugagucuuagguagagugguaaggcucguguaaagcaugcaugaaauaaauccuggucaauuuccaacaagaaaaccaaauaccaacauguacucaaacagagguugagcccacgagucucugcuucucauacauaccaaaauaauuaauuaaucaaaagacaaaaugugacguuauaaccgugaauccuacaauacaauacaaagggggauaaaacauuacaaauauauuaggaugaagccccacucugacuccaaugauccaaauucacagguuaaaaagccagguaaucucuucagugugugaucacacaggauaggccauaauuacguuauauacaguaacggacacaccccuuuauuguguucauucugugaagaucaacuuauaauuuaucagucaagaacaggugcaggcgaucuuaaccacccuacauaacuguaggcgaugggcuggucucugcuucugagcacauccacgggaucucauucuaguguccuuccugguuccaagaucaacacagccagcuggagucuucuuugucacuaaagacuuccaaauagucauuguuucuuuaagugccuuagaccaacucagagaagcgacgucacuggaaacuauuugaauaaugucuugacuguucugggauaacaaccauaugcacacauaccauuuguaucauuugauuacccaaugcaaaacccuuaugaacacuuaugaauuaaaaaauguuuccagaaacuuccccaugucuugcaucuuuagucaagucuaauccaucacugccuauaucuagaaaauucagaguauugguucagaguugcucuagggacuggaaaacaaaacaaaucacagaagagauggguauguuuguaucaugagaaaagguccuauuuagaauuuagcauuuauaacuuugaagagagagccuuuugauucucucucuuucucucucucuccuucuuucuuucuuucuuucuuucuuucuuucuuucuuucuuaaaagaauuauuuauauauauuuaaguugaaaauauaaucauaaaaauugauuaaauuuuccuucucuauuuaauguauguauguauguacauauguaugcaugcauguauauacauacauacagauagauagauagauagauagauagauguagauagauacauagauacauaaauacauagaugcauagauacauagauauauagauagauacauagauaaauagguacauagguacauagauaaaucuuaaaaauauguaauuuguaguuuuaaagcauguugagaaaugacagacuaaaugaugacauauuaaaagucuuaaggaucaaaaaaaaaaaaaaagaauuauuuauuuauuuuauguguaugaguacacuguaacugucuucagucacaccagaagagggcaucggaucccauuacagaugguugugagccaccaugugguugcuaggaauugaacucuggaccucuggaagagcagucagugcucuuaaccucugagccaaucauccaguccaaccaagccuuuugauuuucauccuuaguuccucucucuaaaauaguucucaauaccugaccuuaaauuacaauucaguaauacacaggagauguauagugagcauuuaaaaaagcuacccagauugaccaagcuugcauucaacaggaagaagaaaaaaaagaaguguaugcaggcacaagaaauuuccugacccaucuacagacaacagagccacugaagccuccuggacgcuacccacacaaagauguuugcuguguacccagggagccggagaggagauuuucugcuccacagaaaaugcugacuguauaagcagauaugacacacugcuuuaaggaaugucuuaugccacuugaaauagacaaucuuuccucauuuaucugcaagaugucugccugccaaguugucuccaggagacaaacgaguaaggacacugcagcucauaugucgucacucccggcuacgaagcgacaagugcaguguguguggcagagcugacucaccaaggccgugugguauuuuaaaccaucuccgagcccuuaauucacaguugaacggcaaagugagcucugguggcuaauacgugguugaugaacucccauucuugacagcuuauucgcagugaaucacuaauucuaaaugagaugaaggagcacaguucaaacuguuaaggcugucuugguucaucuagguagcuacagcagucaauuuuuguccuaggucugggcacgguagccacuggugucuguaguuuugaaacugaggcaggagggcauggauucaaggcuaacauaccaagauucugaaaauaauagaauaaagaaaaauuguuucuuauaaagaacuucuguuauggacccauuuuuuuuuaguauaaacuuauuaaugcuaaauugcuaaaucuaucauuaggugguuaucuauacugagaacagccaagugguauuggaaaauuuuaaaaguaugacuauagaccuuacuuaauuccuaaaugaauguucucaaaaaaugguuucuagaaaaugccauuucaaggaguggggacgcauucuguuuacaaacacggggagaagcuccuucauuaggugucuggagaguagaagcguugggucacuuuaaccaagcuuucucaaaugcauucgccuaggagguccauuuacacaguagggcagagcccacccagaccccuccguuacauguuccuuuuauaaagagacaaguuuaaagaguuuuagaagguaucuuuuauguacacauauaucuugcuaccauacagagcaacaaguuuuuaagaaguugaaauaauagccauacuuaaagcaaacaucgggcuacgacgugcuaggacguuugaaacgggugaccaaucguaacuuacgggcuacggcgugcuaggacguuugaaacgggugaccaaucguaacuuaacuaguauuuaaguaaaguauauaaaaccaaaagaauccuuccagggaacagaaguggugagugcuauuauaaaacuccugcagagccaccaugccaaacgaggagaggagacaggaaguaagcaggcugagaaaaucugagguugcaaaggccugugguauuucagaggucaaucgcaagaauuucaaauguguauguaaauaaaauucaggaacuuacaaggacaaaaaacaaaacaaaacaaaacaaaaaaacccucgauauuuauuuauuuauuuauuuauuuauuuauuauuuggcugggucuguuuugccuuuuagacaauacagguaaaaugaacaaagauaguuuguuuaaaguuccagcgagaccggauggcacacagaugucagcacucagaaggcugagggucagaaagaacguugaauuugaggcuggguuggucuguauagaaagacacugccuccccucuccaaaaaaaaaaaaguuuucauuuuacaaaauaaauauaaaaugacugaugauagaugcauauauucaaaccccaucucuagguuccaaaaugacacuugcaaaauuuaacaaaauggcaucaaggaaagaggauuagugaaugagaacaagaagagaaagggcaggagcucagaugccagaaucugcugaagugcacuccugcggggagggacgagcuggugcuuugcaucccgaacacagagcacuagguccuucugauuucacaguagagaacacaaaucaccuccugucucacacuguguaagggaggucagccugacuccugaaugccaggcuccuuuuauaaagagaaggcuucagagagcuuuacaaaguagcguugcguguuacgcauguccugcagcagcuaaguaaaaagaugacguaauggccagaaucuuacuauuugguaaauaccgcuaugcuaauggguaccacaugacauggugaauaccauaccaaggccaaccggcuaaacuuccccuuagaaagaaggacagagugaaaugcaggaaaucuccaccccuaggagcaggcagagcgccucucugucuuguuuaaaacacaggauacacacugcuguuuaaugcauggaaaagauuggggaugguggcauuucauauggucacaaaggauaucgagccaaauguuguaaaaagucaugugaaagacagacacauuauuugaggaccacagaguuucuuuccauuuaccuggcacugacuugcaaaagacaagaaaugacuaauuaagaggcucauggcuagugaagacuccaucucacauucuuagcaucccuuaguugucuacaguuauuugucuaaagaugggaccucugugaaauuucugccuuccaccuuaucaugucuaguggccguaucccuguucaggugaccauacuguugacauuuccuggguguagcuucucuguuaguucuaggagacacaaucucaccucacgcuuuugguccucuggcucuuacugucuuucuagccacuguuccaagagguuccuugagccuugggggcaagauauguauuauguuguagauggguccauuagagcugagcccuccaugaucacuuguuuucugccuuuuagccaagugugauuuucuauaauugucugcagagaaaaacuucucugaugagaaaugagagccacucucaauggugguacacuuaugugugugcaguccugggccauagcccuagaaccaacaaaacaaaacaaaacaaaacaaaacaaaacaaaacaaaacaaaacaaaacaaaacaaagaagaaggauagaaggaaccagagagauaaaggacaccacaagaaaacuuauagaaucaacuagccuagguccauaagggccuacaaagacugaccaaacagagagcaugcauuggacugaccuagcccugcuccauguauguaacagauguacagcuuggucuucaugugggacucuuaacagcaggaacaggggcugucucugacucuacucucugccuucggaucccuuuccccuaacugggcugcccugucuaaccucaauaggagaagauccaucuagucuuacugcaacuugacaugccaagguggguugauauccauaggaggccuccccucuuuugaggagaaagggaggacaggagaaucauggggauaggagggaaggggggaggggaggggaggagaggagaggacaggaagguagccacaauuaggauguaaagcaaauaaauuaauuaauaaagaaaauacagaacaggugagaugacaaagucaaggggaugcugcucccuccguugcuugguaacagaacuuaaguacaggcccuagguuugauccccagcggaguguggaauggggugacugaagggaaagaaggaaacgaagaggaaaauuaggaaaggaauuuuuccuguagaaaaaaaaaaagcaagaggcuggcacagugcugggcauguuccuggaaucacagcacuguacuguggagguuaaggaaagcagggggaugaggaaagggcuagcaugggcuacauagcaagagccuuugaaagaaaagagagaggggagugaugggaauggagccgaggaggagagaauggaagaaugaaaagggggccagagagggaggagacacaaggaagaucaagggaggggagaaaaaagaagagggaggcacuccccacuccuuuagaaaagcuugcccaacacaagugugucuuggagcugacuauaacaacacacguaaacuaauaacccuucuuucacuuuaagauagacguucaguaaauagcccaggcuagaaccgaacccccaauccuucugccucagacuccccagugcuggcauuacagacaugaccacuacguccagcauaaugucuucuuuaacacuuggaaaguucugagaaucaaagucaagguccucccugaguuuuauacaacugggaacuccgaauaucuguucuagguauucugacuucacuaaaauauuccaaacuauuaagauauguauacagaaaugacucagcugcuuggccaagacuacgcugaaggcuaauuccugucuccauauucauucgagucuggacagcacaaguaugugaacuuaaaacacccaaacagagacuucaccuugauugagcaauucuuauuuuuaguagcagucccccucccuuccuuccucaccaucauaggaaacaacaaaucugaagccugggguggggguaagggggacccugcuuaagcagcuaaaaccaucccuuagaugggaauuuacuaccaaaaagaaacucugguuuccccuuugaguacaccuaucuuggggcaauaaaaauuuacgucaucaauaaaacagugaaaggguccaugaaauagaauacugcacuauuuaccaaugccacggcuuacuagcaaaaauauaacaguauuccaguucauggggauucuuaucaacuucuuaaagacaccagggcagaaagcaguguguucagcaaggcauuuaaauacgucgacuccuuuuuucuaagagaaaauugacaaacuagcauuauuaguuuugucuguaccuaaaucauuauggaaaaaagaaaguaccuauuaugguauguacaacuguaaguaugaagggacaauauuuuauacaagccaaaaggaaugauaaacuagagaaaaagcccuaaucaaagcaagccccucugaaucgaaaagcaauucaauggccauggacuuaauauugucaccaaauucaagucaucuuaaagauccaacagcucuccuaaggggagcagaagcaacauaaacacgaucuauaauuaugaccuugagaugaaacgacauccaggucuggguuaucaaaaaucugaugcgacgagccacuaaaggaaggcuucuucuugcaagcagggacauuuagaaaggaaucucaucaagauaagacauuauaucaucauaaaaaaaaaacuaugcuugacauaugauauuuaaggaacaucaaagaagcuuccauuuaaagggaacagagaaguuauuagcaaugccacaugcucauguucugaauaaaguucaggcugaaauauauaccuuaguuagacauugcagcaagucguucauucaugacaaaaaaaaaaaaagacaaaacaaaaaaaccuacaaaaagaacauuguccuaauauaaugaauuagauuaucuggauguauaaaauauucuuuucaaaaguuauuaucaguucuuccuuacauuuauagacucggucccccauuguucauuucccacaggccugcuaugcaauugugcuuucugccugacuuguucagcaucuccauauuuacucauuucuauaaguacggaauccucuggcuuagugcuuacccaaagagcacauaaacacuggguuauuccuauucuguuugaagggggaaagcagcacuaaauuaggccacagcgcaaaguucuuugcauugaaucuucaaaccacuucuaagagaaauaagcuguggugacucagaaaagaucccucccuuuagugucucuaccuaauuuuaaauauuugugcagugacccuaaggauugccugacgucaagaacaguaaaauagauagguaacugguccuccuacuucaaucuaaucuacaauagacguucacuauauuucauugcugaaacccaacucaagaaaagguuguaacuuacuggcagccuagaaagagagaaccuauucacacauucaguuauuauuaccacucuagcugggauuuucaugucagcaacugacguaauuguuuguguaaugcuagauccagauugcuuuucagugugcuaauugcuuguuauguaugauuagucaggggacguaucaguagacucaucuaaucaguaacagauuagagacuccaucuuguuacacauauuuuggacuaaagcaacuaauuaagcauuaaaauaagagaaaaaccaaccauaacuaguaagagaaagcuuucaccacccaguaggaucugguugacuauguauuaaauagauaacucauaauaaauuucccuuccugucccucaucagaacuuuaacuuaguguugaccuugacuuugaacaugaaaagcggaaguuucugucucuaauccacugacuuggagucacacggcagggaucuuucaaaugcagugaagacaggacugagcaggugucugcccauccuuuguuuuguuauaccuuugcuucugcuuuuuguuuuauucuauauuucauaggaacuuccaaaguauuaguguuuagcaguuaagaggcaacuggccagguucuaauaaaacuggcagggaaaaaaaaucccacuugaaacuugaaucuacagggguacacacuguauaaaauccugucuucucaugacaacucgcugaagauaggugcuuacccuguggacuuagaacaacaaugugugacagacuuaagggcaaguguccaauagcauucaaucaugcuucaucuuccagcuuguccacccagccugcguggugagguuggcaauguuuuccuccaccucaucacuacaacuacuacuaucaucaccgauccucaguagccuuccuuggauucuuucuuccauggauuuuucaggcauuauaacaggaagcauaauuauuuucuuuuauaaaacaauaugcucuucauacuaaguuucucugugauuccaggggaacacagucacuugucuccguuggguccccacacaacaggggugauuaucuccugugacucagaucuauugugaauaaaucagaaugcaaacugagaauacauuuuuuuuaacccaggauuuuauaaagauuccucuaaaacuauaacugaccauuuuucucagagucaagauaauucgacauuucauaaacccuucaagucugacgcacucaguggacucagaguaaaaauggacugcccuucguucacuaagauuauugcuaggaaucagccuaccuuagcauuccaucaggccucccugaccggacugcaaugcuuagcuccaaaguuuuaaagaccuuugcacucaugcuuccaagguguagucaggaagagauaucccuuauuagaacuaaucucuguguauaaucacuuaguaagccagggauaaagccaagauuagccuaccucgagauccuagcuucucaugaagguggagcuggcuaauacgauuaccuguagaggcuuccaacuucuuacucaggaauuaaaaaucugaccaaacuacuaggaaguucaaguugaaaaccagacauaaauaugaaugccuuaugaccuuugugacuuagagguaaauuagaggcgauaaccucuauucacuaagccaucucacccucuuccuuuuaaagacagaaucuaagcccaggcuagccuuaaacuugugauucccccugccuccagcaucaagaacaacaauuucucuuucugcuaaaagacuucuuuauuuuuuucugucucucuguccauccgucugucugucugucugucugucugucuguauguauguaugcaugugaguagaugcauacuuuauuuguaugacuguuggugugaguacaugcauacuuuauucgugucuguuugucugucugucugugugaguacaugcauccaugugcucuguaggucccuccuccuccaccauucugccuauuccuuugaggcacuguccuuucuuggcucugagacuuuuuaugugcugggggugggggugggguggagagaagaaugcucacuggucuucuugccucugacccuuagaauugaaguuacagcuauggguguaagcccgggcugugaaaugaacugggauccaaacucugcuccuccugacuaugcgaagagcgaccuuaacuguuaagcuaucuccucagcccccaccauuucugccuucacaugcccuuuaugcccuuccugcucccccugcccccgcccccaccaaugucgaggaauaaacugagggcaccgcuagccaagugaucugaacggugcuacaauccccagcccuaauccaauuacacgcgucuuugacuuuuuuccaaccaaauuuucauuuuuccauuuucuuugccagguaccaggauaaaauggaaaaaaaaaauagagaaggguauccauuuuacucagcaacuucauucuuuggccguaacuacccuccuuuguccggauggcgagucuuccauaagagggcaagugcaagcgcuuggcuggaagacaugaaaaguacaagugccccuccccccgcaaccccucugcuuuucuccuuuccugucuuuagcucuaccaagucagaggcacgucgcauaugccucaccaugaaggcagaggcuuugauggcgaaaucuggauuaacuuuugagaaagaguuccacgcuggugaucuuucccuugcaggucuuccugucuuugggcguguguccuuaaugaagacguggagacuccaaucuuugcuucuucuuucuacccagucauagccaugaggugaaugagccaugcgcucccaccaugcugugcugccuugccacaggucaaaaggucucccagggaucaccgaucacggaacagaaaacuaaggcagugagaaauguguaaccacuaggcuccauccuaaagccaugaggaucuagggaaagcuguuuuucauuuaaguaaaucacguagguucucaauaagguuacuguugaaaaaauugaaauuugauguauaaaacagaagucuggucucuauaacucaucuuuaguaucuacacagauuugacuuauaaguaaguacaaaaaaaauggcauuuuaaauagcugcucauuuaucucuauccaccauauauauauaaucccugcuuuccuucccagaaaguaaaguggugacaaacgcagaugaacugucugaucaacgacacuggaccuaaggcuggcuugguggcuugcuuucuuccuuuccuuuugcuugcuucuuuuucucuuucucuuucucuuucuuuuucuuuugauuuuuuuuuuuuuuuuggagggggauuucucuuuguaacagcccuagcuguauuggaccuuguuuuguagaccaggccggccucaaacucaaagagauccaccugccucugucuccugagugcuaggauuaaagucaugugucaguaugccuggcugguuuggugguuucugaaaacauaaaacugguuucaaagcuauuguuaggccuuggcccuaacuucaaggccagucagcuuaucucuucaucuucaaaucuggguuuauuuuuuuaaaaaauggugcuccaaaaugaaagcacagacuagggggccuuuggaacacuggauuucaagcuguguucuaggaaaccuuggcucuuuuccuggugucccaagguaagccaaauaaagaaauugauacaaguuucaauaaaaacaaagagggcuuuaaaauuuacuuuauaauguguuuuuuuaaucuaaucucuauuuuucuugaaaaaaacacaaugacuuuuaaaaacuaaaugaaacccuuuuucccccuuuuauuuugacugcuaagaguucugauugguggcagggaagauaacucaggugaaaguacuuagcaacaccccuaguaaccugagcugcaugggaacaugaguuccaaccugggauaacaugucagaaggagacaaucaauuuucaaacguugucuucucaucccuaaagcucuaccagggcauguucucacgaaugccacacuaauaauuacauuuuuaauugaaguguucugaaagaagcccacacuggaggucaggauaccugguaagaacagaaacuuaacaccaaaucaggaauagcugcaggagccacaagcuccuucggaaauccuagaccguuguuuuucuaaagccaugacgaugugcuucuaaaauucaguauuuacagcuuggaguuuuuaaaaagggccuacauagcaacaacauaaaccucucuggucaccaucccagagauacaaaagauaggaguccuauuucugucccuucccuuaguggaucugagucacagcuaccccagugaccuuccugaugacagcagauacauguuugucccauaaacagauggcuuccuaguaaacucgggcgaccccuaagcugcaguuaucugauaaguacuucugugcaucuaagggauaguuuuaaaauuaguaacaaaauguauguugguaucuaguggccuguuuuccuaauucuauuggucuaauuuuuaugugagaguuuuuuguuuguuuguuuguuuguguuuguuuguugcagguuuuaaaacagucucagguagcuagcccaggguucucuggaauuuuguaccuagcagaggaugaccuggaacuccugauuuugacuuuccagguacuggggugacaggugugcccacugugccugggcugcuugaagcuuuuuuaauuuaaguuucuaaaaaucuuuuuuaggaacauggcagucauauaaguaaguuugcaaccgcaguccuuggucuuggguuugcaucagaaacaacaauaggucuuggcccacacccagacuaggaaaacuaaucuuuucauaccaugggcagucucacaaauuaucugguucugcaaucacauuuagaaaaacaagcaaacaaacaaaagccucaguaugcauuucaugaggaaucucucaauaaaaagauauuucagucuugggauagcucucacugguacaguacuuuuuacuuaguacacaaggcucuggucugagccccagcucaggagaaaaaaaaaaaguucaagcaaaaggaguuauaagcacugugaggaucauguugaauaggguaccaaaugaaauaguagccacaucguuuauaaacuccaucucuauuuuugaugauuuuauuuugaggguucuugagacaccguuucaugucaccuggccuggccuggaacaucuguagcugagucuguuuugaacucuggauccuucugcagccucuucccaaggcuucccaaucgggaaucggggcaccaccacagucccaaagaugcuacuuugguuuuauaaaaaacacacuuugcaaaaagaagauaagaggagagaaguuccccuuaccauggaggaacugaaaguaacacucacuucacagaauucccccagauaaacugagugacagccagucaucuaacugguccaggcaagcccucuaaccgguccagaagaguuggcuccagucauuugaguuacaucagcagcuguggaauguucccugagaucaacagacacugaccagagucugguccaggccagagcuuccaucccacggugagugagucaacuauuagccagcgagagcuagccaucuuccagcaggcccagcaaggccauggccugccuauacacauagacugugcaaaccucugagccaaacaugcagcaacuauagucgagggagcuuugucuugggaacagagaggcaguuuccuucuuguaaaaggcaaagccuggucuccggauguggggagaagaacuguuggccuggguccauguaaggcucaaaguccaccgcuucuacacuaggcucugacaaaacagauggagucaagagaaaagaauucagauuuagacagacaacagagcuacagaaucuggauuagaauuaguagaguauaaguggugguccaggugggaaaucuauuacucaaugauagcuaaucagcaagguuaaaagguugguugguugguuuuauguaggguacggaugucaacuccuagacuucccauuaaacucuacaaucuauuuugauggcaaccaguacugcauacaucaugccuaggaucuaauaaacacauaauacaaagacauggaacucugaugggacagaaaagcagcagaguguuacuaaaacggggagaaaguaucugucaucagccguuacaugguggcuaugguguccauucauauggugucacauagucauuaugugagcuuuggggguuuguauguugcuacaaagcaaccuugauggugauuuguuucuuuuacugugggauaaacacugauccugaagacagaggguuaaggacauuccauggugucccucagaaacacagcugcaugcaucaacagagagccacugagaacaucuggcagaggaaggggagaggagccagucaugagcacuggcuuacagcagcaucaguaaugacaaaugcuuacugaagccuacacgauauucuuacuguaacccuccagguuagggacuucacuucucuuuacaaaugaagugcaagguggguuugugaaaaagaaguagcaaauaaaaguuaucuuauccaacaugcacgagauaauguuuugauauauauauauauauauauauauauauauauauauauauauacacacacauauauauacauacauauauauauacacauauauauaauuuuaaguaauuaaauaacaauuaacuaaugaaguuaccuaucaccacacauacuguucuauaugugugugaacacuuaaaaccuauuucaagaauauaacacuuauuauuaacuacagugacaauaucuauacuccagcucucuaugauguacccaugucuaacugcgaauuccuacccuuugaacaacaucucccauuuaccccauccacuggcaucuagugucuacucuugcaaguucaacugcuucgauuccauuugggaggucaugggaugcucaucucucugggucauuucacuuccuuuagguaacagcuuagacucgcaccucuaccuuauuauuuacuacaaggguggguaaaugauauagucucacugaaucuaauuuuacuugaauugcacuuugaaauaggauuugcucucggccuuucucgaucucugaacagcaucagaucaauaccuggaucuuuguauugugcauaucuuugucaacuagagagaauguucuucugguuucauaguacauuaucuauaauacauucucaauuuucuguaacucagaaugucacuggacaaauaccuuuaucuuaagcaaagagcauuuuauuacaauaucccguaagcaaaauguuacuaaaauuucaguuuuugguucaggggaggccaggcuuagcuuccuauuucaaagucaguuauaauuuuaauuuauaaagaaaacaucaaauagcugaagacuaaugucuuauucuggcuaguucuuuacaacggcuuucugguuuggaauacagaaaguagaaccaacuucacuauauaauacagagggacaggauggcaguuucauuaagcggcgaaggauuauguccuggucaggccgaggccacugguuuuaaauauagcacacuaauuugggacauaaacauuccacuuuugcuucagcuucucggggagauaugacuucuucaaggggaagucuuuuaaauggcuugacaauuuauuagaaacgagcggcgaagggcaucuguuuucacagggcaacuguucaauuaaucugcguuaauacagccucaaagcgcuuggauccagcaacaggaugugggugucacaggaucacacagccgaacauaugauagggccugacacaugcagggucagggcaaagcaauggcgagaagagaaggcuuguuccucuagagucuaaacagcaaaacccuccugcagccuggggcuugucucgaaaacauuuaacccaacccagguugauacuuccauucuaaaaaaaaaaaagaaaagaaaaggaaaggaaaggaaaggaaaggaaaggaaaggaaaggaaagaaaagaaaagaaaagaaaagaaaagaaaagaaaagaaaagaaaagaaaagaaaagaaaagaaaagaaaaaacaaaacaccucuccuagaccagagacuagguggugcuguguucaacucggguuuugugaauucaugaaauaucagagucaccugaaaccauacaaaguacaagacgguuuucuuugugaaucuauuuucuagggaccuaggcagagaaauauaaaguguugauggugagcggaugcuaugcacaccuacaggacagucacacagaacuaauccuggcagacagaagucacugcuaccugaggcaggagcacggcccacccacuccagaagccugggcagagacuacaaaccacaugaccuaucagaagaucucucaauuaucccugcccgguaugcuuugauaugugauaaacaacccuuuguuuucagagggguuaguggagcccuuugaaagcaagcagccuggaauuccguggcucucucuagcugguucaagcagccaaggcugucaccggcgccuggucaacuguggagaaucagagggaaggacagggaaaugguccucguugugaccagcaugcuuuagauuccuuccuaagcugguuuuguaggguucaagaaggucaagaacugcaaggauggauaagcaaggaaagaaaggcccugcggaaaaucuuaacaaccuggucucagguacagucagggagggaauucgccuagaacggaagccuuccggcuguuugacagcagcugaaacagaagacaagaaccuugggcaaaugggcucuucucagccccugcauuuguaaaaaggggacgcagcacuggccuguacagucaggacuguauagaaaggucagaaaagagcuguuacgaaggggccaagaaaugacaagaagagccauguuaauccuucauucaguaccuuccacauguuaucuuuguaguucuuauuaauucagcauggcuccuaacagcacuauuaacaaauacucuguagauauggaaauggaagcuuaagaaaguuaauaauuccucuacagccgcguuucuacugggcugugccaagucaggacccaaauucauaaucuggaucuugcaugaucugcagacccauguucugagugacccccagaucuucugaggguucccuuauuuggagcugugauaaagagaaggagacuccaaccagcuccucaugcuguggugagccaaccgucaaguuauuuuccuugccgcuuccuaacuaugauuuugcaaauguuaugaaucauaacguaagugucuguacuuccccgauguucuuaggcaaccccugcaaaaaaaaaaaaaaaaaaaucucuugcccaaccuucaauggggucacaacccacagguugagaaccgcugacuuagacgacuaggaaaaaggugaugcgagcagagagaggcagagaagacaccaaggagcgagugugaguggaggugggaggaggucuuacuccucagcaucccuccugcugcagggaggguccagagcaguugagaacuggcugauggcuuaacaaacucccagucugccuucuuaucaguccaucccaccccaaggcugucuuccucaaggagaggaugucuggcccgacaggacccacuagcucagucccacccaucauucacguaggcagugcagagguggcucaggaggcaccaaggacagauuguucaugugguccaaucuuaaauucccauucagcgggggauuacaugaaacacacuucugggcacaacugacuucuagaaggucuaucugcuauuaauuaccauuguucucaccacggauaaggggcuucuuuacacagucaguauuuucacauguaccauaaagaauaauggucuucccaaaacuaacaaaucacaccucugacaugacagaucagcugacuuuuaaugcaaauucuuuccuuuuccuauuccccccagagacucugaaauggcuauaagauaguccaguauuccucacuauccuaaauguugacaugcaaagggaaggcuaaugauucacagucuaagagaccuggagcugcuaagagcagcuacugguggcaaagaaaaaaaagauggaagaaaccagggguuugcuucuguagacuaaggucagugccauguccacgggaucagugauaaacuccuuccugauacagcucacaccaucaaagauggaaauugauccacauguaggcagagaggaguggguaaaagccucaagugucugcuauuucuccguugccuucgggucaaaagaauccauacagcaaagugccuggucucuguucccaugaacacucguacugacucugacuugucucuugagcccuucacuugcuuacguagcgccccuccccuccacagacuaauccccagugucacaggauauaucgauuggugaguuuggcuugcuaucuacucaguagugcagaaguuuggagagaucaggcauuucaugucuuuucauuuuuccccccaugguugaauaugaguucuucuucacguagaguuggggcucaacaaaugacuuugccucuuacacugaagucaucuuuuauaauuccuguucugcugaugguauggaacuucaguuuuauuaauuuaucuaucgugugcuguacuggcauuuauucacuauauguuuauaguauuaucuuauuaaaaaugaacauggaccuggggguguagcucaguggcagaacacaacuacaguauccagcagaauaaauaaguaaacaacaacacgcaguaguauaaagcugggcauguaggcagccccuuaauaaagcugacgugggucuggcuaagugggcuccagauucuacacggugaccucugaaaagagcauuucaccucauuguugaauuuaaagauaaauauaguacucuuugguggcuuucgagucuuaccuuugggaacucccgagaauuaauaguuauaauuuucucuuuauccacauaauaccaagagagacauuagcagcaaggaaacgaggaagaggauguucuauuuacauuugugaaaucauacaacccaauccuguucccacugaguugcuccaguaagcugauggcacaauaucacuaacguguaugccgaaggcgcagcuagguuugccugucaagucuaacagcuucuuacagacaaacuucuaccuucacgagugccgauagagcuguuaagugggggguaucgcuucuuucaaucagcagaccagauuuuuugcuugcuuuuuuugggggguuggcagggggauuuauaaaucccuguugaucuguaugauaucuguucaucucauuuuuuuaagcacauauuauagcgaagugugagcgcagcagcaguuuagaucacucgacaaaugaguaucaccacuuacuuagcacauagacgucccccucuguuaaaauauuaaauaacuaacaagcaaacaaacaaagcaaagccccacacguacaagugaguagcucugguugcuuuaaacaaaugaaugcacccuuuaaauguuauaauuacaaagaauuuaugagggauggaauuuaaccauaaaaagaacaaaccagauaugaaauggaaucuauggcauaauuacaaaaaugcuuuuaaauaugauguaacaacaacaacaacaacaaaagcaaucguggauagaacacaagcacuuauacacuuuuucucacuuucccacaaugaacuuacgacuauuuuuuauucucccaggguacuagagaucuuaaauggaaggccucacgaaugcuaagcaaaugcccugucucuccacuauaaccucugcccucuuuuuuuuuuuuuaacuuucugauucugagacacgguuuugcugcacugcccucacuggcuguccacacuccgaccgaagcagacuggguccucaaaccuuccguaucacccucuaaagaagcggggaggccucagccagccuaacuuggauuugcauccuuuccgaaucaauccaccuuaaacauauuucagaaugacucccaugagcaucuuauagcucaaaacuuuuguuucaaaugcuaauguguacuaugcaaacuaccaaggugggggagguagggggcugacuuaaaaccguacauuaagaauuuaaauauuuguguaugaaggccaaaggaaauaaaggaaucucuuuuuuuuuuucuuuuccuuuuucaguuugccucuguagcucaaauugcccuggacuggugauccuccugccucuggcugggauuacagacgcaaguuacaguacucagccauaucccuguacuuucaccugauugcuacaagcuauaaaacuucuaaguauagccacauaaagcacuauaggcaaaauccaaugacuggcaccaggaacaaaagcaaacgcaucaaaugaauauccuuacaggucgguaguuccuuuguggguaaagcugggccauggcugggaauuagucccaacccuggaacacaaaaacuuaacucuaaaucuaagaucacugaacuaagucacaugaauaaaggggacucucuuacacgaucuacaacauccgugcugauaaauguuuuaggaaggaugaacaaagcaccuuccagcuaggaaaguccacccgucaagcacgcuuucacaccgaagaacaaauacuuggcagcuccgaacacuccacgggaucacacuaugccuccccugcccgaacccgucauaccaagccaacgaauuuccacaugggcuuacauucugaaaauacuuuacaugccaggaguguacugggauuaacuugucaaaaaucaucacacuuuaaguauaacugagugagaaauaggaguacauucacacacacacacauacacacacacacacacacacacacacacacacacacacacacacacacacguuccuaauacaagaaaaaaauaugaaauauaaaagcuuaacccugccauuuccagagagaguuaagcauuaagauauucaucauguguaggcuuauacauacaacuagacaauaaacuuugcaugggaacagcucaucucccuuccuguaagcaggcagcuagcauuucaaaauuugaagucacauacuccuauaaugcccacagcaacaccaacaagcauaaagucaccccuguccccauuaucaccuccuauuacuaucucauggagaacugucaaugugccugguaguucuaccuacucugcucaaaacaguuuccaccaaaucaaacaguggcuuuacugaguggaccaaauguuuuuaagacuccuggcucaauauuuaaccaacagcaacagucucacagugaguaguugcagcaacacaaaucuaaggaaagaaagaaugaugaaagcaauugaagucagacaaaaggguggggcuucugaugugaauggcuaugggauucuaagcaacccagcaucucuagaucuggucaucuucaccuguaaaaugaaggggcuuaggcaguguuggcagaguccauccucuaaaugugaacauguuuuggaaggcagcgggaagggucagucuuguaaggcuccacuguccaauauggcagcuacuuaugacugaucugaauuaaaauaugcacaacagauaaaacuuuaaagacaugauauaaaaauccauguaauauauuuauuuuguaauuagcuuuauguggauuacauguucaaagacuauuugaacuuacuaaaaaggaaugaauaucuaucuaucuaucuaucuaucuaucuaucuaucuaucuaucuaucaucuaucaucuaucauuuaucaucugauagucugugcuggugauagaacccagaguauuauaaaugcuaaacuugcacucuaccucugacuuuaucuucuuuuacauuuuuauguggcuauuugaaauuucaaauuggauuuaaacaguucuacaauaguuuuauuggacagugcagucuaagagggccaggccagacaacuguagagaucaaaugucuccagggaacacuuacauggaacagugccaucccuggcuccucacaguggacuuggaacuucuauuuccacuuuauaucuaucuaaucuaucuaucuaucuaucuaucuaucuaucuaucuaucuaucuaucuaucuaucuaucuaucuaucuagauauagugugugugugugugugugugugugugcccuaaauacgucuuuagacggguuccuauggcuuucgucugcacuuaagagaaggaaaaacugcaacuaacuuagaaaauaaaacgaagagaaacuauugaggaaccaugauagacauuuauuauuauacagauccaggugcaguaugucacgaaucauugagacauuuuaaaugaaaccuuugccugcauuccaaaugucuauggcagacccuucacacgcucccuaauguugaugaucuugucaagccuucuuagaccuguagguuuuccccacaucuucaucucuaauuuccagggacauagcuucauuuggcuacuucuacaauaacugaaaugauuagacaguagcuacguacuucaaauggauguuaagccggaggccccgcuuucacugaugcgagacauacauucagaguucuuuucuccuuuuacauaaaucuuuccacucuggguaagagagacuaaguauaaacagaugugaaaaagcucugucguggcagaaaagugauuuuauauaaugggcagaucuggcucagacgagguccuaaauacugugcuccuuucuaaaagccucaaagcccauuucgccugcuaguccuuucaaaguaaaaguucaacaacaaaguuucuagaugaaauaaaaguuuaccaauggggaaaggaaacugaugcugucauuucuuuccagaaccugaaauuacuccucccccacccccacccccccaaccccucaguauuuucguuggaaguauuccccaggcaucugaacacacucugaguccaaugagcuugacucuugggcgauuucacauacagacgagaagcauuccccaccuccucuuccaucaucccacaaauauuuuccauguggucagccagcagguaagaaaggugggaggaacauuccaaaacugcccucuaauugcucaggaagaauaaugcguuaauggagaacauguauuggucaucucauuuuccucuccuaccuuuacaauacagaauguuagccuguugccaaguauuugacuccucuguccuuaagaauagagccuguugggcaugguggugcaugccuuuaagugcagaacgugggaagcagaggcaaaaggauuucugugaguugaagacgagaauagucuacauaaugaguuccgggguagccaauacuacauagggaggcccuauuuuaaauaaaucaaaucaaaacaaauaauaacccuaaugauagauccugaaauggcuuuccuggcuacagaauacuuggcuaauaaaacacauuuaccugauucccuugcagcuaggugugacaagcuuaaugacaagcuuaagcagacauuaacaagaucuuucauuaaagcuccuaaaucuagaugaauuauaguuaucagugaccacugcuguuucuagaacauguaaaagugcacuguuguucagaaaaugaaguucagauucaucaagggcuucugaaacccugagucucauauccacauaacaacagcuucuacuuuuuuuauuaauuauuuuauuugucuacauuucaaauaauaucccccuucccaguuaccccuccacacacacccgcaucccaucccacagaugcuaaggcuucuacuuuuaacccuuuacccccuggcuguguguucuucaucucuaggaaccccacucugcucugaccaacuuccauuuacccuugaaguccugcccaaaggcucucagccauaucugugaagaguuuacauaggcuuuuauuguagccuuugacauaguaugcguaauuauuuuccugcauuuuccuucuacauuagacugugaaauugacaagguacagcaggaacuaccucuccauauacagcaucacagagaugacagaaugggcuccuguugaaacauaagccaucuuguacaugcucaggaauuaacuuuuuaaaaaugugaucaaagaaggaaaagcaaugugcaguaaauuaguuauaaaaacaucauaacuuccgaucacuaucagcaucaaugaaaugcucaaauucccuaagagauugugaaguagguauagaaccaugugacaccccaaacccuaaaaucccguuaaaauuucagcauuuaccccagcuccauggcugacaacagaaucagggacuugggacuggauuguauauauucaaacucugauaugaaugagccaaugagcaaugagucaacacgccauuacuucaaaauugcaaacauuuuaauaugugacaauaaacccuuggauauuuuaucgaaugucuguucuucuccaggaaggagguugguaaugacauuuuccucaucuuaucaguuauuuaugaagucaauaaauacaacuaaaaacacacacacauaggagaaauacugucaacccacugaacucuugucaucuguguccuuccaacaugacccucagaaguucacgaaagaaccucugagcccaguucauaaaagcucaacaaugcaacacaaauacaaaggaacagaggaaucugaucccccagucuauauuaaaaucccagaauaguguucugccacaaauagaauaucccuaucaucuucacucaugccaaggcuugggaccaacuacagaaggggaucaaaaggguuuuaauagccagggguuuugaaggaccaaaguuaaauggugcccucuaaacauggcaggccuggugcaaccuuaacacauagcaggcaugaaugcuuguaaaagaagugcacaugaucaagccagucgacauuccaguacuggagggggaggggcggugauccccauuccuggcugaagaguuauugacaguagauggcuucuggaggagggagaguuuguuuucuuuaagggaguggccccuagcaggcagaugacauuccaggggauggccccacauccaugaguauagggcuggcccaaaguguacuugguguuuuuauugcuauaaagaggacauaaaguugggaggggugggaaagaaggggguguagaucugggagaaguuaggagaggaagacauggugaauaugauuaaaaaaaacaaaaacuaaaaacauuguagucagguaugaaauuccccaacaacugguaaaaauauacuaaaaacagaggagcaucugcaaaguaaauaaauaaacuucauauacccucuaggaacccucauccuucauuaucuugguccuggacguuucugacagccauguuaauaaacuacucagugguaggcacaucucuguccauccugcaagcuucccuucaacuauuuaagccauacugaaauugcuuuggcuucccucagggauuccugccucucaucuuucacuaaauaacacuauaguauuaccaauauaguccuguaaguagggcccuuugcaguucgucuacuaacagcaagauguaagcuacuuucacaucaagagauuuuauuaggcuggguuguaguggaacaugccuuuaaucccagcacucaggaggcaaaggcaggcugaucucugugccuuugaaaccagacugguauauauguauguauguauguauggauagauagauagauagauagauagauagauagauagauagauagauagauagauaggaguccuauccagaacagucagaacuacauaguaaaacaaucucaaaaaaaaaagagagaaaaaaaguuuuuauugguuguuccagaaacuuccccacccaacacaacuacauuaucuuaaaauucagcuuacuucuagcaaacuuaaauuuccugaacccuuugguguagaaugauuuaacacuugacauaaaacauuaaaaaucaagccugagcaaacaggagaaagauaaugaccucagcaagauuuuuaaugccugucaauagaauggcauaaaguagugcuggcuuuggaauggcauaaaguagugcuggcuuucagcuguuggaaaguacaguuuucuuucuucuucuucuuuucuucuucuucuucuucuucuucuucuucuucuucuucuucuucuucuucuucuucuucuucuucuucuucuucuucuucuucuucuccuucuccuucuccuucuccuucuccuucuucuccuccuccuccuccuccucuuccuccucuucuucuuccuucuuccucuucuuccucuucuuccucuuccuccuccuccuccuucucuucuucuucuucuucuucuucuucuucuucuucuucuucuucuucuucuucuucuucuucuucuucuucuucuucuucuucuucuucuucuucgucuucuucuucuucuucuucuucuucuucuucuucuucuucuucuucuucuccuccuccuccuccuccucuucuucuuauucuucuucuucuucuucuucuccuccucuucuucuucuucuuccucuuccucuucuccuccuccuccuccuccuccuccuccccccuccuccucuuuuuucuucuuucuucucucucucugucucucugucucucucugucucuaaguauguguguguguguguguguguguguguggagagagagagagagagagagagagagagagagagagagagagagagagagagagagagagaacaaacccuguaugcuuguguagagaucagagaucaaugucagguggcagugauguucuucuaucauguccucauuauuuuugaggcagggucacucgcugaccccguagcucccauuucugcuggccaguacaucuccagaauucuccuacccuuccagcaugggggucacaguuaugugccaugcuuucacauggguucugggcauggacacucagauccagcuugaacagaaaucacucucccugcuaaaccgucuaccaugcaccaaaccaugcaacccuugaucaaugcacuguagaauuucuacagugcucaccaaaaguauuuaucaaguacuggauaaaucuggauucaagguauugucccuagugacacaaagauuaauauuccuaguauucuccuaguuccacuuucauuuguaauauuuaacugccucaaagcagaccccaguucacaguuguucuuucauguuacugugaauaguucagauaccucaguuuaccucaggguagugaugcacacuaccugacacacacacacacacacacacacacauauguauguauauauaugcaugguaauauauacaagaguauauugguaauauauauauauauuaccuaaaauauuagcacacagcacacuuccauguagaauucuccuuuagcucuuacccccacguuuauucaacugaccaccugcugcuuccuggggaacaaggaaaaagcugauucuccuugucuaaauaucccagucugaauccaggcuucucugcaagugacgguuaaucuccacgucuacuugacaggaucuagagugaucgggaaguauaacucugggugugucuaugugugugcuuccagggaguguaaagaggaaggaagacccauucucaagugggugguagcagugaaugguugccaugccacggugacaggaaaaaaaaaaggccagaugagcaccggccuucaucuccugcuuuccugacuaugggugcaagcagaucagcagucuuguguccccaggacccugacuuuaugagucaugaggcuuuguuuguacccucaaccugugagccgauauaaaacugaguuugacacucaguuugaagagcauuugccuucaugucuaauaugcaugacccugacccuggguucaauacccagcacuagggggugggggugggaaguggaggggugggaauuggggggggggucuuccuuucuuaaguugccuucguccaguauuuugucacagcaacaaaaauguaacuaaugcaccagguaagaaaaauuagccaguaacuucucugaagaaauuagauuuuaauauuaaaugugguuuacuuaacagacaaguaucuaagaauuaaauauucuuaaaauuaaucuucguauuugaacuuuucauuucuauuggagugucugaagaacuuuucaucucaaauuaauauauuguggcgguaaaauuauacuuguuacaagcaugcuaugacaagcgauuaacuaucagaauggggaauauuugcuauaaaaugugauguuucauaugguaaauuguaguaucacucuccaaaaugcuaagcugagauuucaaaaacguuguaucacuuuaaaaaaaaaaaagauggacauuuucaaaugcuuuaaaaacuccauugggcugagaaauggugcuuauuuaccaugguaacuuuuguguauaaaucauacucuacaacuuaaguuauugauacauuuguaaaaaaaaaaaguaauuaugcuuuugaaacuucauucaauaacuggaacauacuaggauuaaccacaaagucuugagagauaauaacauucuauuuucuuuuaaaaaugaaaugcagugggguuuuguuccccugaguagaggaacaaaugaggcacacagcuaugaccacaccagaugagacucaauggacuguauucuaacuccaacgaucgauccuuuaaaaagauuaaugccagagauguguguggcucagugguacaguaccuaccuaggaugcacauggccugaguuuaauccaaagcacagaaaacaaccacaaaaauaaauguauauugcuucauucauuuuacuguaaaauaccaauuaaguauaugcagacauaucgauguuuagauauguucauaauaacuaagcaauguugaaaugcccauaauaauacaaguuaugaaaccaaucuaggguccaacagaggaguggguaaagaaaauguaguguguaugcacaguggaguauuucccaucguaaagaaugaaauuauauugcuugaaauaauaaacgaagaagaaacugaaaauaaucaccguacacuaaucaggccaauuucagaaagauggauuuuuuucuuuuuuuguaugcauucucauuugugguucccagaucuuauguagauacauaaaaaguaaguaugugggauaugaaaguagaagugaaacgcucuaggggaaauaaggaagcuaacuggaagaaacugggaagagaagggagggaagggaagggaagggaagggaggggaagggaggggaggggaggggaggggaggggaggggaggggaggggaggggagggaagggaagggaagggaaggggaggggaggggaggggagggaagggaagggaaggggaggggagggaagggaagggaagggaagggaaggggagagaagaagaaggaagggaagggaggggaggggagagaaggggaaagaagggaaggggagagaaggggaaagaaggaaggagagggaaggggagagaagaggaagggaaggggagagaagaggaagggaagggaagggaggggaggggaggggagggcagggcagggcagggcagggcagggcagggcagggcaggggagaguauccucagcauacagcauauacuugcaugaaaauguccucaugcagcagaggccugugcacaguaaauauacacauugaaacuuauccagcuauaauuuuuaaauaacuaaggaauguauuuauaaaacauuaauuuuaaauuuaauuaaugucaaacagaagauugugcagacaaagcaaagcugaacaaaugagauuuuugguaaccaggccugaaagggcacaucuuaaaacacacaaacauaccuccaggguaagauuaaaccucauguuuauuguccugcaaaaaugucucuguggggcgaagauauaugagugucauuaaagcuuugaaauuuagcaaggcgacaggaacgauaaagcauuucuucacuuaacacaaaugacuuuccaugacggaucucuuacucuccuaaguguccagagaggcgggaagaguaauuugucacuaucauuuagaaagccccacuguuuucggugaagauaaagacaguauguggcucucuagaaaccgaggacauaguacaaauuugauucccugagggggaaaaacaucagacaaagaacagcuucauaacugggaaaucaccaaaaacaaaguaaauuuuuuauuguuucugagcgaaauuuuuaaccugaaauaucuuuugaacuggagaggaaaaaaaacccaggccaucugaaaaugaggggacuccuguccuguuccgugcccauugcuguacuagguucaggacccacggucuacaaaagcaucucuaauguguucccuuuccucauuucucauguggguucacuggcccugcacucggggcccugagaccaucuggccuuccuccguguaacaucccugaguagggugaguccuaaaaauggauucuguacucccagccagaccaaaaccgaccuccauccaaauacuaaauaaauacacggcugguuaacaaaaacccacuuggaacccuaaggccuuugcuucuugauccuuccgugcuguuugcaaccagaauuuaaucacagaguccuaaguuuuaaauaucauuaaaauaucauuacuaaaaguuucagauaucauuagacuaauuuugacacacagagagaaaauggcacaugagcaacccugcugguguuuucugcguguauuuuuaacugauauguagguaaaagaccugagagccuagcacaacaguuauauaaacucauuuuauuuugagucugauuuccuuacaggaaggcugccuucaugcccugucuugagugaagcuguugcagccgucuacacuaggaccaacauucuuuggcuggcauuugauucuucuauaucuguucugaugacaaagccugauuauucauuuuuauugaaaagguuuagcugaagacaaaacuaagccuguccccagguccucacacaaacccgaagaugucuaacuaauaaauaauuguguuaauaaucaagccagcgcauaaacugguuuaauauuaaacacauggaaaacugcugguaugcacagcauuaaaaaaugaacauucucuauuuguacaaacccugcacacuucucuacuguuuaauuuuuuucagugaacacgaaucauucuaaaauuucuaaaaauccaacugaaauagaaaaucacauaaaugauauuuuacaaacaaaaaacaaacaaaaccagaaaccaaaccccuuuuaccugugcuguauuuaaaucuuuuuuuuuuuucacauagcccaaucugaccuugaaccugugauccuccacucaugucuccuauagugcugggauuacaggucuaagccaugcuuggguaaauucauucaaccuuacagaaaacaaacugccaaguucuucuuacucauaauuagacacuaagugagucaauuauucuaauaagugaaauaucaugaagauuauuuagauuucuguaacuaugcgugagaaaaacauauuaauuuucuacccuccuauaaaaguagcgacaccuaguuacgaucauacaucaaguacauauuaauacauaucgauuuaucuacuuguaaggaccuuauauauuaaauuaauccuugacaacauuaaauacuacuagcuacauuuuacagaagcacagaaauuuacccauggccaguaucucaggguacacauuauccugagcacaugcucaagcaaccuugcccccauuugguuucuggauccauguuuguuauagcuuaaaucauaaguaugacccaaaggccagugggucaaaggcuuagccuucugaaggccccugucguuaaagguggggauugugugggaaucugacaaguuggucucuucuuuucuccuguuugcuuccaggcagaccaccaugacaggaacagcuggccauaauaugcugccucacaacaggcccauaauuauggggccaaccaaucauagacuuaaaccucccaaacuauaaaccaagauaaaccuuucuucuuuuuaaguuggcugucucagguauugugucacagcaacagaaagcaaugugaaaugcuggccuuuucuagacaucugagaaacacucaaugguucaaauuacugaccuaacaauacaccugacaucaaaaucaguauuacaaauguucacuccaguucugucuucuuaggggcugaggggacuaagagcacuuugguucuuccaauucaguugauucacagacaccuguaaauucuaacuuccgggagauccaaggccuguauucuccacagguaacuguacucaugugcacauagccacacauauagacauaauuuuaaaaugauaauacaauauuuaagguauggccaagaguaaccugggaggaaaggguuuauuacaucuuacacguuacaguccaucaaggacagccaaggauaugagcucaaauagggaccagaggcaggaacuaaaacagaagggguguuugcuggcuggcugucuccaggguuggcucagccugcuuucuuauacauccaaggacuaccugcucagggguggccccgcccauaguugucuaggccaacccacaauaaucauaaaucaagagaaugccccaccccugcaggccaaucugauaaaggcaauucucacuugagggucccucuucccaggugacuuuagucucugucaaguuaacaaaaaguaaucaaaacagauccccaucucaaaaaauaaaaacaguuuccauauaaauaaauguaaauaaaauaucuucuuuacccaguacugaagcuaggacugaauguaugugaacccaaguuccccguaaucucuuuuauagcuauuucuugaugaaugcuuucuuuaaaacuaguagcaaaaaaaaacaaaaaacaaacaaacaaacaaacaaaaccucauuuuaaauaaauuacuacagcagucauucuaauccagcauucuugggagcauuuccugucccaaagaugguaccagucaaaccuccuagguagaacaaucugaagaaaagaaaauucacccaacauuuuuuuucauaauaaauauucgucucucucaaaagcaauccauguuaaggaaagagcuauguaacaucucuccuggaauaauaccuccaugggcaaacugugacugaaauauaauauguauaguugcuuauccuugcuacucauccagggagcaugcucacucccccaccuuagccuguccucuuucccacgcacucaugaggguaggucacggaagguaagaugcaggagguuacagcacucaggagcucuugcaucagacaguauugauuaucacucugcacuccacgguuuguaucuaggaucccacuaugagaaggaaaagaugucacaguugcaucaagaaacaaacaagaacagaaagaaaaaaaaaauaauaaccagguuagggcuugggagcugagcgugcuggcugccugccaggccuucacaaacgcaggugugugcucugugaggcaaguuucccaaaaggccacaaggucaucuagcccaggggguggaaugugacugcaguccuggcuacagagagguaaugucaagccacagcagccuuaaggagagaugacgaggcugcaaacagacccgagcuuuccucugcccuccucccuguuuuccugcacagcuacuagcuuccaugccauuacuuggcucguuugguuucagaacagcuugaugaauccugaaugugguucaaauugguccaucuguaacugcccucaaaaaucacaguuucuauuuuaaaauugcccggagaauuuuuuguuuuuuucuucccuuaaugccaauguccaggccuugcuuccgggauucucuuucugauguacuggguggaacucugacaacacucuggaacuuuucugcuucugguuuuguuuucaucuucaugauuccuugggauggggauguagugcagcaggcauuuguccaucaugccuaagucuccauaugaaaucccaacaucacauacacaaacacaggaaggaagggagagaggggggaaggaagggagggagggagggagggagggaggaaggcagagacacucugugacccugauguguaaaggaggaugacaacucuuggcuaacguuccuuauggaagcacuuugaaaauuugcuucucccuucccuccuggaaguuugcauggugggugaagcuuuuuguccuuaccuccccuggucaagauggugcuagggauacuucccaggcugcuuucagccuuggucuccuucuuccaguucuucacccagcuccagagucuggccuacaccugccacaguuucuguuuauuuccugucuugccuggaugaguggacgcuccauaagcuuccacuuauggggguuuacauaaaggugaucagagcugagagacacgauuuggccuaaaaaucaaucaaucaaauugucccaaaugaacagacgaggccaugaaucaaauggaacuccacacuuguucucgccuucauuauguaaaaccuuaucugugccuggcuggaaaucgagagcagggaagacagauaagacaaaggccuugcauguaggcucuagugucugugcgugagcaaauacaauccaugcaaauacuuaaccuccauucacagacccaggacacaaaccuggcuggagacuuucacccaggaaacaucccaggauuaucguguucucuuguuccuuuacucuuuuuaauucuaggucuuuauccugcuacacuuucugaguaccccacuuucuguguccuuucuuuuuuuucuuugccuaaucuguacuuucuuuuuugguacgcaacacuccuauuuuauaauuaugugcaugcuuuauucacccugcauacuucuguacccagugugggagaaggcaauaaaauauauacagucaaguaaacaugagcuugauauuuaaaguauguuugugcagguccaucuugacauaaaaggcagagauuagaaaagaaauguauuagucaaagaugcccuguaaaucccacgacaacaccucugcaaaaauaacgcauaauauuuuauuaagcaccuucuucacgucuauaugcaggaugacugacagauaaucuuuaacacagagauauagaaaauuggcgugucauaaacaguaaacuaaaaacuuaaaaaccuuagccguaaaaguaacuucaccuuccuucaaaccaguagcccauugauccuauuuuucuccuauuuaaucuuaaaucuugaauuuuccaguuuaguuuugugauccuguauauaccuuuucauuuccucgguuccaucuuuuaauugcuugcagccuuacaaguguaaugagggacgcuaucccuugggggugauaagaaagaagcauuuauagucugccaguaucauggcuucccacugacaagcaguaaccggugacucccgauggaucccugucaaaaaaagaaugucagcuucgcuguucuaugaguaggcuucuaccaucagagaggcacuaccgggcagcagucgcagacagugaaggagccaccacuaccgaggcaaguugauaguuaucagcucuauacaagcaaacaagaugaguccaucacgguuugcuaaacgcaugccucuguucaacauaccaggaaaauaaaaccaaaccaggaaaugccgacgcccuggaagacgaggccccagcaucaguacccuggaggccccagcaucagcacccucgagaccccagcaucaguacccucauggccccaucaucagcacccuccaucacacggguucuuuuugcagagccaccugcagcagacggauuuucugugauuuacaaaacgcagccaacucauaauucuguggcuucaguggacgcagaacugcaaagugugucaaaccucaucaggaugaauuaccuauccuuccagugacucaccaaaggcacgaauguagugcucccaguaacccuuuaaaggugaugauaacugcaggagcaucuccaaauguucggcagaaaaaggauaugcaaucgcacaagccaaaacauaaauccaguucaucuuggccuacacugugacucuuuuuauacaaguuaaaaaaaaugcucaagaaaaguaaaaugcuccaaaaauuaaaguuauuccuuuaauuacuuagucguguuucugcacagcaaaacaauuagaaaaaccgaaugacuauacaauuaaauucuuaggucgucagagaaaucagaauucccuugauuaaauggcuuugaaaaaaaaaaauggaacacuaaauucuuaagacucuucgaagaccuguuuuaaccagucugaggugacuuacagauucugaagccacuuguggguuaaaaaaaaaaaaaaaauucagaggggcuaaaaguucaaugaccuuguaaauuaagagcuaaaaaaaauuaaauaaauaaaaacucauacuagugugauagccuagccaauccccacaaaauugcaggaaaacacucgcccggaaauugcuuuuugggaaaauuccuaugagguagaggggaaagaggaggacgacgaggaagggcuauuagcaaaugcuuagauggugaagaggguacaaaugaagagaaauaaaaccagcugccacgcaaacaacuuccaggcaucucuggauaaaaaggaaaacaagccuugugcugcaugcuggagaguuggaugaauggggaagacuuguuauacaccuagugguggguggauuucacaggcugcagccuccacacagcuuuucuuugcugcacugcagaggcgccaucuucuccgucuuaaucuucacccuauucaauccuuuuaucugcaccccuuuuuuuuuuuuuuuaaaaaaaaaaggaacccugaggacccuccccagcauccugugucccccccagggugacuaagcuagaguucccaaaucugccccauaggaggccgcaccuuaaucagacaaacgccuccuuugaugcccuggagccucagccuccccaccaccaggcacugcccuucccagacgcacgccucacucccggcucgcucucucucucucucucucucucucucucucucucucucucucucucucucucucucucucucucaggacuuugcagucccucacaggauugccaguaggugguggugaugcgggggugggagaccgcggggcccuagcagcaccucuaggcccucgggggcagacgcgcagcucggggaaaggaacggcgguggcgcaccaacuaccagggcuccgccaccgcgcccuggacggcgagggcggggugucgcggcuuuuguucccggggaccuucucagacucagggagaaacuggaggugcacugaagaguccuggacguccagguugagggacggugccggguggccgcacuuuccgaucccucccaucacuuggaacuuacacaaaagggagacacgaaaaugcacaaaguuugcaaaaggaaggcggcggugcgcgaccccgcaccgacucgggagagggucgcugcgcaggcagccgccgcccgcggccgccaggagcaaagcccagcuucgcagucaagacaggcgggggugggaagggagugugagccaggcgcuccccagcauccagagcugcccccauuccaacccaggaccccaaggaaggggaagggcggcgauuuccucgcagggcacugaauccugagacgcuacgcuuucgguuuuccacacgugucccuucccccucgaacugggugucucucgcaucccggaguccagcucucaacgcagggaggagucagggucugcguucaggcucguccccucgccuuccagcccuaggcuggcacggauauggggaccccagcgcccuaacccauucccucuucaucgcucgggcagcgcguccccgggcaggguugggccagagccgccgaagcgcagggcgcccgcaggcgggggcggcgaggagcggucuacccgugacagccccccacgucucgagauucaagcuccucgguggggaggaucgcguccucccggcgcccgccuccccagucucguucccaaggcgcggcacccaccuccagagcccgaaccguccaggcggccagcaggagcagugccaagcugggcagcaucgugauccugcgugggccaccgagugcuccgugugcgaguggaagauccgccgcgcccuggcuguguccgcgccgccgccgccgucuccgguggccccgcgcucgcucugcucccggugcucucgccucccgccgccgaggaaac

SEQ ID NO: 12550 - RNA, 219262 nt, Mus musculus
guuuccucggcggcgggaggcgagagcaccgggagcagagcgagcgcggggccaccggagacggcggcggcggcgcggacacagccagggcgcggcggaucuuccacucgcacacggagcacucgguggcccacgcaggaucacgaugcugcccagcuuggcacugcuccugcuggccgccuggacgguucgggcucuggaggugggugccgcgccuugggaacgagacuggggaggcgggcgccgggaggacgcgauccuccccaccgaggagcuugaaucucgagacguggggggcugucacggguagaccgcuccucgccgcccccgccugcgggcgcccugcgcuucggcggcucuggcccaacccugcccggggacgcgcugcccgagcgaugaagagggaauggguuagggcgcugggguccccauauccgugccagccuagggcuggaaggcgaggggacgagccugaacgcagacccugacuccucccugcguugagagcuggacuccgggaugcgagagacacccaguucgagggggaagggacacguguggaaaaccgaaagcguagcgucucaggauucagugcccugcgaggaaaucgccgcccuuccccuuccuugggguccuggguuggaaugggggcagcucuggaugcuggggagcgccuggcucacacucccuucccacccccgccugucuugacugcgaagcugggcuuugcuccuggcggccgcgggcggcggcugccugcgcagcgacccucucccgagucggugcggggucgcgcaccgccgccuuccuuuugcaaacuuugugcauuuucgugucucccuuuuguguaaguuccaagugaugggagggaucggaaagugcggccacccggcaccgucccucaaccuggacguccaggacucuucagugcaccuccaguuucucccugagucugagaagguccccgggaacaaaagccgcgacaccccgcccucgccguccagggcgcgguggcggagcccugguaguuggugcgccaccgccguuccuuuccccgagcugcgcgucugcccccgagggccuagaggugcugcuagggccccgcggucucccacccccgcaucaccaccaccuacuggcaauccugugagggacugcaaaguccugagagagagagagagagagagagagagagagagagagagagagagagagagagagagagagagagcgagccgggagugaggcgugcgucugggaagggcagugccuggugguggggaggcugaggcuccagggcaucaaaggaggcguuugucugauuaaggugcggccuccuauggggcagauuugggaacucuagcuuagucacccugggggggacacaggaugcuggggaggguccucaggguuccuuuuuuuuuuaaaaaaaaaaaaaaaggggugcagauaaaaggauugaauagggugaagauuaagacggagaagauggcgccucugcagugcagcaaagaaaagcuguguggaggcugcagccugugaaauccacccaccacuagguguauaacaagucuuccccauucauccaacucuccagcaugcagcacaaggcuuguuuuccuuuuuauccagagaugccuggaaguuguuugcguggcagcugguuuuauuucucuucauuuguacccucuucaccaucuaagcauuugcuaauagcccuuccucgucguccuccucuuuccccucuaccucauaggaauuuucccaaaaagcaauuuccgggcgaguguuuuccugcaauuuuguggggauuggcuaggcuaucacacuaguaugaguuuuuauuuauuuaauuuuuuuuagcucuuaauuuacaaggucauugaacuuuuagccccucugaauuuuuuuuuuuuuuuuaacccacaaguggcuucagaaucuguaagucaccucagacugguuaaaacaggucuucgaagagucuuaagaauuuaguguuccauuuuuuuuuuucaaagccauuuaaucaagggaauucugauuucucugacgaccuaagaauuuaauuguauagucauucgguuuuucuaauuguuuugcugugcagaaacacgacuaaguaauuaaaggaauaacuuuaauuuuuggagcauuuuacuuuucuugagcauuuuuuuuaacuuguauaaaaagagucacaguguaggccaagaugaacuggauuuauguuuuggcuugugcgauugcauauccuuuuucugccgaacauuuggagaugcuccugcaguuaucaucaccuuuaaaggguuacugggagcacuacauucgugccuuuggugagucacuggaaggauagguaauucauccugaugagguuugacacacuuugcaguucugcguccacugaagccacagaauuaugaguuggcugcguuuuguaaaucacagaaaauccgucugcugcagguggcucugcaaaaagaacccgugugauggagggugcugaugauggggccaugaggguacugaugcuggggucucgagggugcugaugcuggggccuccaggguacugaugcuggggccucgucuuccagggcgucggcauuuccugguuugguuuuauuuuccugguauguugaacagaggcaugcguuuagcaaaccgugauggacucaucuuguuugcuuguauagagcugauaacuaucaacuugccucgguagugguggcuccuucacugucugcgacugcugcccgguagugccucucugaugguagaagccuacucauagaacagcgaagcugacauucuuuuuuugacagggauccaucgggagucaccgguuacugcuugucagugggaagccaugauacuggcagacuauaaaugcuucuuucuuaucacccccaagggauagcgucccucauuacacuuguaaggcugcaagcaauuaaaagauggaaccgaggaaaugaaaagguauauacaggaucacaaaacuaaacuggaaaauucaagauuuaagauuaaauaggagaaaaauaggaucaaugggcuacugguuugaaggaaggugaaguuacuuuuacggcuaagguuuuuaaguuuuuaguuuacuguuuaugacacgccaauuuucuauaucucuguguuaaagauuaucugucagucauccugcauauagacgugaagaaggugcuuaauaaaauauuaugcguuauuuuugcagagguguugucgugggauuuacagggcaucuuugacuaauacauuucuuuucuaaucucugccuuuuaugucaagauggaccugcacaaacauacuuuaaauaucaagcucauguuuacuugacuguauauauuuuauugccuucucccacacuggguacagaaguaugcagggugaauaaagcaugcacauaauuauaaaauaggaguguugcguaccaaaaaagaaaguacagauuaggcaaagaaaaaaaagaaaggacacagaaagugggguacucagaaaguguagcaggauaaagaccuagaauuaaaaagaguaaaggaacaagagaacacgauaauccugggauguuuccugggugaaagucuccagccagguuuguguccugggucugugaauggagguuaaguauuugcauggauuguauuugcucacgcacagacacuagagccuacaugcaaggccuuugucuuaucugucuucccugcucucgauuuccagccaggcacagauaagguuuuacauaaugaaggcgagaacaaguguggaguuccauuugauucauggccucgucuguucauuugggacaauuugauugauugauuuuuaggccaaaucgugucucucagcucugaucaccuuuauguaaacccccauaaguggaagcuuauggagcguccacucauccaggcaagacaggaaauaaacagaaacuguggcagguguaggccagacucuggagcugggugaagaacuggaagaaggagaccaaggcugaaagcagccugggaaguaucccuagcaccaucuugaccaggggagguaaggacaaaaagcuucacccaccaugcaaacuuccaggagggaagggagaagcaaauuuucaaagugcuuccauaaggaacguuagccaagaguugucauccuccuuuacacaucagggucacagagugucucugccuuccucccucccucccucccucccucccuuccuuccccccucucucccuuccuuccuguguuuguguaugugauguugggauuucauauggagacuuaggcaugauggacaaaugccugcugcacuacauccccaucccaaggaaucaugaagaugaaaacaaaaccagaagcagaaaaguuccagaguguugucagaguuccacccaguacaucagaaagagaaucccggaagcaaggccuggacauuggcauuaagggaagaaaaaaacaaaaaauucuccgggcaauuuuaaaauagaaacugugauuuuugagggcaguuacagauggaccaauuugaaccacauucaggauucaucaagcuguucugaaaccaaacgagccaaguaauggcauggaagcuaguagcugugcaggaaaacagggaggagggcagaggaaagcucgggucuguuugcagccucgucaucucuccuuaaggcugcuguggcuugacauuaccucucuguagccaggacugcagucacauuccacccccugggcuagaugaccuuguggccuuuugggaaacuugccucacagagcacacaccugcguuugugaaggccuggcaggcagccagcacgcucagcucccaagcccuaaccugguuauuauuuuuuuuuucuuucuguucuuguuuguuucuugaugcaacugugacaucuuuuccuucucauagugggauccuagauacaaaccguggagugcagagugauaaucaauacugucugaugcaagagcuccugagugcuguaaccuccugcaucuuaccuuccgugaccuacccucaugagugcgugggaaagaggacaggcuaaggugggggagugagcaugcucccuggaugaguagcaaggauaagcaacuauacauauuauauuucagucacaguuugcccauggagguauuauuccaggagagauguuacauagcucuuuccuuaacauggauugcuuuugagagagacgaauauuuauuaugaaaaaaaauguugggugaauuuucuuuucuucagauuguucuaccuaggagguuugacugguaccaucuuugggacaggaaaugcucccaagaaugcuggauuagaaugacugcuguaguaauuuauuuaaaaugagguuuuguuuguuuguuuguuuguuuuuuguuuuuuuuugcuacuaguuuuaaagaaagcauucaucaagaaauagcuauaaaagagauuacggggaacuuggguucacauacauucaguccuagcuucaguacuggguaaagaagauauuuuauuuacauuuauuuauauggaaacuguuuuuauuuuuugagauggggaucuguuuugauuacuuuuuguuaacuugacagagacuaaagucaccugggaagagggacccucaagugagaauugccuuuaucagauuggccugcagggguggggcauucucuugauuuaugauuauuguggguuggccuagacaacuaugggcggggccaccccugagcagguaguccuuggauguauaagaaagcaggcugagccaacccuggagacagccagccagcaaacaccccuucuguuuuaguuccugccucuggucccuauuugagcucauauccuuggcuguccuugauggacuguaacguguaagauguaauaaacccuuuccucccagguuacucuuggccauaccuuaaauauuguauuaucauuuuaaaauuaugucuauauguguggcuaugugcacaugaguacaguuaccuguggagaauacaggccuuggaucucccggaaguuagaauuuacaggugucugugaaucaacugaauuggaagaaccaaagugcucuuaguccccucagccccuaagaagacagaacuggagugaacauuuguaauacugauuuugaugucagguguauuguuaggucaguaauuugaaccauugaguguuucucagaugucuagaaaaggccagcauuucacauugcuuucuguugcugugacacaauaccugagacagccaacuuaaaaagaagaaagguuuaucuugguuuauaguuugggagguuuaagucuaugauugguuggccccauaauuaugggccuguugugaggcagcauauuauggccagcuguuccugucaugguggucugccuggaagcaaacaggagaaaagaagagaccaacuugucagauucccacacaauccccaccuuuaacgacaggggccuucagaaggcuaagccuuugacccacuggccuuugggucauacuuaugauuuaagcuauaacaaacauggauccagaaaccaaaugggggcaagguugcuugagcaugugcucaggauaauguguacccugagauacuggccauggguaaauuucugugcuucuguaaaauguagcuaguaguauuuaauguugucaaggauuaauuuaauauauaagguccuuacaaguagauaaaucgauauguauuaauauguacuugauguaugaucguaacuaggugucgcuacuuuuauaggaggguagaaaauuaauauguuuuucucacgcauaguuacagaaaucuaaauaaucuucaugauauuucacuuauuagaauaauugacucacuuagugucuaauuaugaguaagaagaacuuggcaguuuguuuucuguaagguugaaugaauuuacccaagcauggcuuagaccuguaaucccagcacuauaggagacaugaguggaggaucacagguucaaggucagauugggcuaugugaaaaaaaaaaaagauuuaaauacagcacagguaaaagggguuugguuucugguuuuguuuguuuuuuguuuguaaaauaucauuuaugugauuuucuauuucaguuggauuuuuagaaauuuuagaaugauucguguucacugaaaaaaauuaaacaguagagaagugugcaggguuuguacaaauagagaauguucauuuuuuaaugcugugcauaccagcaguuuuccauguguuuaauauuaaaccaguuuaugcgcuggcuugauuauuaacacaauuauuuauuaguuagacaucuucggguuugugugaggaccuggggacaggcuuaguuuugucuucagcuaaaccuuuucaauaaaaaugaauaaucaggcuuugucaucagaacagauauagaagaaucaaaugccagccaaagaauguugguccuaguguagacggcugcaacagcuucacucaagacagggcaugaaggcagccuuccuguaaggaaaucagacucaaaauaaaaugaguuuauauaacuguugugcuaggcucucaggucuuuuaccuacauaucaguuaaaaauacacgcagaaaacaccagcaggguugcucaugugccauuuucucucugugugucaaaauuagucuaaugauaucugaaacuuuuaguaaugauauuuuaaugauauuuaaaacuuaggacucugugauuaaauucugguugcaaacagcacggaaggaucaagaagcaaaggccuuaggguuccaaguggguuuuuguuaaccagccguguauuuauuuaguauuuggauggaggucgguuuuggucuggcugggaguacagaauccauuuuuaggacucacccuacucagggauguuacacggaggaaggccagauggucucagggccccgagugcagggccagugaacccacaugagaaaugaggaaagggaacacauuagagaugcuuuuguagaccguggguccugaaccuaguacagcaaugggcacggaacaggacaggaguccccucauuuucagauggccuggguuuuuuuuccucuccaguucaaaagauauuucagguuaaaaauuucgcucagaaacaauaaaaaauuuacuuuguuuuuggugauuucccaguuaugaagcuguucuuugucugauguuuuucccccucagggaaucaaauuuguacuauguccucgguuucuagagagccacauacugucuuuaucuucaccgaaaacaguggggcuuucuaaaugauagugacaaauuacucuucccgccucucuggacacuuaggagaguaagagauccgucauggaaagucauuuguguuaagugaagaaaugcuuuaucguuccugucgccuugcuaaauuucaaagcuuuaaugacacucauauaucuucgccccacagagacauuuuugcaggacaauaaacaugagguuuaaucuuacccuggagguauguuuguguguuuuaagaugugcccuuucaggccugguuaccaaaaaucucauuuguucagcuuugcuuugucugcacaaucuucuguuugacauuaauuaaauuuaaaauuaauguuuuauaaauacauuccuuaguuauuuaaaaauuauagcuggauaaguuucaauguguauauuuacugugcacaggccucugcugcaugaggacauuuucaugcaaguauaugcuguaugcugaggauacucuccccugcccugcccugcccugcccugcccugcccugcccugcccuccccuccccuccccucccuucccuucccuuccucuucucuccccuucccuuccucuucucuccccuucccucuccuuccuucuuuccccuucucuccccuucccuucuuuccccuucucuccccuccccucccuucccuuccuucuucuucucuccccuucccuucccuucccuucccuucccuccccuccccuucccuucccuucccuccccuccccuccccuccccuucccuucccuucccuucccuccccuccccuccccuccccuccccuccccuccccuccccuccccucccuuccccucccuucccuucccuucccuucccucccuucucuucccaguuucuuccaguuagcuuccuuauuuccccuagagcguuucacuucuacuuucauaucccacauacuuacuuuuuauguaucuacauaagaucugggaaccacaaaugagaaugcauacaaaaaaagaaaaaaauccaucuuucugaaauuggccugauuaguguacggugauuauuuucaguuucuucuucguuuauuauuucaagcaauauaauuucauucuuuacgaugggaaauacuccacugugcauacacacuacauuuucuuuacccacuccucuguuggacccuagauugguuucauaacuuguauuauuaugggcauuucaacauugcuuaguuauuaugaacauaucuaaacaucgauaugucugcauauacuuaauugguauuuuacaguaaaaugaaugaagcaauauacauuuauuuuugugguuguuuucugugcuuuggauuaaacucaggccaugugcauccuagguagguacuguaccacugagccacacacaucucuggcauuaaucuuuuuaaaggaucgaucguuggaguuagaauacaguccauugagucucaucugguguggucauagcugugugccucauuuguuccucuacucaggggaacaaaaccccacugcauuucauuuuuaaaagaaaauagaauguuauuaucucucaagacuuugugguuaauccuaguauguuccaguuauugaaugaaguuucaaaagcauaauuacuuuuuuuuuuuacaaauguaucaauaacuuaaguuguagaguaugauuuauacacaaaaguuaccaugguaaauaagcaccauuucucagcccaauggaguuuuuaaagcauuugaaaauguccaucuuuuuuuuuuuuaaagugauacaacguuuuugaaaucucagcuuagcauuuuggagagugauacuacaauuuaccauaugaaacaucacauuuuauagcaaauauuccccauucugauaguuaaucgcuugucauagcaugcuuguaacaaguauaauuuuaccgccacaauauauuaauuugagaugaaaaguucuucagacacuccaauagaaaugaaaaguucaaauacgaagauuaauuuuaagaauauuuaauucuuagauacuugucuguuaaguaaaccacauuuaauauuaaaaucuaauuucuucagagaaguuacuggcuaauuuuucuuaccuggugcauuaguuacauuuuuguugcugugacaaaauacuggacgaaggcaacuuaagaaaggaagaccccccccccaauucccaccccuccacuucccacccccacccccuagugcuggguauugaacccagggucagggucaugcauauuagacaugaaggcaaaugcucuucaaacugagugucaaacucaguuuuauaucggcucacagguugaggguacaaacaaagccucaugacucauaaagucaggguccuggggacacaagacugcugaucugcuugcacccauagucaggaaagcaggagaugaaggccggugcucaucuggccuuuuuuuuuuccugucaccguggcauggcaaccauucacugcuaccacccacuugagaaugggucuuccuuccucuuuacacucccuggaagcacacacauagacacacccagaguuauacuucccgaucacucuagauccugucaaguagacguggagauuaaccgucacuugcagagaagccuggauucagacugggauauuuagacaaggagaaucagcuuuuuccuuguuccccaggaagcagcagguggucaguugaauaaacguggggguaagagcuaaaggagaauucuacauggaagugugcugugugcuaauauuuuagguaauauauauauauauuaccaauauacucuuguauauauuaccaugcauauauauacauacauaugugugugugugugugugugugugugucagguagugugcaucacuacccugagguaaacugagguaucugaacuauucacaguaacaugaaagaacaacugugaacuggggucugcuuugaggcaguuaaauauuacaaaugaaaguggaacuaggagaauacuaggaauauuaaucuuugugucacuagggacaauaccuugaauccagauuuauccaguacuugauaaauacuuuuggugagcacuguagaaauucuacagugcauugaucaaggguugcaugguuuggugcaugguagacgguuuagcagggagagugauuucuguucaagcuggaucugaguguccaugcccagaacccaugugaaagcauggcacauaacugugacccccaugcuggaaggguaggagaauucuggagauguacuggccagcagaaaugggagcuacggggucagcgagugacccugccucaaaaauaaugaggacaugauagaagaacaucacugccaccugacauugaucucugaucucuacacaagcauacaggguuuguucucucucucucucucucucucucucucucucucucucucucucucucucucucucucucuccacacacacacacacacacacacacacauacuuagagacagagagagacagagagacagagagagagaagaaagaagaaaaaagaggaggaggggggaggaggaggaggaggaggaggaggagaagaggaagaggaagaagaagaagaagaggaggagaagaagaagaagaagaagaauaagaagaagaggaggaggaggaggaggagaagaagaagaagaagaagaagaagaagaagaagaagaagaagaagaagacgaagaagaagaagaagaagaagaagaagaagaagaagaagaagaagaagaagaagaagaagaagaagaagaagaagaagaagaagaagaagaagagaaggaggaggaggaggaagaggaagaagaggaagaagaggaagaaggaagaagaagaggaggaagaggaggaggaggaggaggagaagaaggagaaggagaaggagaaggagaaggagaagaagaagaagaagaagaagaagaagaagaagaagaagaagaagaagaagaagaagaagaagaagaagaagaagaagaagaagaaaagaagaagaagaaagaaaacuguacuuuccaacagcugaaagccagcacuacuuuaugccauuccaaagccagcacuacuuuaugccauucuauugacaggcauuaaaaaucuugcugaggucauuaucuuucuccuguuugcucaggcuugauuuuuaauguuuuaugucaaguguuaaaucauucuacaccaaaggguucaggaaauuuaaguuugcuagaaguaagcugaauuuuaagauaauguaguuguguuggguggggaaguuucuggaacaaccaauaaaaacuuuuuuucucucuuuuuuuuuugagauuguuuuacuauguaguucugacuguucuggauaggacuccuaucuaucuaucuaucuaucuaucuaucuaucuaucuaucuaucuaucuaucuauccauacauacauacauacauauauaccagucugguuucaaaggcacagagaucagccugccuuugccuccugagugcugggauuaaaggcauguuccacuacaacccagccuaauaaaaucucuugaugugaaaguagcuuacaucuugcuguuaguagacgaacugcaaagggcccuacuuacaggacuauauugguaauacuauaguguuauuuagugaaagaugagaggcaggaaucccugagggaagccaaagcaauuucaguauggcuuaaauaguugaagggaagcuugcaggauggacagagaugugccuaccacugaguaguuuauuaacauggcugucagaaacguccaggaccaagauaaugaaggaugaggguuccuagaggguauaugaaguuuauuuauuuacuuugcagaugcuccucuguuuuuaguauauuuuuaccaguuguuggggaauuucauaccugacuacaauguuuuuaguuuuuguuuuuuuuaaucauauucaccaugucuuccucuccuaacuucucccagaucuacacccccuucuuucccaccccucccaacuuuauguccucuuuauagcaauaaaaacaccaaguacacuuugggccagcccuauacucauggauguggggccauccccuggaaugucaucugccugcuaggggccacucccuuaaagaaaacaaacucucccuccuccagaagccaucuacugucaauaacucuucagccaggaauggggaucaccgccccucccccuccaguacuggaaugucgacuggcuugaucaugugcacuucuuuuacaagcauucaugccugcuauguguuaagguugcaccaggccugccauguuuagagggcaccauuuaacuuugguccuucaaaaccccuggcuauuaaaacccuuuugauccccuucuguaguuggucccaagccuuggcaugagugaagaugauagggauauucuauuuguggcagaacacuauucugggauuuuaauauagacugggggaucagauuccucuguuccuuuguauuuguguugcauuguugagcuuuuaugaacugggcucagagguucuuucgugaacuucugagggucauguuggaaggacacagaugacaagaguucaguggguugacaguauuucuccuauguguguguguuuuuaguuguauuuauugacuucauaaauaacugauaagaugaggaaaaugucauuaccaaccuccuuccuggagaagaacagacauucgauaaaauauccaaggguuuauugucacauauuaaaauguuugcaauuuugaaguaauggcguguugacucauugcucauuggcucauucauaucagaguuugaauauauacaauccagucccaagucccugauucuguugucagccauggagcugggguaaaugcugaaauuuuaacgggauuuuaggguuuggggugucacaugguucuauaccuacuucacaaucucuuagggaauuugagcauuucauugaugcugauagugaucggaaguuaugauguuuuuauaacuaauuuacugcacauugcuuuuccuucuuugaucacauuuuuaaaaaguuaauuccugagcauguacaagauggcuuauguuucaacaggagcccauucugucaucucugugaugcuguauauggagagguaguuccugcuguaccuugucaauuucacagucuaauguagaaggaaaaugcaggaaaauaauuacgcauacuaugucaaaggcuacaauaaaagccuauguaaacucuucacagauauggcugagagccuuugggcaggacuucaaggguaaauggaaguuggucagagcagagugggguuccuagagaugaagaacacacagccaggggguaaaggguuaaaaguagaagccuuagcaucugugggaugggaugcggguguguguggagggguaacugggaagggggauauuauuugaaauguagacaaauaaaauaauuaauaaaaaaaguagaagcuguuguuauguggauaugagacucaggguuucagaagcccuugaugaaucugaacuucauuuucugaacaacagugcacuuuuacauguucuagaaacagcaguggucacugauaacuauaauucaucuagauuuaggagcuuuaaugaaagaucuuguuaaugucugcuuaagcuugucauuaagcuugucacaccuagcugcaagggaaucagguaaauguguuuuauuagccaaguauucuguagccaggaaagccauuucaggaucuaucauuaggguuauuauuuguuuugauuugauuuauuuaaaauagggccucccuauguaguauuggcuaccccggaacucauuauguagacuauucucgucuucaacucacagaaauccuuuugccucugcuucccacguucugcacuuaaaggcaugcaccaccaugcccaacaggcucuauucuuaaggacagaggagucaaauacuuggcaacaggcuaacauucuguauuguaaagguaggagaggaaaaugagaugaccaauacauguucuccauuaacgcauuauucuuccugagcaauuagagggcaguuuuggaauguuccucccaccuuucuuaccugcuggcugaccacauggaaaauauuugugggaugauggaagaggagguggggaaugcuucucgucuguaugugaaaucgcccaagagucaagcucauuggacucagaguguguucagaugccuggggaauacuuccaacgaaaauacugagggguugggggggugggggugggggaggaguaauuucagguucuggaaagaaaugacagcaucaguuuccuuuccccauugguaaacuuuuauuucaucuagaaacuuuguuguugaacuuuuacuuugaaaggacuagcaggcgaaaugggcuuugaggcuuuuagaaaggagcacaguauuuaggaccucgucugagccagaucugcccauuauauaaaaucacuuuucugccacgacagagcuuuuucacaucuguuuauacuuagucucucuuacccagaguggaaagauuuauguaaaaggagaaaagaacucugaauguaugucucgcaucagugaaagcggggccuccggcuuaacauccauuugaaguacguagcuacugucuaaucauuucaguuauuguagaaguagccaaaugaagcuaugucccuggaaauuagagaugaagauguggggaaaaccuacaggucuaagaaggcuugacaagaucaucaacauuagggagcgugugaagggucugccauagacauuuggaaugcaggcaaagguuucauuuaaaaugucucaaugauucgugacauacugcaccuggaucuguauaauaauaaaugucuaucaugguuccucaauaguuucucuucguuuuauuuucuaaguuaguugcaguuuuuccuucucuuaagugcagacgaaagccauaggaacccgucuaaagacguauuuagggcacacacacacacacacacacacacacuauaucuagauagauagauagauagauagauagauagauagauagauagauagauagauagauagauagauagauuagauagauauaaaguggaaauagaaguuccaaguccacugugaggagccagggauggcacuguuccauguaaguguucccuggagacauuugaucucuacaguugucuggccuggcccucuuagacugcacuguccaauaaaacuauuguagaacuguuuaaauccaauuugaaauuucaaauagccacauaaaaauguaaaagaagauaaagucagagguagagugcaaguuuagcauuuauaauacucuggguucuaucaccagcacagacuaucagaugauaaaugauagaugauagaugauagauagauagauagauagauagauagauagauagauagauagauauucauuccuuuuuaguaaguucaaauagucuuugaacauguaauccacauaaagcuaauuacaaaauaaauauauuacauggauuuuuauaucaugucuuuaaaguuuuaucuguugugcauauuuuaauucagaucagucauaaguagcugccauauuggacaguggagccuuacaagacugacccuucccgcugccuuccaaaacauguucacauuuagaggauggacucugccaacacugccuaagccccuucauuuuacaggugaagaugaccagaucuagagaugcuggguugcuuagaaucccauagccauucacaucagaagccccacccuuuugucugacuucaauugcuuucaucauucuuucuuuccuuagauuuguguugcugcaacuacucacugugagacuguugcuguugguuaaauauugagccaggagucuuaaaaacauuugguccacucaguaaagccacuguuugauuugguggaaacuguuuugagcagaguagguagaacuaccaggcacauugacaguucuccaugagauaguaauaggaggugauaauggggacaggggugacuuuaugcuuguugguguugcugugggcauuauaggaguaugugacuucaaauuuugaaaugcuagcugccugcuuacaggaagggagaugagcuguucccaugcaaaguuuauugucuaguuguauguauaagccuacacaugaugaauaucuuaaugcuuaacucucucuggaaauggcaggguuaagcuuuuauauuucauauuuuuuucuuguauuaggaacguguguguguguguguguguguguguguguguguguguguguguguguguaugugugugugugugaauguacuccuauuucucacucaguuauacuuaaagugugaugauuuuugacaaguuaaucccaguacacuccuggcauguaaaguauuuucagaauguaagcccauguggaaauucguuggcuugguaugacggguucgggcaggggaggcauagugugaucccguggaguguucggagcugccaaguauuuguucuucggugugaaagcgugcuugacggguggacuuuccuagcuggaaggugcuuuguucauccuuccuaaaacauuuaucagcacggauguuguagaucguguaagagaguccccuuuauucaugugacuuaguucagugaucuuagauuuagaguuaaguuuuuguguuccaggguugggacuaauucccagccauggcccagcuuuacccacaaaggaacuaccgaccuguaaggauauucauuugaugcguuugcuuuuguuccuggugccagucauuggauuuugccuauagugcuuuauguggcuauacuuagaaguuuuauagcuuguagcaaucaggugaaaguacagggauauggcugaguacuguaacuugcgucuguaaucccagccagaggcaggaggaucaccaguccagggcaauuugagcuacagaggcaaacugaaaaaggaaaagaaaaaaaaaaagagauuccuuuauuuccuuuggccuucauacacaaauauuuaaauucuuaauguacgguuuuaagucagcccccuaccucccccaccuugguaguuugcauaguacacauuagcauuugaaacaaaaguuuugagcuauaagaugcucaugggagucauucugaaauauguuuaagguggauugauucggaaaggaugcaaauccaaguuaggcuggcugaggccuccccgcuucuuuagagggugauacggaagguuugaggacccagucugcuucggucggaguguggacagccagugagggcagugcagcaaaaccgugucucagaaucagaaaguuaaaaaaaaaaaaagagggcagagguuauaguggagagacagggcauuugcuuagcauucgugaggccuuccauuuaagaucucuaguacccugggagaauaaaaaauagucguaaguucauugugggaaagugagaaaaaguguauaagugcuuguguucuauccacgauugcuuuuguuguuguuguuguuguuacaucauauuuaaaagcauuuuuguaauuaugccauagauuccauuucauaucugguuuguucuuuuuaugguuaaauuccaucccucauaaauucuuuguaauuauaacauuuaaagggugcauucauuuguuuaaagcaaccagagcuacucacuuguacguguggggcuuugcuuuguuuguuugcuuguuaguuauuuaauauuuuaacagagggggacgucuaugugcuaaguaaguggugauacucauuugucgagugaucuaaacugcugcugcgcucacacuucgcuauaauaugugcuuaaaaaaaugagaugaacagauaucauacagaucaacagggauuuauaaaucccccugccaaccccccaaaaaaagcaagcaaaaaaucuggucugcugauugaaagaagcgauaccccccacuuaacagcucuaucggcacucgugaagguagaaguuugucuguaagaagcuguuagacuugacaggcaaaccuagcugcgccuucggcauacacguuagugauauugugccaucagcuuacuggagcaacucagugggaacaggauuggguuguaugauuucacaaauguaaauagaacauccucuuccucguuuccuugcugcuaaugucucucuugguauuauguggauaaagagaaaauuauaacuauuaauucucgggaguucccaaagguaagacucgaaagccaccaaagaguacuauauuuaucuuuaaauucaacaaugaggugaaaugcucuuuucagaggucaccguguagaaucuggagcccacuuagccagacccacgucagcuuuauuaaggggcugccuacaugcccagcuuuauacuacugcguguuguuguuuacuuauuuauucugcuggauacuguaguuguguucugccacugagcuacacccccagguccauguucauuuuuaauaagauaauacuauaaacauauagugaauaaaugccaguacagcacacgauagauaaauuaauaaaacugaaguuccauaccaucagcagaacaggaauuauaaaagaugacuucaguguaagaggcaaagucauuuguugagccccaacucuacgugaagaagaacucauauucaaccauggggggaaaaaugaaaagacaugaaaugccugaucucuccaaacuucugcacuacugaguagauagcaagccaaacucaccaaucgauauauccugugacacuggggauuagucuguggaggggaggggcgcuacguaagcaagugaagggcucaagagacaagucagagucaguacgaguguucaugggaacagagaccaggcacuuugcuguauggauucuuuugacccgaaggcaacggagaaauagcagacacuugaggcuuuuacccacuccucucugccuacauguggaucaauuuccaucuuugauggugugagcuguaucaggaaggaguuuaucacugaucccguggacauggcacugaccuuagucuacagaagcaaaccccugguuucuuccaucuuuuuuuucuuugccaccaguagcugcucuuagcagcuccaggucucuuagacugugaaucauuagccuucccuuugcaugucaacauuuaggauagugaggaauacuggacuaucuuauagccauuucagagucucuggggggaauaggaaaaggaaagaauuugcauuaaaagucagcugaucugucaugucagaggugugauuuguuaguuuugggaagaccauuauucuuuaugguacaugugaaaauacugacuguguaaagaagccccuuauccguggugagaacaaugguaauuaauagcagauagaccuucuagaagucaguugugcccagaaguguguuucauguaaucccccgcugaaugggaauuuaagauuggaccacaugaacaaucuguccuuggugccuccugagccaccucugcacugccuacgugaaugaugggugggacugagcuaguggguccugucgggccagacauccucuccuugaggaagacagccuuggggugggauggacugauaagaaggcagacugggaguuuguuaagccaucagccaguucucaacugcucuggacccucccugcagcaggagggaugcugaggaguaagaccuccucccaccuccacucacacucgcuccuuggugucuucucugccucucucugcucgcaucaccuuuuuccuagucgucuaagucagcgguucucaaccuguggguugugaccccauugaagguugggcaagagauuuuuuuuuuuuuuuuuuugcagggguugccuaagaacaucggggaaguacagacacuuacguuaugauucauaacauuugcaaaaucauaguuaggaagcggcaaggaaaauaacuugacgguuggcucaccacagcaugaggagcugguuggagucuccuucucuuuaucacagcuccaaauaagggaacccucagaagaucugggggucacucagaacaugggucugcagaucaugcaagauccagauuaugaauuuggguccugacuuggcacagcccaguagaaacgcggcuguagaggaauuauuaacuuucuuaagcuuccauuuccauaucuacagaguauuuguuaauagugcuguuaggagccaugcugaauuaauaagaacuacaaagauaacauguggaagguacugaaugaaggauuaacauggcucuucuugucauuucuuggccccuucguaacagcucuuuucugaccuuucuauacaguccugacuguacaggccagugcugcguccccuuuuuacaaaugcaggggcugagaagagcccauuugcccaagguucuugucuucuguuucagcugcugucaaacagccggaaggcuuccguucuaggcgaauucccucccugacuguaccugagaccagguuguuaagauuuuccgcagggccuuucuuuccuugcuuauccauccuugcaguucuugaccuucuugaacccuacaaaaccagcuuaggaaggaaucuaaagcaugcuggucacaacgaggaccauuucccuguccuucccucugauucuccacaguugaccaggcgccggugacagccuuggcugcuugaaccagcuagagagagccacggaauuccaggcugcuugcuuucaaagggcuccacuaaccccucugaaaacaaaggguuguuuaucacauaucaaagcauaccgggcagggauaauugagagaucuucugauaggucaugugguuuguagucucugcccaggcuucuggagugggugggccgugcuccugccucagguagcagugacuucugucugccaggauuaguucugugugacuguccuguaggugugcauagcauccgcucaccaucaacacuuuauauuucucugccuaggucccuagaaaauagauucacaaagaaaaccgucuuguacuuuguaugguuucaggugacucugauauuucaugaauucacaaaacccgaguugaacacagcaccaccuagucucuggucuaggagagguguuuuguuuuuucuuuucuuuucuuuucuuuucuuuucuuuucuuuucuuuucuuuucuuuucuuuucuuuucuuuucuuuccuuuccuuuccuuuccuuuccuuuccuuuccuuuccuuuucuuuucuuuuuuuuuuuuagaauggaaguaucaaccuggguuggguuaaauguuuucgagacaagccccaggcugcaggaggguuuugcuguuuagacucuagaggaacaagccuucucuucucgccauugcuuugcccugacccugcaugugucaggcccuaucauauguucggcugugugauccugugacacccacauccuguugcuggauccaagcgcuuugaggcuguauuaacgcagauuaauugaacaguugcccugugaaaacagaugcccuucgccgcucguuucuaauaaauugucaagccauuuaaaagacuuccccuugaagaagucauaucuccccgagaagcugaagcaaaaguggaauguuuaugucccaaauuagugugcuauauuuaaaaccaguggccucggccugaccaggacauaauccuucgccgcuuaaugaaacugccauccugucccucuguauuauauagugaaguugguucuacuuucuguauuccaaaccagaaagccguuguaaagaacuagccagaauaagacauuagucuucagcuauuugauguuuucuuuauaaauuaaaauuauaacugacuuugaaauaggaagcuaagccuggccuccccugaaccaaaaacugaaauuuuaguaacauuuugcuuacgggauauuguaauaaaaugcucuuugcuuaagauaaagguauuuguccagugacauucugaguuacagaaaauugagaauguauuauagauaauguacuaugaaaccagaagaacauucucucuaguugacaaagauaugcacaauacaaagauccagguauugaucugaugcuguucagagaucgagaaaggccgagagcaaauccuauuucaaagugcaauucaaguaaaauuagauucagugagacuauaucauuuacccacccuuguaguaaauaauaagguagaggugcgagucuaagcuguuaccuaaaggaagugaaaugacccagagagaugagcaucccaugaccucccaaauggaaucgaagcaguugaacuugcaagaguagacacuagaugccaguggaugggguaaaugggagauguuguucaaaggguaggaauucgcaguuagacauggguacaucauagagagcuggaguauagauauugucacuguaguuaauaauaaguguuauauucuugaaauagguuuuaaguguucacacacauauagaacaguauguguggugauagguaacuucauuaguuaauuguuauuuaauuacuuaaaauuauauauauguguauauauauauguauguauauauauguguguguauauauauauauauauauauauauauauauauauauauauaucaaaacauuaucucgugcauguuggauaagauaacuuuuauuugcuacuucuuuuucacaaacccaccuugcacuucauuuguaaagagaagugaagucccuaaccuggaggguuacaguaagaauaucguguaggcuucaguaagcauuugucauuacugaugcugcuguaagccagugcucaugacuggcuccucuccccuuccucugccagauguucucaguggcucucuguugaugcaugcagcuguguuucugagggacaccauggaauguccuuaacccucugucuucaggaucaguguuuaucccacaguaaaagaaacaaaucaccaucaagguugcuuuguagcaacauacaaacccccaaagcucacauaaugacuaugugacaccauaugaauggacaccauagccaccauguaacggcugaugacagauacuuucuccccguuuuaguaacacucugcugcuuuucugucccaucagaguuccaugucuuuguauuauguguuuauuagauccuaggcaugauguaugcaguacugguugccaucaaaauagauuguagaguuuaaugggaagucuaggaguugacauccguacccuacauaaaaccaaccaaccaaccuuuuaaccuugcugauuagcuaucauugaguaauagauuucccaccuggaccaccacuuauacucuacuaauucuaauccagauucuguagcucuguugucugucuaaaucugaauucuuuucucuugacuccaucuguuuugucagagccuaguguagaagcgguggacuuugagccuuacauggacccaggccaacaguucuucuccccacauccggagaccaggcuuugccuuuuacaagaaggaaacugccucucuguucccaagacaaagcucccucgacuauaguugcugcauguuuggcucagagguuugcacagucuauguguauaggcaggccauggccuugcugggccugcuggaagauggcuagcucucgcuggcuaauaguugacucacucaccgugggauggaagcucuggccuggaccagacucuggucagugucuguugaucucagggaacauuccacagcugcugauguaacucaaaugacuggagccaacucuucuggaccgguuagagggcuugccuggaccaguuagaugacuggcugucacucaguuuaucugggggaauucugugaagugaguguuacuuucaguuccuccaugguaaggggaacuucucuccucuuaucuucuuuuugcaaaguguguuuuuuauaaaaccaaaguagcaucuuugggacugugguggugccccgauucccgauugggaagccuugggaagaggcugcagaaggauccagaguucaaaacagacucagcuacagauguuccaggccaggccaggugacaugaaacggugucucaagaacccucaaaauaaaaucaucaaaaauagagauggaguuuauaaacgauguggcuacuauuucauuugguacccuauucaacaugauccucacagugcuuauaacuccuuuugcuugaacuuuuuuuuuuucuccugagcuggggcucagaccagagccuuguguacuaaguaaaaaguacuguaccagugagagcuaucccaagacugaaauaucuuuuuauugagagauuccucaugaaaugcauacugaggcuuuuguuuguuugcuuguuuuucuaaaugugauugcagaaccagauaauuugugagacugcccaugguaugaaaagauuaguuuuccuagucugggugugggccaagaccuauuguuguuucugaugcaaacccaagaccaaggacugcgguugcaaacuuacuuauaugacugccauguuccuaaaaaagauuuuuagaaacuuaaauuaaaaaagcuucaagcagcccaggcacagugggcacaccugucaccccaguaccuggaaagucaaaaucaggaguuccaggucauccucugcuagguacaaaauuccagagaacccugggcuagcuaccugagacuguuuuaaaaccugcaacaaacaaacacaaacaaacaaacaaacaaaaaacucucacauaaaaauuagaccaauagaauuaggaaaacaggccacuagauaccaacauacauuuuguuacuaauuuuaaaacuaucccuuagaugcacagaaguacuuaucagauaacugcagcuuaggggucgcccgaguuuacuaggaagccaucuguuuaugggacaaacauguaucugcugucaucaggaaggucacugggguagcugugacucagauccacuaagggaagggacagaaauaggacuccuaucuuuuguaucucugggauggugaccagagagguuuauguuguugcuauguaggcccuuuuuaaaaacuccaagcuguaaauacugaauuuuagaagcacaucgucauggcuuuagaaaaacaacggucuaggauuuccgaaggagcuuguggcuccugcagcuauuccugauuugguguuaaguuucuguucuuaccagguauccugaccuccagugugggcuucuuucagaacacuucaauuaaaaauguaauuauuaguguggcauucgugagaacaugcccugguagagcuuuagggaugagaagacaacguuugaaaauugauugucuccuucugacauguuaucccagguuggaacucauguucccaugcagcucagguuacuagggguguugcuaaguacuuucaccugaguuaucuucccugccaccaaucagaacucuuagcagucaaaauaaaagggggaaaaaggguuucauuuaguuuuuaaaagucauuguguuuuuuucaagaaaaauagagauuagauuaaaaaaacacauuauaaaguaaauuuuaaagcccucuuuguuuuuauugaaacuuguaucaauuucuuuauuuggcuuaccuugggacaccaggaaaagagccaagguuuccuagaacacagcuugaaauccaguguuccaaaggcccccuagucugugcuuucauuuuggagcaccauuuuuuaaaaaaauaaacccagauuugaagaugaagagauaagcugacuggccuugaaguuagggccaaggccuaacaauagcuuugaaaccaguuuuauguuuucagaaaccaccaaaccagccaggcauacugacacaugacuuuaauccuagcacucaggagacagaggcagguggaucucuuugaguuugaggccggccuggucuacaaaacaagguccaauacagcuagggcuguuacaaagagaaaucccccuccaaaaaaaaaaaaaaaaucaaaagaaaaagaaagagaaagagaaagagaaaaagaagcaagcaaaaggaaaggaagaaagcaagccaccaagccagccuuagguccagugucguugaucagacaguucaucugcguuugucaccacuuuacuuucugggaaggaaagcagggauuauauauauaugguggauagagauaaaugagcagcuauuuaaaaugccauuuuuuuuguacuuacuuauaagucaaaucuguguagauacuaaagaugaguuauagagaccagacuucuguuuuauacaucaaauuucaauuuuuucaacaguaaccuuauugagaaccuacgugauuuacuuaaaugaaaaacagcuuucccuagauccucauggcuuuaggauggagccuagugguuacacauuucucacugccuuaguuuucuguuccgugaucggugaucccugggagaccuuuugaccuguggcaaggcagcacagcauggugggagcgcauggcucauucaccucauggcuaugacuggguagaaagaagaagcaaagauuggagucuccacgucuucauuaaggacacacgcccaaagacaggaagaccugcaagggaaagaucaccagcguggaacucuuucucaaaaguuaauccagauuucgccaucaaagccucugccuucauggugaggcauaugcgacgugccucugacuugguagagcuaaagacaggaaaggagaaaagcagagggguugcggggggaggggcacuuguacuuuucaugucuuccagccaagcgcuugcacuugcccucuuauggaagacucgccauccggacaaaggaggguaguuacggccaaagaaugaaguugcugaguaaaauggauacccuucucuauuuuuuuuuuccauuuuauccugguaccuggcaaagaaaauggaaaaaugaaaauuugguuggaaaaaagucaaagacgcguguaauuggauuagggcuggggauuguagcaccguucagaucacuuggcuagcggugcccucaguuuauuccucgacauuggugggggcgggggcagggggagcaggaagggcauaaagggcaugugaaggcagaaauggugggggcugaggagauagcuuaacaguuaaggucgcucuucgcauagucaggaggagcagaguuuggaucccaguucauuucacagcccgggcuuacacccauagcuguaacuucaauucuaagggucagaggcaagaagaccagugagcauucuucucuccaccccacccccacccccagcacauaaaaagucucagagccaagaaaggacagugccucaaaggaauaggcagaaugguggaggaggagggaccuacagagcacauggaugcauguacucacacagacagacagacaaacagacacgaauaaaguaugcauguacucacaccaacagucauacaaauaaaguaugcaucuacucacaugcauacauacauacagacagacagacagacagacagacagacggauggacagagagacagaaaaaaauaaagaagucuuuuagcagaaagagaaauuguuguucuugaugcuggaggcagggggaaucacaaguuuaaggcuagccugggcuuagauucugucuuuaaaaggaagagggugagauggcuuagugaauagagguuaucgccucuaauuuaccucuaagucacaaaggucauaaggcauucauauuuaugucugguuuucaacuugaacuuccuaguaguuuggucagauuuuuaauuccugaguaagaaguuggaagccucuacagguaaucguauuagccagcuccaccuucaugagaagcuaggaucucgagguaggcuaaucuuggcuuuaucccuggcuuacuaagugauuauacacagagauuaguucuaauaagggauaucucuuccugacuacaccuuggaagcaugagugcaaaggucuuuaaaacuuuggagcuaagcauugcaguccggucagggaggccugauggaaugcuaagguaggcugauuccuagcaauaaucuuagugaacgaagggcaguccauuuuuacucugaguccacugagugcgucagacuugaaggguuuaugaaaugucgaauuaucuugacucugagaaaaauggucaguuauaguuuuagaggaaucuuuauaaaauccuggguuaaaaaaaauguauucucaguuugcauucugauuuauucacaauagaucugagucacaggagauaaucaccccuguuguguggggacccaacggagacaagugacuguguuccccuggaaucacagagaaacuuaguaugaagagcauauuguuuuauaaaagaaaauaauuaugcuuccuguuauaaugccugaaaaauccauggaagaaagaauccaaggaaggcuacugaggaucggugaugauaguaguaguuguagugaugagguggaggaaaacauugccaaccucaccacgcaggcuggguggacaagcuggaagaugaagcaugauugaaugcuauuggacacuugcccuuaagucugucacacauuguuguucuaaguccacaggguaagcaccuaucuucagcgaguugucaugagaagacaggauuuuauacaguguguaccccuguagauucaaguuucaagugggauuuuuuuucccugccaguuuuauuagaaccuggccaguugccucuuaacugcuaaacacuaauacuuuggaaguuccuaugaaauauagaauaaaacaaaaagcagaagcaaagguauaacaaaacaaaggaugggcagacaccugcucaguccugucuucacugcauuugaaagaucccugccgugugacuccaagucaguggauuagagacagaaacuuccgcuuuucauguucaaagucaaggucaacacuaaguuaaaguucugaugagggacaggaagggaaauuuauuaugaguuaucuauuuaauacauagucaaccagauccuacuggguggugaaagcuuucucuuacuaguuaugguugguuuuucucuuauuuuaaugcuuaauuaguugcuuuaguccaaaauauguguaacaagauggagucucuaaucuguuacugauuagaugagucuacugauacguccccugacuaaucauacauaacaagcaauuagcacacugaaaagcaaucuggaucuagcauuacacaaacaauuacgucaguugcugacaugaaaaucccagcuagagugguaauaauaacugaaugugugaauagguucucucuuucuaggcugccaguaaguuacaaccuuuucuugaguuggguuucagcaaugaaauauagugaacgucuauuguagauuagauugaaguaggaggaccaguuaccuaucuauuuuacuguucuugacgucaggcaauccuuagggucacugcacaaauauuuaaaauuagguagagacacuaaagggagggaucuuuucugagucaccacagcuuauuucucuuagaagugguuugaagauucaaugcaaagaacuuugcgcuguggccuaauuuagugcugcuuucccccuucaaacagaauaggaauaacccaguguuuaugugcucuuuggguaagcacuaagccagaggauuccguacuuauagaaaugaguaaauauggagaugcugaacaagucaggcagaaagcacaauugcauagcaggccugugggaaaugaacaaugggggaccgagucuauaaauguaaggaagaacugauaauaacuuuugaaaagaauauuuuauacauccagauaaucuaauucauuauauuaggacaauguucuuuuuguagguuuuuuuguuuugucuuuuuuuuuuuuugucaugaaugaacgacuugcugcaaugucuaacuaagguauauauuucagccugaacuuuauucagaacaugagcauguggcauugcuaauaacuucucuguucccuuuaaauggaagcuucuuugauguuccuuaaauaucauaugucaagcauaguuuuuuuuuuaugaugauauaaugucuuaucuugaugagauuccuuucuaaaugucccugcuugcaagaagaagccuuccuuuaguggcucgucgcaucagauuuuugauaacccagaccuggaugucguuucaucucaaggucauaauuauagaucguguuuauguugcuucugcuccccuuaggagagcuguuggaucuuuaagaugacuugaauuuggugacaauauuaaguccauggccauugaauugcuuuucgauucagaggggcuugcuuugauuagggcuuuuucucuaguuuaucauuccuuuuggcuuguauaaaauauugucccuucauacuuacaguuguacauaccauaauagguacuuucuuuuuuccauaaugauuuagguacagacaaaacuaauaaugcuaguuugucaauuuucucuuagaaaaaaggagucgacguauuuaaaugccuugcugaacacacugcuuucugcccuggugucuuuaagaaguugauaagaauccccaugaacuggaauacuguuauauuuuugcuaguaagccguggcauugguaaauagugcaguauucuauuucauggacccuuucacuguuuuauugaugacguaaauuuuuauugccccaagauagguguacucaaaggggaaaccagaguuucuuuuugguaguaaauucccaucuaagggaugguuuuagcugcuuaagcagggucccccuuacccccaccccaggcuucagauuuguuguuuccuaugauggugaggaaggaagggagggggacugcuacuaaaaauaagaauugcucaaucaaggugaagucucuguuuggguguuuuaaguucacauacuugugcuguccagacucgaaugaauauggagacaggaauuagccuucagcguagucuuggccaagcagcugagucauuucuguauacauaucuuaauaguuuggaauauuuuagugaagucagaauaccuagaacagauauucggaguucccaguuguauaaaacucagggaggaccuugacuuugauucucagaacuuuccaaguguuaaagaagacauuaugcuggacguaguggucaugucuguaaugccagcacuggggagucugaggcagaaggauuggggguucgguucuagccugggcuauuuacugaacgucuaucuuaaagugaaagaaggguuauuaguuuacguguguuguuauagucagcuccaagacacacuuguguugggcaagcuuuucuaaaggaguggggagugccucccucuucuuuuuucuccccucccuugaucuuccuugugucuccucccucucuggcccccuuuucauucuuccauucucuccuccucggcuccauucccaucacuccccucucucuuuucuuucaaaggcucuugcuauguagcccaugcuagcccuuuccucaucccccugcuuuccuuaaccuccacaguacagugcugugauuccaggaacaugcccagcacugugccagccucuugcuuuuuuuuuuucuacaggaaaaauuccuuuccuaauuuuccucuucguuuccuucuuucccuucagucaccccauuccacacuccgcuggggaucaaaccuagggccuguacuuaaguucuguuaccaagcaacggagggagcagcauccccuugacuuugucaucucaccuguucuguauuuucuuuauuaauuaauuuauuugcuuuacauccuaauuguggcuaccuuccuguccucuccucuccuccccuccccuccccccuucccuccuauccccaugauucuccuguccucccuuucuccucaaaagaggggaggccuccuauggauaucaacccaccuuggcaugucaaguugcaguaagacuagauggaucuucuccuauugagguuagacagggcagcccaguuaggggaaagggauccgaaggcagagaguagagucagagacagccccuguuccugcuguuaagagucccacaugaagaccaagcuguacaucuguuacauacauggagcagggcuaggucaguccaaugcaugcucucuguuuggucagucuuuguaggcccuuauggaccuaggcuaguugauucuauaaguuuucuugugguguccuuuaucucucugguuccuucuauccuucuucuuuguuuuguuuuguuuuguuuuguuuuguuuuguuuuguuuuguuuuguuuuguuuuguugguucuagggcuauggcccaggacugcacacacauaaguguaccaccauugagaguggcucucauuucucaucagagaaguuuuucucugcagacaauuauagaaaaucacacuuggcuaaaaggcagaaaacaagugaucauggagggcucagcucuaauggacccaucuacaacauaauacauaucuugcccccaaggcucaaggaaccucuuggaacaguggcuagaaagacaguaagagccagaggaccaaaagcgugaggugagauugugucuccuagaacuaacagagaagcuacacccaggaaaugucaacaguauggucaccugaacagggauacggccacuagacaugauaagguggaaggcagaaauuucacagaggucccaucuuuagacaaauaacuguagacaacuaagggaugcuaagaaugugagauggagucuucacuagccaugagccucuuaauuagucauuucuugucuuuugcaagucagugccagguaaauggaaagaaacucugugguccucaaauaaugugucugucuuucacaugacuuuuuacaacauuuggcucgauauccuuugugaccauaugaaaugccaccauccccaaucuuuuccaugcauuaaacagcaguguguauccuguguuuuaaacaagacagagaggcgcucugccugcuccuagggguggagauuuccugcauuucacucuguccuucuuucuaaggggaaguuuagccgguuggccuugguaugguauucaccaugucaugugguacccauuagcauagcgguauuuaccaaauaguaagauucuggccauuacgucaucuuuuuacuuagcugcugcaggacaugcguaacacgcaacgcuacuuuguaaagcucucugaagccuucucuuuauaaaaggagccuggcauucaggagucaggcugaccucccuuacacagugugagacaggaggugauuuguguucucuacugugaaaucagaaggaccuagugcucuguguucgggaugcaaagcaccagcucgucccuccccgcaggagugcacuucagcagauucuggcaucugagcuccugcccuuucucuucuuguucucauucacuaauccucuuuccuugaugccauuuuguuaaauuuugcaagugucauuuuggaaccuagagaugggguuugaauauaugcaucuaucaucagucauuuuauauuuauuuuguaaaaugaaaacuuuuuuuuuuuuggagaggggaggcagugucuuucuauacagaccaacccagccucaaauucaacguucuuucugacccucagccuucugagugcugacaucugugugccauccggucucgcuggaacuuuaaacaaacuaucuuuguucauuuuaccuguauugucuaaaaggcaaaacagacccagccaaauaauaaauaaauaaauaaauaaauaaauaaauaucgaggguuuuuuuguuuuguuuuguuuuguuuuuuguccuuguaaguuccugaauuuuauuuacauacacauuugaaauucuugcgauugaccucugaaauaccacaggccuuugcaaccucagauuuucucagccugcuuacuuccugucuccucuccucguuuggcaugguggcucugcaggaguuuuauaauagcacucaccacuucuguucccuggaaggauucuuuugguuuuauauacuuuacuuaaauacuaguuaaguuacgauuggucacccguuucaaacguccuagcacgccguagcccguaaguuacgauuggucacccguuucaaacguccuagcacgucguagcccgauguuugcuuuaaguauggcuauuauuucaacuucuuaaaaacuuguugcucuguaugguagcaagauauauguguacauaaaagauaccuucuaaaacucuuuaaacuugucucuuuauaaaaggaacauguaacggaggggucugggugggcucugcccuacuguguaaauggaccuccuaggcgaaugcauuugagaaagcuugguuaaagugacccaacgcuucuacucuccagacaccuaaugaaggagcuucuccccguguuuguaaacagaaugcguccccacuccuugaaauggcauuuucuagaaaccauuuuuugagaacauucauuuaggaauuaaguaaggucuauagucauacuuuuaaaauuuuccaauaccacuuggcuguucucaguauagauaaccaccuaaugauagauuuagcaauuuagcauuaauaaguuuauacuaaaaaaaaauggguccauaacagaaguucuuuauaagaaacaauuuuucuuuauucuauuauuuucagaaucuugguauguuagccuugaauccaugcccuccugccucaguuucaaaacuacagacaccaguggcuaccgugcccagaccuaggacaaaaauugacugcuguagcuaccuagaugaaccaagacagccuuaacaguuugaacugugcuccuucaucucauuuagaauuagugauucacugcgaauaagcugucaagaaugggaguucaucaaccacguauuagccaccagagcucacuuugccguucaacugugaauuaagggcucggagaugguuuaaaauaccacacggccuuggugagucagcucugccacacacacugcacuugucgcuucguagccgggagugacgacauaugagcugcaguguccuuacucguuugucuccuggagacaacuuggcaggcagacaucuugcagauaaaugaggaaagauugucuauuucaaguggcauaagacauuccuuaaagcagugugucauaucugcuuauacagucagcauuuucuguggagcagaaaaucuccucuccggcucccuggguacacagcaaacaucuuuguguggguagcguccaggaggcuucaguggcucuguugucuguagaugggucaggaaauuucuugugccugcauacacuucuuuuuuuucuucuuccuguugaaugcaagcuuggucaaucuggguagcuuuuuuaaaugcucacuauacaucuccuguguauuacugaauuguaauuuaaggucagguauugagaacuauuuuagagagaggaacuaaggaugaaaaucaaaaggcuugguuggacuggaugauuggcucagagguuaagagcacugacugcucuuccagagguccagaguucaauuccuagcaaccacaugguggcucacaaccaucuguaaugggauccgaugcccucuucuggugugacugaagacaguuacaguguacucauacacauaaaauaaauaaauaauucuuuuuuuuuuuuuuugauccuuaagacuuuuaauaugucaucauuuagucugucauuucucaacaugcuuuaaaacuacaaauuacauauuuuuaagauuuaucuauguaccuauguaccuauuuaucuauguaucuaucuauauaucuauguaucuaugcaucuauguauuuauguaucuauguaucuaucuacaucuaucuaucuaucuaucuaucuaucuguauguauguauauacaugcaugcauacauauguacauacauacauacauuaaauagagaaggaaaauuuaaucaauuuuuaugauuauauuuucaacuuaaauauauauaaauaauucuuuuaagaaagaaagaaagaaagaaagaaagaaagaaagaaagaaggagagagagagaaagagagagaaucaaaaggcucucucuucaaaguuauaaaugcuaaauucuaaauaggaccuuuucucaugauacaaacauacccaucucuucugugauuuguuuuguuuuccagucccuagagcaacucugaaccaauacucugaauuuucuagauauaggcagugauggauuagacuugacuaaagaugcaagacauggggaaguuucuggaaacauuuuuuaauucauaaguguucauaaggguuuugcauuggguaaucaaaugauacaaaugguaugugugcauaugguuguuaucccagaacagucaagacauuauucaaauaguuuccagugacgucgcuucucugaguuggucuaaggcacuuaaagaaacaaugacuauuuggaagucuuuagugacaaagaagacuccagcuggcuguguugaucuuggaaccaggaaggacacuagaaugagaucccguggaugugcucagaagcagagaccagcccaucgccuacaguuauguagggugguuaagaucgccugcaccuguucuugacugauaaauuauaaguugaucuucacagaaugaacacaauaaagggguguguccguuacuguauauaacguaauuauggccuauccugugugaucacacacugaagagauuaccuggcuuuuuaaccugugaauuuggaucauuggagucagaguggggcuucauccuaauauauuuguaauguuuuaucccccuuuguauuguauuguaggauucacgguuauaacgucacauuuugucuuuugauuaauuaauuauuuugguauguaugagaagcagagacucgugggcucaaccucuguuugaguacauguugguauuugguuuucuuguuggaaauugaccaggauuuauuucaugcaugcuuuacacgagccuuaccacucuaccuaagacucaaggccaauuuugauguauucucuuagaaacacagagguaaauaauaaaugaguuuucuccuaaagauuuaaaagcuuaguucagaauuucaacgaacacacuguugagauuuuccagccaaguacuucuuaauucucuauuuggaaggguuuccugggagaagguggccugugggggaucccugacgucuucaugguagguacaagcagggccacccauauugugaugaccaacuaucccaaugaccuuggauuugcacauggaaacaauucuggaagcaaaaugacuucagaaccaugugaguuagccaguggagagccacugcaugguugaacuacacauguggaagcagugguaagccuucacugaaaacuacacuguggguguaaaaccgaguguuugugagaacugaaaagccaucuuccugagggucugagaaggaugcucuugcuaauuacugccuccauuuuuuuuuuacuuagaaugauauagaaucauguagagaauagccccaggaaagaaggagccaucguaauacauggugccaucauuuuaaaaaucacagcuaugugcauuuugauugguuuauucaaacaaaaguggcuguaucaguaucaguguggugugugugugugugugugugugugugugugugugugugugugugugaacacucucuggauagauuguguaguaggacuuaaaucuuccuaucaccucuuauacuccagagaacgauguagcuugagccccauaucacaucuccaucuccauuucaggacuuagccucuauagaucugucagaacaucccuggagaacagggcguacauggugacaguggaguuccuucuccuccucccccccaccccccgccugucauaggauauggcuggcauaccccucccccugaacucuccaguccaaaggcugggcuacccuucuccucuggcucuuuucuguaugauccaaugguccuuuuguggccuccuguccuuuuguuguccugaucuucccucucccuuuauggcucuccucacacugccggccucaucuuuacucugggcugucccagauguuuccaucucuggcuaugcucucccucauauuuacaguaaacuuucuccucuacuauaccuaggagcaguugugucugccaguuuccuuucuuacguuccuucuccugcaauacaauucacuuuuguaggggcugagaaggggcgggcucauccucuuacaccaaugagcguccuucucuucugguuuuuggcuagggcaguaguuccaugugucuucauuuaguauauacucaaggcugccuagcugcucguccugagaugucgugacuccuucccacacucuccugugcuucuuagcugcugcagucaucaccgugccuaauccauacaagugcccccguccugugguguguccaaugagacaccaccauccuaccuuucuuuauucuuucagcacuuucuguucugaggugagccuugucugagccuguaccacuggguuggaucuccccacaguccuuuucuguggcuaugcuuacugccuuggaaauguuuacaugauccuaagucaccaaaccagaacuucccugaaacuucgccuccgaccgaccgagacaauucuguccugucuacuggaaguggcaagggcuccguagccaucagcaccgaguuugaguuuggcuuaucugucagcgguugguuucccgcaucauccugaaaguauuuucuguucacuaguucacuagccuuucuuucacuucaaguguuagguuaggaguggaaaucucuugagaaucccuuugugcagcugaaggcaucucagcugcaagaacuaaaacaaaacaaaguagcugauugggugcuucauucaggaaguauggcuggccacuguguuugugcaauccuggagcccagugggacaagccuauguuacuccucucaggaaugugcuauucgagcaccaggaagugaaccgagcugccuggcucagaaaucccccuugcguuuugagcuguugccuuuagaauguucuaggaagagcccgaggucaggccaaguucagcugcaauugguaauggccuaagagugaauucugugcuuucuuuucuccauuggcucccacugcgaaaaucuuauauaucccuaagucgggguuuauuuuauaucguugcacagcuuuguuaauaucgacaaguucuuugcauuuugauuuuaauguuauuauuuuuuuacgccgggcauucuuuagcucuuguauuuauugugggagggaggcaggcauguuguagagagcaaggaaguugucacaggagguggagucgcguuuaucuuguuuguacuuuacaaacuaaacacaagccuucgcucugcacuuacaaugcuuagcuggaugcuagcuggcaguaaagacuucacugcucuuaucacuuuugacuucaaauugcccccuaacacaaaauagaguguuguuauaucccuuucaaaauuauagcccccaccccacccccccccccccccagcacuguguuucugagagccuuuguugccaaaggaauggcaauuugaaaaagugguuuuuguuuugcuuuuugguuuugguauggcugggggccaugaaaagggaggcaucuuugauagugccugacucuaaguuacuugagaaggauagucucccuguucuuaucaagcacauagcuggaaacagaaaccuuugaguauucuuuacaaccccggagaagaaauaaucuuggcuuacccuaagagagauaagguaacagaaagcgacuggaacaauggacaggaaugcuguuuuuaagugaucaccaauuuucacauggacucccguauucgcucugagucuuucuugugcccacaaggcaguuucugcuacacccagugccccugugguaaaaauacaauaccaugagaguuauaaacgcaggggaacagccgaugagccaauguuaugaagcuuuggaaagaauuaaaccaagggauaaaauguaaauauuuguucugcucauguaaaaaaaaaauguuucacguccucauccugaagcauucccugugacucugguacacauagaaaggugacguccuaaggccacagauuguugcuuaagugaaaacccagauucacuucaguccugucugaguuggucacuggucucuugguaucuuuacaugaauguguacaugcgcuucucagaauaauguguggcaagaacccucacuggguaugccacacccauuugagcauauauugcuuucaccuugggaaccguggccauagugacguguuugcugaugaaaucuguacacaacugaccacaaguaguacaggauuuccuauucauauagcucuagguaaagugugaguagagauauagucuacuugauaaacauuguauccacauuugaaauauuuccuuguaaguauguauuggccaaaauaaaauauauacagcugaaaaaccaucagguggcuaaaucgugucuuugcagaagucucaaagagaaagaaucagaggagggcuauguaauuagucagagcuagaacuugguagcaguugauugacaucucccuauaggcuucagugcugaugcuuagaacaagacugcuucuacuuagguuuuucauccccagaucuguguguaagaaccagcaucauaugguccauacacuaucgcugguccuaaguccugucaugcaucacauacuggacguuuacggcacuucuggcuuagaaggcugcuauucaaugcggcuaguaguugagauuuucacuugccaagggaagguauuuacuguguauagugaggcccaaggucugauagaaaagaugggaagcaaaccugaagguaaauuugcccaacacaagucuucauuguuguuuauuuucaagcaaaagucuauuuauaagcgaggucuguuguaauauuuugacuuuuaguugugacacucauucucccccucccccccccccaggcuuacuuuuaaugaugguucuuaaaugcuuuaaccucccuuuuagcccucuacccaccagauauaguggaaagggauacgggggaaguacaucuguuuagaaaugguucuuuggaacaagucccuuuuguguugucuagcaaucagcaguucaguuuacagguuaacagggcagcuugacucacucacaaacacuucacggauacaccagcaguauaguuuggcaaagucgguauagcaagcacgaaucagcagugguggcacuaccuaucagagacagccaggccuccaccuccacuugagucagcaggagggaccaaggccaacaggaacaccagcaaaaguucucagccucucucagcaaaacaaagaucagugaagacaaaagaccaacaagcauuucacagcuagcucuauaaggaagccuagcucagccuccgucacugucccuugaguccuauuuauaggcuaggugcggcagaaauugagguuccccagcagcaagugucuuaaacaggggugggguucauauagguuuuaucuuagaaggcuugacuuugggggaaaaugcuaaccucauauacguccuaugcaaucagucucuuuugaaguggcuuguuuuuucauauuaacuacucuuauuuucauuauagucuccuaaaaaaaauggcuugccuccagaguuucaauuguuuuugacaaauuaccuucaagaaucaacuucaaaggaggguaagguuuauguugggucuuggaucuggugcuauagacguguugacacaauacaucauggcgacccagacacaaagggguagaaccaagucuuaacuaguugcuauuguaucucuuuucccuuucagaggcauauugaaugacuugacuuuuaguaccuguuaaggguuucccuacuuacuggcagugccacaggcuggcagccaagccuuugacauggacauuuaggggacacuccagacccaaacuaugaccguuacauucucuaacuguaguguuucucugaagugaaugcaucacuguagauucaacuugauaaaguaagacaguguagcugucuucagacacacaccagaagagugcaucagaucccauauccagaugguugugagccaccaugugguugcugggaauugaacucaggaccucugguagagggggucagucagugcucuuaagugcugagccaucuguccuucuugaggcuguccuaaacaacaaccacaaacucaaauccugaaaacagcucagcgagggccagagaacccaucaagaaugcacuaggaauuauagaacaaagagaguuagaaauccaagguauuuaaaaaauauaccaguagaaaaguuaggagagcaguuaaagccagccgaagacucucaacuacaaccucccaguccaaccugauagauagcauucaaagucuuuccauagguggaggauagguuuuuauuagguuaauacauuccaaaagauuugauuugcuacuccaguuccuaggucaacaaagaugggcaagguuuggcuccuuagcugggcuugagauagccugaaaauaauaauuaauugucguguugaaucagcagcguugcaaacugaauggagucacugaaguuuuuaucaguguuaucagccuguguacagaggugcuuuccaggaauguuccugugcaucgagcaguucaaauucuagucuuuuuuuuuaaaggguaguggggaccuaaauaggcauuuguuggauugcaaacuaacuuugaaccuaauccuuggguuaucucacaaauacuucuguuuuuguuuuuuuuuuuuaaauuccaauuucuaauccauuuauaguugguuaagcagcagucugccugccagucuuugcuaggccuuccuauaaugcaagcuuucagcggcaguuauuaaucucguggguguugaaugauaaacgcugcugcuuucaauagaccucuugguuuccugcugggcaucagcagggagcaugcuucaguagccuugagauggggcagaguuuuggggucagcuggagaacaccuguguggcccucauuugcagagcauggcauccacagaggccaggaaaagcuucuaagagcgcugaguuguaauuugaagcuaugucagcaagugacuccaaagaaugacgaguuuccaggugugaaaacuaccuacauuaagucugugagagcgguuauuuccccuccccucccccuucucuacucacuuuuguaacagauccuucuaggcuggaacucaggcuggacauggcuauacuguaaagguacugugacuuacugugaccaccauguggguaauuugaggagcaggguucuaacagccgucgugguucacuuuucuguacguguuuggugggcaauucuauccuuuguccccacacacauaugcaucugccuuugacagacaguggccaacuucucucugccucugacacucuagccauggaugaaaucuuagucuaguccugcuucaaguuggccuaaaugaucuuugcacuuucuuuccuuuccucgauuguaauuuaagcccuaguuuccuguuauugacgaaacgaugcucugcguauguucucuguggaugauggguuagagggacccucccucgcagagucuugucuuuugguuggaguagcaaaauuugcucauagugauuauucauccuuaaaaggagcucacaggcaaacuuccuagauugucauuacggaaaucaguucaugaccuuugaaaggggagaaggcguucaggguugaauuuaaaagaaacuuggaguguacaguguguguguguguguguguguguguguguguguguguguguguguguguguaaguaauguaauugaacugugcucagguuaugagcaagcaaauaguauuuaugcaaggaaaaccaaggauaggauagaaauagaauccgucuguuuuuuuaagagcuuauacaagaaucccaccaaagaagaaaaaaauaccaaauacuacaccauacgagagagaauuauucaggccagugagaagccugcuuggauguagaaaccagauggucuucauuagccagaaaccuuaaaacgacauaaauccacugauggggccaagcgauggauccaugccccgucuugccaagcuggccuuuuuaaccaggaaaacagagagcuccuuguucaagccccucuuagcugggacuggggugaagaaugcugccaaacccguucuauaaggaauucugaucuugauaaugaaaaggagagaaaguuccuggagagaaggagcgcccuguuugaaaggcagaaagagagcuuguuccagacgcugccucuucccuucauuguaaaugguagggguuggagggguagacuuccccauucacccucugcagauggguccaagucaaguccauauguuuaccuuuauuuuagcucugcugauuuaaggccaacaucuagcugcaguaccaugaggaaaguccauggcaugucuuugcucucuguguuguggcucaaggaaaaaaaaaaacaaacuuuuuuguuuucccugauagcaaagguuuguuuccaaaaagguuagccguguuuuuaagaguaauauuuccguggcucuagcucagcguuuuuuuaaguagccucuuugcuuuugaagccauggcugaacaccuacuguuucagcuggcuguuuuguuuguuggcaccgaacacuguuuucccaugggaaaaauaucuccaguuucaggauggcggcagcaauccauacagguuauuuucauacgcagccuccacaaaaccacacgaaccacgcagagccaccuguguacaguauggguucuagcccgcacuguugacuuacauuucugaaaaaaauaaccugguggugcuaaucccacugguggagauuaagaccacugaaagaauuuuuugauccaaauuugaagcaagcuuuuaauuaaauacuggccaggaugaugaacucuggcgggguccauucuuggggucccaggaaacaguaaagaguaaccuucugcagagguuugaaaaggccaccccaacaggccaccauguuucccaucagggccauccagagcaaguguagguccagacguacuuccugcuuguguaccuccuaccuacauccauccaaucugggccaaagguccuacauccugagauaauuccugucugcaugcaucuggugcaguugagucaagcaaacuuguuuaagggaguugcuuccagccucucugcaaggaucuguccuugggcaagggacuuacagguuagaggcauuguuguuuaauggaucucuuaggcacaguaauuagaacauaccuuuggcucucacggcgguucaguggagugguuauuccacugaucauaauucuccacuuacuaagcggcaucuguugcuuuuccaaguagggagauauuuuuuagaagcgaggaguagaucuuccaguugacauugagaggagaagaggaaucugacagcaaauauguucuaggauagaaagacuucaauuauaugaacguucauacugucaggcucugaguagaacauugcaugggauuuauuaagcuuuuucuuagagacuuuguucaggaaaagagguuugaguaaaccuguucggacuggccgugaggcaggaaaaucuuacguucuguguggccccauugucugaugcugcugcucucuucuuggauggauucugaggcuggguugcuuauagcaaccagcauguugacagaugcaggugaggaugcugagaguugucuugugcugguuaacuuaggcgggcuacaggaaggauugaaaggcuucugauucacuuuguguguuugaucuaauugcuucuucaauauccagcugcagcugauuuggaaaagaauuuuccauuagagacaugguuuuuuguuuuuugcuuuuguuuuuccuuuuaaguacacauuuguaaaagguagcaaaauguuaaauaaaaccaauucugcuguuccuaguucaguaaucuauuauaauuuuggagggacuagagcugaaguucccaaacuggcucuacuuuauggaaauauaauauguuguuuaaaaccuucucuaucuauguauuggcuuucauacuuaauauuuguaucagcugcuucucuuguugcugagacagaacaucuggcaaaagcaauuuaaguaaggcaagcuggcucucucucugaggguagcauccaucaugguggggaugucauggaagcaggaggaugaagagcugguugugucagauacauagucaggaagaggagagagaugaauccuagcgaccaauuuguucucuccuuuuuuuacuaugccuguggucccagcccauacgaugaaccuguugguauucagggagggucuuuacucuucaguuaaaccuggguggaacaacccacacagauuguucacaaguugaccacagacacaccccagguucguuuccacggagauucuaaaugcagccaaguugaugaugacgauaaccacuacaacauuaacuccccuugcacagaaaacccgaagggaacauaggcauauauuuucuaguuuaaacucacuuugcugagcucacaacaucaucagaagacuacagggccguagucaguuucuuugaagagauauggaaaagaucaccaccuuuugucagcacauguauucuacaaacagauggcauuaaaauaauuuuaaagguaagagggaggguggcauagagaaguaugaaagacagaaaaacgaaguucaggaaucacacuuaggaaaauaaagcauaauuuauuugauagguuuaauuaaaaaaaaaaaaggucagguaguaugacaguuguggaaaggacuugacugguuuuagcugcuccaccuguacaauacuaggcuugucaccagugucauggaugugaggagccuccugugcugaccuauuguuaaccauuggauugcgugaggugcgaaagagaagaucauuuauugucaucgguugugcaucagacuaugggaccaaugggcuucuacagcuaguuccaagccuguagcuaugcagauggcccgggauagcuuaaaaucaaugaggaauaaagcaaagcaaacugucaugaauguggggaaggggcuuguagagaggaggggaaaggacaggagugggaggagcauuacagagggucucuauugcugugaaaagacacuaucaccauagcaacucuuagaaaggaagacauuaaacaggagcuggcuuccagguucagagguuuaguccacuaucaucauggucagaaguauggugguacacaggcagacccggugcugguaaaggacccaagaguucuacaucugguucgucugacagcaggaagagagagugugucacugggccuggcuugaguaucugaaaccucaaagccuacucccagugacacauuuccuccaacaaggccgcaucuucuaacagagacacuccuggugaccaagcguucaaguguaugcaccuauggggaccauucuuauucaagcugccacaggagaugaaaguaagcaguagacacuucauacacgugugaaugugucaaagaacaaauuuaguccauuaaaaaacaaauccaaggaacaaaaaccucaaauuacucuucugaugguuccauugaauuccuugauccccacaguacaccaccagcuaguguuguucugacguaauuguguaugugcagaaaagggaagggcucuuuaggcggaagggaacaacagcucugucauuaggauguccucagcuguggguggaauuggaggauaggacucagaaagggggugauuagggaacaacugugacauuucauggugacagaagccaaaaggcagagacugcuaaggaagaaggauucacauguugcgaauaaggccaguggggacacagguacuaagggcauccucuuugguuucucacauugcagucauauggaaccuuugagaggcagacaggucagggugagaugaguaaaccagguuacaggggccuuaaggaacaagugaauggaccggcgagauggcugagcagauaaaggcgccaacaagccugacaaccugaguuugauucccugggacccacaugaugggagaaaucguuuucgccuacaaguuguucuuuaacuucaacauauucgccagggcaguuaguuguccaccacccccgccccacacaccucuuauccucacaacauacacaaaauaaauaaaaauuuuaaaaagcaaguggaaaauguuagcggccaguguuuaaaaucacaagaugauuuaaaguuugugaccaguggaaaaaaaauaugcggacggacaggguggaguuggcuaugucggauuuacugccugcuuuguacauacaguucuggaugggggaaagccuucauuccuucgaauguuguuaaaggcccuuucuccuauagcacgagccuuaaauacguacuagccgguccuuucagggagcucucugaccccugacuguagaagcaugggcaaaagugaggaaguguuuguuccucguuugguguguucagcagaagagcucagaggcuguugaagagcagagcaagagcuguuaguguuucuugcugugugacagguugccucaaacuuacuagcuuaaaacgacaagugguuccauuucagcuucugugagugaggaacuuaggaguccuucuaggugcucugccucuggaucucucucaaagccacauucuuuuuuuuuuuuuuuccuguguugguaacuuuuucuuuccauuuuuauuagguauuuagcucauuuacauuuccaaugcuauaccaaaagucccccauacccacccacccccacuccccuacccacccacucccccuuuuuggcccuggcguuccccuguacuggggcauauaaaguuugcauguccaaugggccucucuuuccagugauggccgacuaggccaucuuuugguacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagaaacagcuacaucuggguccuuuugauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguugggacaucuucuagauauaugcccaggagagguauugcuucaaagccacauucuuauggucacccauggcuguagccagaugucauuggugucacugagguguggcuuaugucuaaacuugcugguguggcucugaacgaggucggaccuucuuauucuugggauucagaccuggaacaaacagaugaggugcauauuuaaccaaguggaccugaccuccagauucucccagaaucccucaguccguguuuauuacagggcauggcuggcauacccugccucugugcugaacuuuccagcccaggggaggggcuugcucuccccccagaaggaggucuucccuacacaauccagauauuuuggucagucucuuucccccuccauccuucuuucccucucucccucccuccaucccuuccuccuuuuuucccuccccacucccccccccucucucccucccucucugcaugcacagauucuuucucuuccccccccccccuccucuaucucccuauaaauggugacaucccuggcuucauuccuuggggccagugaacucacccaagagcugcccugccaauacccauuuuuauacuuuaauuuggcuugaacuggcucuuuuugucagcagagauaaccuaucacuuaagauugcccaacaaugagugagccgcaaugucaugaccuuacuuuugaacuugcacauccccauuucugacaagcauugucugcugcauagacagacuaaugcauuaugggaaaggacugcccaaggucgugauuuccaggaagcagacaggaucguggcgucuuucuugggcuuugacuaucccaggagagaacuuguuacuuaaauucucuuugcagaaggaaacagucucuccugcauuugcguucagugagagguggugagcucaccuggccugugggagugaagaggcugugaggcucuuacugagggaaaugguccucaaggugaggaugggauucuuuugaugauagauucaccaacuuccagugaaaguucuguaacuccucuuugguuagggauaagauggcaaggugugcuaaccguggaaaucuuugggacagaguagggcucacaauaagguuugcagugaccacaaacaagcccccccuuagccuccacgccagggauuuccccacagguggcugacuaugauuugacuuucuuuaacuucccugcccuguuacccaccugcuuauuucaguaaaauuggcaagauguacauuuugaucucuaagauccgggcuuugaauuuccuucaaacucucgggugagcggcuaagaucaaguucacagaacauucuguuugggacacaacuuugccucugguggagaaugagacuuccaguuuccuggauuggugggagaugacaggggccuccuguggaagaguugagcggccgcaacaucgaagggaguucuuguuuguuuguauguuuuguuuuauuucaaaaugguuaauucuccaguggaauuuucuaacgaaaacucagauacaagcuggccuaguggcacacgccuguaaucccagcacucaggaggcacaggcaagugaucucugaguuugaagucacgcuggucuauacagugaauuccaggccaggcagggcuacacaguggauucuaggacagcuuaaggcuacauagagagauccuguuucgaaauaaaacaaaacauaaaaacuaacaaaaacucaaugcagccaguggcucagcauugaggcacucugaugacaucaugcugucaccucuagucuaggccuugucaucaagcagggacuggcauugugcugugugugagcagcugcgggauaugagaauguggguucuuccacggggcuuauauuuauguuagaaaccccucuuuauuguuagaacuuuccaacagauacugcaaaaucuucuauggcaaaacuaaagaauuauugaaugagcaaauguccuucaauacucuuagugccuuccuuuaaauacucuguuaaagaacacgcugucuuccguagguuauuuucugagucuguagcauguauauuagcccaacaaugcugaugccggguugcugugugacugaagagcacuaggcaucaccaucauauuuucuguucuucguggagcuguggauucuguuacuaacuaggacuuauucucuuagguacccacugauggcaacgccgggcugcuggcagaaccccagaucgccauguucugugguaaacucaacaugcacaugaaugugcagaauggaaagugggagucagacccgucagggaccaaaaccugcauuggcaccaaggagggcaucuugcaguacugccaagagguaagucccuaguggugcaucaccggcauucacuaaaaguauuuacuuucuuacaucuuauauuuauauuuucucucauaauaaaaauccugguuccuaaugauccacuauaccuuucauacaguuuuucuuuacucugcaguucacacaguuacauacugcucugugcuaugaccaucaauaaacuggguaaaauuuaaguuuucacaguuuacuauguucuacugugccuguguaauaaagggauaaaggaauuaaaagugcuagauuuaauuauuuauuuuuguucaaccucuuugacauauuuuaguacaacuacaacuugauauuuuucuagcuuuuuuucuccuguaauauuguaucuuugaaguaaacauuuaugcugauaacucuagaaaguauacagaaggucacuuccacuucaucccaugcugaugaauauuuuuauucuuuaaaacguacauuuuuauuucuuguauauggaugcuuguuuugccuggguacaugucuguguaccacgagugaggcugaugccuaaggaggcuccagaagagguugucacaucucuugggacuggaauuaccaaaguacaguugugagcuuucauaugggggcuuggagggaggauugaaguuuccuuuucugaaaugcuuguguucagaguauuuuggauuuuauagaauuugaaguauucgaaaggucauguugagcugcuuuguggaugggacccaagugaacaugaaauucuuaucuacuuccuguaucccucacacucacaacuguaaggucauuuucuguggugcuuuucguuugagcuccuuuuggacugcagccugucccaugagaucagguaggaauuucccacauauagauucagagcagcuuuccaaaaagugccugguuuuggaacauuuccaauguccuguguuuggaccagagaugcucaguuuccgucuucuuugccuuucucacuagcccuuuuugaaaguaagccacaguugucaaggacuuuuccugccgcucuaugacaugggaaggaagcugucucuucagguagcuaccugucuguacccuaaguuucccaugauuccaaagugcuagcagugacugacuauuccaguagacuucagcagaggccaguaggaaggcuggacacacgcuuuguccgugauggugccuucugaauuucuaugugaaugguuguuaguaccuguggaucaucccguaagcccguguuuuccacaaaugaccacauguuuuuaagccuaugaauauugauccuacaaagauuauuuuccuugacugggaagagcccucacuuccugcugcccugagcccagucaugccuggguagcuucauuuucuguuuuaguuuguggcuugugcagggaugagccacagacugguucuuuccacuccagacugccugcuugcggguagccaugggggaggagcaggggaaagccuuuuggcagauuucuucuuucugccgcuaauguagcauucaucucuccuugcucaucaccugcaguccauuggacaagaaagggcuaacauaucaaggguuugcgagccauuuucaugaauuugguccgcauccuauaacaaugaaaagccacugaagccauucguuggcuuaauuuuugaagaagaggagagacuacguuggaauuucagagucaacccuauccaguauauaucacuguagaacauuccagacaccuggucccaagcccaugugacggaguuuccagucccuaugcuuuuuguacagcuugagcacuugaaauguggccaguuagaucuguacuguugagauaaaugucauguuucagaaauguaauaccaacaaaggcauacaacauagauuucauuuugaagugacuauauuguguguaguuauuaaggaugucauaaggauguuacagucaaacuauaugggguuaaaguugauuucaccucuuugugguuuuuuuuuguuuuguuuuuuucaugaagcuggaaaaaaacuugaauguccacuggccacuuguuuguauuuccacucagcagugcucucggcuuguccagugucacugugacagggucguaaucaauucauuauccggucaucugaagcauaagagagaaaugagcuggggaguccccacagauugccacucagaagguucuuggaagccuuuaaaucacauuguucaaucugggugugguggcucucuccuguaauccuuacacuggcaaaucugagccuuagcuauagaaugaaaugucucaaaagcacaaaugagggagauagagagauggcagagggagauagagagauggcaaagcagcuuagagcacuuguccgucucucaaaacaugcuggucugauucccagucccacuugguggcucagaaccaaggauagauaacucuaguuccugauguuugcauacccucuuguggauugcaugggcagcaggcacccaugugggugcacauacauacacaugcauacaugugggaaaaacacagaugauauaaaaauaaauaaauauaaauuaguaucuuuaaaagaaagaaaaucaucuuacuagaauguuucaagguguggagaagauauaagagccagugucuuccucuuugagacauuugccucuggaugguaagaucuccguguagacccacuaauuaacauaagaggagcacagcuccagacccaaggucuuagugcuguaaauugacagggcagaggugaugaugucaccacuuguaaucccuuuucauucuuaacaaagccucagccucagggccaagugcuucugucccuuuaacccacuuagugacacuucuggaaaggagccuuggaauagaccuuggggaaaugcaacauuuaaggggaacaaagagaugcuaugaaguggccagagacaggaccagaacuggcaugugucaugugcugggagacaagcuaaguuaauugcuaaacagagaaaaaugaugagacaaguauggucaaaaaugagagcgacugaagugugauuuuuagcaaggucagcgugugccuccaugaaaacugaccacaugccaaaagcaggucuucagugcacuucuuaaggggagaagaguguaagcuuuucagacuggcccagguugacuuggauagggguagauucuuagcacguuucaauugcauggaugugaacagggaucaccagcaauuauuuccauaggcuaggaagcauugacauugcucacagggucugugcccauaagccuauaaaaucaccacucaacucuaaaacaguaucccucaaaucaaaucaucuuucuccgacuagcuuuggguacuggacagccacaucuaucugccuuuuacuggcuggauacugccuuuuauuaggcagaaagguugucuuuucuucuuucuuccuuucuuucuuucuuucuuucuuucuuucuuucuuucuuucuuucuuucuuuccuuucuuccuuccuuccuuccuuccuucucuuccuuuuuguuugagaaaauuaauuuugacaaaggacauuacccuuaauagagacaagccuaauugcuacaaauaugacaugaccaaguggcgaggauaauuaucacucugaggaaaaaaaaaucuagauaaagagcuugaggugaacagaggcaaaggaaaccaucuucgcuuuaguauuuauuuauuuuuuguuuguuuguuugguugguugguugauugguuuuuaaugauggcaacuuaagccaaaggagacugaagccaaaucaagggaagcauaguuguccaucauaaaucucaggugugugcagaggaggaggcuagauauugcauuggacacagcuaugcuguccaguaccugggaggcuaaggcaaaaggauuaaaagucagaggccauacuuggcuacacugugagauucuguguccaaagagagaguagggugagccgaaagaucugaaggugaaaggagacuccgcugaaucuggugaguuuuggaaauggcaaagaaugaccuuuuuccaagaaacgguuaacuagguagguucuguugcccagagacaaaaccaauggaacagcccauguguguggaagaggguuucuccuacauagagaaaaacccugggcugaaggcagcuuucaaagggaggaagcaggacuagguccuguguuggaguguuggagcagagaacuauucccaagugcuacuucuccuguuaaugccguucuuuguucugccuuuacuccucuucuggugcuaagaugggugccccuuggggcucaggaaggucggaagcuggcagccagugcuucugggaguggcaucccaacuuuguuugccauuguguauuguaauuccagggagaagggauucugaguggcuucguguugaccacacaaagauuuggcgccugcaccaggguacuuacccauguggcuguguggucuggcaacccacaaggcauggaagaauggcugcucacagaagagggagagaaaugcacaaggccaaaacggaaugacuguggcccuguguacaguggcgacagagcuggguaguucuuuuggcugaaagugcuggcugggauccacauugggucuugacuuuaacuggcacagagaaaauggcagaguggcuggagaugaccacuuggggccguuaaauguaguuugacauugccuacaagaucuuucauuaguguuuuaguguuuaguguuuaguguuucccugccacuucccacauuguagcuacuccugguauuuuuaauaaauagcucugauuuauagaucugaauuuuuuguauauuuugcuagaauacauuucuuugcuuuuauuccuucuuuaacuauguuuauauauuaagugacauugauugacucauugcaugaaaugaaaaggaaaauaauacucaacaauuuuugcuaaauuauaauauuuuuauauuuuuaagguugaauauuaagguauguucuguugcaggaauucccaugucagauauuucuuuucaacaggacuuguuuagagcuaaugcuuccagccauguucuaauuucuguauuacuuauuaggcuguuauacuguuauuauuauuuugaugacuuuugccuuaauuagucauuugcaauaauuuugcuuaguaccauaaaggugaucuccuuuuugccaucucucauugcacagauuccuuugaagaauucuuugcaacccugagaccagaguucuacccccagaacucauuguagaaaaagcuacaugugaaguacaauuauaacccuaguguuggggagccagagacagacaacuggucaaccuaucuuacuuagcgcauucuaggagaaugagaaacccuuuucaagggggaaaaaaaucaaaagaugaauggcaugugaugaaugacacccaaaguuguccuuuggccaccgcacacaugagcacacacacacacacaccagaaaugaucucuacuuauuaccaguaacaggacuaaacaguuaaugguuuuuugucucccuguaauggugacuuuauuuuaugcauggacucuaaccucccaagacugagacacagauguuuuagaagcaaucugcugagucagagaggcagcuguuagcagucugagccuagggcagacaggaggagcugaacucaugacuauaaccucauuuugaccuuuugcuaaccaacugaauuuuccugcuaaauauaucuguaauagaugccuuuaacuguuugcuggugcuuagcccagggugguaucuuaauauugauccuuuuauggggaauuagguauuaacuaguuuauguccucugaucucucucacucuucuuggcuuaucuucccugcuauugacuugauuuggaagucuauaagaguggcauuuaugucccuuugguuccuuuggagcuauccuuggucaagggaaagaccgaggagaaacaguaauggcugaauauuuuaccucuacuccuagguacacauaaggccuuaugaaguuugauugagaaaauaguuuugauuguaugaccuaauguguauguuuguuuuagccacauguugaccaggucuuccaaauguuugaugucuauauauuuccuucuguccccagucauaguaguuuuucuucuacccagucauuguugaaguacaugucucucucuuuuauuucuaugcuuuuuauuagcuccauguacaguuuuucuucagcuccuuaucaagcacauauugagugcuguuaaccaacugaacaauucugcauucccaaaguucauagguuaggcuaacucucuuuagauagguuuuggagacacagucuuucagagaugacuaguauugaugacgucaugagggcagagcccuccagaugguauugaugcccuuacagaaacugcagagagccagcucucuuuacuuccucauacaaaggggucaugugaggaugcagugugaaaauagaaaaauguccucagcagcacauucggacuugguuuugucacuuuccugaacugugacaaaauagauuuccauuguuagaguugcccagggugugguauuuuacuguagcauguccaccaggaccccauuaugucuccuguagguaaaggcucuagaaacccauggugcuacagagagugacauuuuuagggucaugauucacaaagcauuuuaucugacaacugaagcaugcugguggccauuugguaaugcugguggaugacuuuguuagcaugagacuguaguaggaugggcagaggcauccuugucuauccugagggagaguucccugcaggagcaccugugguuucugccugaggggccauucuguucuacuguuccugguuuuaaaguuguuagacaagagucaugggauugcacagauuuggccucauuuuauauacccaacaaaaagugcaaugagaggaccugcaaccuuagagagaaacacagaguguagcuuuaaaaugcuuuaauauugucugugacucuuugauggaggaaaauagccuuuucuaugaucaauacuagaagcagagugcuaacauggagaaagauacuuaaauguaacuucauaaauuuaacaauauaacaauagccauuugugcuaaugagcuguugggguaccauggcaaauguuauggcugaagaaaugucaaaauagaaaaagccucagagaaacaaauauuauguauuuucuauuugugguuccuaugcauuguauagauucauaaaaucaugucugucuauaugacaugaugguaucaaugagaugucuaagggaacaagaggugacagugggugguauaggguaggguaagguagggaaagcuauggaggagaauauauucauuguacuguuuaaacuuaugugagagcucuuuaugcaucugagugccauguacaauggauggacacacucaaagcuguagaaauauuaaaaauaagagaucaaaaaccauuaaaauuuagggucagaaaaugagacuuauuagguuucauugcauggcuuucaggugaaaugauauuuuuuuaaaaaaaaaauauauuguuucauguacaccaaaggcuucaggguguguuuaguuccacgucucaagacuuuauuucuuuacuuuuaagccaggcaacccuggccagcguagcuaaagacuaccgaggauagggcuuugugucagacaaugccuuuccuggcuuacaaggggugcaaacaugcucuguuccaucagauugagaauaaaaccuagaaaauggagacagugguagguagcaaggagggucuugauggugauguggagacucuggauccagguuuugagagauggaagccaggggauguguuaguaugagugcuuuuagugagacauuucaguaguguguuucaaagguugggcugacuggggagagaauuuauuuuacaaacagaggugggaaaauggaugugaaagaucauccucugaauucugucagugaccccaugguccaguguaugaaguaccaugauucagggcaauccacaaacaaugucucagacuguguccuuccuguguaaccgggacaggcagauguuaugaaagccaguuguuaugagaaaucauauacagccuugauccuccucugucccccucuggucuuaagcacacaggaaggacuuuugcuaggcaaagcuuccugaaggaaggguuggcucuuugagcauccacuuggagccagccuguggaggcuggcugaggaugggaaaaguuucaaguguagguagucagauggacgcacuuggcuuuuugcauuuccucuacucuuagauuauucacacauucuuaaguaaguccuuuauauucaugacaaugucugugauuucuuuauccuuguuccucuauuugagugcuuucuuugggauuaacaggcccucaaaacaaaguaguccugugcagaagcaaacaaacaaacaaaagcuggcuauaugaauugaaaacagcucuuucuuuucccuaacuuucuauucuaaaauuuauuauauaacccaaugugggauucccaggaagaguuauuucucuuucuguugucauucuucauuaauaggaaacaaaauuguuaaaaagacaaaaacaguuuguccucaucaaucuaacugucuuucaggguugcccugugauaaacagcauccccgaaauaaacuugguuuguuucaguucacacguuacaguccaucacugagggaaacuaagguaggaggaacauaaggcaggaaucuagaaguaggaacugaagcagaucugggccauggaaaaguauggguuacuggcuggcuugcuccaggcuccuguucagcuacuuuucuugucuagcccaggcccaccugccuagggaugguacugcccacaguuccagggucccccuguaucauuuaacagugaaaaaaaugcccauagacaugccuacaggccaguguguuggaggcaccucuuuaguggaaguuccuucuuuuccaguuccuagguuuguuacaaauggauagcagaugcuauaggaguguauucuauauacuguuguuucucucuggucacuuuaugugcucaaaauuaacccacagaucauaagcgucauaguccugauacuuaaaagguccaagaauucauauuaaguaaagcaguuuuuugaaucgguggaucauaauuuuugaauaugaguacugguguauauucugcaucgauggucuauuuggauucaaggacuacuuggaacuuagggcuaaaagagaugaagucagucuaaauauuguaacauaagaauuauagugagggugugugucuuaguaagccuucugcugcugugauaaaacccugaccaaauccaacuagggggaagaaagggcauauuugauauuauacucccaggucccacuccaucacugaaggaagauagguagggcaggaacuucaguaggaccugaagcaaaaaccaugcaguaucgcuguuugccggcuugcuuucccuggcuggugcucagccaacuuucuuagacaacccaggaccucuuuccuaccugggguugcaucaaccacaucaaucaacauucaagaugguuccccacagaccagucagucaggcaggccugggcaaucccuccagcgagccucccucuucuccagugauucuugguugugucaaguuagcaauaagaacugacagagagaaaacugaugucugaaugaggccauguguguacgcaugugucuuuguuuucacaucugugacgugccuuacacgcuaggcauccccucuuugcuuuucucaugagugcuuuggaaaggcagcggcauaccagccaaaccaggcuccuccgugccuucccgcaccaagugugaaugugcggcuagaacaacacauuaauaugcagugucacaugcagaauugggccaaaugguugggaaacacacucuugccuugcagcgcuuugccuucugccucgugcaaggcauccuugugagagcagggcccacucugcuccccucucucugacauugcagacguguuucaucagcugccugugccucucagcaccucauuaagucacgagcagccgccacuuuucggcuuccauuucucuuucucaacugaauuagauguucuguuuucuauauccccucucauuagcagaaucgaggcggaaaacaguuuuaagaugcaguuuuuucaucagguucuagaaacuuuaaagugugucacuuaaaucuggaaacagaaauguauucucuuccgcacaccccagucuuggcuuacacacaccaaaguuuaagcagcgaagcgcgugcuguuaauguggucuccgugugcuuagaaaaggcaccugcgauaguugucaauccgcugugacaugcugcccaggagauguuugcagugaugucugccauuggggaaaccuuuauuaugaucugguuuuauuuucuucuugagcauucucuucguaugguucaaccucauggaccacaucaguucuggacgccauaguuugcuaugccuaccugugagcuaaaugucuugaaggaagcaucacagguuacauaugggguucugguguacagacuuaacaguuccugacauuaaaaaaugauagagaaacauccuuuaagauaguacugcauccuuuaagauauuuuauuuuaagaauaaaaacccugacuaccgauaucaucuuuuuggguuguuuugguugauuuuuuuuuuuuuuuugagauagguuuccccuguguagcucugacuguuccagaacucacucuguagaccaggcuggccuugaacucggguauccaccugccucugucuccugagugcugagauuaaagcugugugauaccaccuugcugcuaccacuuuuuauagggaacccaagaugguuucuacaugaccauuuuucuggcuuuugguauuuuggaauuuuuucaauucucuauuuaaaaauaauuuuauagacugauacuuaauccuuuaaugauauggcaugauucuaggaccagguaaaugggccuuuaaaaaaaauuguggauuuaauucuuccaacaguucaucuucagcuguguauuauuguuagcuuauuucaacccaagauacuauuagaaguauaaccuaccaccucuguuuagaagaacaacauugagagaauuauuuuucucaaaaagcauaaaaccaaguagcugucuuauagucauugggccuagcagauaggugugugaugcccagcaagaguguaagacauguaaaccauuuccauauugaauuguaucaggacuuaaccagaaauaacauuaaauauuugucagacauuacugugcuggcauagugggaggggugguggguggggacuccaacugcaccgcauggcucuugccuucaagaaggacauguuccagcaggugucuaggagguaggacacggucaguugccagguguugucagugauaauagccauggcaugaaguggccuuguuccagaaaaagaaggauucguggaggggcauuugugaaaccagcaaauaaagggguccauuucuacucagcugaaaggaacauagcacuagguuuuaauguaucugagggagauauacuguaaagggguguuuccuagaagcugagugcccuuguuuugaguuucggaggcucggugcucuucugcagcuucucucucugcaccucuuccuauuuaccuccccuggauugcccuggcuccugcugggcaccguacaccuauccaccaagcccaauacuauagccagcuacuugcuuuuaugcuuuuugaaaaaaagcauugucauccugaugacuggcuuccccgccuuugcucuggcuuccccgccuuugcucuggcuuccccgaauacccagaacuggaaccacagguguuuuccagcuaccauguugauacuaggaaaggaaccugggucuccuguaagaugcaagugcucuuaacugcugagauaucuuuaucugcacccaucaaguccaugauuuucaucaagaaagcaaccguacacacaaaacguagcaaagaaaggaccacaaacaaggauuuuuuaugucuguuauacuagcguucugguacauacaucauuagugacaguugucccacuaacagcauauuuucgaauguaaaguacuugcaaauuacauguaauuuguaaugcaugugagaauugaggacuaauguccaaaguuuuucuuuaacuucuaacaacuuccugcuguuuaggauggcaaaauauuauucuuuuuggcgauuccagauuaauaauccuucaucucugaguaaaagugacugagucagguugaaguugcugcauccaugucacagaucagggaaaucagacaaacugcaugugacaugacugacauaugccagcagucacauacaggacugcaccuguacacauuauauauauauauauauauauauauauauauauauauacuuaaacacacacauacacaaaacucauggcaucuuugcuuccuuuauuaaaauuuacugugucacaaaaauauuaaauguuguccuguuucuugugauuaaauaugaugaauaauuaaauauuguuacaagguuauuuacacauuauaauucacuuaauuuuuguuuuguuuugcuuuuuugagacaagucuuucuauguauuccugguaguccuaaaaccaggcuagccucaaacucauagacauccucuugccucugcccucaagugcugagauguaagaugugugccaccacacccagauaauucaguuuuuauucuugacuaagacagugcauuaugugaucuaaucuaucaacaaaaaaugcaccauugucucuauagacuucuucuggagcuacuuaaacaagcauucauaaauuuuuuuuuguaauuuuuaaaaauauagguguuucguuguguauguuugucuggcauugcuuuguugggguuuguaccugugcaaagucaucacauuaccuagcuggccauucaguacuucaaaaggaaauuuacuacuuuaauuuuuuuuaaaucaucuuuuuccccuuuaaauaaacuuccugcuauuuagaauggcaaaauauuauucucuuuggcgaucccaaauuaauaauccuucaucucugaguaaaagugacugagucagauugaaguugcugcauccaugucacggaucagggaaauuagacaaacugcaugggcuuuaugcaguucggguuuuauaaucucucaucuuucugcauaugaacacugcugucagagcauggagggagguggagaagcccagggagucacauguguguccuagauucucuggauagaauuggaaauuaauugucuggcugaucgccauucaaagcucugguaaucucaagggagagccacauguucacagguuuggucugucagcuugccaucuucucugcacagacacugggcaccgaaagauuuacugguccgcugcaccagauauuauccuaggagucugaugguggugugugagcaaugggagcaaggaggccccuucuccugcugguccauuuguaaacucaauuccuugguuguaauggaaaggaaggaaauguggugugacuguauuagaggaauuuauagaaaaaugacgucuaagaugcgucucguaggggcagcauuucuaaagugccagcuggguucccuuuagaaagaugcaguaacucacacuucacugcacauaaaguccuaucccccagggcaaacucucaugccaucgaguuuaugacucacaagugcuguuuguuuguggucuaauaaacaagaaaaggugggagaauuauauuucuguacacaacgcuaccugcccuccauuauagagaauaaugcuauggggcucuuaaauuuuuaguggcauuuucaaggggagcauugcccgggccuuaaaugcauguacucacggguuggagauacuuaagcacaaaaccaaauggagcgaagguagcugugcccuuugcagcuaaacugcuggucguguuugaagaacagggcucugccuuacagacgaaacuaauuauuacauuuugauguucucuuguuugugcacgcaugugagugcgucugggugcacaggugccaacaggugauugcugaagauugaacucaggccagccggugccuucaucagcugagccaucucacuguccccgacuuggguacuuacguauuuguuuagccacaugauuccucugauugauaccuuguguuuuauuauuugagaauauaguuccuuuuuuucuuugaaagagaagucauacauuuaccaaaaagcauaaaagacggcagagagaugcaguagauuucucuuaucaugaagauauucuaccagaaugagccagcccugacaaggcaugaacccacacugucaugcuuugucgcucacagucuauaguuggucuuagggcuugcucuugguguuguagcuccuaugggucagauaggcguguguguguguguguguguguguguguguguguguacaggguuauaccuacagggauaugggcaagcauggacaccaacuuugagugucuauucuucaagagccaucuccuuuuuacuuuuuguaagauuuaucuuauuuugucugugagaauguuuugccuguauagauaugcaccauguguggugucuuuuauauacaccguguguguguguccggugcccacagaggucccaagggcugcuagauggcaugacacugauguuaagaaugcuaaccacaaugagggcgcuuguaaucacaaacaauuccucugcaagaacaauaacugcuuuuuguuagccugaguuguccuuccaggcuuaucaccuuguuuuaugagacagggucucuuaggcaaggccaacugcucaacgagucucagggaucuggcugucuccaucuucccagcucuguaauuacacaugagcccccaacaugcacaguuacaggggauucaucucuggcucauaggcgagugcuuuguccagacacugaucguuuugcugccuguguagagaauugucuuuauagacugucaugucuuuauaggaagucauaacaguauggauccuuuauacacugauuucugccacuuaaugguaggcauuuauuucaguucccucuguguauuuucuuagcuagauggaucauuuuggggggagaggauacuaaauauuucuguguccacaauguaauuauguaguuuuuaaauauccauuuucaucguccugucuuucuuccuuuccuuuccuuuccuuuccuuuccuuuccuuuccuccccuccccuccccucccguccccuccccuccccucccguccccuccccuccccuccccucuccucuccucuccuuaucuuuccuuuccuuuccuuuccuuuccuuuccuuuccuuuccuuuccuuucccuucccuucccuucccuucccuucccuuuccuuuccuuuccuuuccucuuuccuuuccuuuucuuuccccuuccuuccucccuuccucccuuccucccuuccucccuuccucccuuccucccuuccucccuuccucccuucuuuuacaaacaucuuuuaccucacaaaguaaggugagguaaucaaggcauaaguaauaucguuuuauaguauuucaauuagaugccccccuccccccauaacugcaauggacaagaugucagcaucuuaaaugaagacagggucacucugacaaucacaaacaaaguaccgcggcguauccacggcucccaggugggcacggugcucuaguucagguuccuagguuuucucagcagugugcgcagaagcuggggaugagucuguuccgcaucuccagcuccacaccccucccccuccccccaaaacccuuaaaccugucuaugaacucuagugcuuucagccuagacugucuuuguugucuauggauggaguugacccugagcccuacuagccugugguacgcaccuucaaucuuugaagucuucugcuucuggcuuccugucauccauuacaacccuuuuguaggcuguaguuaucugggaggagucagugauaccucugguacuuccguuucucaaacccacaucaugaauccuucagggacauuggcuucuuuuuguuuuguuuuaauuaucuacucccuuugauggccauauuuauauuccuugcgauuaccaauaauugggacuuucucagauuccuaauuuuaauucccaaacucucccaagcacuaguccuuccuggcucacuuucuauaauaugucuacaccaaacccuuuagcccauuccagaauucgaauccuguugucuuacaaccuuuugacuguguccaauucccuucauguucucaccuucaccuccuggauucaucaccuccaguuaaacuaucugcuuccuuacagccuuuaguaaacuauuucccugguuauuuaucucgcaaaauggcucacuuuagagccauauuguguauugcuauucuucuuucaaaucucuaacccauuauuauuauuacauagaagugguuugauauuucacaaauacauuuugguugauugaguuugacauuucguuccaagugaucagcaaacagcaugauucaugagcagcagucaucacagacagagauaaguaguuuauuacugaaggaggagaauuccugagugccguccuuuaaauggcucucuugaagaugcacuuaauaaaauauuuuuguguaaacuguuuugaggacagaggcugauuuuuuuguguguguggaaaccaucuaugugccaugcucugugcaugaaguauuuuucagauagcagugaguugaauauaaguagagaugacaaccuuaaguauaucagucccaggguuucuuuagaauacuacaagcuguggucuucccuagcgguuuauuuugcauagaaaaugaccucaugcuuucaagagucugugcuuucccaugguucuaguuuaacucuccuggacagugucugaaaagacagcucgaugcaagucaccuuggaguggaauacuagguacagccgcucaggcauuuuccuuuguaucaguguccgugcuuggccagaagcagagcaacuuggcucuuagagaauaacggaaccuuugaauaacagcgaagguucaacauguacucugugugccagccaggcuuugccaagaguaaucauuuccucuucuccuguguuccccaggucuacccugaacugcagaucacaaacgugguggaagccaaccagccagugaccauccagaacuggugcaagcggggccgcaagcagugcaagacacacacccacaucgugauuccuuaccguugccuaggugagccgguuagccagccacccccacagcucgagcugaggggaggauguuguaauuaggucauauucaugcaugcacauuuuaucagcaugucacugccaacauauuguuggugccauaccuuugaguuucauaucugcagauucauccaaagaugggugggaaaaaaaaaauggaagugcaaacuccaaacaguccugugucuguccuuauguuucauuuaaauugcauuagauauuggaaguaaggagaggcgauguauuuguuucuucauuauuuaguguggugauugagaacaaacauaggacuuuauaaagguuaggugagcauucuauuaauaauguguaucccaagccugggggaggugaguuaaaguuuguaagcacuuguauguaggcuguaggagaauacucauuuucuaugaggcuugagguuuuaguguccacaaugcaugaaagggccucccucccuccccacaaauaccaugggaguguauacuacuauaguuuggauggugcagguacugcccuguguucuuuuaauacaagaccagcauuccuuagcucucugcuucugaauagcuuuccugucucccagccagucccuggucuucugaguggaaagugucugcuggugaaaccccagagacuugcaagggauucucguuuacacuguccaguguuacaaauggcaggccuuguauauuuccucacaggauuucacaggaagacuauaaugugaggucuccacacucuagcuaauuccucagaaagcccuucccuagggcaccccuuguuccuacaguugaaaaugaucaggaaguauguuugcuggauuguuugauuuuauauuuauucagaucgaaccgaaggaaaccauguguucacaaaggccugaaaacucuacuuucauuuuuaucuuaaaaaauggaguccuuuuugucuuuugagaaagccaucuuaaguccauuuucaaucuugucacaccuucuuccuggcauuucaugugaacaagccugccauagcuagcccuguuugaugugauaaaucccacuugaauguuuccauuguuauugauuaauaagaagguuguaagaauggagaucuuuauauggauagugaugacuuugaauaaagucuaaaagaaaucuuuuuuagagagucaccguuccccuuccagguacaaggaggugaguuugcauuccaacacuuuagcuacaagggcuccaaucaaaaccuuguaaauaaagauaaauacugaagacucuaggaacuuguauaguuuuguuuagcuguggauuccauagagcauacuggaagcugguggaacagcucugcaguuaagaguucuugcugcucuucugaagaaccugaauucaguuccugguacucagguuggaugacacacaauugcuuguagcuagcucuagcuccaggagaucugacacccucuucuagacuucaagggcacuugcgcucaaaugcaccucccacuccuauuuuuauauauucuuucaaggacaugcugacgucugcuuauuugcgcauguaauuugagacaucaacagaaaacaugggccauuagaaugaagaucucaccuguguuucauauucaguaaguuaacaaugaagacaauguugaaccagaugcuugaccauuugauagucuguguauucucuuacacucccuuauuccuuuaaucccuuauuagcucuuuaaguaugguugagaagucaagauuucauaagagaauaauaagagccagauuuuacacugugggcacauaggaacuaucaaaaucuuaguuuucauuaugauaaaccucauuauaucauucagggacagccucacuaauuugccuuuuaguccuaguuuauguagcaaacaccaauuagugaccugcccccugcuuuucccucaacuguuagagaacgauuuuucacugguugagguuuguagagauguccauacaggucagacagggguaagagaaaguggagaggugccucaaaauuguccaagagauccugugaggaaaugaggaagaccgaauucccugcugccucugucuucggcaaggaccagauuucucuuuuaucuucuaaauagauucugagcuccuuugauguugaaguacauaauucaaggaggcaggccacuugugacauguuuagaaaauuucccgggucuggggcagcaucugaucuaaaucagcacacugacucuaacuguuccugacugcuaauagacuagaugaucauuagauacucccagcaggcauuuggccuguuugaaucuuuuauuguguuucuccuauaaagucccuggucuuuucccauuggaucugaaacaaagggucaguugacaggcagagcauaccugucucuugcuuugccaaagagcuuagauuagaauuaagcaaugugaacauugucaauuucuuaggcaguggcaaaauuucuacgugucucagauauguuacacaaggcauauaaaaugcgcugauguguaugugugguguaucuucaguuuugagaaaaaggaauuacagaacacauauaacucaugucuauuguuugcaugaacauuguaaguugcaccucuucaccuacugucuucauuccuucccucccucuuccccuggcuuccugaucuguccuucaucuugauguccugucauugguggcaugggucauccauuggaauggcuaucccauaagguugacucuguuggccucccuucgggaguauaaguguucauugcuagagaaguuggauuucuugauauaagucacacagccaugauguguucagaucaggaccagagcccacaauuucuugauuucuuauuaucuguauucuuuauaauuuuuuuaaaagaauuaggccuggcaguggugguguguaccuuuaauaccaggacacagaagcauguggaucucuugaguucaaggccagccuggucuagagagugaguucuaggauagccaaggcuacacagagaaaccuugucucaaugccugccacauagaaaaaaaaaguauuaaaacaacuguccacuugguuuguuaauucaaaucaugcaagaaagguugugaauuugagacaauaaauauuaaaauccacaguagauaucauguugauaaagguggcaauuuggaccuuugguaaggaaugauugggaguucaaauuuuuucugauaauuacagagguagucagugacuuccuucucuauaauuugcuucugaaacaaagaauucuuguuuagcacuaaucuacaaacucucugagacuucccgcuguauccaaauauauauuuuagacaaaggagaguuuuacuggaguuaauucccacaaagacgugaccuaaaaacaagaguaagauugucuuagacauugccauauugaaauucaaaacaaaucuggagagagacgccugccauuccuggcuugugaccuccugaccgcugccugucucagaugaaggaccagaauggcaugagcugaauucccucuauagggguguuugccucgggcucuuagcucugcacuaucucucuuugcuggugagauggggaaguguaucauguuaccuuuggcaccguucucccauggaauggacggcuuccgucccuugggaaggaaggcuagcucuccuuucccuuuuuauuuuucauacuuccagaagcagaguauaggaucugacuugaucaaguaaacaucuuaucaugugccauauguguaauccaaagcacaucguucaucgucccucagggaagcggucgguuuuuguuuuugcuuuuucgaaccuuuuccauuucagugacuucucucuuuaugggauaauggaugcacuauugaaguuggcacacuucugcacuugugucugacuaguagugccacaguauguugccuaagauaaaucacuguugcuuuuacagggccaaagugcaguuaguaguguaauccaaaagaggaauuagaaguugaggaacuacgaggcgacacugcgguaugccccuguugcuaaggaagauaccccaaauuugcagguuguaauggccuugugcagaaugagaaauuaagguuccauucucugcauuuugaauuuuauagguuuaauaacauuauaagacaagucugccuuaguuccuagauggcugcuucucugaagcaucuauagccaucuuggucuucuuuaggucaaauaguguguauuuguuuacuugauagauaacuguacaacagaugugucaacuuaugcucaacagauuuuuguuguuguuguuguuauuguuuguuuuuuuaaacauauuagccaaugguaaaauguuuaagaguaaaaauguuaccaaagugugaaaguaggaaagaggauggaaaaacauuuguuuuagacuuuaaauauccuuuaaauguccagaaaccuaaauguuggacuccagagaauuuauagauuuaacauuuuuuuucaguuuuaauaugauaaauuagaaauuagguaccguuuuuccugauaaugaaucuacaaaguacucauuaaaaccacuuuaguuguuuuaaagguaagaauuuuaucaagauuacugaaauugaauuaaugaagauauuauacuugacugauaaaauacugcuggccaggguaggagaugauaggcuuuuaaaaucauuaucuaaaaaauaaccucaagaauauaagaauuaacaugacauaacagugaaucuaaaguucaaguuaaaagacaguuuaguaucaauaucagcuauggcccagcaugguggcccaggccuuuaacaccaauacucaguaggcaguggcaggaagagcucugugaaauauaggccaaccuggucuacauaaugaagucgaggauagccaggguugcaaagugagacccuuucucaaacaaagaaucaggaaggaaggaaggaaggagggagggagggagggagggagggagggagggagggagggaggggggagggagggagggagggagggagggagggagggagggagggagggagggaggaaggaaggaaggaaggaaggaaggaaggaaggaaggaaggaaggaaggaaggaaggaaggaaggaagauugguugguuuaaacauagguacgugcagaaggcucucauuauuuuucucuacaauggagagaaauucaggucuuuuuuuuuuuaaggucaugguaguugccaaguagcugauuaaacauucuguuuuuuuacauaccccuugaugaauuucauauccccaaugaugugucccaggggccccuucucugucccucuuccuaguucucuuuuccugugagucuucagcuuuggcuuugaucccuaacagagaaggaaagucccaacgcagcagcugggcagcagcagucuggagagcaacgagggaagauugcagaagaguggagggcaucccagaaguggggcucuugaggaagagaugacacugauggaugaccugcuguagagucccagcuuggccccuuguguggcuuuagaguccucucacagaguuugggaaagguauagugccgaggaaacauaggaagugaagcaaauuuuaaagugugggcucuuacuacuuuuggcaaacgaaacacagaacauaaaaauaaauaaauaaauaaauaaauaaauaaauaaauaaauaaauaaauacagcaaaaaguuauuuuauuaaaacacacagacaucagugugaacagcuaugucaucuguguuguugguaggcuuucuguggagcuccgaggacaaggcucuuaguuuagcgcgugcagaguugguuggcccaauuguuuugugccuauggugagguaagguggugauaggaauacauggauuaccucauggccagcaauaaaaaguaaugggagaggaggaagcuaggggcuucucacaccucucuuggagggcaaggccaccaaucacauaaccuccucucaccuccaggcuccaucucucaagcauucuguuaccccuuuuaguaccugucucauuggagagacguugaagaugugaucuucacugccugucuugaggaagguaccacaugaggcuacgcugguaacguuggugugaagagaaggcaggagacuuaagaggugguaucaccucccgcuuuggggagacuuaaaguggagaaaucacuaaagcagguccuuacccaagucaccagcacuaaccuguccccguggacccccauagaucccuuucacugggguugcuugugcgaguauggaucagggcuugaugacgggagucuuaccaguggcuacaucauuaaagaaaaugucucaucuccccguuugaauggcagucaacugugagagcaucgugucaggaaaguauuacaucagugaauuggcgaaucugcuuagggaaaagaauaauugcagggcuauauuaggaauaaauacuucauggggcagaagauuaacaaugcuuccucgccaugcuuuugcauucggagauaauugguuucugugugaaauauaagcucuuuggugauuaggacuuuuguucgcucacugaaaacucccgagagcuuagaacaugucacagccccuuaguucccgcuugucaccauguauugaaagaaugaacugaagguuuaaacgaaugggagggacagggagaaggagggacaucacuugaaaggcagaagacagggaguggaacuucuccugccaaacacuuccuaaggugacagcaggcaucaguguccuuaugucagccuaugcugauagcagcaugacuacagucagccuuccaagaagcucccuuggaguuuaccaguugagugauuugagcuguuuucaucaaccgccauggcucuuauaguaagauuguagucagaauucgaaguugaguuuaaaauguauggguaccaaaugcauccuuguauuuuuugaaaaagaaaaaaagaaucuauuguuuggggcuggagagauuauagcucaguagcuaagagcuguucuuccagaggagcuggguucaggucccaguacccuuuuggcagcuuacugcugucuguaacuccagauguaagguaucugucugacacccucuuugggccucugggcauuccugcacgcaugugcuucacugguacacauacacacacucaggcacagagagagagagagagagacagagagagagagagacagagagagagacagagacagagacagagacagagaggcagagacagagaggcagagacagagagacagagacacagacauacgcacauagauagauagauagauagauagauagauagauagauacuauauauauauauacauauaaacaaauaaauguuuuuugaacuguaagagaaaaaauauuacugugugcgcgcgugcgugcgugcgugcgugcgugugugugugugugugugugugugugugcgcguguguguugugucaugguacaacuguggaggucagagaacaacuuucuggagucaguucuccccuuuuguuuauuaccuagguuucuuggugagaaucgagucgccaggcuugcauggcaaacacuuuaagcucacgagcuaggccuugagcaggccuugcaggccugcgugcauauauuuuccucgagauguucuuuagucuucugucucccuuuugacuugaugaagaccuuugccccacggcccguuugauuuccguuaucacuacuguguaggcuucucgggcuuucuuuguucuucagagaacucuuggcuucgugucagugugcugaucgcaugcauuucuugagcagacaucuuugcugucuguccuucacaguucugccuccugaucuggugguuagaggucauaggagggccuguuagccuucgacucuuuugcagucaggcagcaucaggaguccaugucuccagcuccguuuaucuguggaaucacugaugcucugagcacagauucucuugauuguagucuuugccuugcuguuccuucugugcauuccuucauuguuuuccaucacaggcucuuuuuguagacuucagaaauccuaacuacugguguuuuucuacagccuuucucccuggucguucauuuuguauaacucacaugcuugccagaaaauuccauccaugcugugguuucccuaauagccguccugaguuaucaugcccaaggcaagguuucuucucuaggaagagucucagauuuggugugaccucuggaguacuggcacauagcuuucuuggacauuucaggagauaccgguagaugccaguuccuuaugaagaaaugcugggcaguggucgagcauuugccugccgugagugagguccuggguucgagcuccagcacugccaaaugaaacacuacuaauagaugauaaauuugagauuuuuagauuaaaccgugcuuaaacaguaugcuauuuuuaucacuuaauuuauugcuaaauaccauuugcaaugauuacaauuugucauaagagaggaguauaguuauucucagccuucugaaaacuaugcagauagguauaucugugcacaugcaugaauguauaugugugugugcaugugugugguacauacucacgagagagagagagaagggguaguuaugagagauugagaagggcuggagaaagcaagaagggaggguguuugugcauguacacccccuacgccuguuccuuucuuuuaucaaagucuccaggacucuugguuccuugcuuaagaacuaauuaaguccaugugaacuaggaguccugcugccaauaccuggcaagcauucauggccugauuuuuaauauauuuuaaagugguacuguguaauuaacacauucuuaaauuuugacuucuaaaaagcauuuuggaauacuucgguauaaauauaagauugguugcaaaguauugguuaaaaauauagauguggucucuaguuuagaaugauguuauuuuaugaggagaauuuaggacuguccuaaagcuagggaccaaggauauggcucaguggauagagauguuugugcauaggaugggaaagcugaguucagggcccacaucuuggagagaaaugaccuuugagaguuguccuuugaccucuacauauacuugcuugaauucucucucucucucucucucucucucucucucucucucucucucucucucucucacacacacacacacacacacacacacagagagagagagagagagagagagagagagagagagagagagagagagagagagagaaauuuaaaauuagagcugaaaagacgaaaguuaaaucaucugcaagcaaaugcagaggccgcuugcugagggaaugcuaacuagaguugccuaaugaaucaaaaaaauggcaaaugcuuaaaauucaggaaaauacagauaagaccuauuauuuauuguuguaguugaauauucuguugagaugggacugguuaucaaagauguccuuuguacucuacguggcuuuucgaaugucagcucuauuuucucggagagaugggcuacugugucuaggcuuggagauagccauauagcuugaauagaaccccagacgagcugaucgugcagaugucauguggcauccacugaggucaagaggaaggaguggcuuugccuuuauuuucuuuauuuuccuuucugaugaaugaccucaagggcacacuucauacaacuuuaagcuuagaccagagaacuccuauagucugcuaaaguggaugcuguuggaagggcugccucacucacacuucuuccagaagauucugcuacguauugucaguuugccucaguguuuuuccuacaccacauuccugggguaaaacaacucagaucugaaugauaacuuugcuugaaugcauguucgucaacaagaaaggcagaaaucauaccaucugaaaggggguauccccuuuaauuauuucaagccuuagucacauagguccuccuucugauuguuuaauauaaaaugagagauguaaguucuccaaaaacucugcuuguaucuucuauuuuugagaaaugauuuaagugcauuuaaaagcuuagucucugcuugcccagaaugcuugcucuucaaaauaucugcuccccggagagguaaacucaaguuagucuuuucaugugacucuggaucguugaccuggaagacuucgggguaauggaaugggcuuuggcacugaucgcuguuuucugguugaguacccagccuggaaaggaaggcgugacugagccaugugcaaagggggaggguggguggagucuaacgauguuugaagcaugaguacaccuucauuugaugccucgauuuacugagggagagaacucuaaacugcugcauccauggauggauggaagugccucagcuuguaaggaugcuuauuuaaaugauuuugcauauucaaaugauucuacagccaaucaaacgcauucauucccugccuggugagugaaaacugaaugacacuugugcucccucugaaaggaacagacguuuucauuaucaaauucaaccaagcagaaaaucuggcgaagggagcagaaaucuccauuuauuuacaucuaccaucgacuguuuggugauaggagauuaguagguugaggaagagccuuguucucauuuagcuaugugacccuagacuuuugucuccuugaaaauacuuacuuagguuaugagcaugaagccaaccaaaagucucaaauugugcauauauauuuaauucucuauagauauuucuggugcuugugggcagagagaaguccuagucacauauuaacauucuaugucuuccuuauacuuuaaagccauugcuuaucagcuguaaaagcuuaacugcugccuuuauguucuguuagcagaguguccccaucugacuuccauuuuauuugcaucagccgguguaguucaucauaaaagucugcauuagagaaguggaucagaacccuccaggggaauuugcugccaaagcauaguuagagaucuaccuuuugaauccuccauauaauucuuucuugcccaaaccuuucuccguacaaguccaggaauucaauuauuucagcucucugaggagcaguaagcuccagaaaauugauuugcaauaaugaaacuaagccuuguuuacaaaucugaguggcacuuucgaagacuggacuggcauggugacaggaggaggguacgaauuuaucuaggggcucacccccuuugaaaagaucauguuuguggaaacacggcuggaaaggauauagguaauuucuaaaagaccuugaugggucauguuuuaaucugcuuccuuuuuaauucuauuaucuccuguguugcucaucccuaggugugcugcugagagcgagugcuuuaagagagugagugcugauagcugaccauagugcucugaugcccaguuaaaagcugagccaguuucaagggguauggccucauuucuuugcaguugacuuguuaagugcugugacauuuuuuucccauucucuucuuucuccccauaagauauuugacccagugagaaaugggccauuuuucuuugcguacaugggauuugaaaagcugguuggacaccaugacgucucuaugugucuagccggugacuagaaaugccaaaagagaggucagccuuggaagaguagagaaagugacugaauccuuaggcccgagugguauuccugagugacaguggaaaaugagcagagggcagagcuuugugcaaucaggacuguuaaaaagugggugggggggcggcacugagagugagcuucacacagaaagcggagaacaagagcggucuggcuugcggagaagcgggaggagaggacugaagcuacaagaagacgguggugugauggaguggucagggaacacggggacugagaccaaagcauuugguguugaccuugaacgaacuguugucgaucgucaugugcugagccacguggaaaggaucggaaagauuccggcaagguuuagagaaugacggacggacuagagcucgggcagaaacucucuaagugccucuuccugucuugauuauagccugccucacacagggguuucuggaucuggcacauggaagaccgggcuguguacuuuuucuucccacugugaugucagguuuugcuaaugacuggugguugucgugccucacuguaccucagccugguuggcguuuuguaaguaauuauguggguuuuuuuucuucucuuuccuuuuuuuuaaagcaccgcauauaacucuaauuaauuacaucuuuuuuuuuuaaucuauguggcuuugaaaaaaauuuuuuuaaugaggcagaaaaagaaaagcguuuggggaaagcggccagcgaggauauuuguguuucaggagacaauguaauauaggacggugucucugcaggguccacuuuuuagcuccuaggaaacaagaaugaguuuaaccaaaggaggcugaggccuggugggaaccgacguccuucgguuuccauagcggagcuagucacauauccuauaaauacaaaauauaauaacagcagaacugucgaaaguggaggagggagaaaggcagguaugguaagcacugauuagggugguaacaaagcgaauccuggaggcgcaucucucagcaucuaugccguuuacgcucacacgaugaacaguauacucacauaguaaaaccgugcaguaucaguggacaguugcauucagauccagacuccuguuccucuacuaaccccugucuugggcuucacauguucucccaaaaccccuaccuguccgaauuuagcucauggguccucaaaagaaauucccgaucuuuaaaauccuauggaaggugucuugugcucacugccagccaccagccacuaguggccauacaauacugaagacagcuacuccagacagcuuugcagguauaaaggcaaaccguggagcaaaggaaaauacagcaugcuuuaauaaguauuugugcaaugguuucacguugaaaagacaaaauauaggaugcauaaauaaaauauguucccagagugaauuuaguauauauugaguauggaaaaaugcauacugcuuuuuagaaugugccugaaaccacauaugugagcuacuuuuuauuucuguugggccugacugcucuuggugcacacugcuugcauaugccucauuucucccaucuucuacggauacagcuccaggacagguuagcauuuagugguacccacugauguugaguagccacuuaaaauugcaucacaucauguuagauuucgauguuuauuuucauuacucuuugaauuucucuggccaguaagccuuuuuuagagugucuccacuaugaaaaacugagcauucuuaucauaaaaccugaaauuccaaaagcuucauaauuggggacuuucuagaugccacauccugccauaaauggaaaauccuauacuguaaaaacuuguuucuuguccaaacuaugaaaggaauugcagagggucaguguggccucauguguaagcccagcauucuggaaguagagacaggaggggggaguauucaagauacugaaaaaacaaaaaugugguaaaauugcuggagaaguggccaauuuuaagaaccgggcaguagauaaacaagaagacccuacagcaucuugucagaaucauaaagucugugcagggggguaugcccgaugaguacaggagacaacucccaauagcuaaagguggaccaauuuaggcacacaaacauaauauguacacuguaugugaaauauaacacauauacucacacacacacuuucauuuuuaaagaaagucauuacacggagcccacgacugggauggagaaucacgccccacuuuuccuagguuagaguuuauauguguaaaguauuuagaauucuucugaauaggagauuaucuuuuuuuuucccaguguuucaucacuuagacuaaugaauuuuccuauuauacgucgauauuuaauucuguccugcacaguguguguguguguguguaugugugcacacacaagcacacaugcucacuuuauauaaccccuauaaaaacuuugugauuccaacaagaugcuguaggguuguccuuuaucuucuccacaaaucuaagaaucaaucauuucuccagaguccuguuuccuuuuguuggagaauaauagaaagauccaauaucuaggcuuugugugcucauugcugcugaagugucugcuuuguugcugauggaccgaggaaguccccuugcuacuccucgaucuuauaguauggauuccuguagauauuucuguagcucucugugucucaauuagcaucccuaggagcucacccuguugaucccucuaucacccacuggacuguucuacuucccgugcuugucuguaaacucucaccccacugugagcaucugccuuccacccaccuuccuuugccuccaccauuuaauucagaaugcucugaugacaacaucacaauuacaguacuuuaaauugugaaagcucuuuaaaaaauccuaaaauuguuagccauuguugaucacuauacuuugaaaaaauaucauuauuauuucaaaacaauuauuguuaacagagagguacagguagucuguuucucuugaacacccaucucacgguuaguguguucacgaacgugagcacaucugcgugugguauguaugugaggcagaacucuccucaccugaaugagucugaaagacuuaaaggaaacuuuuagugcucacuucuuggcuugcagcuugcuugaaacauucacucagcuucugccaucugccaaauuguucucugaagaaacccagcugccagcuguuauuguaauaguuacggugacacucggggugacagcacagccacuuuacagaaccgagucauuuacucauguguuccugagaacccagaggugacccucaccaugaagcaaaacucugccucaugccgagccaguugagaggcauuuuggugaaauacacuucugaaaacauucuuuccacacaaaugccucccggagccguuugccagcugguugucagcgugcgccacuuauagggcgucaguccaucuaacgugcugaaacaaaauauauauauauauuuaaauaaauuuuccaaguaaauaugaguaaacauuucuucggucuguagcuaucacuuugguauguacauaugcagugugaacuaaagcgcacauaaaucuagaguggguauuuguacguuugcgaauuuauggggacaugugagacacaucugauccugggcaucuccauccggugugaaguggcuucuaguuugugaggcaggaguaggcaggcuuuguuucuuuccucccggaucuuuucaguuugacuuccauucuaaacucuucauccuagucugagguggugucacuuuucccguggauaaggucaacagcaccagccuagucagcuaugaugcuaaugacaggcgaacaugcccaucucccuguguuccucaaaagugcugaccagauuuguagcugaacacuguguagccugcccucacccacccaugagcucaugcaaauugcucuucucugagaauucacccccuccuguuuuugucuggauucauaggcaugcguuugcuagggacuucuguacccuguugcucuguggcuggaaugucuucugucaacguaggauguuuuucucuucccuuuucucgcuuucuccagcgcauucucaaccuauucgcucucacgacccaguaaaguucuccaccuugucucucagauuagucccuacuccaguuccuccacuuuuucuccaucauauuucucaccagccaacaguuucuuucuuauuaucauguuccucuagagugcuacuuuauugcaucucuugucgguuuccuggauucucagcccuaggagaaauguaaauaacuugcaaugaagacuuguguuagggguggacugagguucuugggagagguguuugaagauacccagacuucucuuaagaaccaccaucaucgugagacuuggaggcucacugcucucauccugggccucugccucccucugcagagcucuaccggagcuguuaucuagcauacgugauguucaaauguacaacgcaccacuucaucugugaggcuccacagagcuccacagaauagcuauaauaaacgugguucucuugcuugcagcuuuuccuuugaaaucauuuuauucaaaaacccauucugacuguccaaaacaguccuaguucugagaaaaaaauuucucaauugucucacacugguuccuucuuauuuuccccuguggggcgaacugguggggguccccucauguuucugauaguggauguuuauacuccuaauacuaccucauugcugggaucuuuuuucuguaaagucacaauauaauaauuagaagugcaucccugcccuugaaugcacgguacugcagaaucuaccuuucacagguuucauagccaccauucccucuccuuuucucaaacguucucuuguguaagggaaccuuauacaguaagcucacuggcaaauacuuucugcucacuuccauugcaacucaauucgagcagcuaagacaguggguaaaaaugcagcccguuggcgggggaucacuuggagggagagucucccucccugguaacaccgggaaacugcagagcaggaaaccgcccauccuugcuccauuccgccgggagcgugaccgugagguuauagguucccauggacagucuaucuugugacuacagagcccggugucacacagucgcacuguguucaagucacuguucgauggguucuaacugaugcagcagaaugcauucccggcccguucauuuggaugacuggacauuuuagucucauucuuuucuaauggccagacugaucagaucauaacauuaaaauauuucacgggcuuaggauaaaucauuuucuuauaucaaagccaagggagauuggccauguaaaccauggugacccgaguuucaaugagucaagguaucucuggaaggccagagagcagggacacgugaaauuucagcucagcucugcugccugcuggcccugugagcgaaccacugaccugcacuucuuccugcccaucuacaaaaugagguaauucagguuagaggucuguucuccccgacaccagagccagcacugcacgccugcaggggcccuguugauuuccacaucuuuguuuucuugccaagacaucagccaagugugcauuuuaucuacuuuaaaaacccucucuccucugaaauuugcauaugugcuuuaaauaugaaauucuuuuuuucuuucacauaaaaacaguuugcauggcuaccaaaaaacaugcccaguguguauuggagaauuuuucuguuuagaguaaacguugccuuauuucccacaauauguagacgcggugagcacagcuucuccuuccgauucucuguuuaauuugaacauuggcugccuucaucugaauucuguuaagaaaugcucgcucuugaagcaugaguccacauaaacagguuuauuuccaaacccaaagcacccauccuuguguauggaaaccccagguuauaccuaucauagacuuuuuaaaaaaaaaaaucaauaaauuuugauuuacauauuacucucagucuauaucaaaacauccaucuuucccguaaaacuaaacuauguucuagcauagacuuuguuaaaaaauuaauuuuuaacaaaauucaauccucucaauucuuaaagaauuuuuuugcuauuuauuuccaucuuuaauuguauuauguggauaauucucaguaggacaaucugugcacgaaugcagauauucacaguugucagaggugucgggucgcaacggagcaggacauacuggaugcuagggacugaacucaacaacaguagcccucuuaacuccugagccaucucuccaggcucucucucucucucucucucucucucucucucucucucugggagagauuuuuauaauuuagccuucuaaccuucuugaugaguggcauucuaauaugcuuucccaacccucaggggacgauaagaaaggcuguccacugguaaauuucacuuuaaugauagggcacagugagcuuccauuuugcccuuuguccugaggccuuuuaaaguagcucguguuaauccuuugcuagagcaauuuuucguuagcuauaggcaauaccagcaacuuacaguuaaguaaaauaauuugcaaauuaaaaauuccaguauccuuuuaaaauagaaugaacaguuguuagacuguaagcaucucucagugacuggcucagcacugucaucgagcccuggacagacgaaaaccgauggauuugauuuuguuucuuggcaccaguuuuucuauuuguacccccaagaacucauuuaggccauggaccagaacaucuuauguuuucuuuugauauucuaaaaauggauucaauauuaacagucagcauuuaauaauaggccagcauuuaaucuguccaauaauuacuuaugaaacaggaaaacaucacagaugcaaauauggcugaccauguuaacuaaggaggguggcuauauuaaggguuguggucacuuuugucuuccuauacccuauuuuccugaaauaccucagugaauaggcauuuccuggccgccaggauugguuaccugacuuccucagacagccugaguaguucaccugggaacgguccuuccucauagaugguaucuguuuagcucuggaacuagguuacaaccuccugugguccacacugccuuaggcagguuucuuugcagagguuucucacuagggaaguggauuuguaggagaugacaucauggcucuguguggaguaagaugcaugaugcagcugcagaagugggaaguuuugaagugcccuuugcccuucccuuccuccaguacaagcaugcuugccagagcugugucagggguagggauggaauagucugauggccagcauuaauccacagaaucuagaaucaccugggagauuggccuaugagcaugccugugguugauuaucuuauuauguuaacuaggauggaacaaguggcccacuguggguggcaccauucccuugccgggauccugugcugcauguguggaacaggggagcagaggagccuguuguauuccacauucucugcuuccugguaguggaugucacagcugugugagagacugucuuucuuucccaccaugauggacccuaugugcccuuggauccuaagacagagucagcucuuucucccuuaggucauauuugucagagaguuuuuauuuuuacagcagggaaaaucagaugauaaaugaggugcuguccauacauugugaaacuuaucuucaugaccuacucuacccauccacuuagacuaaccuuuagugauauuucuaccugaagacauuccccugugcacccggucagauucauucacuguauugaccuaggacuugcuucauucugguaugaaaagaaaucucuucauucuucaacagacauucauugucuaguagaugcagacuuugugcugaagcagaggaaugccacaauggacaaaaccaagagcaacuaauuucacagcuuauguuauuuuucacugucaaucuuuuacccucaugacuauguaugaacaugcaugaacauguauguauguguauacaggaagggugauauguaacauuccuaacccuggaguaccagucaggcuuaggagccuuucucaugagauguaaguucaaagaaaacaagauuccauaauuugaaugaauuacucuuuccagaguguuuuuauauaaacacauauauaauacacauuguguauguacagauuggagcuuaacauuuaaaaaugcugcagucucuaacaauuugcaagcaguuuaaauuuacaaaauacagaaacagacauugguguugacagugcucaaauuaaagcuaucuguuuuuguacuguaauccuuaaugacaacgaaugucaguggcuacuugugcagcugcuauauggaugcagaaacugaaauuaauucaaggagaaggcacugggaauauauagggaacauacagccaucaaggaugcaugcauagggaauguauggacauaaggucuucaugguagcaaggcagucgguuguuuaaagaggcugacccaccaugcuaaagguaguguagccuuugugggguuuuucgugcauugaaaguucuggguaaguucucugaccuccgucgagcccguguguguccauggugaaaucagcugucauacgcgaaugauacagguccacucuccucucuuucaguuggugaguuugugagcgacgcccuucucgugcccgacaagugcaaguuccuacaccaggagcggauggauguuugugagacccaucuucacuggcacaccgucgccaaagagguaccaaucugugcccgcuuuccugcagagcgaucuccuugggggaggggggaauacaaagauguuuuuagaggguuguugaaggcaguaaguucuuggugguuuuuuguuuuuguuuuuguuuuucgagacagggcuucucuguauagcccuggcuguccugguacucacucuguagaccaggcuggccucgaacucagaaauccaccugccucugccuccugagugcugggauuaaaggcgagugcuaccaugcccgguggcagaaaguucuuuauggaagcaauguucaagcauuuuaaaacugaauuuacuuuuuaaaguaauuuuauuuuuuuggcaaggucaccacugaacagaaagucuaaugagcuacccugaaccaugucuguacacguuugugcuucucuauccaugaacagcccucauggucagcaauagcucucauuagauacaucucugggcuacaucuuacagaugaacauaaagcugucauguuuaauaggcauauguaaccuuacauugagcaucuuucucuauuuauuuucuaccaucgcucuugucccaugugguuugcauaauuuaacuagcuacuggugaaugagcugguagaacaaggaagccacauguucaaggccaccugaggccacagucguuaaagucauacccucuccugccaccuuccuuuccacggugagcgcaucugggguagcacgcgcagcccuuugcuagccucugcuuugggcuaagucaguggaauauuaaggacaauagaauguagugaaucgucacccuuagaaccgcacuguacccuccauauaauuauaaugcuuuucuccuaaguaguuaugucaagaugggggagccaguguucuagaauuaggguccuuuaucuagcucaggaguucacuaccagcgucaguuuuguaccccuguuccuuccuaggaacauuuuugcuugucugaccuguagaggcacuaccacuggcagguaacagucaaagaccaacagcuaaaaacccucccaggaacaggguagacuccaccuggcgacguuucuuuuccacauuaaucccauggaggcugagcuauaauagcccucugagcuauauccaaggccuuguuucuaaagugcuucugagauccaaaguagagucuugcuaaggggcucacuuuggucuugauauugcacuauaauucaaucaggccaugaacuugccacagccuuccaaguagccagaauuauagacuagaugcacuaggccuggcuccucagcaaauuaauuuaguccaaaauaucaaauacguugguugacgaauuaaagggagaaaaaggguuuaacuugacuuuuauauuucaugaaagagugugcucugauucacuguaaaaacaaaacuuucuuuaucuaaaaaugauuuuggaaguggaauagcugccugagcuuacaguagacuacauccuuugaagcccagcuucccaaaugauaaccucacuuugcgcuuccucugaguuugcaaaggaagacucccuugcuacuacgaaacaacaaacuggugauuccugugggguuaaaaugcaucuauaauacuuuuacuguuucccuaggcauguugaauuauuaauuuuuuuucucugucacggggaaauaguuucucaguuuuucucuucgugccgauuucugcaaaauuaacagaucccaggcaaucaaaaagauacugaaagagaaaucagggcuguggagggcaguuucuuccuuccugggacugggacucugagauaugagccaagagacaccauuuccagaauaagaugcaacuaacugccuauaaaaaaaaauucuauaucugggguagagaaaagaggggauaggcaaauguagacggagccuucaauuccugaaaagccaucacagcccaaaacguaaaucauuuccugauauuuguccccguguuuagcuuucuggaaccugcuuucuuuucauguuuacuuuguaaacauaauacauuaaaaaauguuuuuagguauauuuauuucauuuuauguauauauuguauauauugccugcauauauguauaugcacaggucuguggcuggugcccauaggccagagucaaaauuggguauuagauccauggaccuggcgguggguacgguucuaaaccaugggucaggggucugcuacaagaacaacaaaugccuuuaaccacuuaggccaucucucaaccccaccuaccaagaaaacaauauaaagauagaauaccaggcagcccuugcugaacaccggguuagaaacgaguucagacagcaagccgcccuuaccuucuggaguaggcuccaaaucuaucuguccaugcugauuuuccuggcugugacggcgguucaauuguuccagcugugguuguguucgauuaucugcgcagugacugcguuugauuguuccagcuguggcaguguucgauugucuggucuguggcuguguucuauuguuccaacuguggcguguucgauugcccgggcuguggcuguguucgauuguguggaccauggcugcuguccgacucuucuagcugugguucgauuguccgggcuguggcuguguucgauuguccgggcuguggcuguguucgauugucugggcuguggcuguaguccgacuguccuugcugcgguuccauuguccuggcugcggcugcgguccgcuugccucugugcccacacugacuccuccuuccuuuuguagacaugcagcgagaagagcacuaacuugcacgacuauggcaugcugcugcccugcggcaucgacaaguuccgagggguagaguuuguaugcugcccguuggccgaggaaagcgacagcguggauucugcggaugcagaggaggaugacucugaugucuggugggguggagcggacacagacuacgcugauggcggguaaggcggcuuuugagaugggucucagauuggcugagccaucucgucucuuacaguuuuuguauucucugagugugucucucugucucacaguggaaagagaccucucacuccaguuauauuugauaauaccagaaaaaucuaacccugaagggcugcucugauucuuguaugccacuuacuguuaguguuacugauaaaccuucaugaagucauuggaccacguuugaaugucaggaauacugaucagacuccacucagagcugcuccucaguaggucuaccaggaagcuaguagauuugagcucagcacucuggcaugccauuuuguccugccauuuggaaauauuuuuuuauuagauaauuucuuuauuuacauuucaaauguuaucuccuuuccugguuuccccuccgaaaacccccuaucccuuccacccucccccugcucaccaacccacccacucccacuucccuguccugucauuccucuacacuggggcauagagccuucacaggaccaagggccucucugcccauugauguccaacaaggccauagucugcuacauaggcagcuggagccaugggucccuccaugugugcucuuugguuggugguuuagucccuggaagcucuggggguauugguuaguucauauuguuguuccuccuauggggcugcaaaccccuucagcucuuuggguccuuucucuagcuccuucauuggggaccuugugcucaguccaaugguuggcugagagcauccaccucuguauuugucaggcacuggcagagccugucacgagacagccccaucagacuccuguuagcaagcacuucuugauauccacaauagugucuggguuuagugacuggccucucucccuaucuauucaauaccguacuuaaaaauacuuuuaaacacucuuucgugaacucaauacaaauuuuugguuaaggaagacaugguuuguguuuguauauuuacucuuaaggauuuccuucuucuuugcuuuugguuugguuuuggauggguggguagaccccuccccucaaccaucuuuuuccuuuguguagugagcaacacuaauaaauguuugcggaaguucuuuaacuaucuccaguugcgugauugcugguugacauuuuuuuuuugccucauuuuccuugggaucuuaaccccuucguuaauuuucugacucuuuucacuugugcacaaauauccauauucaaaucauaagucuaugaagccagaauuuuugaguuagaccuaugacccgguuuguugaugaauccaggcuauccuaucccugaaauguaaggcucgggcuuuccugccaagguccucucagcuguuccucaggguuuucuagcucaaacggaacaccaaccaaaaaucacaaaacuuacuaucaguaagaugaggcuucauuuuaguacuagcugccugaguuuaucaggacgugugugugugugugugugcgcgcgcguguguuacagucuuuuauauccccucuuuaccauuuacuuucauccaucuaucuauuugagucaggauagaggcuacauagagaggauacauacaggauagaggcugcauguagcccuggcuggccaggacuagcuauguagaauaggcuggcccagaacuaagagcucuagcugccacugccuucuggguguuggaauuaaaggcuugcacuacuuacuacauccagguaauugucuugcucccccaccucucaaaauaauuacauuugaucuagcuugacauagagccaaggaaacugaaaaaaagauuuucagauacuucucggugauguaaaaguucaccaccuaugcauaagucucguguuucccaggcaagaagucuccgggaagcagaauuugcuucugagauuucugucaucuaaugaguuagggguuccccauaauggcuugacaacccacccccuauacuucuguucuauguaccacaugugggacaggaauggguuaaacuuaauuaucucucucucuuuuuagaaacgagguggccuaguucucccuuauuaagcccacuccuacccuccuuggccacaucuagauuugaacguuucagaggcuucggaaacaaaucccauccuuaggcgucugaucacagaaccaguacaaccagcauuccuaaaggaaaaucuaguuacuuagccuggacguugucuguuuucauaagcuacuggauauuugauuugcuaauuuccagugaguaaccugacuauggauugagaaaguaugcagaaugguauuuaaacuuggaaacuuccauggcugguguuaaaacucuaaggcacuagauauguauuuguaaccaucuuguuaaccaucaaccuugugcugaugucacagggaacauguguauguguguguguguguguguagaguuuagaguucaacacugaguguuuuucucaacuauccuccaccuaauuuuuuuuauacuuagacaccaaggcucaaacucaggcugucaagcauuuaaucaaaccccuaccucccagccccagcagggacuuuuuaaauuuuaaaaugauuauuuuuauuuucuugaaagccaccagccucugccaagcuucuuccacauguaagacauguucuaugccucguaaaaccuucuuuuuaagauggguccaguuuuccucagguuuugaucuuuucauccuacacuuuuuucugagauacugacaccauugccacgguaucaguggcccuuucuccugcugcuggaaacugaucccggcagauggcuuugcauucugacccaggucucuagucuauucaccacgucacuggguaauuguaccuucuugauacccaucucugagucuaugacuucuuuuaguucucacuguuacaacucccaagcuaggagacauuuguuuuccuccuuugaaugugcuguguuugaaugugcuaugcuaccuccuagagaagggguauaguauguuaucuaaaccagagagaacacucagaccccagccacccccugcguggguaauauggucacccugucaucaucaucaacuugaaaugcaagcuggcuccucuccuaauuaucuuccuuuguauucugucucauguuccaacucccucaucccuuggagacggugcacgcuuaguauucccaaccauuacaucugaaccacucaccgggucuugcugccuuucagacucaucaucacagcagcagcaugcaacccgucgaccuuuccuuucuuuugcccaugaucaauccggacagacugaaccacucacauauaccccacacauccuagacuugcagagauguucacauuucccaaauauauuuuggucaguucucaaugccggggaaaacuuaacuucuuccuguaaccacuuccgaauuuccugagcuaucgaguuguguaacugagccgguugauuccacgucguaacagcagcugaaaccuuaauguuucuggaugcuccugauuacuguccccauuugaggacagaucaucgucuaccaagccaucaauccaaaccaacugccuuggucccuagcaucaccuuucuuccuugcuguaucuaugacccuuucauagcuaaccucuguggaugucuagagcaagguaccuggcauuugguggacacucaugugcaagucuccuuugcuaccuaaauaucuccugucccuuauucuucuagccuggauuccugguuaccccccaccccccaacucccuccauuacccuuuccaucucacuggcuccaccuccuuuaccucuaaaccugcucuuucuggaaugauuauucucugguacucccuuccuuauuuugggagcacaccaaugaaaguggugaucucguacugucccauccuucucggcaggcccaucacugcuccauuuuuagguuucugggguuuauuuggaauaguuagcgaaugacggugacauacuucuugggaugucaaaauaagaaaaugucguaaccuaggaaaacugaggucaggacccugcauguguccuggauguacgauacguuacgguggacuuguaugauaacuguacaauaaaaugaguuuugcuuaauuauuauuauuuuucuccaagaaagaguuaaaguucagaaauacuauuccuucuuagaguuacuuacacugcucagaaagguagcaagugcugggauuccaagaguuaacagcccaucaguuccugagaguuugucacuuggcaaguggaaacaccuggcauaauuguguaaacauuaggugcucaacaaauauuugaguagaauuggaguggcccugacaucaaauccguacagaggcgcagucauugucaccaaaggucagcacauauacacaaagugauugguauaaagaaaaaggaaaacccaaacaaacagcagaggaacaucauucuugguaggcaaugauuacaugaaauugcaucagaaaucccugaagcuagaaauuguauugaaaaauguacugagaccaaaggaaaauuaauccuuucuuaaugaccuuuaauguggagccuacaugaauaccucauucaaaaaagugugauaaaguuagaaauaaagacaagauuacuuuucuuagacccuaggguaaaagucaguuuguguuuguguuugguuugguuuguguguuuggcaggaccaaccauuguaccuaaagcuagggugggggugcuuuaccaccgacguucagcauuugcccuuuuauuacuauuuguuuuuaauuuccgcuggcgacagacucucccucugcaguacagggagccuucggcuuucuguacacuugcaucagcuuccggauuagccaggauuauuggggcugugcaaccacacuggcuccugaaguccauucuuagacaaacuucuuccuuuggaaucaguaaguuccuuuuguuucugucaacuuggagugcuuaaaaaaaaaucaaacaaacaaacaaaaccuguagguaaaaucccaguaaauacaaguuauaugcaugggacuaccagcuguuggcaagcauucugugauuugagaaacaaacuucagugaagagcaguauuucccaauggugaacgauuuucacucaaggggcaucuggaaaugucugccggcaguuugaguugucacaguguggguagugugagagaaaugucauugucaucaagggggcuagggaugaugacacugccaaacaucccacaguguauaggacaucccuaugacauuguggagugugcugggguuaagggcccccaauuuggaggcaagaaagaugcuccaaggccaagaguacauguugcucuugcagaggacuuggguuugguuccgagcauccgcauggcagggcacaggcaucuguaacucuaguuccagggccucugccauccucauuuagcuuccaugggcacuacaugcauacgcugugcacacauacaugcaggcaaaacauuguacacauagaaaaauauauaucaaucuaaauuaaaaccaguuuuuuuuccccaagugucaggguucauaccuauagacccagcgcuugggagacaaacacaggaguuuucugggaguucaagguuaccugggccacagagcuuguucuaggccagccaagacugcauaauaagacuccauccaacaaaacaaaacaaaacaaaacaaaacaaaacaaaacaggggggggaaaaccucuauuugaagguuuguuuaccauuuaacuuuuagggaaccuacucuccauucaaggcucugccucuaauucugcauggacaaagaagcaaccaucuacccaccuugagagucuuccucuaaaguacaguuuggggauuuuuuuaucccucccucucucucuccuucguucucucucucccuuccuucuucccucccuuccuccucucuucuuccucucuccuuccuauucucucccugcuccuucccauucucccucuguuccuccuucccucccucccucccucccucccucccucccucccucccucccucccucccuccuuccuuccuucccuccuucccucccucccucccuuccguccauccaucuaaauaaaccuuccuagccucagcugcagccuuaaaauucugucaucaaaaugugcuuaagugcagggaacuuuuauugagacuucucauuuguaccaaauuauuuuaugaaucuaugaucucaguuuugcuacuguaaacuaccauuauacuuugggaggggguguuguagcuuaagauauucagugaauuuuaaaagcaugagagagggagaaaaaaaaaagcaugagagaaucuuaaugaccauugcauuccauuugaauuuuuuuaaagcugucagaugaggggcaaauuauuaugguuugaucugauuguaaguuuugguccauauagauuuacuuauagcuaaaacaaaaacuuuaauccuaaaguauuaccaucauguacuuugcauucaaagucuuacuguuuacuccuugaguucuguuuauuaugguucaucgucuguuuuuaucccacugugagauguuacacagguggucaaugcagagcacagacuuccaugaacucuuccuuaaucaccccuuguaggcaggauaggaaguucacauuaaggacuuguuuguaaagcagcacucugcuagguauagugacugaaaaaucacugucauuauggccucuguaccccaagauccucucagacauuaauagccacaugacuuuauagaguaaguuuuauuugaccaucuaucuucuccuuuauaucuguggaguccaaguucuuagaauagucuuguucaguuucugccuugggcuuuaagaaaaggcuacucaaggcugacgggagaagaaaacaccacggauguuagacggacaccaagugaaucacacaaaugaugaacgaaggucuggagucuuugucaguggaugagucgagucugaauggaaccgaugaagcagcgcauggcuuugcgaugugacugucacagugcuggcuuggcagcuuccagagcugggcugggcugucugccucuggucugaauaaaggaacuaacuugacaaugaugacgaggagaauugcagagacuuguacuugcccuugaggacacuggccgccacuaccaaggccuuauuagaaaugcugucucuaaaguuaauaaacuuggaucgcauauacauucagaaaaaaaaaaacaaaucacguuaauagucuucaccggauuccagacgaugugaggccaagccagugggguuuguuucgguuucugagcaggagauggcagagagaagagcguuuuuccuguauaggacuuggcugcugguaucugagguacaguugguacugcauugagcacaaggugcccacuaauagaaagucaucugaugacauaacccacacucuuggaaguguuauuuuaagggcuggguuauucagugauggugauuucaggaccgugguccacggucagagaguaagacaagagaagaagauauagauucuuguuguuuugacuggauacagugacucgcacccacaagagcuaauuuccugaugaagcugggaucaagauaaugucaucucuagaguaaaaucccuuguuuguauggaauuuaucaccgucucaugucaaagucaugacauuuaaaaucuuuaauuuacguauuaaguuguuauggcaaaagauauuucucuuacuagaacuacacggcaugaagcggugccaaucgcuuucuguaagaaacucagcaaaaugugaaagcauguaguucgguagaaggaagucagucuuuaggcaagugugaaaccacauccucucacuucccauauuuaugaacuaacauuuuaagggaaccggugaaauuaauugugaaacuagagauggugggcaugcccaauuuuguugaagccaggacaugaguguguccaaguagaugaggaaaggggagcccuguuagcaaauaagaucgucuggcuuugcaaucgaugacccuuagacagagagacucacacggggcgaaucgcagagaagaagagaccguaguguucagccauaaaugacaucugugccaugcucccauggcucagggaucaucacagaacguauaagagccaaagguugcagagcacuacuucaagaaaggguuccuuuggacaucauaggcuucgcugcccaugugaacccauagcagcugugacuacaugcagaagaccuguguaagaucaagccagucagaacucuaauguagggacuggaaggacucaggaagccccacuccuaguugaacagcuauugacaauggaaaacuucacugagagggugugucaguuuucuucaggggugcaggccaggguaggcugcccaugcaccaguggcuggcccuaugcuuaggcacauaccagcagcaccgcaccagcuagacugccugguuaauauguuaauaaauagcaagcacaugaaguugugagguagcuuuggaaggaagagacauaagagggggcagagagguaagauggucugaauuucaucaagacauuauaaacauggaugaaaaucucaaagaauaauuuaaaauauacauuuuuuuaaaacaugcuuuaacccuagcauaucuguuugcgccucuuuccucugacagggguaauguuagauaacuuguaucacagugcuuuuuggucuacugacuaauguacggacacauuuauaacguguagacuggaucccgaagggagguaaaccccuauggagcugaucuguagaccaccccaccccaacccugucucguucugccaaauuauaaaagcacucuucgggguguggagcccaguguccuacaucugcucaauaaucaugaccaguauacuguguucuucucucagucgacucuuaaggcuuugucacuguuguaacugauacugagagaugagcacaucucagaccucuugucuuagaugaggcugagaacaucuuaaagcagcuguugguagcaagcgagugaugauacuccuuuuuuauaugccuguuuuaucucuuaaauauccaagaauuauuuuaaagaugcaaaaaaaggaccaaaauauaagauucccuaugacuggaaauugcccauuaaauuaguugugguugacuuugguucucuuggauauuuuuaaauagaaacuuaaugacuguuuaaacuuucaauuuccacaucugaaaaccuuccauuuuauaucucaguuauauauuuccgaaauagagaagaauugcaaguaagagcagauuaaguuuuuaaucuucugcccccuggaauaugcuguucaucggcuucccauuguagaaccguugauugucauguuaaucggccuucagcagaauuuuauagccaguguuguuagagcuggagcugaguuguacaaguaucagauguaguaaugaaagacuuuggcuuuaugaaaauguguguccaggguauuccugggacagcggcaccucauuuaauugaggaguaugcagguccuaaguccauugacacagcauugccaggcaccuaucccacaaggcuccagacccauccacuacucaugcaauacucaugcaauacucaugcugacacucccuuagcaaugcaggacauagagcaucugaaaccgggaggccuucuaagucccuucagcuugacaguauuguuucuacccaugcaaauugggaauugaccauauagccauuuuagauacacauuuaugacauccauagucucugauuuaacccccuacauugaauggggauuuuuguuguuguugguuuuuuuuuuuuuuuuguuuuuuguuuuuguuuuuuuucucugucaucaacacaagugacaggcuuuuccuuggauucccuggauuuuaaccgucagguaccaguacaugcacacacaggcccaggcaucugugggcacaggaguucgagcaaccauagcagaccacggaaagcuuagaagguccuuggaauccuuuauuuccucuccauaucugacuuaccuauccuacuauuaccagccugcucuucuugugugcucuucagucaaggcauugauugggucuuuuguuuauuggauuauaacuaccugcucucucuuuuugucuuugauuguaaauauuaguuaaggcaaauaguucaagacuuacuucuguagccuggaagaccucguuauuuuacagauaaaugaauuccagugcauacggguguuguuauuggcugcuggcccccagccccaguuggguuccgugauaucuguucuaucuuuagaaacacuccuugaaguauuagagcccagggcucugcacuguuacuucugcaaauucugccagguuugcuucaccuaaucuguuuauccuguccaaauacaaucuuagucuaaaguaccuuaaaagacaaccaaaauuaguacccuccuaaagucuuaucauuaacuuucuccuaugcauucauacuucuucaacauacagauugaaagcuuauagccucuauagagcagcuacaguguggaacacgugaauacauaacccugauguagaacuccccaacaugcuuuggugaguucccaacauacuaaagagccaauaugcagggugaaugcagggaagucuugcuugaagcaauguaaguggauacaguuacagagauuguuuuugugccaagcccucauguaaucuaugauucuguguguguguguuccuguuguauauaugcaggugaauguaugugugcauauguauguggaaaccagagaacaaauuuggcuauuguuccucaagugcugucaaccuuguuuuuagagacaggcuaccacuggcguagagcucaucgaauaagcugagcuggccagucugugagccccagagaucauuugauccuaaccuccccacucugagauuauaaauguggagcaccauucccagccauacauauauauguauguaaacauuacauacauaugcugggauuugaggagggaaauccuucccuugagagggaaacaccuucugggugucagcccucuauuuccuccccaaccccccacuuccccacacauaucaagucucugcaggacuaggcacagccuuucccacugaggccagguaaggcuguccauuuagggaugcaggaucuauaggcaggcaagcagacaacaggcucaggaacagccucugccccaguuguuuaggggucccacaugaauaccaagcugcucaucugcuacauauguaugggggagagaagggggcuagguccagccugugcucaugcuuuaguuggucaaucucugggagcucucaaggauccagguuaguugacuguuggucuuccuguggagucucuguccucuguggcucucccaacauuucucccaacucuuccauaagacuccucaagcuccaucucauguuuggaugugaguuucugcaucucuucccauuggcugcuggguggagccuguuagagaaaguuaugcuaggcuccugucugcaagcauaaugucaguuaguuaguaaugucagggauugguucuugccccugggaugggacucaaguugaggcaguuugguuaccuauucccgcagucucuguuaccuuugucccugcacauccuguaggcaggacauauuuugggucaaaggcuuugugggugaguugcugccccuaucccuccacuggggauaguugccuaguuacaggaaguagcaauaucagaauccauucacagcuagaguugcccccuuagacccucugaggcuucucccaucguaggucucuggcacuuccuagagaucgccccugcccucagcugaucucuguucccucucccuucuucucccuacauaugaccuagccccacuccccucccacaggaacagacaagucucccugccuguaguccucuuccccugacaggcucauggccaguuugguguuuuguuuuguuuuguuuuguuuuguuuuguuuuguuuuguuuuguuuuguuuuugucuuggauaucagcuccuuguuucacagaaaugaaaggagucacccuuuucagaagauccaggcuucacuauuucagucuuggcaucccgucuguguguccugacacugaccccgcgcuucagcauuuuauuugcuccuugucuuuuucuccuccaguggaaugcgcaccaugaggaggggcaacuuacucuccuugucccuuugggaaccucauaucugacucaaguucuagcgcacguuauccaccggcuaacguuauccaucuucuuguguccauugucugugguuuuggcuuccacgaucuaaaaauauuaguuggaaguaucuaaaaauaagauucguaaacuuuucaguugcgugcugcuuugaguagcauggugacauuuggcgccaucugcucccuucugcucaggacaugagccacccuuucccaacagauccacacuguguaugggucuugccuguuaauaguugucucaguucugcaaccgaaaguugugguauuauaaugcuuauggauuuuuaaaagcauuuguuuaauaaugguuguaaagggcaaagaugaugcugacagcuuuuauauuuguuuguuuauugucaagagaagccauaaaauaucaucuuacaccgucacauaagguacuguucaauaacauacuguggaaaagagaccagauucauacaaugucuauuaugggacauuguucuaauugcuuuuuguaguuauuaguuucuuacuaugucugguuuauaaaaguaaauuuuaugagacauagaugugcgcaagggauaaaaucuauaauauguauggaguucagugcucucuacaguuccaggagcccucuggggggccuugggaugucuccucacacauaaugcuguuuaaaacauuguucccaauuaauaaaaugggauauuuacuguugaauaaaaccuauaaggcaucucaaaaucuuucucauagaucucugaauugacagcagucgugaaauacguuccuggguugaucagggacagaaacaagagcuguacaauuagacuucagaaggccagucucuguuucuacuccaggugauaauguaaaugguccauguuagccaugcacaaagugaggggccaucugcuccacuaucaguggucuuucaggaauuguaccucuucauuuuuuuuucaaugcuguguauuuaagagucauaagaaggccaauucaaacagacuguauucguggcccaaauuucuggcccuucauuucuagcugucuguugaugauccuuuuccaauaguaucugucagcaugucaaauccaucaugaucaaagccggauccauuaacgucugcuccuugccacugggccuuccugcuguaucccguugccauuaguaaccaucccuacccuuucuccaucuugaagcacaagauucaucuucccacuaaccccgccccauccagacggccaccaguucuguuauucucugaaaccccucaugguuucucagccuccuuggcugugcuucuccugaaccuucuccacacagccccugucacucugucaccugucugacccccaugccgcuuccagcgcacgaaugucgaugugugaccgcucuuccauccuuugacuuaaaguuuguuuauuacacgcuggguuccugugcauaaggauccagaugagucuucagccggugaaaacaaacucuuucauaguacagccauggccugccuucuguuuucugugaacacucacucguguucugcagccuacagagcucuuggcccucuguuguccccuuucccaugugcucuuuccuguagcuucguacucauauauugcuucccacuuuauuauauuuugauucuguucuuaagucugccuucuccagaucuugucucucucucuauauauaugcaaauauauuuauaaauuguuauauauugcuuauauacuuuauauauguauuguuuuauauauuguuuuuauauguuuauauuuauuauuuauauauagaaacaaaaauguuugauuuauauaguaaacugauaauaaauagggugaacaauaacuaguaguaaaacagggccauuauaucagguuguggcaauaaaagcuagucaaaaugcaugaauuguuucucucagaaacuuuucacaaaauauuuuaaguccgaggccgacccgaaggagaguaacugaagccacaucuaaugaggugacuuacuguguacuuagugucaucugucuuccugauagaacaaagcacucacagaagcagcuguugucagggacuucaccuaaaacacaagauguggccacacugagcgcacuacaugugacucuccaucuacccuugcugcacuguguaaggaacacugguguccugugugcugacucugaguuuuccagauacuucuugagaaaauucuuaucaaggcaagaaacuggccuugcugguaaaggaaaaaaaaaauuacccacaguggaaaagcccuuuuccuaucuaaacacgcauuccucaguuuucuggcuaccgaguccuuucaugaugcaguagugauaggcuuaaauuuauaucaccucuaguuuauauccaauugaaaagacucccuuacucacuucaaacccucagaaacaaaaagaagugggguaugugaggaucccugguguagcuuccuuucuugcuauuuuuuccgggaugagacaacaagacaugucuggucuuuccggaaaggcucuccugagagcauaggugcaaccagcaucccagggguucugcccuuucuuagaagaaggguugcagguuccuauggcuacgucacguaugaaaccaauguggcuuucauacaagcaggaagcuucccuuucuccuucuccuuuccgaggucgugugugugugugugugugugugugugugugugugugagagagagagagagagagagagagagagagaggcuugauuaguuucucacuuuaagacaguccuagaaagcuggauaagcauuuagcucacagaucaccugcaguuuuaugcuuguuaaaagaaagcagaagagaagacugggcacagugucccucagaugcuuguguucauggugucuucuccagcugccuucauucaauacuuuucucacggcugggagcaaacaccaggacaggcuauaaccuaaagcuucccgugaaagacccacuucuuuuuuuuuuuauuagauauuuucuucacuuacauuucaaaugccauccugaaaguccccuauacccucccccacccugcuccccuacccacccucucccacuucuuggcccuggcuuuccccuguacuggggcauauaaaguuugcaagaccaaggggucucucuucccaaugauggcuggcuaggccaucuucugauacauaugcagcuagagauacgagcucuggggguacugguuaguucauauuguuccaccuauaggguugcagaucccuucagcuccuuggguacuuucucuagcuccuccauugggaacccugugauccauccuauaggugacugugagcauccacuucuguauuugccaggcacuggcauaguaucauaagagacagcuauaccaggguccuuucagcaaaaucuugcuggcauaugcaauagugucuggguuugguggcugauuaugggauggacccccagguggggcagucucuagaugguccauccuuucaucuuagcuccaaacuuugucuguacaacuccuuccauggguauuuuguucccuauucuagggaggaauaaaguauccaugcguuggucuuccuucuugauuuucuuguguuuuuggaaauuguaucuuggauauucuagguuucugggcuaauauccacuuaucauugagugcauaucaagugacuucuuuuaugauuguguuaccuuacucaggaugauauccuccggauacauccauuugccuaacaauuucauaaauuuauuguuuuuaauagcugaguaguacuccauuauguaaauguaccacauuuucuguauccauuccucuguugagggacaucuggguucuuuccagcuucuggcuauuauaaacaaggcugcuaugaacauaguggagcauguguucuucuuacugguuggaauaucuucuggguauaugcccaggagagguauugcuggaucuucugguaguacuauguccaguuuucugaggaaccaccagacugauuuccagagugguuguacaagcuugcaaucccaccagcaauggaggaguguuccucuuucuccacauccuagacagcaucugcugucaccugaauuuuuuauccuagccauucugacuggugugagguggaaucuuaaggcuucucggccuccugaaacagugcuaccaccuaggaaccaaggguuccauacacgaguguuugggaaaugccucucacgcaggccauagcacagcuuuggacaguccaaaugcucaucccuuagucaucccugccuguccuagauaguguuccugaguucaguuccccuuuugugcucaucaccuuggacugugccaguagaccaccauuucuucaguucguagucuuuuuuggucuauaggaugugcguaccaggagggcagagacauucucugauuuguuucucgcaaugucccccagauuuugaacaugcccccaaacuuaguaugaagccuauuguccaaauggauagagaucauggauucccugaucuccauuugcaaucugcacacggucggucacccauacucaccaagacccugaucuucaggaauuuguuccuucagagguuucuggcauagccucugaugaaccaggauuuuguuuucucacaucaagaauuuagaaugguucuaggacuuuuuuuucuuucucacugcaggugcuucuacuuaauccugcacggaucauaaagcugucaggacaauguacuuuauauuauauaucacuuuucuuacuuccaagauagccuuggggggaagaaaagcacuuuagucuuuuacuguaauuauaguccagauuuagaagccuugccagaauaucauucuaccacacuuuuuuaugaugcugaaauauuuuaaagaaaaguucaguuaagagcauacuaacuaaauaugucuguacaucucuaaaacugcugcucugcagaacacacugauacccucucacccacaaaauuaauaaaaaaagaaaaauugauaccaggaaguacuaaguucacagauuugucuaaacuguuuuucaugguuuauuuuuuauauaacagauccuuccuaacaacagagguuuuuuuuuucaaaaauauuuuaugguugggguguuuuugguuuuuguauuuuaccugcauguauaucuguacaccacauagaccuacccgacaccccaugcaguguccaaccuuugaacuuccaguccuuccugccuguuguccacuccauuagcaagaucaaacaaguaaaaaacgucucuggguaugugaaguauuaauaugcuaaugagcagguaggauguguguucuggagaccaugagagaauuucaagugcaguguccaugagugacccugagcaagucagaagaugccauaacuacugaauggcaaagaguauagucuaauggaggcauucaagguuggaugaauggcugcauugccuauuuauucauuaauuuacauugaaccugccuagaucucauuuacauccacauuuaaccacuaaggaaaaagcccugguuuccuucugucuuuccucuccauuaaaacucagugucccugugaacuuuuguugggaucaucguuauuugcauauuguucccaauugcauaaugaaugcauauuccugacucaucccaacugcccaguggccucuggccugugccagucacuuucuccuuggaauuucugaagcgaguguuaugcaaguccccuguugcucacugagccauuaguagagacucucucacccagaauaggcauuacuaaaugugugaugacgacucaguccaauuucaaaccaagguugggaccggcagcucacucuuaauugccugagucaugcaguuuugaugucucagucuuuaaguuaaggcuccagcuggguuugagauccuuccucagcaaggaauacuuuagcugcaaaugucaaaaaucgccaggauugguucagagucuuuccagugagcugugcuuaacugaugguccacuuugauaaaucuaaugccauccgcucguagcuggcaggggcuucugccuuucggguggucacagaagcuaggaguaacaaggcaaagaaacaaagacacaggggcuaccuuuucaucuggaugugacuucuccaugaaguacaggcauguagccuggcuucugguuguuuagaaauugccgguugcaaggccuucuagcugcaagggaugcagcaauguggacuaaugggcuauuugguucuuauccaucuccugucaagggaggggaggaaggacuugagaaugaccuuggguaacuuacacaguaucugcuacaaggaguuuaugcuuucuucccaagggaaacauacaucggauuuuguuuuggaaaacuucuaacugaaaauuugauaugccuugcuagcuagcaugugucaccaaggcaacuacuccccuaucugcaggagauacggccuauaggguucugucaucacuacauuguguauauacuuuuuguugcuuuccuucuguagagugugcacucauccacagaaagaggucauugacagauuaucaacagaucaugaaaaagauggagugaucauaacgauaguguacuaagaauuacuuaaagguuaugaauuguuucuggauuuuccacuagauaguuuuuuagacgguguuugaccagguaauucagagugucaucacaguauuguagaauaaaauaggaacuacauuuuaagucuauagucaaaagaagacuuuuuguguauguagaucugaauugaugaaguaaucaguguagaggauaauuugccucguucaaccugauucagugaugccaugacaaaagguacuauagauaugaaaagucauagccguguuuuugcuuucuuuuguuauaauuaccuuuauuguacuuguaauaggguucuuggaagagggaauauguuugcaaauugcaggcccucaaauggcaguuuugcuacugagaguuuuuaugccagaucaacccacaaguauuuauaagaaaaguuguuuguuacauuaggaaaaucuacuucaagucuuuuuuuuuuucugaaaaaggggugugcauuaacaaagaacucauaacacaacucuacagcuuugccuaauuuuuaaaaccaaaaaugaccugauagucuaaaucagaacaccuacccuuaccagccacccucuccugcaauccagguuucuucucaccagauccuacaacuccugaauucaucugcuugaacauuugccuauauucauuguuucuguaagugagugggacaugguucaugucaguaaggacaccauuuaggaggccgaggcaaaagguuccuaaugauaucaaggucaucuuaggcugcugaccggaaccuucucucaaaccaguauaaacaaaugaguaaagaaauaggcuaagagugaccuuguguguuuacuuuuggaaugggaguguucuugacuucaccuuccuugggcuguccuuuguugacgauuuccuggggaccacagaaaacaagcuuaccuucuuccguguuucuucauguucucugcaaguaacaacaaugaucucagacauugcuuuucuuuggaacacacugacuuacucaguuggagaacucugaauccaacgaaggggaaaacaucuguucaucucagguuguuuucuuguguuauuggugcauuggcguuuguuuguuuguuuguuuguuuguuguuucugucuucauggcuguauuuucucugugucucucacuuugauucugggaaucucucacagacgcuucugucuuccucuucuucccguacaucggcaugcauaggucugagccccaucuuuuuucagucaugcuccucuggccucuuauuggucacaacauguugggaacuggcuuuugguuauuuuuaucacugcugaaguggaggccagauaguagaucgcauucucguacccaugaauaucagaacaucucucugccauuucuuuucuccgguuucuaugauagcaggaagaaagaaaaacaaacuaaauguuuacaggcugugaaacaacaaauaaaacuucuaaagguccuuuauucauuuaauugggcaggagguaccaacacauucaauuaucccuuacuucgugacuucaaaccccuaccauugugcccaacagaggaauacauguggcccccacuauccuaucaugcagaauagcuucacagaccaaaggacccucaaugaacugugaguucacuccucccugagccuccaccccacagccacugaucuuuuuacuccagccuuuggccguacauggaaugucagagaaugcaaauggcaaaacacuuugcuugacuuucaaaacaaggaaugaaagcuggugugugaauccugcugccuaaggagacucccagguggcagcaucauaugcaauuaugucagguucagccucgugggaaauggcgauccaccuucaugguagccuuuauccuccagcaaaguacaaccuuucacugugucacuggugacucacugcaccuccucacugcacucagauacucuuaggauggccaggagcuccuguuuccuuaguauuucuuaguauuucucacuuuaaaaccuagagaaagcauugguaauauguaagcugacggccuuugcaguugggggaugggaugagaguguucugccaucuuaucaucuuucugugacuguuucuugcccggcuugugaagaaauggcucugccucacauuuucacagacuucuccccgcccuucuguuuucuguugcugugcucagcuuuacacacccaucucaccuuucuuacaucacagaagaaacuaacuggccuuucagcugguggcagaaaaacaucuuucccgccugcuaaugcuuccuguuagcccuaaaagcuccaauuagaagucguaagagggacacguucaagauucucggagaagaugcagccucauuaaaacacaauugugugcuucugcuuuaaauaguguccaaauagauaagugaauucagguccgccuaaauuuaauuccagaaaucaaagccacagcaauaagaacuggaccugaguucucuuagggcaaguaauuuaauuucucagccaguugaacuauuaugcaucucaguucuuaguuauuaugacaguaaauuaugccgacagaggcggugaggggugaugugcauauaauuucuucuuuuuccuggcuaagcacacaccagaaugcagaugucuuaaacagcuuuucccucagccaaggcuuccguuuggagcuuuaaaagcaguguuuacguaauaacggaagauggauagacaccucagggaauccagcuguguauaugcuucacccuaccugacagcccagggcuaaccaaauccuggacuguauaccagugaugaacacugucacaacagucauggagugagaucauggguaauucaugguuuauagagaauccuggccuggacuuagcuuuucucccugccauugcuuuugcauuaccacugacaguggagaaacaaagggaauugugacugauucgauuggacaaagaggggauuccagacacaaucaauucaggaaucuaccacccuucacuagaaaaacagccuugagauuaaguaaaagaccccaagucaaaucugcgccagcuguagguuuaguuuggaaauacgccaucggugcuagaugugugcacagagaguuuugugcaggcaaucaagaaaucaauuaguuuacccuauuuauaucuaggcagauggaggcuuauccuaucugauuauccauuucucaccuauuucuucauggucuugaugagaaugugaaaaucaguuauagucuccuaccuaucaacacauuaugcauuagcacuucacuaaauuauucaucuuaauaauuucuucuguacauuuuagucaaacguuucagaauauguuguguuuuucaucguauuucaccagaguuggggaaauguccccuugaagagcccaacauaguuuuauaggauuuuuucaaguccugcauccugggcuugcacccaagggccugcuaugcaucauucauuacagaaccuguacaaaguaucccuggaguuggaggaaaccacaccggucccuuggugcuacauccaucuccuuggauuuccuuucccuuucauuuucaggacagcaucucacugcuacgcugucagacacugacugugagagucuuucaaccucuggaagcaugugagaucacagcugggaccauuccagucucuagcucacaugauacagucuaugacacuggacgcacacuccuuuagagcugagcuguguccuuccucaacacauccagagcaucauggugucacagcucauacaaccuccagauuuccauugccuuucccaauggaaaagcacacuccuucuugcuggccacacuccacuucggggugauaguuuccgugugcccuguuuguugguggggacacugaccuggccauggccucuuuuccacucucuuguguagugcuucucauuugacacaacugggccagagagucucagucucagcuguuugucuuguguuggcuuuuugaugugguccagcaugucucuguccuuucccaguaggcaauacaggguaggcucucccugcuuuuaucuucauccgugugcucuuggccaagcuggcauuggcagccaguugcuuuccgcacagguuccuuaguaguuccuuaaauuguguccuagacauguccuuucacgauuuuaucuugccaauugcuaccugaccuguguguguugguacauagauguuuacagccauauuaucucucaacagucuacauaauuuugccuugaccgaagcgucauauaauuggagucagaguaucuucuuucugcaaccauuaaacgaagagcuauguccacuugugaaacauuuuguggaccucagauagaguuccuacuuaacagcauuuugaccuuccuaguguuuuuucaucaaucccauacucccucacgcauuaccaaagucccuugauucuuuuucuucuucacuuuccuaaacuuucauucagccgagucucucacagcuauuuuuuuaucuguucuuccagugaagacaaaguaguagaagucgccgaagaggaggaaguggcugauguugaggaagaggaagcugaugaugaugaggauguggaggauggggacgagguggaggaggaggccgaggagcccuacgaagaggccaccgagagaacaaccagcacugccaccaccaccacaaccaccacugaguccguggaggaggugguccgagguaagccgcuguuggauugcuauuuaacugcccugggauaagagauuucaaucagugcuucccuucuccagcccccugcccucaccucccucccaccacucccccaaaaucacaaggcuucuuccucuugguuuauugcugguguugguuugguugcuauaacaagccguccagcaguccauuuaaacuaaaacaaaucucgcuugcauagucacuucuaugccuuguguaugcuguugaaggaguccuagacuauauuuauauaagaccccaccuagccagaaggcaucaaauuugaaaagugcugaaucaugcccugguggugggccuucauuguucagcacugcccguugcaucuuggaccccugagacugggaacuccuugauuggaagaacuguaguuugggucauucacugugcuggacuuauagacaauuccaaugaaguuugcucgugugaauagcuuuuuauuagauuuuacuaauuuuacuaaaucuauuuucuuuuuguuuacugagucaaacuuuuaauaugauuugguaagaaucacuuuauuucgugcugugaaguucaacaugggcaauuuguguuacuuguuuaaucgggacguaugucggcaccuucuucaaaacagguguaauucccaugccucagcgaaugccccucccgagaauguuguaaaccaaagaaaugaagaagacuuuucaucuccaggaagugaaagcaaauacuuugauuauguuaaacaaaccaaauguuaugccaacuaguguguuuggggguuggggaauuuaaauggguauguguugguuuuuuuuccccacaguaaaaucugccucuagaucuagacugagugaacauggguugacuucauuuuaguguaaugcagaugauguuagcuuucguccacaaauguuaaaaacgcaguaagauuuccuuccuuuuugauuaugguguaaugauuacagcucauuagaguuuaauaugagacacuguccaacccaaggacaucgcuaauuauuauuacuagcccucccucucccuuugcugcauuuuaaagaacuuuauugagguaagauuuuauauaucauaauauuaacucauuuucaauauauaagagagugacuuuaauaaauuuacucaguuguuuaauaucacgguaaucucgcccagggccuuccagcacccuaaugagaucccuucugcccacucacagacuugguccucgcucaugcccauaaauggcugggcuacuuuggccuccauugaguugccuuucucugaauacuuaauccauaacugagguuguacccggcacagcuuaauggcugacuugugucccuuaacaguguuuucuguuuuucacuuggaguuuuugguuagugacgaauugaacacuuagaucuaauggaaguauucuauauuguuuaggaagagaguccaguuucagguagaugguuuaguuuuaucguuucccuacuuaagacagcaugugcaaauagagguauccuugaucugaaugaaaugcucuucuucaaaugcccaaggcaucuuuuuccaaagaaauuuucaaaugucucuggaggccaugacugguagaucuggccuaaugaauuuuuuagcccugauuuuucucagcaaggaaagagguguuuuuuguuuuuuuguuuuguuuuuuuguuuuguuuuguuuuguuuguuuuugguuuuuuuguuuuuguuuuuuuuauuuccccacucuggguuucuuuucuuggagucacaucacagugacugauaaucugcaaugaagugaggucuucagaaguagaggacacuuguuggcugccuguaagucugaauggcacaggugaagaccacacacagccucaugaugaccaugagcgcugagaucuaggaugaaaucaaagccaaagaaaugcaaaaccuucuacucuguaaauuaagaacacagagccuacuucagaacaagcuuccagguuggcuaacaaagguucuuaaguagauggcauuuaagcaaggcaggggaagugucgccagguaaauuuuguuaugacgcacacacaucacagucagucggaaagagcaaacaaacccugugcucugguggaagauaaggggcaugcuugggagacaggacuaguugguacucuguggaaaagaaucuggaaaaacuggguugggacagaugcugagaaugaugggaaauggagugaauuugaccgucaugagucacaggggaacacggaguggugaucuuaggcuuauauucuaaucaagauggaauuuucucgagaucugugaucucguuaacuuucaagucuuguuauuuuucugaauuaguucuucccuuucucaguuucacgaguaccuuugaauuuuagauguuuaguuuuaguauacaguuuuccauguaagguguaauuuuuagaucuucagacagaacauauaaagacaugaacacuauggaauuuuucucuagaaagccucaaguucaagugagaacuacaagagaucucuaagcaagauguuuauaagaaaaaucuaaagcaagcacuaauuuuaaagauaagcaggagcuggggauuggcacaggagauagaguacuugcuacaaagguaggaagagcuuaguucaaacccucagagcccgauguaaaaaggcaagcaugguuaugcaagccugcaacccagagcugaggacacaggaaguuuguugggggauauuguuggauguucuguagaagacucuguguggagaaaauaagacaguguuaaagcaagacauccaacauccuauucuggaaaauacagacgaacauacaacacacacaugcacaaacacacacacacacacaaacacacacacacacacacauuaaugcuauaaaaagguuuuuuuuuaaaugugagcacauucacucuauguaaggcuuauggaguucaccaacgacauaaauucaggcaaaucuuuccgagauguuagaggaugcucauuaaugaugcagauguaggauuaaggcagacgacccuucccuguguauuccuaguguagaaggcgacugcuaauucuucuccuuaguaggagccccagcaauggcagagccgaucgcacacuuuguaaaacccucccugcaaagccggcuuccgugccugggaagcaaacacuaccugcagagaacagauuaguauugcacucuuauuaucaacgucaauguuuucgccucugaaaggacaugaaugugauuuaccaccauucauagaaagaaaaaucauuucaccauuucaagacuccggcaacuaagccgaguccuuacugggcuucuuaagaacucgguccuuucauagcccauuggcuccugagaggacuaagcagagggaaggaagcagaagauauuuuuaccugaucauagaacuucuaaccccagcugccuguucugcauuacugaguucagagagaaggcaauucuuuggagguaagcucguuacugcaaaauccaucugguugcuaagcuuugcuaauuaggaagauguuggauaucagucaaaugccucaaguuguuaccaguuaagggaagcaacagucuuagacucuuguucucauuuuuuucagaucauaaguccgagaugugaggguuuucuuuucugaagugugaauguuguaggaauuggcucagcuuuggcuuuugaacccaauucugccuguccagaaaaacguuuuccuuaugguuauuuauucaguaaauauucuuugugcccugcugcuggcuaaagucuuugcugcuguagaaagcauagcagggcuagcacagacaggcuuccaccugcuagaagcauccacguuggaguucuuuagaacuuagaagugcucuggcucaccguuucccuuguucuuuaaagccaugucuuagucaggguuucuauuccugcacaaacaucaugaccaagaagcaaguuggggaggaaaggguuuauucagcuuacacuuccacauugcuguucaucaccaaaggaagucaggauuggaacucaagcaggucaggaagcaggagcugaugcagaggccauggagggauguuucuuacuggcuugauucccccggcuuacucagccugcucucuuauagaacccaggaccuccagcccagggauggcaccacucacagugggcccucccagccuugaucacuaauugagaaaaugccuuacagcuggaucucauggaggcauuuccucaagggaggcuccuuucucugugauaacuccagcuuaugucaaguugacacacaaaaccagccaguauaggcuguaauucuccuuuuaagccuuauagcuguaguaugcaguagaaaaguuauuuccccuauuugaagucagggcaauuaugacuuagggaaacuuuaaacauacauuagucauauaaguaguaauugaugaagccaggauuuggguccacaugagcuaggcuauuucaguuucguuaaugcccaaaugauauuuucacuuuucuuucuaaauacauacucuucuguuuaacuugcaccuccuguaagugccuguucauuugcuauggacauggaugcaucuuuuauuucugugccguacauuccuggaauuuucuguuuuuaaauuaaacaauaguaaugaucaggugucaaugaucaguaauacaugacuaguggucacaauacuauauauauauuccagggaccacaaguagcauguuaccuauuuuuuaagacaaagguuuuccugggagacacucaaccccacuuauuuagauguugucucuggcuauguucacgcuauaaaagcagaauauagagcugaggagauggauaauuacaaaggagauuauacugucagaaaagaccaagguauauacuguuucuuaaucucagauauuguucaaagaaagaauucuacuuacuaaaaucaaguugauuucaguguguguaugugugugcgugcguguguaugcccauguguaugcagguacauaugcauacauguggauguguguguagaauucauaggacaaccucauucaugcauguagauauguguguagaacucauaggacaaccucauucaugcaugcaaauauguguguaaaaaucauaggacaaccucaaguguuguuccucggguggucccaaccaccuuuucuuguuucuagacuuuaggcagugaugggaggcagggccuuucacuggccaagaacugauccaguagacuaggcuacaugaccaacaagucccacauauguuuggaaugguaagcggucccgccuugccuggcuuuuucuuaaugugaauauugaacucgggucuucauguuugugcagcaaagaguuuauggacuaagccaucccccuccccucagcuccaucuguaguauuuacuggagacauuuaucauuuuauggccuugggccagucgaguaaccugcuuuuuauuugccuaacauaagugcugacguugccuugcauguuuuaagagugacuuuacaugaucuaugauaagcgcuuaccuaggaagacuuagacuuaguugcucaaguacagguugcucagauuugaauccuacuuagcccugcagccugggaacugcaaaauccugcacgaugcagcaaugcaaguaguccugcauccucguaugucucuguaaaacugggguugauaucuagccacucugugagaagcaaguggcuccuaguaaccccugggaaccauugagcccaguuucugacagacaggaaguccucagccuggagcguguggucacugcgguuguagucaucauuccaauaccuugguagauucagaacauuagacaacuaguguuuacuaccagucagacguauuaaagguaaaccaacagauugacauuuuaauugcagugugaugcaucucugaacuguugguacaacagagcugggguuuguagacagcauucuguuaccauuaaaaugcagcaugaacugggucuccugcuuaaaauaguuuugugugugaaucuauucccacauaucaagauauuugcaauuaaacuuuauaucuagcggcaaauugaacaagaugguacugaaugucacguuucaagaucgacuguuuauuccuuccauccauuuuaugccccgugggaggaaauucaucaguaaggggacagagagagagacacggacacaggugacuuuuuaaacacuuguguuugugaagcuaaaaucuccggucuaaacccuggcuggcuuauguuagcuggcugaucuugugaaguuauugcuccucuguggauaauuacugagaagcagcagacaaguaucaggaauugacaugaagacauccccaacagugaugaggcacauuuacacacugggcacagcauuauucucucggggcccagggauaugaacccagguagcucaggucuguccauccagaucugcguagccucuuuucacccuguguggaaaagggcauccguauccuguggacguuuugacccacugacagagcaucagaaguaaugcaucuaacaagcuucauaaauaaagccauguugcucuguaggguauaaaagagacgaagcuuauguuucucccccaucuccauugguauggcucaauaaaggcaugacacaagcagccuggaacucauggguucuugcuuugucugucaugcucagcuuuuucagacuccggagaaacaguaaacauggcuugcugugagugugccaaggagcucaaagcucuaaaguguguuuggggguugaggggguaggaaaaagaacaguaguauguucguucuucaagagccagccauaggcuuuuaccucugcucuaacuaaggcagagaaugcauucacacauucgaaccaagguguggcacccccuuuaaugucgggaaaacuggugucagcacuggccauguaggugacagguggcagccuguuauuuugugcccuguggcauaacagucacugauucuaagccauuccaugcaugcuuugcuugggcugagggguccauguaacuguugcuuaacuguccuaaucuggaaagccuacuguagcaauuagugugcuuaagacacaggacuggggaaugagguuuacagagacagagagagagaguauacauauaugugguuuucuuaguuuuaguaagaacuucauugacauaauuuccuaucgacaaaguuuaguaaauucacaaagaucuguuugccauaagaaaauuuuugugccuuaaguaaugauuaugugucuacuuaacaguuuauaucguaaaaacaaaaaaauaaguuccuuaaaauguaaugcaacaaauuagagagcagguaacaugauuauguauguauacauuuucgccuuuucaauuaaucauuaacuccagcagaguguuguugucucagguaacaaagcucugguucuucguggaaauauuuaguucccuuaauauaaguguccagaacuuuaaaagugggguggauugcaaccaaaauaucuguuucuguugguuuucagcaaucccgcccuucugaagauccgucugugacuuccaggcauguaucagaguagcgugucuaucauuuuguguuuuuauuaggagaauacggagaauuccagaagagaugagacugaauaagucucaauguguguguguguguguguguguguguguguguguguguguguguguguguguguguuuauguaugcugaaacacaaaagacucauuguaugacuuuaaacuugaucucucugugucuugguugcuugugcuaggaucagcagccugcaccaucccugguuugacacuccuacuauguaagcagugacauguggaggaaacucuucucugaucggguguuuccucuuccaaaggaauccauucucccuaauacacugaggugaaaggcaaacccuggucaugggacagacuuuaaguaggaaugaugcuguucucaguuugaaucuuaauucuucucuguuagagacuauggaaggaagccagccacuguggaaaggugggcaugcccugucuuccucagacagaaacguguuuccagaccccagcucacuggaaguguucuuuuguucucaaaaguguugaugccaucucgaaugucuucccaggaaaacgcugugaaaaguuagguuccaaguuugcuuuaguucauuccuugauuuuuuaaaaauuuuuuucagcauuauuuucaaaauaacaaaauaauaauaauauaauaugaaaauaaaagcuguaguguggaagucgaagagggccacuagaggucauauuucugagaagugacguuuuuauagguuuaaauauaagagaacuauuaucucaguauugauuaaggcagaaguguugugguguuuuuaaaaacaguuaauuguauagaguaggaaaaauauguauuggcaaucuguuuaaaaacaguucaucuguuaucuuucuguauuuuuuauucuaagacucuucucauuucccacaugaaccaaacguuuuccaauuuuuaccaguuccuccccucucguccuaaggugcgacugugucucuauauuuuuaauauaacacauuucaacuacauuuaauaaguuaguugggcaugguggcacacaccugcagucuuugaauuugggaaucagacuggaggauugaucauagggguuuacuguguacaugagccacgucaugugaccuugcuucucuaaacacaggcuagaaagccacacccucccacacucgcuacagccuuucaaggugcuuagcauccuuugcaguucuucuccaggcaccuauggcuuucacugagccuacacaggagagaggggcguggcuggucagagagagagagagagagaggcguggcuggucauggagcguacuuugaugaaauuuuagcaccauuucuugccuucuguguuuugaggauuugggcauggagacaggaaauuugaaacuuaaggggaaagcuuucuuuuucugguagcuuuccauucgugccuguguuuuccugguguggcacugucagaucccuacugggcugugaaaacuaauuauuacuguagugaggaauuuugggagucauaaccacuacagcuugaaauaccagucgugggaguuuuaccuagaaaauagccaaaugcuacaauguauuuaucuucccagauacacacaauuuuuuaaagcaaauucuuccaucucauucgguuagaaaagaaaauauuuccccuaugacacaagguacgccuuauccuuacccuguucuagguuuaaacguguugaaaacauguuguguguccaauuaaccacagcugacaggaagucaagguucuugaagcaucauaguggucucugagcucgauugcagcagucucaggggcacugacugguguaaaacccauuuuacagacccaucuccuucaggugcuauuuuauaagaaaccuuucugcauagggaggugugagaaucaggucaaguguaauuacaaugacagagaacugcacaucucaauacaaagcccagccagcuugaggcuaccugcuacacugggucucaaucuggugguugugaccccuuugggguuugaauaacucuuugacagggguugccuaagaugauuggaaaacacagauauuugcauugcgauucauaacaguggcaaagacuacaauaugaaauagcaaugaagauguuaaugguuguaaauuuaaugguaauaauuuuaauaguaauuuuaauguuggggggucaccauaacaugaagaacuaugcuaaagguuguagcuuuccauuaggaaugcagccuuaggaacacugaggaccauugugcuggagacuucuauaaaaaauucacacacaucguccuucugagucuaugacuucaauaaugugcacagcugcucgugugauuugcugauauuucaaccuguauuuggaacaugagauuucaucuccagcuugcuggccuaauuugcaugauuauauuuagcacaacaugauuacuagauaauaaauauuugaucauuuauuuccugguaaagauuaauuuucuuaucguuuuuaugacuacuuguuagcauucacaaugcaugaugaaugugauuucugcuagaaguaugugauuguagcauuggaguuaacacguucuuuaaaaaaggaaccacuugggcuggugagauggcucagugaguaagagcacccgacugcucuuccgaagguccgaaguucaaaucccagcaaccacaugguggcucacaaccaucgguaacaagaucugacucccucuucuggugugucugaagauagcuacaguguacuuacauauaauaauaaauaaaucuuuaaaaaaaaaaaaaaaaggaaccacuuuucuaauguguuguuuuaaauuuugcuucaucuaugaaaaccaaacgaauauuuaccuauagaauauaguuuuuguucagauaaauuaggcucuuggaauguugcuauauugcaauuguuaaauuuguagcaauaacuuaauugggauuuuuaaaaaauaguuuuuucaugcuuauuuuauuaggaauauaauucuuuuguuuguuugcuugcuugcuugcuuguuucuucuucuugucgcugauaguuuagaacuugcucuguagacuagacuagccuugagccugucaauauaguccugucucuguuucccagguacuggaauuggcggguauucaccgccacaucuugaucaugguuguuuuaaaggacacugacaucagaguuuuccauuauuaugguugaauguagaccacaauuuauuugaaugaaguauugaugaucaacacacuguaguacaacuugaaugucuuuaccuuuuaagcuuuauuucacuguuaaguuagauagcaaagcuguauuugucuuuguucucuacaauuagagacuaaaauuacaaaaacgggguuuuaaaagagguacauuuauauuauguaugucucuguauuguguuuaauuuagcauguuucacagaacauggagaaaaucaugcuuugggaauguuuuucuccgcauucugagaaucugcaucuccuaauuuuauccaucaaacccuaguaucggaaggcgcuccauccaguggcugucugccggaugcuaaagggaggggcucacuuuuguccaguucuuccaggcucacacagacccaucccauccccucucccacacauuaugcauuugccacuguuuaauuccauuaccucaccugugcccgaguucuggcucuguuauucagugagugggagagacucugaggacacgccccuuguaccagagccgacaaggauggauuuugcugacagucucuguugacugaagguggugccaguggauccaaaacuucuguuccucuuguggccacacuacaaacccagugcaggacacugcuguccaaucuuggcauugauaaaaccgaagaagagacuacugaaaaguaauaucacguuaggaacaaacgagggugcuauaaagcauguacagucccagcccucaaaaggaacaggaggaggcccacaguaggaauaccaguggggaaugcuggaaucacgugauuccuccuagaaacuggaaaagucagaauuguuucagaugcuugucacauggaguggauucccauggaguucuguuugaggcucuccaggguuagaaacccccaaauaagagauggagcuauuguucuccuugcaacaaaaacagacauguggaaagucuauagagcucuaccuucuaauagggaggaaccuuuaaaaugcaagugaguggguugcugcuuuuuaaaccaauggggauauggaacugauuuggggagacaggggcaagauagacugacaaguaagguguguuuuaauguaagauaaugugugguauauauuaauaaauuugaauguguuagcuguauauguuacuguuuggagcaugacgggcuaagggucagaaaaaaauacacgaauagauaauuucuuagaguuaccaugguugacugucagucacucuugcagauguuacguacguuuucagguuuaguccguggacaggcuggaaacauuaaacauaaaugugauuacuuaugcaugagucuaggcgaucauuuacuaagaaaaacagucagaaguuggagagaacguaaauuuuggcaucacaucccgagaaauccuuuuuuuuuuuuuuuuuuuuuaaacaucagaguugacucaagguuguuuuagaagaugccuuuuuuuuuuaagagaaauuuuugaugugcagagagagagacuuuuuaucuuuaaauugagaaaacaaccuuuucacuucuagcccaaauccuguagcugcuacugcauccuacacauuaaacaagccgagaaugucuuguuuuguggaagaggugacucugaagucugagugggucaauucagucccucaaggaagacuuaaaguagcugcuuccuccguucagcccaggucaccacugggaggaucagggcuuaaguugaguaaguauguaugugaacagccagaagaugucuuuucucgcuaaaugugguuccccucugauuagaggugugcucugaacaagccgagaccgggccaugccgcgcaaugaucucccgcugguacuuugaugucacugaagggaagugugucccauucuuuuacggcggauguggcggcaacaggaacaacuuugacacggaagaguacugcauggcgguguguggcagcguguguaaguggauccuuccuccagccuggccaccucuugucuuucucgccacuggcucugcucuuuguaacagaucgaguuucccucuuguucuugggaaugggcccacuguugcuaccacuaaccacaugccugucaauuucucuaauuaccagaagccuccuccaccacgguauguccagucaugagcguaucucuccgucuaucucuaauaaagcauggccuuggauguauucuguaguagucaucauagagucuucuuucaacuccuaggaacuucugacugcuucucuuuacacaagggcuagaguggcuuuugucuucuucaguccuuccugcagaugcauagacaucugugucugucuauguucuuacaugucuucguguuucugcaugugcacaugggcaguagccucucacugguagcuggcuuauggcacugucuugauaagauugcuauagagaauuccucuuauuucaucaugguuuuuuuuuuuuuuaacuucauucugauaaugacauuuaauugaauugagcucaugucaccucaggugcuaucaugguguuucauugcugugaagagacaccauggccacagcaacucuuauaaaggacaacauguaauuggggauggauuauaguucagagguuuagcccuuaucaucauggugggaaccaugggacacauaguuagacauggugcuggacaggcagcugagaguucuucacccggaucggcaggcaacaagaagaagagagguacugggccuggcuugagcaucugaaaccucaaagcccacccccagugacagacuucuccaacaaggacacaccuacuccaauaaggucauacuuucuaauaaugccauucuguaggggccuauguggcccauuuucauucaaaccauuauacuaugggugcccaugcuguucccugaaugaaccucgagcacauauucuugccaaguuuuucuuuuuuucucaugcaauuagguagacgagaaauagggaucgggaccauuuaauaaaaacucuugccaugcaacugugaggaccugaguucaaguccccagaaugcacauaaaacaaaugugcagucugugccuaucuaaugcuagcacuugcaaagggggaugggaggcaguggcuggagaagcaccugaagacugggaccagcuagccuggccuauguaguugaaguagacuguuccaaacaagguagaaagcuugugaccugugacuaucacaugggcuccguggcgugucacacaugaauguguacauucaugugcacacaaagaaaagaauaaugcuagcaacuuucaguggcacaaggcugaaggaaauaacuuacagugucucucaggaaacauccaacugucucuacugugggagauaaugaugugaaguccugaugacuucaguguaaaaugaaguauuccccgcagagagucaguccccaagaagccaugucucagauauauggaauaucugcuucuauuaguagccuuucaagcaaaguccuuaguuguauuuguuuauucuugaucacaaguuggcuauaugaauuauucaagggucuuagugacagugcaugccuuucuugagagauucuugcauuuuaauucuugaauuugcagggagacauaucccuucccuuucccuggauaucugggaacauucuggcaauuuuccaaccaaaucccagaaccaagcaaaacaaagacuugcucucuuaagaccucacacugugagguagcuaauaucuguuugggaccuagaaaggucuuauuggucuccuaggagauaacuccacuuaaguacucugaggaaacuaguaguggagaggcucugacuucaauuggaugauuguagcuccuaguugaagauacccaagcucauuuucaccuagagguuaauuggguuagauaacugaaacacaauaaaggagucuggugccuggagccuuuggaacaaagggccuuuguuaccucggcucuaaaggguuuagcugcuaggucaggauuuccuggcaaaguucucagguuucccccccuuucccuaagguaggguuaguuucuggaauaucauauucuagcgaucaggaaguuugcuuuauauuauuagcagagaacaauucaacucaaguuuuggacacugucuucuuacccacccuaguguaaaccccccucaucucccuuccacuugauuacucugugcagggaguauaaaacauuauauaccuucaccagggguuggagcaugcauacacuuuauagauggauuuguaaaaauccagugccuucaacagggucuuaugagagaaggucuguaguccugauuucauuuuuacagagucggguuacaagguaucaaggaagcaaaggcacagcuggguaccagacucuggucugauucucagaaccuuuggaggaauaaggcaggggaugggaaggcuggagagaugcuucagucuucuuuuaaaaaaaaagaaagagaaaauuucaauaaaagcaagagaaccagcguucaggucuccagcaccuguugagcgugguauuguuagcacuuagaaggcagggacaggagcaucccuggggcuugcuaggcagccacuguagccaaccagcaagcuccauguucacugagaaacuuugucucaaacaauauggcgagcaaugguuggaaaagaucuaucugcucuccacacgcaugaauguguaacccugugcacauaagcauuacaaacacauacacuacgcacaguaauacaacuuuuaaaagaaggaaagggaagaauaggguugaaggucagguuagacggguggauagugaagaauggaagccucaucacauaucugagccagaccucagaagcguccccgugaacaagugacauaugcggagcuacugcugaggaaggcgcagagagaaaugagggucauuggugcuaaugagggaaaagagaccccuaaguccuccuguagauuucccaguguccugucaguggcagaaugggcagcaauuucacaauacugaucuuuacugguaacaaaucucaccugcauuuccuugguucuuuguuuagguuuuaauuuuaguuucaugauuucccucccagcccucaauuuuguuugauugcuuuugaguccuguggguguguuucugccaucauucccaccuuucuguuguugggguuuuuuuuuguuuguuuguuuguuuuguuuuguuuuguuuuguuuuuaguuauguucucucguuuucuccauagcaacccaaaguuuacucaagacuaccagugaaccucuuccccaagauccugauaaacguauguugucacugacuugggggaggggcaaggggaagacuauguugcaugacugaauguguccuucccuugcaucaucugcuuggcauggguuuugugugauuauugaccaggaaccuuuugauagauacuauuuucccauugucuugcgugucauuucauccgguuuuuacuaggcaacuucagauguugggcagagagcaucuacuuaaaccauuuacacuucugaacaaauuccuuucugauuuguguuguucugugaaauaccacacauagaguauuucuugauuuggcagaacuuuuuuuuuuaauuucccgaaagcugucaacaugccauaauuuaaugaaaucauauuugauaguacagguaacccccucccuaaaaauguaauauugcuuauucaagacaauuuugugugcacauuucaagguuccuguguuaaaugauaacugugcagcauugggaggugaaaggugagccacauagauuucaggacuccccuccucccccucccagagugcacacugguuggugugcuaucaggucuuccacuuagggaacuuaauggaauuuccuauaaaaagacauugcuucaaccauauaauauacucuuggucuuaacagcgucuugcuuucugguugcccaaucagucuaauuucauuuucaaaugucauaucuaacacauccauauucgcuuuuaaaauucagucuguauuuagaaauggauccccccucuccagggauggucuauauuguugguacuuacugaggcuugaagaggaaacccaauuucaguuggaaaugagaugauuaaaauucgccuuugucacgauuauccuggaggggauggggggauccuaaccucaaaacuaauaagaaaaugauuuuuaaaaaauguaguguagaugauuacaucauccuauacuguuauucuucaggggccuccauaagauauuacuguuaauucaaauaaugggaugauauuugaaagauguggguuuuuuuauugacacaauaagcccauguccugauauugugaaauuguuccucuaaaaccuuaagucuggcaagugggugguagaggacuagggaaagucuccgagcgucacacccaaagacuaggaaaacaucauuugugugugugucgcguuguucccaggguuuucaaagauugcagaucuccuucugacacacuuguguaccuuuuccuugcaucuuuggugccuaugagaaaauccgaggccuaacgcucucugugcguugucugcaggcaucaaacaccagagggccgugucugaaaccuaagggcacucuggcugggcuccacaccaaauggcuccacacuggguucugacauuuucuagguuagacaguuuccaagguucagaaagcacauuuucaaaaaauauaagaaaccacacaaaacuggaaaaugcuaacauaccuccccaacaaggucacacguaugaauaguaggcauuucucauccugucuugaaaacgaugguaauugguucucuuccauuuuauuuccuuucaguauguaaaaggcuguugguuuucacucuucuucauugauuagaauuaaacauuauuugauaauuuauuuuuauaaaguauacauaagguuuuccagacagauccuggaggcgucccuuucuccucccaucugcggugugguacagacccuaacauccuuccaucccggggggaugaggugauuuuugucagcuuuauuucuugucucccuacagagacuauucaaucacagcaagugaaggguuuugcagugcuaguaccaacauacgggagaaagcauauaauuucuaguuauuuauagcugugugguugugcugccugccuuauuuauagcuaagccacacauuugaauugaaaaagucauggucaccuggaggucaaaugcagaucgcagccucgauucugaggaaaugugugcagaaugagaagaggagcaggcagccuguuccacuggaaaacccaggcuuaugcacggcgucuucacccacuuagaguuaauugaauggcaucucuuugcucggaggugauugguucuacagaugcucugucugaagugcugcuagugggagaauaaaugcuaaguaagcuagaaaaggcccuuccacugaacugcuuuaagacuuuacauacagagaacugugcacugggaccgcaucaugaaucauuuccugacaagucuuaaugcucuaaccaggcacugcuagauuuuaacuucucccccacaaacaccaacacugaaaagcaccacaauuuucaggacacuuauuugucgugacugcucucccagagaccucugcaccacagggacagcgagaggccugagacugaagaguggucuuauuccuaaccauggguuccuaucucuuugaaaacccuuuccaucugaggugaagaaccuccugugucucagcagcuucggacgucaguucugcaucuauuugacuuaauacacaggccucaccuccaggcccucaaugcaguucuuguaaaauaguaaaguuauuagguaaagauuugaccagcuuauauuucgaaggugaggagagcguugccugucugugugcuaucuccaucagaccucauuucaaaagcaggcagauaaacuccaugaugaagacaaagaacauuacaccauuuuuuuuucugauuuauuuuuuauuuuauuuuauuuuauuuuuauuauuuaguauagaauaaaguuuauucagggcauggggaggggagacaagaggguaguagaggcagagaaaggcagaaagaguagagaaguagaagaguggaggccggccaugagcacauggagagagggggaagggaauggggagagaggacggaaggggcaaggggaaagagagggaacaagaagaaaagagaacaagagggcaagagcuacuuauuuauuuauguaugugagugcucuaucugcauuuaugccugcaggauagaagaaggcaucagaucccaguaaagguggcugugagucacugcaugcuugcugggaauccaacccagaaccucagugagugagcgcuccagggaucuaccaggcgcucccacuuuuccaccauggugcaguauaccacaguaccaagauguaccucuguuccagucuaguauucucuucaccccugaccugacugagaguggaacuacguucauauauagauuugugggucacagaugggagauccuguuaaaguauaaggaugccugaagccgcagauguuuaugacccuguuagaccaacuuccuagaucccagaugcuguuguucuuugacuacaagaucagaugucucaguguuuuuuucuaauguauuguaagcuacgguggauacagaagguagaccagcaagcucuguuaaucaugguuuacccgcauaccccuccccacuuccccguuuguuucauccugguuuccauuaaccuggcuaucuguagagaugcuggagacccuugcuucuuguuuaccucuaucuuggcauuguguuucuggucuuagguccaugauuacagcauaucagggggagauauggccccauacaugguuaaaacaggggaagagauggcuuuguccacacauugugugauccaguagucccgaaguaguuuuuuguaucagaagguuaugauuugcaaacaguagcugacucaugccaacaugaauagggucuaccaguguuacccucagccauuguccuuggcuaguuuugggcuauuguuuuaaauuauucuucauuuguucuucuagcugugaaauaauagccaucaauuuguuagcacaucauggaauacuaauaauggaacuaugcuauucucuuagacugccaaacuauaguaaaaacaauuauuuggcuaggcaugguuggcgcacuucuuuaaccccagaacucaagaggaagaagcuaauggauuucugcaaggcugaggccaagcugggcuccagaguuacuuccaggcuagucagagcuauauaaugggaccuauuucaaaauaauaauaauaauuauuauuauuguuguuuaaauaauucuugcacagauauguacuccuuccaucagcuacuugauaaaggcauggaagugcauccauuuuauuaaagggauugggcgugcuuuucugucaggccguagagucacuauccuaucuacacacugcugcaaccacagauaguaaauuaguagguagucaugacugugugguugccauggcagccagcguccuaggagaggccucuguuggugauguaccugcuaugcaagcaugaggaccugaauuugaaaauuugaacccccagcauucgaaugcggggacugcaacacaggaggagucuggaacccuggugcuaggguagaauggugaagccagacuagccaaugggcuugcuccaaguuagugaaagaccugccuuuaaaacaaacaaaaacaaaaacaaacaagcagguaaauaaaagagggaguggccgaggaaggcaccuuacaguggcuucuagccuuugcauacaucuacauaaaauggaaagcagcuagcagcaacaugucuacuuuaauacacagagagguuacuuuuauuagcccagagugugagaaugcuaccacuaugccucuugagagacucggcaggauaauguaagcaggccacauucaguaauuuacuuacaggaucagagauguggucggaaggauuaaaucucagcauaugagugaauugggaaagguugcucuggaaggcugugguaaauuuacauucgcuguaucuuuaaggcuuuaagaaguuaaggauccaucagcgcucacuaucagaguuuuugugauacgacugguagugaagacuggcguucugaacucaucuguuaaauauugaguaguuaugacuguucaugucuuugugagccacugcuaaugaagucaaggaagcuuccagcaaacuaagaagaaacaacacccuacggcuaagcgagucugacuuccaguuacuauuacucucauuuuaugucuuucugccuggugguuguucguauucaggcuaaagauagcauuuaagugcagggaauauagcuaugaauaaaaauuaugcuaacauucauucuucuacauucaucgcacauaucugauaaaaaaaaaugucccaugucaguacaaguucauagacauaaaaaagaaauguagcuugacuggugaagaguaaacagagcguagauuacauuuuuauugccuucuguccacguaggacauucauaguguucuccagcaacuguguucgaacuggccguaaaagaagagaggcucaagaacacaccucuuuaaaauccagugugcuguugaaagaucacucgcuucuauuuuccuguucauccaacucagacuugguagggguggccgcuauuuagguuuugaguggaauguacuaagaguuuuagcuaguuugaaauuagagagaugaaggaaacuuuauauuaaaaaaauguuuuaaguggagauggcaguuugaaagccuugucacguggagauuaaaauuuccuauaaaguccuucuuuauagguuuacaguucacucauacauaaauuacucacgcugucauagcccauaacucguagccauuucaagggaccgcauuacuagcucucaaucaaauagaauuuucaaugauaaggcagugaguuacauaagucuucacuguuaucuuugcuugccauuguuguauagauaagcugcauucugccaggggugggggauauaucaaauagaugcuauccguggggaauuuugucuaggaaucacucccuuguguuguaguuuagauggucaagggcauuacaccugacccccaccacacacacacacacacacacacacacacacacacacacacacacacuaacacacauacccagcauacacaaaacaaaauaaguaaaucuaaaacuaauauuaaaagaaauggugucaccuugcaaauugaggagucaaauggauaugaaaacuguagggauuuuuuuuuaauaucuuaauugucggugugaggaucgacuggagcccagucaguccucagucuccuuaucuaugcauucaagcaaccaugagucaaaaaugaaugccucuguacugagcauauacaagcuuuuuuuucucguuucucaaacaauacaggaagaaaaaccacucccuuuaauguuugcauuaucuucaguaauauaaacagucugaaaaaggacaguguagacauuagauacuccaaacuauauacaaauauacaaaagggaggugggcaaacuggaguuugcucucuauagcgaacccuggaaccaaccgccucugcacacacccaggcacaguuagccugcagggagcugaaaucacagugagggaaauugguguaugaagagucgggcucgaucaugccugucugugaacccucugagcugcauagugacuucagccacucccaggaaccucaguggguuucacuuuuuuuucuuuuuuuuuuuaaugauguuuuuuuauuagauauuuucuucauuuacauuucaaaugcuaucccggaaguccccuauacccucccccugcccugcuccccuacccacccacuccuacuuccuggcccuggcauuccccuguacuggggcauaugaucuucacaagaucaaaggccucucuucccagugauggccaacuaggccaucuucugcuacauaugcaguuagagacaugagcucuggggauuacugauuaguucauauuguuguuccuccuauaggguuucauaccccuucagcuccuaggguacuuucucuagcuccuccauuggggguccuguguucccauccaauagcugacugugagcauccaguaaguuccucacguaguaaggccuuucccaggggacagcaacuacagaaaauggugucguguucucaggauaguguuuuuugugagagaccaugcaucaugaagacucagaaauccgaaguaagccuguuccccaccaaccagaaaauagacguccaguggaucuuaagaagaccuaagacuguacagcggguacugugaccagcacuggugaaauggacucucacaugaaacuuacucucauaauauucaucuuccugggcuuuagguuuagguagcguaguuuuauuaugagaaaacagacacacccgugucccuucguguaugugaccagcagaggagggagacugcagaagacguguguguguguguguguguguguguguguguuagcgcucgcaggagcacgcauacacauauacauauacauuuauauaaagaauucuacucugaggaauuuacuucugugauguuuguggauacugguaaguacacgauugacuccaagccaugggaaucagaauguucccuguccaugggcaaagaccagugucucagacaagaauccaaaagcacacauaccuccuuuggccuuuuuguuagguucaagcucuuggagaagcgccugaagagaucuucagauccaguagccaaucuuauacagaaacacccuugcaugccuacaccaaaaugacgauugacucuggcacgcuguaacucauucaaauuggcacaugaaaugagcuagcauagcgcuauaccuucaugaagcagaguaaaugguaauaacaccauguguucauuuccauguuccuguaagaaaucuauuugaaauaacccugauacccguaaacauaccccacuugcucguauccugauuauuauuuuauucuuauuuuugcaggccuacauuuucacuuagcccaaucaaggcagguuuugcuaaggggaaccauaaucagauaguacuuacagcagauucugucugugccugugcguucccaccguauggaacagaaagugcagguugccuggucaccuccgccuguugcuauucuauuuacuaguguuuacuguagcuucucauuuucacucugccaguaagagggaaaaaaugguuagguccaugggaagcaaguuuugauaaggcgguuaggaaacacguguguauugauuugcuugagguugugcaaagcaaauauauuugucuuugguaucuuuucuguuacagacaguacuuaaaauugcagaucauuuuucagucauucaggauaagaaaccauauauuuuauuuacguccauguucuguguggacuauauauaaguugaauuuuucugggguuuguuuguuuguuuguuuguuuguuuucuggaaaauguguugcuuuuccuguaggugacauugcauaguccuguguucuaacuuauuuucagugaauuagaaguaaauauaucugauuuuuccccaagguuagcauaaaagauuucuguaggacauaaugguaggcaauaaaggcaccggcgugcguggaguuacccugugugacuaacacuuaauuguaggaugcaaggcauguuaucaccacuagauaaaaauccugggaugcagagugcucgggucacuugcccuggguaccagcugguguaaaaacauuguucacaccuagcugggccuaauuuccaaguccugaguggaccuuccuucccucucgccauugggcaaguguucccuuuuuuaucagcuagaugaggacaguuguuugagguuccaagaauaagccuuugccucccuccuucugcucgaaagccacaccugggcagacaucucggcugcuguuagguuuuugaaaaguuaugauuaaccagugaccacagaaaaaggaaagacaucagaaugcaugccucucguguuuauugaaacgcacucugguuucuguuaacauggucaaaccuuugauucuaaugccagucauuuucuuaaauauauagacaagguacuaucuccaugugaccuagcugugacuucucaucuauuugccauuggagauacugcaucccaagccucuuuacuccaagaauuugaugaacagugugaagagaauaugcgaaacagugguugauauuguugaaugaacauugaaagugauuugagaaggaugauaucauuuccugauaagggggaaaccuuuuaaaaacugucucuuuccucucugucuuucuugacucgcuuaaauacuuccaauucuugcaaaccacuacucguucgugaguuagaauauucuuguuuuauaguucagucuucgguuuucggagcauccccguugccagguaacaucacagugaguguggcaauucagauacugccuggcaguauugaauugaaagagaaaucacugucuauuugacgaaccuugcgaugaauuacagacuguugccaagugugugaaggcugaauguccuugcgugguuucgaaacugcacuuguugauguuuaugugacuuccugugguguucuagcucucucaugaaagguagcgucguaauuaggcugucuaaaacacaaugugcggaauucccaucucgccgagaugccucgauuuugcgaucgccuucuucucagauuccauuugugucugcgggacuuuacaaugaugcuggugauaccauuagcuauucugcagauuacaaaauagccaagccgagcaugaggauuugaugaaacauggccauauuaagcaguggaugcuggaggaaugccugucugggaaaggcauuuuuaaugcuauagcuuuuaaaugugcuuuucuugcuauguucuacagaggugaaacuugcuccugccaugguaaaaugucucugggugcuucuuucggcugcauuggcaucuacugugugcuccucuuucacacgauuucucuguccugggaaaugacuggcuuucuuacaaagguugggcacccugugucucuucucaacuugccucccaucuccuuucuaguucccacgacagcagccagcacccccgacgccgucgacaaguaccuggagacacccggggacgagaacgagcaugcccauuuccagaaagccaaagagaggcuggaagccaagcaccgagagagaaugucccagguagggaggaaucuuccauccucuguuguuuuguuauauagggaaaucugcgcucgccucugccucagcuggguagacauaaaguuuaauuuaaauguuugcugcaaggccacagauuccccccacaucuaucccugugcacggucacaucaaguaaaggcaaguacaagaggauuuugaagcacagguccaacucucugcgaaagagaggaauucugugaagauggugaggugagggcuguuaauugauacauuguaggaaacuuuaucuugugugugagucucaugauaggcuguguacuuuaaaugugcguuguaagauauacuuaaagaauaaaaaggaguaguucaaaucaguaaacuaguuccuauugcccacuaagcucgaggaccugaguuugauucccagaacacacauuuaaaaagccagaccuuguggccucuguuuuuaauccagggcugugggggcagaagacaggcagccugucuaaucugucuggagagguccagccccaugacguaagccguuucccaggaagugugagguacuagaggaagaacaccgacaccuuuaagcuaugccuuauuccuugggccaaauccuagcuaacuucuuuaucaggcuuuggguuccaggcuccaacccugcaacaggcacuauugcuuugugaaaucuccccaugccauagaacuacugcccagcugagccaaccaaacuaguuauuccuaagcuggcuuaccucaagucuuuacuccugccccuaaauacauucuaagguguugcucaguccucccgucuauccucccgucaguccucccaucaguucucugccugagauuggcccuggcccugugucccuguaaaucauugagucuucuucauagaacucaucuccugggcuguuggcaucccaaacaacaagaaaacccucauuuuaagcagaacuaacgauguaucucaaaaagcaggacaagguugcuauuucuucaaagacgacuagcaauaaaagaugacuagcuauaacacuuggcccuacucugcaguuguaacccugagagaaaagguuuuacaacuacacugaaccacaauaauccuggccaugaacuaucacuuacauccuaccaguuggccaugagcuaucauucgaauccuaccaguugcccauggggaaagccugaaagccaguugagcuagaaagccaacugaauggaacaggcaacuaaaagcaauccucuggaaaacuagaacuuuucacauuuuuuuuucauuagaaaagucauuuaggccaggcagugguagccuuuaaucccagcacuugggaggcagagacaggcagauuucugaguucaaggccaaccuggucuacagagugaguuucaagacagccagggcuacacagagaaacccugucucgaaagaaagaaaaaaaaaaaaaaaagaaacaagaaaagucauuuaggaagguguggaauugggaauuacuacaauuccuuccuuuuuagacucaagacugaucucauuuucugaagcuuucagaggcugcccugggcacauaauggggcagaaggccagaggaaguguaauaaacacugagcgcucccgugauguuuccagccccugccagggcacccugaugccagccuugccuccagcuggaagcuccuccccucuccggcuccucuccucucuggccucacuuugcucuugacauuggcuuacuuuagaagugccuuucuucuucuucuucuucuucuucuucuucuucuucuucuucuucuucuucccacccacaaaucucagcagauccgcugcugcacaucuugcuugacucagggcaagugguuacucgaaccuuuuauuugauucuaaagauuuauauaauaguuuacuuauuggugguuucuauaucauauguucuacuacacucuaauuccuuuuaaaucauacaaaauuauauaaggcauaccaacuuuauauuuccuccuuaaauccaugugaaucauuuuuuaaaauauuuucacuuucuccaagauauuuuuauguaauuaagaaaauuaguuucaaguaguguguuagcuucugacaugauauguuguggaaauaagaacacuggugagcaucuauuuaauccagggcuuaguucauagauuuccgggagacuuucuccaucuucacaucccagaucagggacuacuuagcuguagucauuccuagagcagagaaugcaccugguaguccccaguguuacagcguuagcugccaucucucaccauagucucugcugcucaauucuagggacuuuuugacuuugaacuugucugucucuuaaaucucuacuuaguaaucgucauuuucucugcaugacauagccaggccucuaaagaacuguaaauccugauagaauuggugccucucugcacacagugaaaaacugcuggacagggacccacagugcagcccugaaguucagauucagagaacuucagguuuucaaauucggagccuuccaacuugacuuuuguuguagcuuucaauuaguuuucuggguuagcccccccaaauaauggaccucaucucuuuccacugcaggggcaggggguuagggaagaugauauuuguauugauguugauggccuggugaucugaagaucuugguuacagugugacuggcaugugucagaugcagauaagcacacaugcaaaacccaagcgcuucaucacuguauuagugacuucuugguaugccaagcaaccugagaagagcaaccuaagaaaggaagccuuuguguggguguagaauuccaggguacaguccagagugacacagugagcauggugugaggcaggagcuugaggcagcagcaggucacauggcaccugcagucaggcagcagagugcauggccugcucucuccuuugccuccuguccagaaaccccagccacagcccagugcuucuuaaauuuagggugagucuccccacaucaacuaaccuaauccagaaaaucccugccccugacauuuccagagacuugguucccuaaaucccaucaggcuggcgagcaagaucauuggucacacuuacuucuauaucuaguccauuuagugugcaugcagaaugaaguccuucaaaacaaaaacuugcccgaugcugaguuuuuuaauauauucaguggcaucuuagggacagcuacugguacugacccuugacuugccuguagauagaucugcagcagcacacugggccaggaggauaguaggcucaucaucacuccucguccauugguuacucucacagcuuucuuaaacaggucuguagaguaagauuacugaguacagagccugcuguaaucaggcaucaauuaaaccagacagauuuuguaaagcacuuuacccaguaauauuaucuauuaccagugcacccuaguaaaagccacugguuaaggggguaaaucuucugccuacagcgugucuguaaguaguccuucagugacgacauaggccauggaugugugagaguagaagauguuugcuaaauuauucugaaaagucaacauucaaguucauuuauauaguaaugcauauuuucaauacauuaccuagguaaaucuuaauuauuucauggaucugcaauuccaagagggugauccagguuccgaaugucuaagauaagaugauagcaaagauacauaaugcaggggaaucgguuuucaugccccaguaagacauuuaguuucuaucucaaacuaauuuugagaugucuugccugaggaauucuccuuagaacaucgccacucgggaacguucccuuccauacaggaaauugaaacauuuuucuucccaggcucaucuauaaagcgaagcaucucuucaauaucuuuucguccaacgcugcccuuuauuagcuaauagaaauacucaaguaccuggaacaguuuguacauuuuccauguaucuuguucucaagaaacuaauuuaaaaaaaaaaaauccaacucacgugcugaucggauaagaccuuauaagccugguuuuccucacagauucgggagauggauuaaaaaguccacgaggaccuacucuguaaucaacuuuguauauugcuucaucuuccuccauuaggcuuacauuacagcaggcuggccugcuuccucaacuagugucuuaccuuucaccacauucaggagauuauaaugcauacuuucuggggcuuucuggguggauuuggaauaauccccuugcuacucaugacuuaguuacugaacaggaagaguccacucuucauuugugcaaggaauagacuuuggcauuguauuccugguuuacacauacacauucccaaaacauaccacuuggaaugcuuugacuugaugucguaaaagguuaaaaucaaugucuuaguuuauugaugggagacuucgcucagauggcauacgccuuuuauggguaaucaguguuuacucacgucaaguaaaaugacuuuccgacaguucucaaggaaaauggaaagaugaaccaaccuuauuucgggagacugcaauacauguaggcauuuauauucaccauaccgcuggcauaaauuauuuauauucuuguaggacaaauauuagucacauugggaggggcaugugauguuuuuuuaauaggaaacauauugucguauaagccacuguguuaaaucuguauuugaaaggacaaugggggauuuucauauugccuuauguccucuuuauaggucaugagagaaugggaagaggcagagcgucaagccaagaacuugcccaaagcugacaagaaggccguuauccagguaacaccccggucccaccuacaccagacagaacaugccacucucagccaucaggaccuccaggaaucugcuggaaaccccuguuuuauauauuuucaugaccuucacuuguucuucacuucuugucuuaguaauaaguugcuucccuuacauuuucuccaacuauuuaaaauuagaacuaaucaccccaaauauauucuauggcuugcaaucuucuuuccauuaaugauacaucuuuugagagacugaaguuuucagcuccuccaguaaccuuggaaaauuuaagugagauuaggaauuuaggacuaaacccagucuacacaugaccucguacaaacagagagaaacuaucuuugcacuaaucguuauguuaagaaacaaauauguuuguguguguuuuuaucauaucagcauuuccaggagaaaguggaaucucuggaacaggaagcagccaaugagagacagcagcuuguagagacacacauggccagaguugaagccaugcucaaugaccgccgccgccuggcccucgagaauuacaucacugcacugcaggcggugcccccaaggguaagucauauugauuugucacuucaggucacagcaucaaugaugguguccagacaguggagacuggaggccgcagggaagaagcuaggagaaaugccacaagcacuuuauuuguagaugugacuuagguacauuguauccuaaagacaugggguaauagaccaguguuggcccucccucucuuaacucuuuuggcaguuaccuuuauacugauuuccaugcugcauucuuauuuuucuuuaagccaucauuuuuuaaaaucuuuuuuaucuaaugaggaacuauuauacuuuuuugccuaauauagucaugaguuuucauagucauauucucuguucacauuuaccauguaucauuuuucuucuugggcauccuuuauguuuucaagugcagaugaaaugaaguuugaauucuuuggguuacaauguguauaagcuagugauuuauuuaugccugaaaaacaccuuaacuuuaccauugguuuuaaaagauauuuuugcuggguauagaauuaucagucgaagugauuuucuuuuacuacuuuaaugauguuugcuguuuucaacagaccauucuuaucaccucuacagauaaucuuuuguuugaucuggcugugcuagagguuuuucucuuuucacaguagcuauuuuauccauguaaaacgauggaauuccaucuguccuuagucucuuaugaccaucccuucaucucauacuuaagauuauguuugauauuuucgugcauaaauuuuuauuggcuaucauaaacuaugaaauguuguuggugcuagguacuuuuguauaacuaugaauauauucagacuuugauuugaaaucuagcuaguuuuccuagaagcagcuucacccuuucgcauuuugcucuuuuuagauauguuagguggagugacucuucuuguaacuuguuauuuccauuuucaaaucaggauccuuaauagucuaccaugaacucugaguuucaaauuggauugacaagaaccaggcagucaugugucugugggacuucaggcacuauuaccucuaaucuucuggguaccuuuuaccucuagccucuguuucuuauaccagcaggcacugaauaguccucagcuacagucaguuaguaggauaaccugcagaucucuuauagagcaccuguccuguaaagucuagccaccuggguuuccaaugcucuuuccuucuugggguccacugccugagagcccuaccuuguacagucagggaagcucagggaccaugguugcugacaguuguaggaccucaccuuguguaucuccucuuccucucugguccaugguccguacucugcagaaacuguuccuguuauguaguccaucuauuccuuuucucuggcaggagggugaaauuuuggucuucuuagcagaucuugaccagaaguggagauuuguccacauuauguaagggaacccaaacuccacccacccacuugugcugauuucccucaccacacugauaguccuuucucaguuaaggagcuccuggcauuccuccggguaucgagaggacacugguucuuuuguacugaugacaucacugugaucucggaggaugggguggcugguucagggugauaccaguagucauggacagagaaagcugagagucaguugccugcugcagugucucuucucugggucacacuuccucccugaacaaacagcuucugacaauaagaugucuauauuagcauuuuguuuucugugagcaaucucugucuuucccaggcaguacuuagugaaauccugcuuauaucucuuugcagaugacaagguucuggguuacucuuucuuuagagagcaugcuuuggugaggagaguugugggggucauuuguccaggcaagagcugcuagguagauuuuuaagccgcaggccugagucuuggggcacugacuccugugcauaaaguuaccgaccuugaguuauuuaaauuuggacucagccacugcagauagcucuguauuuuugaaagguguuagaaaacucucucuucccgauugccuuugugcaaaucucuaaaaagauauaaaucaagaguuuucauuaaaucuuguaauucgaucuacaaacuguguuuggauaugcugcuuauaacaaccacagagccauaacaggugaugagaaauaugacuuaaaugugcgcugacuauuugaacacaaaauuaaaagucaaaagguuuuuuucucuuuuaaaacaguuuaaucuuauucuaaauguuugccaagcuucauagacagaucuuccucaagaccagugagaaauacgugaccaggggcauauguguccuaguuuuaauuaauucaaacagaaaauuaaggaauaagcuuggaagcuuuccuguuucucaaaauguauuccuuaacauguucccuccagagaggagcugcccuccggcacuuccuucugggcacgucuucacgggcagcuguccgcaccugcagugcugggaugcucuguggaccauuccuggggugcuaauaucugcuuuuuucuuuuaucuuugaaagugaaaaaauuacuaugaaauuacaaguguuuagauacuuaaaaacauuuuauugcacacaaaugaaaagugauuguuaccagaguuugcccuagagagcagggaguugguaagauggccucucucucuuucucuuucucucucucucuuucucucucucucucucucgcucucucucucucucucucucucucucucucucucucucucucucucucacacacacacacacacaccacucuuaaaaccauuuccagggguacauuugcuuguuuaaauuuaacaugcauucucaucgaguaauaauaauaagugucagaauaagagugacuugaaauaaaauauaaaauauaaucaguucaguugcagagaaaguuaugauaaggagaauuuguaagcuaacuaguauggaaauauaaaguuucugauauguaacuuuuuucuuuuuuuaaaugauuuuggcugacuauuaauauuagugguaguaaccaagcugugagaaugauuagugguguggaugaggggucugagggaaacauaauugagaaauuuaggccauuuucgucguuuuugugauaacagugguaggcuaaggagacuuacuaagaagcuauaagagguuacguuuguucaggguauuuuuuuggaugauugugauaaucaaguuaaugggagaaguauuagugaugguaaaauaauuuuuagcauuguagaagguuaggguuuuguacauagucuguuccauacaaacucaucaguuauaacuggauucuaagaagucuuacuuuaguuuuauuauauaaguguuuuuaauuaaaaagaaaaaaaaaacagaaaagaacuuuccguuguuucacaacaguguaggcguuggaaaggagggaauguaguuuaagcagccuagguucauucaaccuuggauuguugcuucauuagagagcguuugaagaaagagcagaggaucucaaaugcgaauaugcaaaauuaaaacagauuguuguaagucacccugaaaaaagucaagaauaugucacagguggcauuuguuggauggccagaccucuuggcaaaccuuucccggggucuguguugcuuuaaaacaucuuuuguugacuaauucaugcuuacucuguaggcucugccuucuggguuguguuauuaagccuguuuauccccggagagcuucggucuguuugguuugacaaaacaaggcuuaaagaugcagaaguccauaucagaccuggccuuucagugcugugggguuggaggggguuagcucuguccccagugucuguacagcuaacauuuagcugaaggcaugggcuucaucgcagagcugugggcaagggcuaaaucucagucuaaaccgaaugucauugacaaaggucgcugguuugugggagaggacugcaaucagucuguuuuccaaagguucugguguuauauaaagaccuguguuuaauggccaagauagccauuuaaucuguaacuagggacaaguuacuuaacaaaggaauucuuccuccccagucugcaaaucgggguuaaauuuucaacauuguugaaacagcaacuagcguguuucuagcguugacuggccauaauucaaaaccagaaggauucacugaagguugagacaggacuguagagaguacaaagaugucuuccuucccaaggggucugcgaggugguauggaacacauggaggcuuuggugacuguccaguugggaagguuugcuucuuaguuaaagaggagccaaugggcgaugacguaucggaacuccuugcaugugcgacaugucugcucuagcagugugaacccugcacaaaagacagauuaugcaaaaccuuuccauguaacacaucauuauuaucugaacagaaagaagccuccaagaauaaucuauugccauuuucucuacucaguggaauuuguguuugaccuaccuagauaguuuucuaaagaaaaagauuauagauacauuuuauaucaggcuuuaaauuuuuucacucaaucacuaaacuuaacugcaaaagaaaaccuuauuuucuaaaauuugcaauguaaguuuccccaaucgguuuugauuuguuuccuugguuuauuuuuguuugcguucauguuccuggggucuccuucuggauuucuucuccugugacauugagaauauguauacaagguugauggcaaaaucgggaaucaaacucaguaggagacagcacaagguguagcucucucaagugugucuuuaaaccaccacacaguuguuucauacaguucaugucauaugcugaauacuuuuuguacucuaagauuaagacugcaaaaaucuguggccuuauaaaaacaggagaaaguuacuuuuuuuccugcagagcuaaaguucaagguuucagaagccauuagcaugcaauuuaauguuucagaaaggguuuuuauacuauuuaaacagggacaggucaugguuuccuuccauuuuguggacaccagccugguaucaacauguuauaaagacaauggauagauaucuuuuggaauuagugaaaugagccucauuaagagaaaaauuggauauaucuggacucuguuagguauuuucugggacgauugaccacuucaaacaccuucuuaaauggauggggauacugaguaaauacaccaaguggguuuggaauuucaguguggucuaugaacauugggagacuguuuuucucaucugagagauauucacuugcaugaauaagauacaaaggauaguuuacaggccagaaacacugcugaaauuauacuuggcucugagucacgcaucaguuuaauuaacaguaaauuauuagcagcuacauugagccaggaacuaugcugggaggcaggaauaggccaugccuuuguuccuaucucagaaugugugcauucugcuuugccgugaguucuugucuucugugcucucauuguggacgucaucuaauccguuuccuuacugcguaucccucaucuuuccagaaauuaauuuuuaaaugccucuuuuaaaaggcagugugaucccaaggugaaggaggugacaauugaaagggccacaucagcugcagagagaaugcaguuacgggacaaagaugcacacagaaacaaugaagaugauaauaagggggcuggguauaauuggucccaauggggcagaucuguuucuuuauucuuaaccaugaguuuuagaucccacccauugccaguauaaccaaauugcaguauuaauacuuaacugaaauaagaauuuccaaguaaaauacacaugaacacauacauguacacacauacagcacauacauugcacacacaaacaauaugcacaaacacacauacaugucuguauauguguguauauagagagaugcauauagauguguguguguguauaaauauguguguauauauauaugugugugugugugugugucacuaguuagagaaaauuucaagacuuaauguuaaugaauauuaaauuauuuauuaucaacauauuuauaaugagccacugaauuuuugcuuguucugugaacaauuccauuuugaaugugaguaacaucaggcuaacaguuauuaacaacaauuacuuuaaggcaauuuacuugugagcucucuauauagacacaguagagauaccaggcauucuuuuuuucuaccauucuuaaguggacauuuuuucuuuuuuuuaauuagaauuuaccaaauucaucuuugucccggcauaaucaaaugaagaucccuagacaacgaugguugcucauuacucgacaauggauuauauagcucuagaaauaacuaucguccaccuuggagaauuguggcugaaaguuguaaagagggcugucccucuuuacauuucauuucuuuucuuuucuuuucuuuuuugaaggaaaugcgcaugaaucauaugccaaagccaagccguuuucuuuguaacaaaugaaaacauaauaauguggggaaaugcugcuuguuuuuuaauucuuuaucuacacacacugucuguccucuaugagguccggacacacaccauuuuaagugguuugucugcuuguucuccaacguagagauugaucuaucuaacuuuuuaacuuucuaaacacgauccuugcaaauugccagcucagagcaaccaagcagaagccagcagcuaggagcaucuuacggucuucagaguuaucugaugucagcaggcuuugcucaugggggucuccagacucacaggaugaugaggucagagcucauucugagcccccagggcucacggcgcauacaggucuagggcugggggauccucgaggccugcugugcuauugcucuguaucaggcucugggggauuuucagggaaaguuaggaauaucuuuccaaaacacacaaagaaguagugguguuaagcgagauaagagcuugaaaccaugugaacacauucuuucuuuaauuaucaccaggcuuauuagaagauaaggaugaauucagaaggcagacccaugaauaucauaaaagcccaacuuguaccuaauaccuugaaucacuuuucaguaaucuucuaaugagauugacaggggacguuccuaucuucuauuucuccuuucugcuucagaccuuuagcaaaguacagccuccugccaagagccuaggaccagaaaugagauacaguaaucuaaauccagaucuucuccucuguuaaaaagaacugcagucagagugcuccacaaauucaguccuguuaucugcccuggccacaguuucauuuuugcacaauuuuaguuucuuauggucaucgcugucucagaauauuaaauggaaaauuccaagugccagccauaaguuuuuaauagcuuuuauuucaccauauugcuguuguuuuauuggggaguguugguguuuuacugacuaauuuauaaaucagucuucaucauagacauguguguauaguaccaagcacagucaauguacaaucgguaccugucccugaguuuacagaacuaggaauucagaugagaacucccagaacaguuuuucacucuccaguugcaucauugucaagccuaucugcgccuugauagaaaucuaucauguuaaauucuaagaugggcucacauaguggccaaggguacagagcuauggaggcagacagcuuuugggggaacacuaagugucuaugccaccuggacuugugugucccuuacaucaucccuucaggccaagcauuaacauccaacuagucaacugacgaaacuuuuucauccugaaauuccuacuccccuucucucucucucucucucucucucucucucucucucucucucucucucucucucucucucccccaccccccuggggacgguuuauguccauuguguauggcucuguuuguauucuaaggcacaggaacguggccuguaccccgcauauuucaaguacagagcaccaaugccggguugggcaccauggaucggagcuccugauggagcuccugauagacaggaagugagaucuaaucuggaccuguggcugucacuuugaagagagggaucuagcauaauaacggaguauacugaaugcaacuacuggguuuugaacagcaauucaagguagaacagagaaagggcaccaaauuccacuuagaauugccaggagaaugccucaaaguuauauauaugcuuaauaaauaaauauauauguguauauauauauauauauauauauauauauauauauauauauauauacaaauuauaauacacaguguacauuuuggggccgugcacaaaacaugcuaauuugauauauaucacauuaccauguuuuauauauauaugugugugugugugugugugugucacuauauauaaccuugaagcauuauauaauauaauauauauaauaauauaugauaauaauauacuauaaauuauauauaguauaauaaaaacacuguaauucacccuccuauuuacuccacauauacacucacaugugcaaacauguacauagcacauauacugguucauauaugcauauacgcaugcauauguacuuaacauacauaguuucugguaauaaguuccauaccauccaacuguuucucuagguguugaacacacauuauuuaauagcuguauuugucuaaacauuccuggcaugucuucgugaaggauguauacccuugugcaucaucgucugaaauccuaggcaggauaccaacagcagcagaauugcucgagacaaaggaaacuuaaauccuuuuuaaaaaaugucuucauguaaaaccugaauaaauugaaguagaaccaguuagaauaaaaacacacccaagaagcaccuaagaaaaaacuuaauuguuucugggaguuuuagcaucugauuguuugaaaagagcuuaauucaauuucaaaguaacauaacuacaguucaaugagggccuuuguucuggggaaagauaauguuucauggggcuuaucaggcauuccuugcccgacaguugaagaguaguuagauugucuguuauuuucuuauuuugauuauugcaccacuguaaguuacuaaugaaaggauuauuugggaagcacuaauucuggucuuggggcugugcacaaacaugguaauguaaucucaugaacacuccaugaauauuucugugguuaaauagaaggaucuuacugaaaacugagaaauccaaagcuuauucucccucuacagcagaaagcagcuauuuagaaagagcgugcugauuuaggacagugucagaaauacuaaacacgcauauaauucguaaagaggaaaaacaggcuggguauccauuuaugaagaauugggagaauucccuugcagugcacacaucaugggacccuugaacucaaugcuaguggaagaagugauguuuugcucacacuugaaacccauguucuugcgguuuuccucacagccucaucauguguucaacaugcugaagaaguacguccgugcggagcagaaagacagacagcacacccuaaagcauuuugaacaugugcgcaugguggaccccaagaaagcugcucagauccggucccagguaagcccugagugggggaaccuucugcagcuuacaguccaguuguugcuuccucaguuuguugggaagauaauuaccucccucuagagcaccuauggugaggguguuguaucucuuugucaagaguucuuuaauaucugaaacucuaaaagcuaaucuucagaacacacaguucuacaaggcuuaacauguggaggcagaaggauggauaguucaaggccagcucggcuacuugagagagaugcugucucaaagaggugagaagcagagagaugacucaccaguuaagagugcuugcucuucuugcugaggaccugaaguuagugcccagcccccacauuucaccaccacuuaaaacucuagguucaggggauaugacacuaucuucuggcuuccucugguuccugcacaaauaucugagugcacacaaacacacauacauacacacauacauaaauaagcugaaucuucuacaaaaggaaggguguuuuaguacugugugccuugacauuuucgaaguuucccccaguaauauggaauauaaauucugaaguguugagagcagccaaaauuuuuaaugcuagccauucaucauuuaaugcuagccaccaggucugggaaguggcucacaguugacaaagugggaaccagaguuuggaugccacugagugugguaacccaccaguaauucuagcacugaggaagcucagaugggauccguggaacaaguugguuagcuaacauagucguauuagugagcucuggguccgacugagaggcucugccucagugaacaaggugcaaagcaguagaagaagauucucagugugagccucaagccucuacacacucccacuugagugugcauccacguguucaguuaacacgcaaacauucauacaugcacacauacauacauaaauaaacaaaaaauaaaagaauaaagucaccaaaauggagaaaaugauaacucaguaaacagaaagcuguguacucuaaucaguaaacuaugcccaguccuggcaaacuccauuguaacuaccauguuuaggguugcuagagucuagaugaagauuuguaauuauuuucugcuuucucauucccagagguugaaaaacuagggucugccuccagaaaucuaagauuuuaaauuuucucaaaugaaauaaaacuaaaaauugcauuugccuucuauacaaaauauccaaucaaauugaaauauuccuauguauuagaaaaucuucaaagguauuucuguagggacuaggguauuuaggaagcuucaguggucggaguguggugacugauguggucguugaaaucgacuguuacaagcaugcaggcuacugguaaauacugaggaaugagagaauaaaaaagaggcaaagaaaccaaaagccccuuuacuucaguguuccagcuguguguguguguguguugggcguggucuuugucacuguuuccuuagcagagauuguucauguggaggugccaucuucuaacagguuaugacacaccuccgugugaucuacgagcgcaugaaccagucucugucccugcucuacaaugucccugcgguggcugaggagauucaagaugaagucgguaagugagcuguccuucggauguucuccgagagauaggcuuacccccagaacacaucagggcugagagucuucugugucugucaccugugcccaggugccuacgcguuguacaguacauuuuguggguugguggagggaggggggguuucacacgugugugaaugagucuaaaauccuucagugcacauggcaaccaggggaaggaagauaccagguguuggaagauacuagguguuggaagauaccaccagguguucuacucuaucaccccguucucaugggacaguugcuaucugaaccuagagcuugggugguggccagcaaagccccgugauuucccuuaauggugcugggauuccggggccacaugcuuauacauggaugcugaggguugaagcauagcuccucucauuuacacagcaggcaaucucgcccauucugcccucucuagccccagaucgccucuuacagugaaucucaccuuggcugcugcuucagcucuuaacuuucaaugccugugagaccuaaagauguaaccugguauagagaagaccuugaagucuucaagcagugaaucaguuguugaaucccaugucaacagugauauucuaauuuauccaaucuuguagguagauacucacuaggcuucucuacuuuauaacuaagcacaguaguuuuagccuacccuguguaucgagagcucaacuccccauuuguuuuucacuuccuuaaauuucuugugacugcacguuucaguuauguuuggaagacagagaucaguaauaaguccucuauauaagaagucaagaacuggguacaguaauccaugccuguaauuguggcacuugugaggcucaaacagggaauugcuucaaguucaaguccagcugguacuacggagugaguucaaguccagucuaggauacacagugaaaccuaucucaaggaaaagauaaaaauaaaauaaauauauauaaaugaaaacagaucuccacaagggagaaaaauucaaaacauaacucauaaucuuacugaauugaaguuaaaauuucuagaugugugcauuaaaugagugugcuuugugguuagcgucacccucuuauccugugugacuuacauuaagguagcauuagcaauaucaaacuauagaacaauaagccauuagaaaggaacuguaccuaaacccgcuaauuacaguuggcacucucugguuucuaauuugcucuuuguagagcuucucauuuggcauugugcuccucuaaauauuagccacaagugagucggacagauggcgacucaaaucccucagugcugcaaaauacccaagaacgggaccacccaguaacuuaaaaucucaguggcagagagaugguuaacuagaaucacacuuggguuucuguucuuucuuucaauaaaguaagaaacugccauggggguagaucaggaacaauuacguaaaaacuaggacuggagggauggcucagugaguaaagugcuuacuggacguuuagaagaccuggauugagaucccucgcaccaacauuuaaaaaaaaaugucagucaugaugacaugugccuguaagccuacuguaggggcaaaagcagguggaucgcaggggcuugcuggccagcgcuacugcaccugugucagucgauaaggagaagaagccauugaagaaggcaucccaacaucaaccuaucagccuucgugcacacacacacacacacacacacaagauuccugucauucuacauauacuggagaccacauacuuacagaaaaucuuucuaagaucuuucucuuggaauccuggaugcuaucaucuuaagauaguuguuuacauaggaaaaaccacuugcugcaaugaacacauuacagccuguccacuacaggccugugugcccuuuaagcuccugacacaaaagcuugagguacgaguucuucaaggacaaugggcuuccuugguuguccuuagugggcuuccugaagaacugugacacaaacaagcaaaugaacagccaguaaaacucuccaucacaucgaugcagacaaacccaaaaucggcucuguaugcugcucacaaaauccuuuauauuuuaaucucuuuacuuuuguucauauuugaaguauuccauaaugaaagugugauuuguuuguuguuauccaaugcaaagaagaaccucauagaguccuuccgauuggcaccuuacaguagacacagucgucuguggauuccguucacccaccauuuuucccuaaguuaucaaacuugagguuugaaucaguucgguauagauaaggagaaagccacacuucaguuggcagaagggugagaugggaaauauagagaugcucguguguuuuggguaaacguuggcgccuuugugcaccucaacuaggauaagcucaauucagucuacagcuuggaaagaaugcagcauucuacugcuuaacacucaugguugcuuucugaguaaaggguuuuaggcugaggaucugccaguaucaguuuuucuuuaaugacacagguguaucucucucagugaauuaugcuuccaaccuuaaaucucuauuauaggccaaaaugggugagaagggggccuuaacuacaaagaaguuaugcugugugguuggagguggggacuggaaucaagccuguaagaaagaauaaauaaacaaaccaaccauacugacuaggaaucaugcugccagggaauucuggcccugaucauguuaccccauugugcuucccugaggcagcccaucugguuaggcuacagccagcucuaguaaaucccaaaucgguaguucuaguaaccacacacauauggguggccuuccgucauccagcaucuugugugccugagagacucuggaccaguccuucucaaccuuccugaugcugugacccuuuaauacaguuccugauauuauggugaccccccccaaccauauaauuauuuuguuccuauuucauaacuguaauuuaauauuaugaauuauaauguaaguaucugauaugcaggauaucugauaugcaacccccgcaauguggucacaacccacaguuugagaaccagcuucgguagacucuggaaccacacauuugaccuuguccugcuuccauggucucaggaacuuccggccgaauaucugagccuuuaccucgcauuggccgccucacccaaauucucccucuggauggccugagcaggacagguguccuguccuuggaaagucgcaucccucaggauccaacugaaagccucagcagcucuguaaagucuucaccgauaaccucagagggcagagcaggaagcaaugguuugaugagcucagacgggucugcccaugacaucagugucuagguauauugugaaaggucaccuuggaguacuggaccagcgcauauagaaggagcaggaggucuaggggaggaguccgggcccucggucccucagacauuagguguguccacguucagcaagguuuucuuguauuuugcacaaaggcggcauacgggcuaauaucaauggugaagaauucuguggcaguaucuccagcucauaauugaagaaacuggauccuagagaggccacuuaggaugauaguggaggaauaaaacugacucugaggccagggucuugccugaaucccacaucuguguucucucuggcacccauugucuugcaccgugaguucucuucucuuuaaccuuagggucuacacauaggguuuaaaccugggaggccauacucuagcuuguguugauuucuauguuucuaucacagcaauguccaauccgcugagcucugcugccauccauggucuuugacugugguucuagcagacagccuggugugcuuuagagauuuccguugcuguagucuaggaaugaggcaaaccgucacgcuuugaggucgcugucccuuaaauuaugagaugaucuguuucuugauaaugcccaaaccuccaugcuaagcuccuuccuugaccccucccauacccauugcacgaaguaccucccuuucugcugugacaauguucccuaaagcuguuaugguugaucuacccaacagaaugaugucaucgggcaguggcagcaaaguaaagaauaaagcagauuucccagaacccuuuuuuaacacuguauaaggagguuugggucgcagccuugacacuguguccuguggucaucuccagaguuuacacagucacaugguugguugauugguugauuaaccaugcaucugauuugguucuccuaaguauugucuaaacugcuguuaguucuuuuuacaaaaggcugaccuuuuauuaucuugccguuuuuaguccagcuuaaauuauuauucacaagucccaaagcacacauacuaguuacuauuuucuuuuucaaagguuugcauguaaauuaugaagcuuucuuguucagaaagguuguaagaaauguugauaaagaggggacauugccuuacgucuucuaaauccugucuaggaaugugcuguucaauucagugaugacugaguuaccguucugaugaaaugcagcugcucagaguuccugcccaugcaaaucgucgucacuucaguccccacagcucuucagcucaacgcugauuuggcccacuugccauucuaagccauuagauguuuuugucccuuguaauuucccuuaagucccuuaaguccuugcuaaauugguucuggcauugaggaauuuuuuuuaucauugucccucaagauucuucagauugcagccaccucaaggcuguaaaacuguagcagcauuucauuccgagaugucugucucacacaaggcuguccugaccaauuuaugaguuaaacagaaggaaggaaggaaggaggaaggcagcucuaauuguuucacacugguuuaucauuuaaauuaauaaaaaaagugaaauacuaaaaaccagaaagaccggugacuggguaaauccgugguuaguggggcugguauggaaugaugugccaaggagacaagaaagccacuuucauggaagagugcuuacuguuguuacaacuuugcuuuuuauuacaauuucacuguggccucuugauaaaaauguccagccuccagggaaaaaaauccagcaugucuauuucagggacagugucucuguugucugugccuauguggagcugguuacaaauccaaauuggguuuaaagucgaauauuuacaacucuucucagucugacaaaauagaagagugaguuaguacugccugagaauuauuuaccaucccguggguacuugucaguuaagagagagcauuaguuucggcuccaaacuuugucucuguaaguccuuccaugggugauuguuuccaauucuaaaaaggggcaaaguguccacacuuuggucuucauucuucuucaguuucauguguuuugcaaauuguaucuuauaucucggguauacuaaguuucugggcuaauauccacuuaucagugaguacauaucauuugaguuccuuuaugauugcuauuggauggagcacagcacccccaauggaggagcuagagaaaguauccaaggagcuaaagagaucugcaacccuguaggugcaacaacauuaugaacuaaccaguacccuggagcucuugacucuagcugcauauguaucaaaagauggccuagucggccaucacuggaaaaagaggcccauuggacaugcaaacuuuauaugccccaguacaggggaaugccagggccagaaaaugggaauggguggguagggaaguggggggaggguaugggggacuuuugggauagcauucuaaauguaacuaaggaaaauacguaauaauaaaaaauauuuacaaaaaaagagagaacauuacugagagagagagagugugugacgccccaggagauggaguucaagaccaaccuggcugccuagcuagacauccuggcuuguugagagugagggaaccagagagauagagacgauaaaauuguuaguaaauaagacagaggcacuauuuaauuuauucuguucuuacuugauuuuuaauaaaagugacugcuacucacauguaaagucuuacagcugaauuaggcacucaaaaacaacauguguucauauuucagacagacaugaggaccuuccuuuggugacuucauuauagucucaaagccaaucuguuguucccaguaucauuaacugaguguuugccuugcuuguagccacccuuauuuaaauggguaucuuugacucccccugaaaaaagacaacauuuuuguuuuuugauuuuuuuuuuucaaaauaaagccccuaguuccacgcaugaaaaugucugggcuagugcagaaauccccagcagaagauaguagccuucaaauuagaugguauucccaguuuucugacagagugagacuggguugacgaguccccagacagagagguuagccuccucagagucccagccggucuuuacaacguggggaagaggccuuuaacagauaaacucgcccaaacugccaagugcuguucuuuauauacauuccuggcuaucauauaguauaagguuucauugucugacucaggaguuaaauuagaucaauagauuauacgucuuuaggaagaucuguuaaagugacugauaaggucacaugaaugugucaaacaucccucuagcaugauucucacauagauauuuccagugcacaauaguggggaagccagucuauacuagcaacacccagaaagugcacuguccaagaacaaaugcguaggcuugguguuucuauugguuuggcuuuuauuuuuaaccaaucagucuccccugucuaaccagaaaggcaaauuguugacacugaaaccuagaaugcagcgcagugcauggagcuguguuccuguccguggaugcuggcaguccucagcugaauuaaacgucauccacauugugcugacucacuaccgaucuaucucuugguuuuuuuccagauaaaguguuaucuucucaaauccuugaaccacuuuaauugguuucuuugcuuuuuuauuauuacgguugaguugugugcguucuuuguauauucuaggcacuaacuuaucacauacacaaccugcaaauguuuuccccauucaauggguguuuugguggguuuuuuaacuuuugcuuauuuuuuauuagauauuuucuuuauuuacauuucaaauguuauucccuuuccuagauuccccucugaaaauaagccuaucccguucugccucccccugcucccgaacccacccacucccauuuccuggcccuggcauuccccuauacuagggaauagaaccuucacaggaccaaggaccucuucucccauuuaugaccaacuaggccauccucugcuacauaugaagcuggagccaugagucccaccauguguuuucuuugguugguuuagucccagggagcucugucugggguuacugguuaguucguauuguuguuccuccuauagggcugcaaaccccuucagcuccuuggguccuuucuuuagcuccuucauuggggacccugugcucuguccaauggauggcuaugagcauccacuucuguauuugccaggcauugcuguuuuuaucuuuacacguguuuuuuuguuguuguuguuuuguuuuguuuuguuuugacaugcaguuuuaguuguucuguuuuuuaauuguagacaaagucuagcagauugauucuuuauuuuuuguuuuugcacuguugcuuugguaauagauagacaaagccacuugaauucugauuggauucauuuuguauggggcacuaacuaguuaagggucucaguuuacagauuccuaccaugugaugaagaagagguucuuccuaacuaaaagacauuguaccgugugcaaauucuguugacuguagacuucuauacccucaauuuccugccuauucuucgguccauacuucuacacuacuuugauuacugugacuuugugguuaagcuuugagauuggcagguauggguucuguacuuuuggauuuuuuuggugauggucauuguuguuauuguuuuaagauugcuuugaacauucuaguuacuuuugaauuucuacuucaauugugauguuuuucucaggacuguuuaagagaauauggguuuguauuuuuuuucucauugcuaagacaaguuaucugauaagagcaguugaaagaggggugucuuagucaggguuucuauuccugcaaacaucaugaccaagaagcaaguuggagaggaaaggguuuuagucagcuuacacuuccauacugcuguucaucaccaaggaagucaggacuggaacucaagcaggucaggaagcaggagcugaugcagaggccauggagggauguucauuacuggcuugcuuccccuggcuugcucagccugcucucuuauagaaccaagacuaccaggcaagggauggucccacccacaaggggccuuucccccuugaucacuaauugagaaaauuccuugcagcuggaucucauggaggcauuuccccaacugaaugaagcuccuuucucugugauaacuccagccuaugucaaguugacacaaaacuagccaguacaauugaccccuugucaacuugacacacaaacacaucacuaguaagccucaacccuuaguuucuuauucauccccaagaucuaaauaacuuuaaaagucccacagucuuuacauauuaaaaguucaaucccuuucagagauccaguaucuuuuaaaauccaaagacuuuuuacaauuaaaagucucuuaacugugggcuccacuaaaaagcuuccuucaagagggaaaaacaucagggcacagucacaaucaaaaacaaaaauucugggauccacucaugaucuucugggcucuuccaagggcuugggucacuucuccauuccuuuccuuuguagcacauggcuugucuucuaggcuccagcugccuguacuccgcugcugcugcuguucuugguggucaucuuaugguacuggcaucuccaaaaacacugcugucuuccacuguaacuuggcuucaacaauagccucuuauaggcucucaugguaccaagccucaacuccuuugcaugaccccuucaguccggggccaucaauugcaacugagguugcaccuucaccaauggccuuccauggccucucacagugccgugccucagcugcucugcaugaccccuucaugccuucaaaaccaguaccaccuggguaacucuuacacauuaccaaguccagccacagcacaagguacagccuuggcuaucucugcaacacagccucuguggucucagaaaacacuucccaggagaugucaccucaaugaugcuggucucuucuuaauuaaaguuagguucuuaccuccagauaaccagaaucaauagucaauaguuccaguaaugcaaagguuuugcuuuaguaguucugauaucuuguuaaucacagcugauucuucagccccagcuaaccagaaccacagaaucuucacaaucaaaauagcaauggcccugaaaagacucuuuaaucuucccucuggaauuucacaagccaggccuccaucuucugcacuguacuccacauuaucuuccaagcuccuacacaacaucugacagagcucuuaacaaugaauggauggaucuucuagcccaaaguuccaaaauccuuccacaguccucccaaaacauggucagguuuuuacaggaguaugccacugugcugguaccaauuugucuuagucaggguuucuauuccugcacaaacaucaugaccaagaagcaaguuggggaggaaaggguuuauucagcuuacacuuccauacugcuguucaucaccaaggaagucaggacuggaacucaagcaggucaggaagcaggagcugaugcagaggccauggagggauguuacuuacuggcuugcuuccccuggcuugcucagccugcucucuuauagaaccaagacuaccagcccagggaugguaccacccacaaggggccuuucccccuugaucacucauugagaaaaugccuuguagcuggaucucguggaggcauuuccccaacugaaagcuccuuucucugugauaacuccagccugugucaaguugacagaaaacuagccaguacaagggguuuacuucaauucauauguaugcauucaugauggcuggaaaguucccaagguagugggagcacaaggcagcuggccucacugcuauccccaguuaguuaggaagcagugucagacaaucgcuggugcccaccuugcauuggccuuuccauuccugugaauauuccagcccuggaagaacugcucucacccacauguaaggugagccuuaccaucccaguuaacucaaucuagaaacuuccuuauaaacuuauccaaaguuuaucuccuaggucauucuaggcccuaucaagcugacaauacuauucauaauuagauuauaauggcucucuauauagaucaguuugggaauuauugcuguuaucacauuuccccuauuuucaguguaugugaauguguuugaggcacaguggcccacacgugaguacaugcauuuauacacacauguuggguacacauguggaggcuggcagcugaugcugaccaacuuuuccccuccauucuacuccauuuacaguuguugcuguagggcugcccucuccaccccgcugguacuuagauccugggaauucaaacuccauucacacuuccagaaagccuugugcacugaaccaucuccccagacuccuguuauaaaguuuuaaauaaggauuaauuaaacaacaggaugcuacagcaggccgugagaggauucuagcugaggcccacugugacaaggcaaguucuuaaaauuaguggaauucacgcuuuuggcuuucacgcuauuauuuuaguaaaauuccaaagguuugguaguccucuugucaagaugugcugucucuacuaccucaguagcuucuguccguuuucacacagucacuuacuuugcaguaaggagcaucucuaccagaugggugaggcuugaggcagcaucucccaccccaagcugcugauucucaugaagaugcggggagucauuuucccagcuccccaacucuuaugugcuguaguuugaaacaaaaccuaaagagaagcccuagcaaaaacugaguagggugugaaagcagaccacagcgguggcaagaugguuuccuggcacgaaacacugcaacagauguguccugauuccuuuucuuuucuacagucuugggaaaaaccaaugauuuuggacgguaacaagggcugguuacucuauuuuucacaagcagcugccuucaagguucuuuuuuuaaaagggaaaaaaaauguagagauauuugccacccagaauauggaaaugaagccaaauuaauuuugaagugugcuuccacaaggauuaacuggagaugagaugagcuuguuugcaugugagucagaguugggaacgaauguaauuugccucuugcuguuccucucagaaacaaauucugcaauguagucacugaggaagccucauuauucuuuauuaauagcucuuagguagugugucuugugcagacacuguuagcuaggaaaucauaaacagggagggugugucaacagggcuggagggauggcucagcacauaaugcucuuagagaggucccaggagagguucccagcacccauguuggacugcuuacagcuucuguaacaccagcuccaggcgaucuaaugcccucuucuggccaucacagccaugcacacacaagaacacacgugagugcacucacacacacacacacacacacacacacacacacauacacacacacaagacuuaauauucuuaauucaugggucaaccuguuguguuuuaugagagagagagaaagagagagagagagagagagagagagagagagagagagaaagagagagagagagagaguuugguggaggcacaguauggugucuguggaaggggguggcucugugggcccaugcugaggcaucccuucccccugagguaccagccacagaaagguauaguauagaauaacuuuaugugccucaguacaggggaacgccagggccaagaaaugggaggggggaggguaugggggacuuuugggauagcauuggaaauguaaaugaagaaaauaccuaauuaaaaaaaaagaauagaguuuauuuagggcauggggaggggaguugagacagagaaaggcagagaaaugggggagggaggagaggggaggggaggggagcggaggggaggggaguggagggaaggcaggccaugagcacauggagagguggggggagaggggcaagaggaauggggagagagggguaagaggguaagggaacaagagcaagaggagaagagaagaaagugaggaggggacaagcagucccuuucauagugaaucaggcacacauggccauuaccagggaacugugggguggggccuagacgaaaugccaacacaaccaauuaaccuauucuauuaugagcgcuguccagagaaacaguauuuugauaugugucaagacacuauucauucaggguauguuaguauacaccaaaaaccuuaucacuugggagacugaaagaggagcaacuugaguucauggcuggccuugacucuaccaggaaauccuaucuccaaaagacaagggauuaaaaacaagcaaacaaauaaacaaguaguauuugcaaugccuuuguuaguggguagaguccaguucauuucagccacugcugauagaugauguauuagcaaagacaaagaauuuacuagccauuuggugcacugaacucguuguugcugacuggcauuuguucauaaagguguuagcuacaucuuuugcuugaaaaaaagcaccuggccucuaugaaauuacccuaucucugccuuugcuuuuggucuguguagcauuuagaugugucuucccguccugagacaaggcugugucccuaagucugcaauguccccuauuacacugaacucuguacggcugcguaaguaggccaguugugaaaccagacacaucuuuggccuaaacaagggaagcaagcuggguagaauuucauucugguacaaacacuagccugagcccuucuagcccuggcacaccagcugugucuccucuuuccgagguuguaaccauaagcggaaguuuugcaggugccuggguuccucuugcagccuugccucauuaagaaggagcuuccaaguacaguagugcaaaguuaagaguguaaacgagaguguagcacguugauaggaucaugcuuacuugcauucuauaauguuuuuauuuaggaaacagugaaagcaaaccaaguuucacauucugaaauaguggguguggaggccucuuuguuugguuuguuuuuuuaaugugugugacuguuugccuaugugugugugugugugugugucuaucacauguaugccugaugccugaggaggccagaagagugccgaauccuuuggaacugaggugauggaggguugugaacugccaaauguauguugagaacugagcucugguccucuucaagaucacugaguacucaggaccaccgaagcuucucucgggccccauacauguuuccuaaugaaagucugugauuuaaaauucaaaguuaauuguuagcuuuaaauauagcaaccuucauuucauaauuacugagucuuaggaagcaacugagaguucucagaugauagccaauaucuucucuauaaaggaagguugcuacacauacuuguccugugauauaggcauccuguggcaugaaaaugaaucauugugucaucuuucuuuguuacaauaaaacuucccuaggaacucuagccaaaugaagugcuuauugcuagaaguugucaaagauaccaauaaacaguucuccagaguuucuauuugugaaauguaguaguugcuaguauaguuuuaaguguaguuuucuaauaguaaauaucuguugccuaauacaaagaaaguuuaguguugccacugagguagaugagugacaguuuucagacauuauuauuaucugaaaauaaucuuugaugauuuagguauauacauuuuacauuauauauaugcauauauauauacacacauguauauaaugcauauguauauauacauauauaugcacauauauacacauuauuauacuuuuauaugacuuucaaaaaauaagauguaggaaggcugggugugacuuacuuacuuacauaggagagugcuucauagccuguaugaagccuagguuuccuccucccacauugcacaaaacgugguaugaugguguaauaccugcaaucucagcacacaggugaugaagacagacaaaucuaagaccuuggcuacuuaguacagcuaggcaugaaacacugucuuuaaaaaaaaugucuauccauguacauacaccgcuaucauuugccacugugaguaacaagaagauccaagaacuaagcaaggauauucagcaucagugaauuguuuguuaaauaccuacaauacucugggacuguuaaagauucggggcacagucuuucuuacucaaauaacuuagaauaauuuagaauuugcuuagagaccgcagaucaucagccaagacaaggcucuguucucaccgaggcaguugaugaaggcugaucugauagcacgagguggucuugucuaauaaccacccuuccuccuaaccaccucaagaagacuacuaagcaagagggaagcuugcuuuucaacagcucaagccacguuauuuuauagguucaacuaaggccauacaucacauguggucaauaaucuaaggccauaccuaacgccuggucaauagccugcagacuaacccguuccauuggucuugauccaacggcacucacuuagugauaauagcaaauucaaggcugaaucugggaauaauaugggcagcuucagcguccuuucacugaacguguuacgcacugaagaguugucucaacagcuuugcacacauacaucucuguugauguguuaaacauuuuguaggacuugggggccaugccaccuuucuccauuugaucggaacucauaugcugaaguaugagucgcugacaguuccguggaccaugauaucauaauuccccaugaugacuucaccauugauucuccgggaccagccaugcaggcuagggcuuugccaauguuuauggucagagacuucuggcaaacagcauggaagugguguauuguugcuggccauuaaaucagacccaugaaguggccuccccugccagcagagcagaucgcuucuugguuuguuuuuuuccacucaaauuuacaaagaaaggcuaacagauaauuuaaugaaaagcucuguauauguuuuuguuucuauuauuguuaucuucauuuugaucacaaacuuuuuuuuagucucccuaagucuugcuuaauccucaaaaaaauccuugauaagcaaaguguauggcuuuucccgucauuuauuacgguauuacuuuauauguuuuggaaacaggccuguguaugccaggcugcucucauucgcagucccccugguucagcaucucaggugcuaaggaacaugguagucgucuuccuuucuucucuugcugagucugacauugcaggcaagcugacguccugcucucagcccuggauacacuggcauauguucugcuuaugucuacaguguugacuuuuucaggucgaauaugcauuuguaucucuucacaaaaaaauaugcccacagccaagggaugauuaauagaaacaguucucaucauguggcuuuggaccggcaacagcagcaucaaugagaaauuguuagaagugugcauuccuuggccucauucccagccuaauaauccagcuauguguggaauagaugugucagcuuuuaucucuguggcuaaauaccuaacauaaauaaacuuaaaagaccagcuuuauuuuauaauauaucuauauuucagaagucugagucuauaguccauuggcccuauugcuuuggguuuguggcaacuauauuauggccagaagagcuucuuaguuuccggugaccagaaggagaaaguaaagaugggaagaagaagaacugaaacaagagaauucucuguaaagacaaaucccuaacuuccaagaggucccaucucuuaaagauccugcugccacucauuaccaacuugggcugcagacaagucccuuaaaacauggaccuuuggaggaaauguaagaucuagaaguaauuggugcucagucuguagugauagugcucaguuaguacuaaaguuaugaugcucagucuauagugauagugcucaguuacuauuauaauaaugaugcucaaucuacagugauagugcuuaguuaguauuacaaugaugaugcucagucuacagugauaguacuuaguauuauaguaaugauacucagacuacagugauuguacuuaguauuauaguaaugauauucagccuacagugauagugcacagucuagacuauguuaaugguccaagguccagauauaguaauggauguaaaugauacacagcuugucuucagagagagauguuuuugcuauuguuagaucuuuuuuaggggagguggauugggaaaaugacucaguagguaaaucacaggcugcccaagcuugaagaccugaguuugaaucucucuccccucccauguaaaaauggacauagcaucaucuguagucccuauacuccuacaggaagaugggaggcagacacaaaaaccuggaagcucacagcaugagcaauaaacaagagacccugucucaaacagguuggaaagcagagacuggagacugacaacugaggcuguccugggaccuccaccuacacaccaaguuguauaaaugccuguacucacauacaagcacauguacauacaucauacauacuaauacucucucuugagugauguugccuguaaaacuauagagcuguaaaggauggaagauauucaaagacucggguucucucucucagaccccccuuuaggcugccuaccccaguguccuuagacuuuagaacaaccgcaguacaagguguuggcugugaauacuaaaguucaggaacuaccgguggaaaugguugggccuaagagaacuaugagugugagaugaucugcuuucuuccuccaggauauuacacgugcucaugugagcuuagagcucuuaauuuguauguaacuggguaaagggagaggacuauuuccuaaugugcuaccuaccaucuuccccucggauuuauuagaguaggugaugccagauaaaauggguucaaccaauucuuugaguuucuguuuguuucucuguacuuuguccggaaucuuuuauccaaaguccuugggauuggaaauguuucagauuucagaauuuuucaaauucggggcacaacgcuaccaguuauaacuagcuaucaucuucaguccaaagagcugagauucggaaugcuuugaaagcuuuagcuuucagaacaucccacauguagagucugagagcaagcccaugcaauauagguauucagaauauaucagagagcaacaguaacccucacguuuacuacugaagaccaaccugagccguuuccagucugcugcuggcaaugucugugauccugagcaaaaugggagaaagcugucucaagaaaaagagguggaagccaagggaagggcuuuguaauguguucaggccuauaggagugcgguuagcgcugagccuguguuuacauucccucguucccuuaggcagggagccagugucuugcacugaguguuuuguuuucucccaccuuaaggagaagccuucuuauaccuaaagcagaaaguaccuccuucaggugcaggagggaaaacuuaagcaaucuguggauugcucaaaacacagucuguccuuugauaaaccaggcaucgcccugcaagucaaacauuguaugaaaaugugagagguuuggcagacuguucucuuugauguggagagagaaaagcuggcuuccuuucccacauucagcucgggucugcaucuacccugcugcuaagaggcucuucaagggaacuugaaaguggugccggacccuccagcuuugcagauuaaggaucuagggugauuaacugauuugaucaaaaucagagacuaaaacuggucaggggucgagggcuucuucacaucuugccagaguucuucagaaaucaaagugaguuuuaaauaccuggggugugaauaaaugagacaauuuucuuccauuaaagaaaaguggccacgaggaauggggaacccuuuguagacaucagaguguucaaauauggccuuguguccaacacggccuuguguccaacacagccuugugcccggagcuugccacgaguugaagcgagcaucuaagcuggcagguuccggucccucgggaguucauccugucauuucugcaugucugucccuuacuccgcugacaguaaacagugucuacauuuuucaggaucuuacuucaguugcuguaaauacuucaacaaucugaaagucucauucagaagccacuuaggaagaaaaguuacucucaguggaaauugguauccuggaagucacugugucucaaugcauacuugggaccaaguaaaguauaauguggaggaguucuuguuuaaaauaccgggucuugaacucuuccucacacucagagaaaucaacucaucuucuacuucaaaugauucuugaauaauucaaaagguuuaauguuuauaugugcuaguaaaaauacaagcuuuuguagaaaauugagaguguauuuguauauaucuuugaccuaaaaaauuaaacauuauuaauguauccuacaugaaguuagaccagucuuucccuucagucucugauuuacaguguucugacuuacaagauuuucugacauuguagcgaggagaaaguaauguguuuugaaucauaauccguccccgggucacuacauguggugccagcauacagcacugcguggcagguccuuaucuuagucaggguuaccacugugcucaaacaccauggccaaagcagcuuggggaggaaaggguuuguuugaucuacaccuccacuucacuauuuaucgucaaaggaagucgggacaggaacucaaaaagagguaggagcugauguggcggccuuggagugguguugcuuacuggccugcuuucuuauagaacccagaaucaccugcccagggagggccccaccccacccccaucaaucacuaauuaagaaaaucucccacauacaggcaugugugcaaccuaaucuuguggaggcauuuucucagcugaguuucccuccucucuggugacuuuagcuugugucaaguuucacaugaucaagauaauaaucaacaauagcccucacucucucaucuugagcucugcuguucaguggacuaggugcagccguggcauguuugacuaggaauguuguguggaaggaccaugaggcuauauucgcaucaugaaagaacacauguauuuccaaggggccacugcauaaaauacuuccgggagaugacauuuacuuugaagguugaauacagcucuguuaaguaacacaauguugagguugcgcuuaacuuacccaagucacuggcauaaacuccuuuucucuuuguuuuuauuguguucaugugugggcacacgcacaugucuaggccagaggacagcaaaagguuuuguuccuuagcucuuuacaccaucuguuugaggcaaggucucucuuuggucugcaagucacccaaauggacuagacugauuagccaggagccccaaagauccuccugucuccauucugaaauuauaaacccaacaccacacacagcuaucucccugucucccucuucccccucuguguuuuggggggcaggacagguuauauccauacaacucagauccuguguguguguguaugugugugugugugugugugugugugugugugugugugugugagugugugugugucugugugugucugugucugugugugugugucugugugucuguguguucugaccacaaaacucagguccuuaccuccugacccacgcacaccccccaaacccgccaacuuaaccacuuauuaaccucagucacugcucuugacagugaacagugaaagccuggggcuggugggaacuucuugccuagaugcugcuuuccuuggaaguucagagccugcucgucucucugacagauccuuuuccucucucaguccugacccuucgcucuccuaucacugauuccaccauagaaauacuccauggagguggccuucaaauccaagaugauacuaacuucaucagaggcaaaagagaagauuaaugcuaugcccagggugaccagcauuguagaggacauucauccgaaucucggacaguucacugacagccuagcauccgcucaggaaguauguguccgauagugaacggacaaaacaagaacacgagaaaagcuaugcuggcugccaacacuagaugccaguccccaggagggagcucacugugucacacggucacauguguauauuuuagauuacauaggaaaacccucuaaaccccuuuugugguuuccugaagugacauggacuagaaaucaaauaccagcucuucuuuuauuccacaaacaaauagaccaccugauuggacaugcuccagaaaugugggaaagcuaucauuggcuauuuuccuucaaccuguggugaacaaggcauguggaaauagaaugcuuaagaagagagcaauaaaaauuaaaaucauuuccuugucuucucugugaaggggauguacgaucauuucucccuguuuagauauccaggcacaugccuguaaucucaaugguucccaaguucaaaggcaggcuagcuacauagugagucccagaccagccugggcuacauauuaagacucugucucaaaggaaaugaaacaaaaagaaguauguuuuucaaagccuuuuucuugcguauccagagugagcaggauuaauuuacccucagccugcagcugucaccuuucuugaacacagagaagaaaggaaacagaaucccuuagagaagacauuuagaucucuuccuuuugccucagucuggcuagaaaggugcaguagugaccuggguuagaguucuguucccauuugcccucuccagacucuguguauaaaauugauagugcguacacaucacacacacacacacacacacacaccaccuguuaccucauaagcgauaguuuauucugaagccaaaugcgucuggcaguggccuggaacacagauuuauuuucuccaaauuccauguuccuacauggaagcaucuuauaguaaccaaacaaagaaagccauaagucaagacacuccguaaaggcaucgguggaaauaucaggguagacugguugaggaagagcagagaaaccccaccuguaguccucaggugccaccugaugacauucuaagcuugcugacugguuggcuaacucuaguuuguacauccggagggauuuaccuaauggucgaaaaggagcugggucagguauaaaggagaacaguacaugacugcugcaggggcuauugagggcccaaagcucuacacuugcugccuuccagaguuucuggucucugugguucucaucaguuacaugggcuuacagaagggucaguggaacuuuccagaauccccaaguguauguguuaauugccuugaggugcagucuuuggguggcaguuaggauuggguuccguguagcuaagaucuucauauagaagcuugccguggacacucugcucugugauggcccagugggagaucccuugcuacauacggguacccugcucucucuuuuuuuuauguauuagaaagagaaggauuuguauggcuuuugcuucuuuuguuuuguuuuguuuuguuuuguacacugagaagaaagcaguagacagaaacagaagaagccccugcagaaacccccuuuauaaauuauucauucucugauccucaguuaugacagaaaauagaacagccucaagcuuaggguaauggcgcaaacuuaugauuucagccacucagcauacugaaacaggaagauccuggguucugggcagaccugggcuacauugugagauccugucucaagaaaauacagugguuugaauagcuuaaaaaugaaagugacuuuucucauguuuuuuggagcucguaaauucaagaugauggguauuuaggaaggccuucucaguuucuccaugauacaauuuguuucaucguauugggagcaaggauccagauguucuagaggcugccccuggggaguuccugcuaugcuggaacaaagaacuggcccagggacacguggacagugguagaaaaagacaugauuuauuaagaaaaagaaagccauuuucaggauggaacuuugagagauuuggacacaggugggccacaguucaaaacacuaacgguccuggguucuugagccuuuuuagaucauguguguagcacccaccuucccccaucuuaggagaucacagagguuuucugugugugcaugcuguuuggucacauacagccacaggaaguggagguugucuuccugccaucgguugcuuuccugugcugaucuugauguuucuucccauaaaaccugucuuggaaggagcaaucucucugguuucuccccagccucagcauccagucacccugggauaauauuuagcgucagucuucaccuuaaauggcucuucucaagaugaugcccuugagggcuaaggccuccauggauuucaucggggauccaguucagcccacaccacuuagcugggucaguccuuuggcuaggucuaauguccucccucucuguugacccuuacccuuuagccacuuacagcgcaugugcucuuuauucuaaaagcuauacacagaagccaugacauauaguaguacucuuaauuuuuaauuuuuugacaucuugaauuggaauagaauuacaucaauucuccaaccccucucagcaucccucccucaauccccuucuaugcuaccccagucuuagguugguagucuccucuucaaauccaaaauaaauacucuggccaccauuuuuuuuauguuaugaagccugagagucacaaacaacccagcacugcucgcuaaucgugcacuccauggcccaaucuagucauccuauaaaaacaacagcaugaccuucaggcuuuuugaagauaguuuugugcagacccaguuuguccagugugagcccuaaguugaaaucaucaggcuaaauugcacggcuuccuccagcugucccggcuucucuaaauggagucccugggcuugagugcagagugcaguucuccugccucugugaugguggugucaucacucugagugcaguaagaucuaaaacucgccugguauuugccacaugucuuggugccaggcacaacucagcuucuccggcuccccaggaaggaagugacauagccgcuguguacgaggugcuugaaugaggcuacuccauuuuccugcugacuugaagaaucugcagacacuucccccaaauacucccauguuuaaaucaaacagcuacaugucuugaaucuucacccuacacgugaaaaaaaaaagauuaauuuccauauuacgaaacuguaaaagguuuuaagcgccuuuccuuccugugaggcugauaaaggagugaauuuguaaacugcggcuggguuaauuagccaggguuaauuaauguuuaccacacugggacgaugaaaagagguguguaaaugcacaguaaugcgggucauuuuucaauuuauuguugaagcuuacggugugugugagugaggacaacauaaagcgcaugcguguuucagagggcuacugaugcucugcgguaauuaugaggcguaggcuucuaaguggauuaauuacauguuccugaagacgaucacaggcuaauaguguuuauuuagggacaggcugcuguuucaaguugaacuauuuggagagcugggugaggugaggagaggcuaacugugugggcaugaaaacagcauuuuaaaguaaccuuuaaaaauaaauaauagauagauuucuagagucguguauuuucaagagagcccaaagagucuuaggugaaguccuggauuaaagcugggaaguacagauacuagaagcaguuugaagagauuggaauauaaucuccuaugaacuggguagauaucccucaguguugggaguuuaggaccagauuccaggacacgcccaccucaggaauccccaaauucauggaugcuccaacuccuuauauagacaguuuguauuuguauaggacuuaugagcaucuucuugggggcuggagugauggcucagugguucagagcacugacuacucuuccagagguccugaguucagaucccagcaaguacaugguggcucacaaccaucugcaaugagaucugaugcccucuucugaugugucugaagacagcuacaguguacuuccugagcaucuucuugugugcugcucauaaaaccuaauccauugccacugcucagucaacacucacuacccuguaauguuuugaaaacagcaugguaaaagcccuauuuguguucaauacagacacagugaguguuuucccauuaacuuuugaucugagugccggagaguuggcuuaguggauaaagucuuugcuaugaacacgugaagaccugcguucugauccccagggccgugucaaaagcaggaaugacagcaugcaccuauaauccgggcccuaaaugauggaaagagaagugucugaggaauaggacauccuagugcuuguguggguccuuuccugucagccuugaguucuuugcaugcgaagaaauugaguuaguuauuucuggcacuggucuggaaauaucgacaaaugaguaucagugagcucaccacguaacucguuugagucuccuuguuccagauucuuacagggauuucuucccacuccucaccucugugcacugagugccuuccugaaggcaggucgauuccaccccuggccaaaccccuaacgcuuagcacuugccauuuccaggcuuggaugcuaucuuacuuuuucuguugcugagauaaaguacccugaccaaagcagcuuaagggagaaaggcucuaucuccgcuugcaguccaaggacacaauggaucaaagcagagcagccaaagcugcaggucacuugacauccaggacgaggaaguggaggguggugauuggucgguucuuguuaauuucccucuuuggccuaguaggacccaagcagagaaaggugugacccacauuuaggguaggucuaccuucuguuaaccuaaugaaaccgaucccuccuaggcaggcauggaggcuaacuuaaucuaaauaauccuuugucuccuugguuacuccagagccuaucaaguugccaguuggcguuauucuucaucacagucuccugggccucguuaagggaccaugugaaugaguuucugcuggagagaaagggccaucgccauagcuaggaaagcaagauuucguuaaagacaaacaggccaguguacagaagagcauacuggauguguuuaggguuucuaaaauaugcauacauuagcauuuaaaugagcggucaugccuacagagauguauuguguauaaggaacauagcccuccauugugaugaccuguguauuuaggcacauuuuccacacugagcccuuauuuaucagcauaucuuuuagggucuccccaugaaauugucuacagauguuggcaucuuccuuucuaccacgagcucaccaucuuuugacccaguuuuuucaucccccugaauauaguaguuguccgucccucaucaacuggaacuguacugagcucucuuccuggcccagcagugugugauucccauuccauacaucugcuguggucuugagcaggccaggcaggguucucuuccaagucugagggagagcacuugagagccugggccacugcauagcuacaguuguauaagucgcacaggacccugcuauaacggacagcagucauggaaaccacagugaagaguugucugcagcugcacagccaugaacagcaguccuguggccaugccagcauggccacccgccccugcuucucucucugauguguuugaagacgcacaccauugcugaaguccaaagcacguguggcagagccagucaugggcugugcaugugacucacucgccucaaagaaaauguuauguccauuuguaaggagagagguugauuuccuuaccagcugucucagagguggcucggagcucaaguggggaugaaagaaccccaaguaaugaugcccagaacacccuacaggagccgagaaggagccacgggacuccgggcucaauuaauuuuuuuuuucaucucuuacucuacguuuguuuuuuuauugguccacacuaaaaauuaguuuuucauaauaauagauggugcuauuauaaauauucugaccuuuuacuuuuaagcaaauauacgucaacaccaaguauuccaaagagccccaguaaaaugaaaauuaaggaucuaacuggaaagauuucuuccccauaaguccauauuuauauguccccaaaccuaauaguagucucaaagaugucauucucuauggccacagccauaaagauuaaauaagaaaacaagacgggacauccucuuggaguugggggaggagguaugggaugaggaacagucagaggguggacugggaggggagcuaaugacuggacuguaaaaaaagauucaauaauaauaaugaugaugauaauaauaauaaauaaguagauaaaauaauuucuaaaagacaaaaaugaaaaauaaaaaugugaguuaaauguauaguggccuccuagugcuagauuuuccaccgugugauucauuuuccaagcaaguacauccguguaauuuacacguaugagcauuagaacuucagcccacagaacuuucuuucaaagaccagugcuguagugugaaaacucugcagucagggccccagguggcugacaucccagggggauuaagacccccuaaagugguuggaaauaagaucgggaccuuggcccaaguuccauaaauaaacacggaaagggaagcuuuuuaauccuuuugccaaggccagggagccuggcuguguuuucaucuugauuucuggcuaaugccgguugauagaacggagcuguuugauguaggaguuugaaagccacaaggaaacuccucuucaagggaaaggcacuucuucugaaacuucagucuagaccagacgaugguauuucaggaaaaugucacuugcaauaaggaguaguuuucacaagugaugcuccgccuucugugaguccucucuggggacaguugccuaccauaaguggacggaacacacccccauuugaaacucuguggccaggaaacuucuacacaaaaauaaaccucgaucuagacaugagucuguacuuagacucugggcaauucucgagauugauaguguagcuccagauaaaagagcugccuuaauuuucuagacgcggagguuuguggggagagcucauugcuaagugaugucuauagagguuuuccccccaguuugggaaacaguccuacaaugaucauucucucucagccacugagguaaccugaucacuccacuucauuugggcacagaaaagauuuguggggcagagcccaacucaaauucagauuguuuaacuucucuuaacugugaaguaggguguugaagccuaguggggguuccuauggcaaccaaacagccuccucuuagauugguuacuuuucuccuugcagagacaacaucugacaagaaccaauuugaaggaggaagggaugggguuuggcuugcaguuuaaggggagauagcaugccugguggcaggaggcaacuguucacauagcauccaaagucaggaagucaggagagggaacaggaaguaggacugggcuguuaaguguucaaggcccacccucagggacugacuuccuucuucugugaggcuucaccuccaagagucagcaaacugacucuucccugagagcaccagcagcgaugagcuaaguguucagguccaugaggcugugcgggaucauccacguugauauggcaguucccacaguauuucaugagauggacauugaagaagggaaagacagugaguguuccugggggaaagaaaccauuguuggaaauggaaaauccaaacagaacugauggacaacagcuucaggcucugucacacuucccuaaugagccucuagagcuacaccuuuaaccucuuuggccuaaguuuauuggggggggggggaauaauaaucauugaaauuaucucuuucuaaauaacaugaaaauucucaugggcugaugagaggauuacauuaggaacugggguccucagguuucaguuauaguaucaguucugcuacucaauauguauuuaucuacauauuauuuauuuuugaggcauauucucacuccauauguagugcugucuuggaacucacuacauauccaagcuggcaucgaacuuauagcccuccaguuucagccucccaagugcuaguauugcaaguguggggcuagcacaugccuuguuuguugauuuuaaaccuucugagaauggauguuugugcauucuguucucaguggggguugcuauggguaccaaaugagccagugaguagcuacaaaggccacugauguggacaguguagggaggguagugggccccccccagcccccaagguauagcaggacuugaguacuugguggacuggucauggcauuggagauagcugugguuuguacguagucagagugaauacagcaaccauaggaagauuccaugugucccugcaagucagcaucucuauuagcugcugccucacaaagccaagccaggucuguccagccaggcuggucugcgaaguguccacagugcagaaguaucucuccuuucugggaggagccaggaaugacguguggccuggugcuuucuuguguguacguucuuauucuuggagacuaagaaacaucaaccuauucccaacacaucucugugcuuccccuuccugcuuaauaaaugauuuggccaagaaggaaaucaugguuguuuucaguuuuccugggcuauccugguacagaaaugugaucuugaacguuaguuuuaaggcagccaaguguuggguuugaaaacuaagauuugcugaaggcguccuccagcgcacgucuucuccuggcagugguggugcuuagcugagugugacacacucuccgaaaacuggucugucugugaugacgggaacugaggucacuacauucuugcuucugcacugcauggcuuauggcuccgguccucucagacuucaccacaagugaugacuagccuuugacaguugucaccugggagcccucuaauaugcagauuugcuaccuguauccaaggaguggaaggggcacgaggauucugucuuuucucuuucugagacaaaaguuugcuauguaaccuaggagauccucaaaccuccuauauacccuagguaagcccuauacuugaaauccuccugucucagccucccaagugcuggaauuauaagcaugcuuuaggacaccuguaggacaauucuguacuuccaacaagauccccaauggacaccuaugucccgagauugaguuuacauaacagaauuuaagugauggagugccagagacugucacccaaccuggaaucuuguagauaaggaauacaggcuuaaggaguuucagaggccacggggacauuaauaacagcaucacauuaauagacugagccagggguuagacaugcacaggcucugguuggaaaauuaaaucugaucucauagcucuaguaugggcaaaaugccuagaauggaugauggcugauuucuagucaagcucuuugauggggaaaaauuacagaccuucuuccagugcacuuggagccaaaggacaguguagggaaguagcaggcagauauauaaguaucuauuuaaaacauuaaaaucgguuuuaggagaauccucuguuaaacaaaauuaaaaagaaacucccauuuugguggagaucagagaucaguaauuuuucacagggagacaaagaaucaaaauuaagacagguauaaugucaauaaagauucaguccuagaagaaaaacagagcaagccugacaaaccgcugguucaguggucuaaacuagcccuuuaauagccuuguuugacaagguuaagauaacuccucacuuguaugaaaaauaaaaaauaaaaaauacucaguauguccaguacacagaaggcaucagucuguaauuaccaguuauuaugaaacuuguuagaaagauugacucaaugacuauaaauuuuauuuuuuagaaaccugaaauguagcccuuaagauuuugaaauuuauuuggcugaugugucauuuaauaguuauaaggagacucugggauggaauacguaggauucgugucuucccuccucuggcagaccuuuauucaugaggcccuuucgcuaaaaacaaauggccauggacaucuuuaguguccaccaaaccaaaacuaaaaguuugaaaucauuugaagaugaaaucacugugacucucucuuaauguugcucucuuugaaguaucuugaauguuuuccacaauagcuaacgcccuccccuaccccaccuuccuguuuacucuaaguuugauuugcccacauaaaucaucaaagcguuuuugaaagaggaaagugaugggguucacucugugugugugugugugugugugugugugugugugugugugugugugugugugugcuagaauucacacccauuauguaaaccauaagugaaacauuaccaucacugggcuuaauuaaauauuccugcuuuaaccuugaaaaacccaagugucuggauauuacagaagauucuugacuggaguaguaccugaugaaauguuagaugguaacaaggugcuguccugaaggggaaaagggagucuugggaaaaugaauguugucucuuagauuaauauagcaauugguaagcuuggauauuuaaaggcuucgaugguccuuaauauaggccaucaaauuagaauaaaauauuaaauuaauucaaauaaaaguauaacccauuugagccaccacgaacacaguagaagaugguuucugguggcuuugccucaccaugggaucaaagcucagugacacagucacucuggucccugccuugucggacacaggcacaauugcccagcgucagugcauuucccagcgguaaaauccugagcccuuaaucacagaguagcuggcugucuugaacauuuuaugaucauaaaguagaguccuaccgugguaauggcaauccuuucgaauuuauucagcucucugcccuuaagagcagacugaauuccuuguucuaaauggcauugccacaagugguuauuuuuaaauucccuacguuaaauuaagauaauaauauggaucccugcuacuugugcuaagagauuuuucucucagcugaaaaugucgcuuuucuugaagauuucaacuuuucacauaaauuuccuaauaguuuuuuuuuuguucguuuugaggugaugcagaugauuuuuuuaaauguguaagaauguuuugccugcaucuauguauuggcacuacauaugugcccacuauauguuucagaagguaucugaugcccuggaacuagauuuguagaugguugugagcuaccauguaggggcuggcaacuccacccagguccugugcaagagcaaccagugcucuuaacuacugagccgucaccacagcuccguccccaucgugugaauuugugugcuguucacagcagugggcuaugugucuugugucuauuuggaggaaauaucuugccaacaacuuuaaggauaaaugagacaagggugccacguugucuuugccugaacuuuccgggacccuguaugcaaauguauccaaauauaagaucuuccuaugagacggacauguggucuggucugcgcucucucucucucucucucucucucucucucucucucucucucuccaccugcucuagucugagaaaccccuuuuggggugggagugggcaguggugggaggcaauguccacucuauaaggcugguaugguuacaaaucaaccucuccagaugcaaggcuuauguuugaucugcuccgcaaauaagcacucccaggaugguaacccacacuguucaauaccacagcuccagagggaugcuggagacgggaaggaguugcaacccacaaggcuggagauaugcagggagcuagggacacugaagggcccuagcaucuuggauuaauucacuacacaguggagacuauugaaaugagaaggagucuugccucaguaucugggaaggaucuagggaaggcagucaaaugcagauugguaaagagcagcgaucagucaguucauauugccuuaacaauaucugagcucgaugcggugguacauuccuguaaucuuagaacugggcagugggggauuauggguucaagguuauccucagcuacauagaguuugaggauuccaugagauaugagacucaugucuucaaguaaaacaauaacaacaaaaaccaacaaccagcaauuuaucacauuuauauaaauuuauaacuaggcaauuuauaaaaaauaagacuuuuguuucucgcagaccuaacuacaaguuuaagaagaugcuggaagcuucagugucuuagagaacucaacuuuccucauucagaguggggacuuguugugcccuccagagaggacaagcccuacuccauuaauagcagugagagccuucacuuaaucccauccccaaaccccacacaacccuguguauuguuacuucuccggggaguaaguuucaauacgugaauuuugaggcauauucauaugguagcaggcaguaaguccacagcuacacuucaucaaagcaaaacugaggggaggucacagaacagggagacgauucagaagcggacauucgaauguugucaguauuguuaaguauguaucguggauaguucugaggcugagaauguaucgacgcuaacugccacgggaaggcaggagcgaagagaaccaagucuguaguccaagaggaaggcucaagcaucauauaccuuccacguugucagaauaaaagagucagucaugaagaaauaccauuucaaugcuguccacaugaaggagaucuuuacaccuucaagcaugggucauuuucaaaggagaaaguuggagaaggaaaugugagaagaaaagguuaagggcacagagcuugcuuauuuuuucuccuuccuuccucccguccuuccuuucucucuuccuaaggaccggcugacauuuucagacauuaugagggaacagcaagacaaugaaaaaguuucaaaguccaggaaaagcgugguaauaaaugccauagagaccucaggcauccaagagcucccuccugguucuugccucucaagguggacgugugggcaucgauaauuauuccaaacuaucuugacuucaggguauuaagugcuaaccagucaaagcauaagauuuauauaaaagaaaugcccacuuaauuuauuaaaucagacuuuggccaaguuacuggccauuaccugugacuugauaagacaugaaaaagucuaggagaagucuaaugagggccuuuuaucugugugggaaaggucauugcaagcaucaaauauugaauuuuagaucagugccacacugaguagguauauauuauaacucaaauuagacuucaaaaggacuaauuugcuagggguucuaucauuuaaaauaaucucuuguaauaaaacugacucuacaggaagauauuaaucgcauacuuuaaugcugucccuucaaauuguuuuaauggguacacauuugagcggaauauuaauuuuuccaguaaauuggcuuuuuugucaacuuaaaagaggauugaaaggaugauaguaaaauguuacaagucaaguauaaauccagguuuaauuuucuuuauuuucuccagcauugauauuaacuagugaugggcuugaaauauaauucaguaaacugacacaggcgugacucaguaaugacacacuuaauuaaucaaguauuaauaccauaugaucaaugggccucugauuuuuaaaaaacuauagauaaaaugucaggggaacuuuuuguaagauaauaggagauucacaaaucaucuguuuugggggguuuuggugauggugguagcaacuacacucauuauauuacauucuguuuuucuguuccccugguaaacuuuuuuaauaaugaaaggugcaauuggaggauuucuuacuggacucucagaucuuuggguagaucagcuauauuccauaagguugauuuuuuuuuuccuucggggaagauagaagcuacagaaaacaaauucagggacuuucaucucaggucacuuauaugauccugagaggaagagauaggagauuagcucagacagugagcauucuucaggguccucagugacaugccuugaaggacaaaguguauguuuguagcucugcugcaucuggggaaggcagcuguuuucagagcaaaggucacggugacugaauggagcaggaggcccguuuguaauauuuucucacccauccacaucugcccggagguggggguagacagacgcuauaucuugguucccagacugcaccuccaugccugcuguuaacacucuaccccggucccacaucauagcaugcuguagaauccuucaugaucacuggauacauggggagucuguggaaaggaaaaggcaguuaguucacccuccaggucuucaccucuggagaagagaaucagcaacaagaucagccagucucgacaggcucagagcagucucgacaggcucagagcagucuccacaggcucagagcagucuccacaggcucagagcagucuccacaggcucagagcagucuccacaggcucagagcagucuccacaggcucagagcagcccaucgggucaaccacuaagcucugacuuuccuuaaggugcuucguuuuuuacauguuagguggugccaagugacaccucgucacacacggcauguagucaguaggaauggccgcuguaagcguacgcuaaccgaggacacacuggcuuuucuuuagaugagcugcuucagaaggagcagaacuacuccgacgaugucuuggccaacaugaucagugagcccagaaucagcuacggaaacgacgcucucaugccuucgcugacggaaaccaagaccaccguggagcuccuucccgugaauggggaauucagccuggaugaccuccagccguggcacccuuuugggguggacucugugccagccaauaccgaaaaugaagguaagagucccuaccuggagccaaaagccuucuggguggguguggccuauguuauagguccccaugguaacaguugccuagaguacuuuugagagaaggaccugguguguggcagagaucugugucacccgcagggauaccacuccuauagauuagaggacucacaguauaugcugugauugccccaugugccgucuucaucucuacauuuuaaaaaagguaacaaaaauaaacuaguacuuuuuauuucuccuuucccuuuguaaauuuacauacauauuuacauagagagaggcacacaccuaccaacuguccaagacuggcauguacaauauagggaaacaccaucucaaaauaaaagugcauaaggaaacauagaucaggucauggaugacuguggagguggggggcgggguggcagagagaaggacagacagagacacagaacuagagacgcacaucuuuggacucccagaaauccaccugccuccuccuauguuugggaauuuaagacacugggaaauaauuauuuaaacauacucucacugggaguuauuuuaucucuuccaugaaaccaggauuugauuugcgcuucuaagcuuuuggcccagaauguccaccuuuaaugaaaagggugaccaaauuaagggcagaacuuggucccccagagagaagguuugacagggccuuguacaguagacagacgcugaaauaauccuccucagccgccgauucuuacugaaagaaugcagcgaacgcaauagaaugaguagagugaaugaagcaaguuuacgucagaacuaaagagaaaugauuucucgaucaacgaaucugcacaccugggugauguaauucuuucaggggggauuauguuagggcuucuauuccugcacaaaauaccauaaccaaaaagcaaguuggggaggaaaggguuuguucagcuuacacuuccacauugcuguucaucaccaaaggaugcaggacuugaacucauacagggcaggaacuuggagacaggagcugaugcagaggccauggaggaugcugcuuacuggcuugcuuccccuggcuugcucagcuugcuuucuuauagaagccaagacuaccagcccagggauggcaccacccacagugggcccuccgagccuuaaucacuaauugagaaaauaccuuauggauuucauggaggcauuuccucaagggaggcgccuuucucugugauaacuccagcuugugucaaguugacacacaaaaccagccaguacagggacuuagaagaaccuguuuaggaagcaacaaaauaaccuguuagcuuauuuugccauuuuuccauguucaguacaaauugcaugcacacaauuaccuugauuucuugaagcuaagaaugcuuuccaagaaggcaacaguaucugccugggguuuuccucacagugcaaaagcacugagcaaacagggugaugguuguguuugguugguuuuugguuuguuuguuugauuuugguuuuggggucuuuguuuguuuuuugaggcaauaucugucuauguaggucuggcuauccuggaacucacuuguaguccaggcuggccccaaacucacagaguucuaccugccucugcugggauuaaaggugaguugccaccaugccccgugagugagcaguuuuugaagacaggcugcggaaaucuguguauacacuuuuuuuuuucacagcauaacaacccaauuuguuucuuuaaucugaaaaaacaaaggcaacuuacagguauaauuauauuagauacuauacagcaucaacauuauuuaugggauauaaauaauugacuuucccacuuguuaaaagaauccuaccaaaacaaaaccaaaaagaguaggucauuugauuuucuaugccucaugguuauuauauagauacauuuggggcucuaaagucauuguuaccccguacauaaucuguaauaagaugaguauguaaaaaaaaauguacagccucauuuucuaagcucagcgcacaugagauuggcucuucauaguaaaagcacauacugugacaagcacaugugacacaacacagacacagucacugauacucuugacaauugccaagauguccaggcagagccuugauuuaagugagucuggacguaugcucaguacucagugcgauguagccuagccuuuaacauccaaagcaggcuuucuuguuagaggugugcuacuggggcuggggagaucacucaggaaacugguuuugccuggcaagcaugaagaccuguguucaauccccaccaccuauguaaaaagcaaggcuugguggcucuggaaagguagagagagauagaccccucaggcgcguuucccagccagccuagccuacuugguaaguucuuugccacuaagagaccuugucuuaaaauucaaggugauggugcaaauaacauguacacacacauacacacaagcacacacgcaaaucugcuaaugauuaacagcagaaugagagcaguaacaagagagggcaggaaucuagucgauacaaaggcuuaugcagaacaugugaaccaucuaucuauucagucugcaacaaugccagcuuagcuuuaugccccagggcacaugagucuuccugaucucuaagucuugaaguaugggucucaccuuuauauacccaaugccccauuagaacagguauuuugaaaagccuuuucaacaauuaauucguuuuguuguuguuguuguuguuuguuuguuugacuuugauggucugaggggugaaccuaggauuugugggugcuaagccugaccuccacuauggaugguagccccccagccuaugacaguucaucuuagaauaaaugggacuggcaaggucuuccuggaaaaacaauguugcaaauagcaacaauguugcaaauaacaacaauggugcaaauagcaacaauguugcaaauagcaacauugaaauaauacagcccucccuguauuuacucaguaacacacacacacacacacacacacacacacacacacacacacacuaagaacugcagggguugguugguucaguaaauaagaacaaugaauuguucuccaaacaugaaguccugacuuugaaucuucaacacuuucauuaaaaaaaaaaaaaauggcuauacauacuccaguauugggggcaaacauagguagauuccccuuuugccccccaaaacuaaaucccacauggcagcauauaucauauguguaacuccuguauuggaaacagacauaggcagauccugaguguucauggcccagccagccuauaugaaacugcaagcccaggcucagugagagacccugucucaaggcagcaaggugcagugcuagaaugagauacgcuaaggccugcucugcagugugcauggaccaaccaagugcacacacaggcacaccuguguguacacaccauucaugacaugcacacacaacacuauggagccauacugaauucauaaauucagagcugaaguggguucuggauuuacauuaccauuaaccccuuacauccagugggaaguuagagagccguguaggguguggguugcugcagugacccuguguacuccggcauucagugaccuggauccucacccccacuaaauggcagucaugccucucuuugcuuagucuagggacuaaacaccacauuccccuugggagaguagccagggcuccuaauggucaggucugacguuccauuacagcucugcugugugacugcucacgugacugagccucuccagccacuguccagccugagauaaucuguaucuucguuccuugcuuaaaggcaguuugagaacauuuucguggagagcucuuuaaaacaccuuuucaauggagcugggucuuguuggagcggcguggucauucucuguccagauggcucaccuugcgccuaaacaguaugcccuucaaaugaauaaguaauaaaggcauaugauacaguguuccugcugugcauuccccauguucccuguucuccccuacacacacccugagcuacuaaaaauaccuacagcucucaaaggauuuccuuucauuguccaugaggcccuucccagcauagauucaaaugcuuaccagaaagggccugauuuucuucaacaaaaagagucaaaaaaaaaaaaaaaaaaaaaaagagucaagaccaguagauaccuggucauuuaguucuuuuacauugagaaaagaaaaaaaaaaagaguuaagaauguggauggcucugaugagaguauuuucaggacacgucagggcaguuacuuacacaaauggauucagacguugagacggucagaaggcgagaccugcacaggaucugcaucgagugaagaggugaucauacgugccagcccuaccucagaacuuuggcaguugauggcugcugcgagccagggagucaguucucuccaaagaugcgguccgcgguccaguagauggcucuccaccaaugugcacgcuggcggugcugaguggacucuauggcugaaggaaaggacacaggaaguugggagggaagaauggaagaggguagaggaggaauuggggaugagggaguggagugggaacuuuggucaaagcacagcguguguauauaucccaaauucugaaaggcaauauagguagacaagaaacagaauuuuuucauaccguaaacaauaucauaaaacaaaauuuuccagucagggaaauuugucagaauuguguucuuaccucaguagaaugaauagcacuuagaauaaugucucucuacacacuaguaauuuucaucauuagcauaauacuugugggugaggaggcaaccagcuguacaccuugccugugcaccacagguacaggugcuacccugagccaaacguacauuuucugaggugugacugucaacagcgaggggagcuucguuuggccacaccagcaaccgcugcaccaauuagcuccucggcaucaagacauuuaaaaaaguagagucacccucuucggcuaacuccauuuuacaggggucauaaaaaucacgguucauauuugcggugagaaaugagauauagagaaacuguccaugucauuguugaaacagacagggcauucaauaaauggaagcauacagcaugagaaccuucaauguaaucaauguaaucaaucaaauaucgcgagaagcuucugaagugaauuuucaaaacaaucaguccuuacugcaauaaaaagaccaggugcuguuaccuuccuuuuuccauaagaggaaacaaccucgguggcuguuuggccacagucacacaccuugacaccgguucuggguuucuucgaugccauuccuccacuucuuucuagaccacguugccaguuuccacaccagcaaagucaggaccgcuucagccuccugacacgcccaauucucuuaaugcgcucagaagcgcaauuggcccauuuuaugaagacaacucucuguccuucuguucccugccgccauucuuaucaacugugccauccauucagaacggauuugggguuguggucacuuucgaccacuuggccugugagccucuguaagcuaaaugguugaaacuguggguccccaaggcucccaucaaacucccgcuggcuucccuccaccacuacgcucagauuucuuucucucuuuuacacuugccagaccugacccaggggacuuccuccucccuugccuucaucugcccuucagccacuuguuaauccuuaaagcuugguugcccucucucucccuuccuuauuucuucaaaauccagucugagcugagggaaguuguuuucugacaagggacagaacaccgccuugggaaugccaggcggugcagagucaccguggggauuaccgcgcuuagacguuguuuucuuuggaucagucccagaacgcguacaaaaggaugauugugacugucagcagauaugacaggaaauggucucauuucacacaauucagaugaaugucaucuguagagaggaagccagccauuucaaaggagaaacgggggggggggggagcccguggguuacuucuucuacccuaaacucagaaggaauuugcuucacuaaauggcaaaaagcguugcucuuccgauaaacucauauuugcauuuccccuggcaauugaauaaucccuuaguaguuaauuaacuguaaaagaagauaagauugaguagcuguaggaggagguagcuuuuaaguuuacugcugggcugggcauaaucuauuuuauuucuaaucaaaagccaagaaaccaucucuaaccuagcccagaggaaagucuaccuuccccagccuccgucuuugauccuauuguacauccuggugagugcucuaugaccacacuaaggagacacguuggcacgucaggggcgcuaagccuuuggaagugguaccccuccccauccuugaugcccaggauuagcucacaaagguucuuuuuuuucccagcugcuccuuuuucaugacuuguuuauugcaaaugcuuucccuugcucuguguucagaagccacgacuuaaccauccugauuugucuccuuugcucucugucucuugcuuccugcaccagucgagccuguugacgcccgccccgcugcugaccgaggacugaccacucgaccagguaucugacucgccccauuucgccucugcucucagcacugugcgcuucagcaaacaugccucucuggguugcacguguuacgggauagaauuuaaaacgacuguaggcaccaagcaugauuucagagucuuggcuucuccuuaugccucauuucccaaguuccuacgugaucuaguguuuguuuguuuguuuguuuguuuguuuguuucugagccuucuuucugaaacaaagagagucuuuucaaauguggggcucuuuuucuugauuucuuccuuuuuuaauaaaugaagagugugauguggacccuguccucacacacgguagaggcccagggagguguagauuucagugggaaauugauucuugcugaagacaucuccuuccucucuuguuuaguauucauggggguccuugaguggccucagacuuuuguugguuacuaacauagacacaauuuccuuaaaauaucauuauugguauuucuccagcuccagaaauacuuagugcccucuguggauugacuaugcuuacgcucagccaguggcugaaguaacacaacagauggauaugcauaauuuugcagagaagcccuuuuguuuuucugucuuacaaauuucuucacuaucaaaauagauauuucuuuuuauacaguuucccaagauuaaaaagaaauggguuucgacccccuauucuauguuuagcccccggcuaaacuuaaagucuuaagaauaaugucacaccgcaagagacauagaacccgcuugugucuacuccuugcacagccucaccccacugauagugaccgacaaagugaaucagagaggggaaagucaaugaauuggaagaucuguguauuguggagagauuuucuuccaaauagcacauaccuucccacguuuacuuucuuuaugcccagaucccaugagauacucaagagcaauguuaacaucccuuggggacaucacuaaagggagguaguuuugcuuccugguucagagguauccccaguaagaccagauauggccacgccccucuucuugccauucaaaucucuagccuuggcugcugccagccaugguccuagggaaagacuuugagaguccuucuggcaucacacugaucccaugaugugguucagcaccugagcagaaauugcagagugauacgucggaggacagcugaccucauugaucugacgaacgucuugucugaagugcuuuuaaaagaaccuugaguuauauaaguuguacacucuuugggcucucucauguccucuuuaaugacagugucacuaaguaaauguccagggaaccagcaguugaccuucccaugcuguucugccagccagugaagcccaaggcagggccaguaaguccagugaguccucaccacagcuacaaccagcucaagcuggucuccuagacuuuuuaaaauagcacgcuacucguuuuauuuuuuuaaagaugaccuauuuuuuaucuauaaacauaaaauguaauauugaggcguacauccagccgauuuuauuacauuccucuauuauauaaggauguacuuguuccuguucaaauaauccagcacucacacagucaaccagcucaucuucucacucuguuuauguaaacugaacauguaaaaggcauuuucauacacuggcaaaaaaaagucaucuguuuugagaaaagaaacuaauggcguucuacagaacagggaaagccuacaauaacaacaguauuaucccaugagacaucaauguuguaaauucugugaauacucaaaaagaauaaaugauaagguucuugcucccgggggccugagauguaaucaaaaacaacucacuuugaauuuagagaaagaugggaggacaggaauauaugaggacacacaaagacguuuggugacagagcauguuauccagggaacucucuggaaaggagcuuuccacagagagaggggagugggagauuuaaggcccaggggagggcgaggaggaaaucaguuagauuagaaacuguccugggcuuguccuuguaagaccuguauccauauauccacauccuuccaaagauagccaccgaagaggaagaugguauacaccaggcaugcggaagccagcuaagcugcaauuaugagcauggaauuugcucaccgugucugaggaguuguguaggcucuaucaucuguacuucuguguuggcaaugagucugccgcauauucagacugauaccuuccuacgcugugcaccuguuccaauaacucuacagccaccuguuaggaauccacacucuggacucugccacauugcaucuguagacuuuuccggucuuagaugcccuucccaggauugcccuccaccauugcucuuuaauaaucuuucuugucacucagaaacaaagaaaucaagggugugaguuuuggcuuaguccuuucuaugcccuguuucacaucaccaugaugaagagaaugauuuucuuucuuaucugaaaaaccaggauauuguaacuuuuagaagauagugucacccacaagccacagcaauaaugaugccgauuuuuagacacagugacaaucccagcuacucacucuuccuggaauguuuccaagcaaaaacuggacucuugcagacaauaagaaaacacaucagcagucucuucacuugguguguuaagcuaccccgccauuauucccugucccauccuucuccaggccuaacaaucuaguuucgugaccccaagagauauuuuccuauugauuuauuucauuguucuauuguuuuguuaaucucucuguaauaauauugcuuagugcguagaacaucuucuaaaugccauuacgugcugaacagcagugaaagagggacucuuucugcugagucuuacacuacugaacugugaacauugccagucgugcuagcaugugacgugaauuugauuuuuuuuuuuugccuuuuucugucaucagauacacugucaguguccucuccaccauaccaggagcuuauacgguuuuaaauggggacguaauaauugacauauucaucgcaaugcugugcucucugccucccccacccccugauauaaaagggaagacuacuuacaaguuuucacuaaaaucucagaaguaacuuuaacugccguguuacuacucgcauguggugagggaaggcugcauuagaaagaaaucacuguugaucuaacgaggaaguaggucagguuuuauaaagguuuggaggaagaugaaaauaagcaaccggggugauuuaaagagcauucaugucacugccacauuagaaaaaaaaauagugucaggaaguacagagaacagagugaguuauaauaugaaaaaaauaaagguaauuuuuuuaaguaauguaaaaauagaagguugcaguucuucaaguaguauccaaggacaagggcugucgaaugaaaacaagcagagcuaaugagaugaaacagaaaggggacuuacaggucucguugugucuuuccugucuaaauuaauaaaaaugaucucccgaugaaaggaaauuaaaguucagauagaacaccgugagaaaagaaagcgcuaagccuuuguauucguugccuagucaccuaucgcuguguaacaaguagccccagaacuuagcagcuucauagagcaagcguuuagcuccuuacagcaguuucagccagccagcauuuuagcauagggcagagcuggcugguucuggcucaggcucuuucaugaaaucacaaugaagacacugccaaagcuguggucuccugaaggucuggcuagagcugacagagaucaagcacucucuuggcugcugucaggagccuucgguaccuucccauggcagcuggcuucccacacaccaagaaguacaauagagggaauaagaaagaagcuuuggugccuuuuauaaggcaucaguucugccauguucuacuuacauagauaccauaucauccccugcuccggagaacaaaagaacaaaguucugguuuuuugaaaucauuauuaauaauaaauguguguuguauacucacauauguagacaaguacaguucccuacaacccaggcuaagaacacaugaagaggaacuugaacaacaguggcuagucauugugagaguuagaacagaagaguaggaaggcccagcuagaaggaaauggggaagugugauccagaggcagaagcgagggagagcagcauuguacugugagcagauuggcauucaucaugagccugguuuacgguggguuguccaagggaagcguugugggcaguuagacaagagguggugaugagucacacccagcauggacugcccaggucugucaauuauacucacucucagcagaagccaugcugacuggcugacgggcuuucucagugcuuaugaccuugugcuuuucagggucagcaggggguugacaaguuuuccaauacuugauggacaagauuggaagagccauuagacccagaagaggcaaugaguucccacaggaguugcgggaauucacaauguguagccagagaaaggaauccucacugccuugccuuuaaugucugacacacgugcucaaaccuaccuggugucacagauagaugccuggcucacucgaaauaggaccaggcccugcgguguagguuacagggagaccguguugcaguaaucuguaggaaacaaaaucauucucucugguaugcaaacugaccucuaccuuugaauucacguaggugcuaagaaccugccuccauuggaaacaucauggaggagguggcucuaaaagcccuuccuucauagccucagauucuacuucaguaggaucacuucagaaaacacgacaacugaugcaaacggacaucccuucugucugucuucacuuccauuucuaaaacauauuuuaccuuuuaguuuugagccucagaugaauaguugaaucaugaaacgcuguaagaauugguccaagaaccaugcagccacguauagagaaagaggaauuagguaaugaauucuauugaucccagagacgcucucuguucauugugugcuccuuucgagucagcggaugaagcgauuccacggggcguguucagcuagagagcugggaugcugagcuaaacaaauuaugugacugacagugcuaccgccgugcagagaaauaugaacaugauuuacuugcaauuagaacaaagcuccaaaguaauggauuuguucucccaggucguuaaaguucauuuccaaagccgugcauuucguuuuucuuuaagcagucccagcccauaaaaagugcacacauaauaaacaacaagccgcuaaaaccaagucaacauuucuuagguacaauuuaaccuggcaucuuaaccagcauugauuuuuccccccuuucccucccuccccuuuuaauuauggcauguguuuggccacacaggcauuacauauucagcguucuucagucuuuuuguuugcuagguggugguuaaugguuuaaaucuagggugucauuuuucuugagaaaaaucccuaaauccguuuuuccuaaaagcucuggccaagagagaacuuuaaggcaguuuuugccuccuuguggcuggcggucacacuaacggauggcccugcauacuuuguguuugacgcagguucugggcugacaaacaucaagacggaagagaucucggaagugaagauggaugcagaauucggacaugauucaggauuugaaguccgccaucaaaaacugguaggcaaaaauaaacugccucuccccgagauugcgucuggccagaugaaauacguggcaccucguggcuuguccugugucaaaacugagaaggacuacugggaauaaaaccaaaaugccugccuagaucuucacaaagauaggaaggagaggaaguggggcucuguugauaguucuugcugagcagaagccgcugagcccaggcggaacauacaaguguaauucaguccaacguugcagcuacgugagcugacuuccuaggaaaaugguuuuuucggguuaaacacaucuaaucccaauauccaaacuggaaggcaggauaccacaaacaagaaauucaaguccaugaggcucugauauuacugugugggggaagcauaagugaauuucauuuagagguggucccaguuuccaagauggucucauuauguaaauaccaaaaaaaaaaaaaaguuagaaaucaagauuuucgaaacccuuuuggucaugaccauucucgguccacgauaguuuuauuugaagaauuggucuuaaauaagcauguggggaguacuugguuguagggaugcucucucgcagugcuugguuaaguucucaucuacaaauggauaauuucaguccauuccaaccccuccuccuuccuacugcuuccccaccucccaguauuucuuuggcuuacaagggaaaguuagcagagacccuuuaaggugagugaagcccagcggugacuuugccgccucagcuucucagucagaaaucuugggcaaggcagauagcaguuucucuaaagacaauggcgguuuucuuccuaaugucagaauuagaaugaguagagaagcacgggucuuccuuauagguaggcggagauuauauaauucucuaccaaaaccucagaaauucaaauaagccaaauuccagaucguuagaguuccuuccauguuaccaguuaucacaauaaaggacuugagugggaauuuuaaaaacgguaagaaaauaccuguauaguggugcuugauaagaacuccagcucugugguuggguggagugugggagacugcagccugauuccuuuguaaaguaucuucccaguguuuguaaauaaaauguguagauccuaguaugaaucuccaaaagaaagggccuuuacuguugggcuucucaauucuggauuauuguagcaaaucuaaagcuggcuugggauucaauuuugcauuaauuuuuuuuuccuuuuuuuauucagaaaaaggcacccagccuucugaaauguaguuuucguuggaaaguuuauugcuguuuuguuauugugaaaccagaggcacuccugagcaggcugaaacugcaagguuucaaaacaaaucugggguaacugcugaaaggcuggcugggggucggggcguggcucggaagaugaguacccaggaucccguuuuccugagcuggugucauagacgcccuucucaguaauuacaugaacuucuauaaugcgacagugacuaaugacagccgcagcaauuagggguaucagcucccucuacugcacuagcugauaagauaauguacuauaauuagugcaaugaauauuacagaauuacaguauuuccuuaaagacggagggauauauccagacucacauuuauucccgaucaccucacuguaguaucauuaguuaauuaaugaucuccuuuaauaaauguguugagcuagcauuuuugguuggcgaggggauuaauuacgagccauuucuaauuuugccgcagaugcgcugugaguaacauccacuuagaaaaauuuuaucugcucuaguuuaccucgccuuugcaaacugcagcagggauggauuuagcgauggaaaucggucauucaccuaucuugaagccgccuggaaagaauuauuuagggagcuguuggcacuaacuuacauaacaaaugugcucuagaucguuaggcacagcugccccucccucccucguuuaacccaccauauaagaucaucucuuauauaacaagaugauuaaagugcagucuguauguguuauuucgccuaaguagauaaagcugggaaccacuggcuugcuuuucaaaagagcguggagacguauguauacacugcagagacuuucucaccgugaauacauuucuucuuugucacguucucaggauucuuuuuuauguucaauauaaacaaccagaguaaagcaauauugccaauuuugguuucuaggggcaacuggauaaaguaugacuuguuuguuacacugagauucucuuugccuacugcugcuucccuuggcaaacauggcgcuuuuaaaggagaguaugcguucugugguuaauugaaucuauguacuauuguacuaugaagaagguagcuuggcuguccuuuucucucugauuaacuccuguguuucagaacguuuuuugacccauauagaacaugucccuucaaagaaacggaagcaugcagguuugaaaccuagcuaagggcaaagucaccugcugugggcaggaacggagugaccuguuuccagaacaauggcggggaccucuauuugguuuuuaccaaaugcuuaccuguuaaagggcuucagaucccugcagacuucuaccucaugaugcaccagagaaauugacuucagaacccgggaagccaccuguugcucauuguuccagagacgaggacgcucaguccuagggacccaccaacucacgcuucgcugagcuauggcggaggguccccugaaacuuugcuacauccguugccucuugcgcuuacagaccuuuuucucggcuuccuuucgaagguguucuuugcugaagauguggguucgaacaaaggcgccaucaucggacucauggugggcggcguugucauagcaaccgugauugucaucacccuggugauguugaagaagaaacaguacacauccauccaucauggcgugguggagguagguaaaccuggaggcuugucugcaagugggaggcaagccaggaaguacaggcacuggcccggggccacuuaggagaaaagcaacaucccucugugguacucagggcacagcugcucucucgcuguuuugcauccaccccugggugccaugaauuuaaugugcucucauuaacauuaugcauuguuacuuuuaacuuaugacuuguauugaaauuaaccaaacuaagacuaauuaugacgcucagcuuuaaaaauacauguaugguuucucuuaaauaacaaaaaugguaucagaagucaaaaaacggaaccuagacguucauuucugauuuguauuuuuuguuguuuuguuugggccucugauuagaaccaggugaugauaaauaauacugauuuuuuuucaguaaugacuccuagcauuaauuucuggaaggaaguggcccaguagcgaauagcucaguauagcaugcgugguuaccauggaggaacauucaggcuguugcccugaacuuccaccugagcagagaucguaguuucccggaguuaguggagaagcacagggagugugggaugagguacacacgagcccuucacacugcauauaugcuggacuucuuucugcccgcagagcagccaagcagggacgcuuaccacaaaagucagugcuacgucaucaaaaaaguacaggacucgaauguaacuccuuccccgucuugauucggggaagaaagagugaaaggagguagauucacaaacauuuaaauauauuuguggugacgggaaaguuuuaaagcaucccugugugauuaacuuuuagauauauaauaguauaaaccaucuagaacccaaagaacgccgaguccaagcagaucucauuuuguaggugagaaaagucgaucaaauaaaaagaaccgcacagugccaagcuuaauacagucaggguuucccccauucuacccauugauuuccaucagaggccaguguuaaguaagcaucuaauuaaacccgaagaaagugcucuaagccauccuuaaucauacaaaggcagggacaguuuaauaaacucaagcuaaagaaagccagagaucucacauucauugguccuuagauucucgacacuucauucgugaggaugcucaugggaauuacuguggguuuuauuuuccuguccuaguugauguggauauacuaaagaccaguguguugggugaggcccaggaaacugagggggcaagaggcgaaagagcugaaaauuucacacacuagaguauaaacauguuuuguuuuguuucauuuuucucaaagcaauaacucuggggcuggagagauauccaguaaaguguuugccacacaaauguaaggaccuguguuugggucuguagcauccucacaacacaccaggcacaacauacccgggaugccaguacuggagagagacacgugaacccaaggguuugcaggaaucgacaagcuccagguucggggagagacccugacucaagaaauaagguggagagcuuugagaaaugccuaccuacaucaaccucuggccugcgcaugcacauguccacaugcaagagcauguguguguacaugcauacacacacacacacacacacacacacacacacacacacacaugcacagauaccaaauuugggguuuuguucuuucuauaauggcaccuaaguuuuguucuucaaggacuguaaaacauuaucuccaaugcaucuuucucucguuucuaaugaaaucuguuuucccccuacuucaauccccuauuugcauaugcgaauaauucaaaaacuccuuugaauuucauuaauagaauucaauuuaaauggucuuacaguggaaugacucuguccaagcugggacuucugucugggaggaaaauaagucugccaauucccaucuugauaccacaagccagagccugucucugcuugcugagucuaccagcaagguaccaaggcuaccacagagagaaccacagacagaguggauggcacaacaaaaguguacuuuccugaccagugauggagguuagaagucugagaccaggcugucagcagccuugguugcaccugaugccucucuccuugguuuguagauguuuguguucucccauggucucccgggggucuuacuauguccugaucucuuccuucuaaggacauacugggcuacagucugcccacaugacuucauuuggcaguagucauuauagccacaaucugaagccuuggauuugauaggggcacauugauacccaguaacaacaacacugagcaacaacaacaacaaaaaaaggugugauguucuuaccagaacuccauucacgcugagacaugggaauuuucucgaaggcuucaguauaacacacacuaaugcugacugcuuugagguacucuuuaggcaggcuuuggguagcaaaaaaugauacccccucaccuccuaaccuaagcccccucuuaaacaccuuccugcaaccuggaccgagugauucuuuugggcaguaaccaagagacacugccucuucagaaugacagagggaaagagguugacauguugauucuaaagaaacuucggcauccuggaagggucacugcucggcguauccaaguggcaucuucuugagcgccacucaagaaauggucuugguuuucacuugauucccuauagacucacuuuguccuggagagggaugccguggagagucugaaaucucuuucccuuuaacagucuguguuucuguccgugacgaggcuugguccagcuccguauugaguccacacugggacagaggguugaaauagaacucacuuguacugcugugccuguacccugcccuuggggaggugucauuuagcuggagugguagaacuaggccaccgagagcuacucuucagccuggggugucaguauugaagcacgcugccaugggcuucagcaagcccuucaucuuugaguaccucgggaaugcgcaggguggaugucacccucuccugccugacuuuggagcgcugcacacacucggccacagugucuccacagccacagguugagcuccccacccccgccccgccccaacugaucaaaaguauuuagggaaaauaaugcaccugagcaugaacagauuauuccauaaauaaucacuaugacaaccauuugcauuuagauuguauuuggaauuauaugucacagucaucugggggugcguagccaugcuguauaggggagaauguguguaggucauaugcagauaccaugcguuauuaagcaaagaacuuaagcacccuuccucuuugguuuuggaacccaucuccugugugugcugaagaaacgcugcacguacguggaaaugacacuauucccggcucuacuucauuuccuucauggaugagcagaccucauucaugucaguaagaacaaaaaggggcaacgaauggaccgagugucccggucacucaaggccacgucuuuguauuuuuccaucaccugggcaugguggaagcaugugucuccugaguaucucuuguccucacaaugaaagacucccaugggucacaaaguagcaagccuaggaaaacuguggagggaaaugugggcauucaaagaagccuaguggcuauuauuauuauuaucauuuauuauuauuuuugauacaguaaauagccaucaggcaugagcaguugguuuggauuuuuuaaauauuuuuuauuacauauuuuccucaauuacauuuccaaugcuaucccaaaagucucccuuacccucccccccacuucccuacccacccauucccauuuuuuuggcccuggcauuccccuguacuggggcauauaaaguuugcaaguccaaugggccucucuuuccagugauggccgacuaggccaucuuuugauacacaugcagcuagagucaagagcuccgggguacuggauaguucauaauguugcaccuacaggguugcagaucucuuuagcuccuuggguacuuucucuagcuccuccauugggggcccugugauccauccaauagcugacugugagcauccacuucuguguuugcuaggccccggcauagucucacaagagacagcuacaucuggguccuuucgauaaaaucuugcuaguguaugcaauggugucagcguuuggaagcugauuaugggguagaucucuggauauggcagucucuagaugguccauccuuucgucucagcuccaaacuuuguaacuccuugugguuuggauuuuuaauaccuaagaaguaaauauuaauuuaacgauuugcuuaacaugaugccaaagguucauucugccaggaaggcuuccuacuuuaguaacagcuaucauggcccuugaguauugccuccugaacaugcccacaauuucagucuguugcuagaggcacacaguggucacagagggauuggcacaguccucgagguagcuuugagggcccuugcuaggaggaaggcucauccuuguucuuuguuuagccggagguuucuccccagacaugaauauucacuuccagaauucaagacgauuggggauuaaaagaugccauuuggacucuucuccucgggugccuuuaaaagcaaucuauucggaagcccagagcccugugaacacugagggcuaagcuguccccauggcaggaaucgugaaccccuucugcuucccagcagcaaagggcauggaggauuagcacgcaaagcaaaccaagaaaagacagggaauugagaugcccggacugaguccgcucucggagccuuggaucuccgguggggcucccuugagcauuuauuuuggaguuugaagucagaaaacuaaauaacaguacuaaacacgaaggugcucugcuguucuuggaaaaugcagaagacuguuggcaggcagcucgagagccgcugccccuccucgagguauagacacacuaagaaacagcagcuacaugcuugaucuccaaagcaaguuuauuuauuuauuuuuuuaauucccuuauuugacauuucaguuaugggguccuagagaguggagaaaauggccagguucaaguggcacaggauugcagacaggcuugucucuagcaagccgaacaggagggugacugaaugcucucacuuuggggaguuaaucuguagagagaaggcauuuuagcuugcaagccugucgccaauuaaaucgaggugaccucauuuguugacagcagagcagaucacagcaaacaggaggagaugggaaaaacaccuguguguuucucccaaggggcagugaugcugagcaguguucucugagugcuagcuccuggguaggccuugguauaagaggaaaacacccaggcccuuacuggagugaccuggagacuggacugcaggcaacucucacaggagggaagaugcgagcagcucccaucuggaucccaccucgugcagaugggaggagucagggcggaugagcagaaggaaaugucccaggaccuaagggcagggcagcuccuauucccacugccuuugacuguguccugaagucuguccugaagucugucucgugcccagccuaaaaaggacuaacuaguucucugaaguggggucacacccaauggccaugaaggaauucaucucuacaaggcucuccaccugaauuacuccuuaggugggacuaggcgugaucuguguguaucauaugaucuauguguaucauaccacaugucuguccaucaccugguagguagggcagcacuggcaccaugcauaucugccccccccuuguuguuuuaggagccaccauaacaguaagacaguugugcagggucugaacugugccacacuggcaguaggcggggugggggcaggggacagagacaaagagaaagcuggggaauugccagacaucauuugacagugcucagcaaugggaacuagagaccucugaaaaaugaggcugcaagcuccauucaguccaggacagaauaagaaauaucccugugaaaugaaucccauagaacacaccuuaacuuuucugugggaaacaugguuuaugcuaugugcauacggacagaguccucucgucuuccaacgcggcuuuacagaggcuuggagcucauauuaauccagcagacucaagcaagcaccuccucuucuccucacugggagagguaggacaaauauagaaacaagaaaagccauuagcuacuguagagagaugugugccccgcacagucugcagagacuaacaccugcccggcucuccgugacaauggcugaggcagauuauguuuaccgugccgaccugaucuuacagcugaagccugcuguagagcucuggccuggcggaaaugaggccugaaugcaacccccaggacuacaaauccuguauguguaggaugaauggguagguggguggauggauggaugaguggauggaaggauggaucgacagacagacagauauguauguauguauguauguauguauguauguauguauguauaauuaggauagugugucuauacaguuucccuuuuugugucaaguaauaccccccuuuuuucaaauuuuuauuagauaauuuuuucauuuacacuucaaaugcuaucccaaaaguccccuauacccuaccccugguaauacaccuuuuauauacauacacucacacacacacagacacacacauacauccauauauguuaccuuuauuuauaccccuuuuauauguguauguguguauauauauacauauauauauauauauauauguauauauauaauaaaagacauauacauacauguguguguguguguguaucuuuuauuuaauaggcucucaaaacucucauuaacauuucuacagagauaaauguacuucgaaauggcagcagauaccuggggccccacaaagcggaguguuauauucugcacagaucuaagcgucacucacagucauucacagugcggcuuugugagauguucuuucuccuucaccaucccacaaacuccagugcuggcuguuucagccaaugugcccugugcagacccgaguacucgccucaagaauuucagcaccaccuaguggccagaugcagcaucggcguaagccauuggcucugccacguggugucagaaguuggggcuaaagcugauaaaucacgguuguuaaguacuuugggggcaaagaaaagaacugcacaccguguccuguuacugccuacgaguacugugcuccuuuaaaguccucggucuauuuuaaacccggaucucuguaccugcuuucuaggucgacgccgccgugaccccagaggagcgccaucucuccaagaugcagcagaacggauaugagaauccaacuuacaaguucuuugagcaaaugcagaacuaagccccacccgcgccacagcagcggccucugaacuuggacagcgaaaccauugcuucacuacccaucgguguucauuuauaaaauaacguggaaagaaacaaacccuuccguuuauuuacucacccucggcuuuugacagcugugcuguaacacaaguagaugccugaacuugaauuaauauacaaaucaguaauguauucucgcuuucucucuuuacauucuggucucuacauuacaugauucauggguuuuguguacuguaaaaaaaaaaauuagcuguaucaaacuagugcaugaauagauucucuccuaauuauuuaucacauacauagccccuuagcccguuguauauuauucuugugguuuguggcccggaaaaaacuccuacuugaaauaugcuuuaaaaaucgaugggggaugcuucuugugaacgugggcgucuagcugcuucuccuacguauucuuuuccugaucacuaugcauuuugaacauuuuuuuaaguauuccaaaugacuuagaaaauucuuuuuccaugacugcaucuuacuguacagauugcugcuucugcucucuuugugauauaggaauaagaggauacacauugauuucuuugugccuguuuuaugugcacacauuaggcauugagaauuugaacauuuuuuuuguccauguaucuuuggaucuuugauaaaaaaaaauuaaaaaaaaauuaucccuguucaucauaagcacuuuuacggguggggggagggaguguucugcuggucuccaauuaccaagaauucuccaaaaauuaauuuucugcaggaugauuguacagaaucauugcuuaugccaugauagcuuucuacacuguauuacauaaauaaauuaaauaaaauaacuccag

SEQ ID NO: 12551 - RNA, 87302 nt, Mus musculus
cgcuccggggacggccacggagcgccuccucgucgcacuccccccuggcuccaguucucucuccucuuucucccuccagcucccguugcagcuucgacuccgcugugguggcgcgaccgugucccaggcgcggcuccaaacggccagccgccgugagccccacgccacacgcgaugcgggccguucagcugggaccggugcccuccgggccgcgcgucgcgcuccugccgccgcuccugcugcugcugcuccuggcggccgcgggcuccgcgcaggcccaggccgucgacuuggacgcccugugcaggugggugucuugcguggcgggcgcggagccccgaggacacgcagaccuccgccccgccccgcccccgcgggaaaguugcccgcgugguggccgcggcggcgcaggaggacgcgccgccguggcacuggcccccggagccccccgugcccggccacuuguggcugucauaagucgggcggcuuugugcgacucccggggcccgguguguccgucggaaguugcagggggcagagcuaaggcugggcuuuugucccgcugcacguuuccauugaaguuccagccguggggcuucggaggcguccccucuagugugcagucuccagggagugcgaacccacgcgaugcucuuggaguuggguaguggugguuucaacugcagauugaccccuucuguggcaacucucaguuuuccuuauuuaaaguagccauuugucagugguugaagcuuuuucuucuuuugacaaggguugagagguggucaucucuguaggcuuucaagacuuuacccuucacgucucucaguuagcuuccugugugguugcucacaugaugucauugucuccagaguagauuauucuaguggagucuucugcucugggauccaagguuguauaauuuccaguccugucgaaguuuguugguguuggacacagacuugugggccuagggaacuuccaauaccauuaguuuggagacaggccuccucugggcucuuuagggugaagggaaaccaaaucuuuucuuguuuuaaaaacuuugauaagaaggaagcgggaagagaaucuugaagccagcuuuacccuugacuuucaaaagugacucagaaugagacggggcugagccaaacuugauguuucuaaugguaguccaggcucuuuaguccuuuguaucagagaguuuuguucucucaccuggaguuaauaauuuguaggacuuguuaguguaagaaugagcugaccagaauucuauuucucauuuuggagaguauuuggagggagacacugcugcacugcggcuuauagaccaauuagcugcccaaagauagauugcugccccgguaacuucaugauauggaggaagggugccccuuaaacaauaguaggcccaggggggaacauuuagaacagaaaauuuuggauuuagggcugcugugaccaagaauuaacacagcuggucuagugcuguggaagucacggucuugcuagauaacuggaauuuguuucuuuugaaggcguugguacaggggauccaaccuagggcccaggcaugcuaagcaaguacucuacuacagaccugcggccuuugccuuagaauucacuuuuuuuuuuuacaccauuauuuuuaaagugugugugcgcacaugcguguccauugugucugccaugcagaggccagaaaagggucucagaguccuuggagcuggaguuacagguugugagcagccugcguggcugcuaagaauugauccccccccccuccaaaggccaacucucuagcuauaguagguuaauuucuucgaaaaaauuaagagaauauuuuuuuauucuaugugugugaguauuuuguucgaauuuaugucuguuuaccacauaccuuacgguguccuugaagaaggcaccagauuccccugaaacugaaguuacagauggcugugaggcuccacguggaugcugggcauugaacauggauccugugcgaaagcagcaagcacuccuaacugcugagcuguuaacugucuagucuccuagaguuaaguuuuuuuuuuuuuuuuuuuuuuuuuuuuggugaggggaaggaggggagauaggguugcucugugucacccuggcuauucuugaacucacucuguagaccagacuggccuugaacccauaaaucugucugccugugugcucccaagugccaggauuaaaggcggcacuuuaaucccacccaguuuagaguuuauauuuuaguagaguagaauuugucaaggagaacugagcgucauggagucucagagcugcucacuugugcauggucaucucauugucuugaacuuguggucuuucaccucaucuccaguggagaugcugguccuuaccuuguggaaugaauggccuuuguacuagucuacuggggccacugucucacauggugugacuuugccagugcuagagagggucuaagguuguguuagaggugcccuucacagcuucugacgucucuaagguucuucuuccucuagcuuuccucaggaguagugaacuucccaguccuucucaccuauccccugccuguaacuaugcucuuucuuagaaacauuuugagugucuuggagccugcagaguguaguuugucuuguauggucuguuuaguuuuuuuguucugggagcuuaaacccaggagcucaaagucaggggcaagcuaggcagcuguuuucuuccagagcuggacucacagcccuuuaagagucucugccacaggcuuuuagccucuuccuugggaaugugggcaguuacugcuagaaaacgucaccugcaaguuccuuaggguuagcgcacacacaaggagguuagcgauucuuucuaaauccaguauaaugcccauaacguaucaagggaguauggcguguuuguccgccucaccgccuacagacuccauggcugagauguaaauagcccccuggggucuccugagugaacaguagacuccuguaguuggugcccuuguguuuguuuuuggcaccuggucacuuggaggcagcuccuuauguggucaggacuguauuccagggguugguaaaccaacugaaacaggggcuacauuuucccuguugaaaaaaaacccagauggauguggugugguuuggugcccagagcacuaccggaaauuauuucuguaaagguauuggccugcccaggcaucaugggacguuccugagccugggcaguugguucuuggacuugugggagaacagccucuuucaagagaggauacuuuucagagagcaggaggggaguccugacccauuucuggggugucugguugguguggagcguugggaugagcuagggcucugaccacugggauaggggugcaguuucuacggaaucuggcuuugggggaggggucaaggaacccaaguggagggaucauuucagcagcaggucucaggauauuugcacaguggagaggccugcucugugaacuguauguacaguagacacagcagaggggaguauagguuacuggaacagcacgguacacagccugcuuacucuuugaagagacuggagagauguacaugcacacagaugcagucacacagauacugggcaccaacugacccuggguccucaugcaugggagggaagugccaucccuucuuuuaucuuuuguucugagacaaaggcuugccaagcccagacuggucuugaacuugccaucgaccugccucagucucuguuguagccagauuucaggaacugcuagaccuggcugaucauacauauuugucaaaugucuggagggaagugugcuguagaagaaguuacuugggucucucaagaugugggaugcugguguaaagaaaaggucacuagacugaugagccugcuggugguggcacuggccuggauaaggucugguguagggaacaugugaaggucaguggggcaggauaagugagaacaacacagggaggggggaagaggccagguaaugcaggacccucagaguggaccgcaugcacuggugcucuuggcugguuguucagugguucagcuuacuacuuuaaacuuugcagaaugccguguuaaguauguaaaaugcuucccacccuugauuuagguguucacaguguuuuuuggggaaggcuuaacaguuggaacugauuauaaagugcuuggucuggugguuaacuacuuugaaauuuauaccggacacguuuucuccaaauuguuuggguaugaauacuggagaguuuuuauuauauugaggacaagagaauaaugaagccagcugggaguugcaguagguuuaguugcuaucucuagagauuuuuccccccuucuccuguaacucuucgcaaagaauaaugcuuaugugccuaauuugggccacauguuagccuggaucaccuccguuuguguacaugcauuuccuuuaaccauaaaaguguguguuagccuaggauuguuaauuaugguuccaauaugguuuuuguuuucuuuuuugacaggauaucacaaugcccucacuacgaccuugaacuccugguccucucgccuuuaccuucucucaguucuuaaaucacaucuuaaccaggcggugguaguccaugcccuuaaucccagcagaggcaguuugaggccagccuggucuacagagugagucaaaaccaaaaccaaaccuaagcaaccaaucaaacaaaccuagcauuuuaauaaacucccaggaaaugaauagcuccuuaggcuucuaucuuuuaucaguguuucacguauagaaagaguuuuagaagcuggugugacucacgccuuuaaucccagcaccugggaggcagaggcaggcagauuucugaguucaaggccagccuggucuacaaagugaguuccaggacagccagggcuauacagagaaacccugucucgaaaaaaagaguuuuagaaaauggaauuccaaaaauaaucaggaugucuauucuuuuaaacguuuugggguugcugggugugugauguggucuugcgugcgugcuaggcaagcagucugccacagagucuauccccagacccaucuccucucuucugagcuuggcacacagcauauugugcugugcagagauuucagcaauguccagagcaaugugcaggggcccacagugguccaccacuuaguggguuacugacauuacuuuguuauugacaucauucucuugggcuugucucagugaauggggccuuucuauagugcugcaccuggugguuuuggguggcagaagcagagcugccucacugugugaacugccaaucuggagcccaagucggcuguaccguucugcacccccauccacugcaugcaagaauucuagcuguuccacauucuugucaacauuuggucuuagcaguuuugaaaaggcaucuaaucucaccauguuuuugagucucuuuucuucacucuccacuccccccuuuucuauaaggucuugcuagaguaggcuuggcuagccgagugcucuuccugcuucagccuccuaagugcugguguuacaggugugugcccucacaggcucaugguguaagcagaacugucccugucuucauugcuagacuuaaugacagacuuguuuauuagaaggacuagguagggcuuuuuuuuuuuuuuuuuuuuuuuuuuuuuuuuguaaauaauaauuugacuuuugaccccuuggcaguuuguuuuuaucauguacuuauggaaacucaggaguuucucaggugucgagggucaagaucuuagauauguuuccuucccugccucccuucccucucuguugcugaaacaccauggccaagaccauccauagugguaggcgaagagacuguuuuggcugggucauuguggcagcaaguggcggcuuuaccugaagcaaagucugccauauguccucuaccaaggccacauccccuaagccuccccagaugucacaaucaacuggggaccaaguguuuaaauaugggagccucugggugcuauccucauucaagccacagacccuaagaaaucauagcuguggcagaauuccaucccuggaggagccuuccugugcauuguuggguguuaggcaauguuccuggcccauacccaguagguccagggcucuucaccauaugcccuuaccuuggugacacaaaggaaaaugucccuagacauuucggaugaaacuccaaccagacaaaaucucuccucuuugggaaucacugggcaccccaaggacacagauuuccuuauuguuuaacucuaggaucugugaggggacggggaagguucauuucccccuaacugucauuguauucaccauccuggaugcugaggugguuuguuuguuguuguuguuguuuuuaaauuuauuuuuaucuucuguguuuugccugcauguauaucugagggcagaguuacagacaguugugagcuaccaugugcaugcugggaauuuagcugggguccuguagaagaguggccagugcucuuaacugcugagccauuucuccagcccuggcagcugagauuuaaagugguaucaugcuguaauuuuuuuuuuuuuucugacuguguuaccaugaauaugacaguuuuguggaaucagccaaccuuuuuuuuuuuuaaugcauugggaucaauuuuuguaugaacuagacguuuuccgguccauacauuuuuguagaacuuagcaguaauguucuaguaaucugguacuuugggagaggagggguaaguaggggggaagacccugugcagaguugcaaggcuuuaccuuggggucccugucucagucucuggagucacaagcgcuugaugccuuacucaggcuggcugaccuuugagcuuccagggaccuuccuaccuccucacucccaggcucucccaucugugggauuguaagugugugcugugccuuuuuaacaugggcuccaggggcuggugagauggcucaguggguaagagcacccaacugcucuuccgaagguccggaguucaaaucccagcaacuacaugguggcucacaaccauccauaacgagaucugacucccucuucuggagugucugaagacagcuacaguguacuuacauauaauaaauuaaucuucaaaacaaaacaaaaaacaugagcucuggagcuccaacuuacguucaagugcuuugacuggcaaaggcgucuucccauccucaaaaugucuuuaaaacguacauuagggcuggagagauggcucagugauuaagagcgccgacugcccuuccaaaggucccgaguucaaaucccagcaaccacaugguggcucacaaccaucuauaacgaaaucugaugcccucuucuggagugucugaagacagcuacaguguacuuacauauaauaaauaaaugagucguuaaaaaaaaacuuacauuaauuagagauagaggcugcugucuagccugggcuggccaacuugagaucugccaucuucagcaguuuuugcagucacgccuggcuuucuuuuucuuuuuguuuguuuuccuuauguuaacauuuuuaauguguauagguaucuugccuguauuugugucuaugcaccaugucuuuguaggccucagaagaggguguuggauccccugggauuggaguuacaagcaguugugagccaccaugugugcuggcaauagaaccagggguccuuuagacccgugguggugugaaugaaaaugguucugucggcucauagguguggccuuguuggagugggugugguuggcguuacugaggaacugugucacugggccugggcuuugaggucuuagaagcucaagccaggccuagugugucucuuuucuauuuguugcuuucugaucaaaugucagacucugagcuaccucuccagcaccacgucugccugccugccugccugcuugccugccugcuacuguguuucccauugugacaauacuggacuaaaccucugaacuguaaguaagccagccucaauuaaacguuuuccucuaagaguugcuauggucaugguguuucuucacagcaauaaaacaauaagacacaguaagacaauguucuuaacugcugagccaucuuuucagccucuaaaaauuucuugacauuaacuugugggcaucuuuaucaaaggcuugucaaugcagaagcucuaguauucugauucauauauuguggacaccuuuuuucuauuuuauuuaauacucacuugcugaccucuaauuuuccuguguuuaguuuaauugaaagcuuaaaucuuuaaaauuaauuuacauuauaucaaggcaugucuuuggauucuggaaaaagagcuacuuaagagugccuggugcagaggaugugggcuuggugcccaguauucauaacaggcaaagucaacccauggauauauaauuccaggcccagaggauccuggguguaccugcacauacauagacacucaggcaugcacacauccacaugaaauaguaaaauguaaaaaccaguuaaagccauaugucuuccccugagcgccacagcagucugacagucuuuaagcucuccguuuccauuuucuaguuuuaaccuuccugggccuacugagauguauaguccuccggaagcugugcuuuaaacguagguugggguccccaaagcuucauuguugacauuuaaaucccugucaugaggaauuaacagguagauguuuaaucccguauugguguugagagguaaggccucuugggaggggauuuggauuacgugguacuuuaggguggggccugugaccgagucccagagacuuuauaggaggagggggaccacacacaccaccugggcgcaugcauauucccauaccuugacgagugacacuacauguacugaaaacuacaaucgccugugucacccugaccucagaccuucaagaacugggagccauaauauggccugcuccagucauuucuuuauggcaaaaugugcugauaaagcaagaaacgacuuuuaggggguuuauuuaucuuuuccacuguggccagugaauggaauuucccuuguggccugccaccuagucaguuggaagagccauguauguuuggaagaaauggucucuauuugggucagaguuauuaauugugcugcccagcugccucugcccugaguuauuccugucccacuugaguuuugucuuguuuacuuuuuguucauggcucuggguuuggauggggugugccuaugggcuuugcaacuucccuugauauagacccacagcuuugugguuguuuuguuuuguuuuguuuuguuuuguuuuucuuuguaggaaaaaaaggguuucucuguguuucccuggcuguccuggaacuuugaucaccaggcuggcuucagacucacagaaaucugccugcuucuccccccaaccccuaccauccccaggacugcucagcuauuuguuuuuuugagauaugguuucacuacauagccaaugcugugcuugaacucagaauuguucuacuuuagcccccagaugcugggauuacaaucaagcaguaccaugccuggcuugcccaacuuuuauuuuuugucuugggcccauuucuguugguuguugucuuguguucauguugcccucagcuggcggcucuugauugugcucauuuuggacaucugucguccuugcagcugcucagggcagggcugggaacauuuguuggaacuuggcuauaaauugucuugggggagaugaggaaugggcgggacaugccagagacuggucuuuccuuauucuccugugggucaccuaccucgugcugcuguuccugccaggaggcagcuguuggcuccucuugauaguuggcagagcguugugugcugccuguuggcaggccguguaaguccuaucugagacagcuggaugacgaagcuggugucagaucaccuuugggucuuugucccucccccacacagcugccuuacuuuuugagacuggcucucuggccccagacuugugauccuccugucuuaguguccugagugcuaggaauguggggcguacaggaguaccaccaugcuccacuggaagccacuguuggaagucaccgucuuuuugucaccccuuagugccccaagaguuucugccucagugagugagugcuugcucaugagguuuaagaaaggguucuacuuucugaaaguauuugaagcuguggguuugugggucacuagucccaccucacacucaguucugagauacugagcuagcagauugcaagacuuuuuccuagcaccagaacuugugggcacaauagguguggggugugggcaggugccagugccggugcccccuauugggcugggucccguucguuuuugcuuuauucuauuuccuggaaguagaaagaggcagugguguguguguguguguguguguguguguguguguauguauguauguguguguaugcgcgcucgcgugugcaugcauauaugucuagagaucagcguagccugccucugucucccaagggcuggaacuaaaggcaugagccaccaagcccuguguuguuuguguauaguggaggcagcacccuagagguugggaaugucugcuguacauauagccccaagagguuagugggaaaauguuuggucacuucaccuugcucuaaaacuggaagucggcuauugcugacaagauuuugaggugccaaagauugugucauguccuauuuuggacucugacagacccacugcuacacacacagucauuacaguggaggaaaaucccguuguccuguucccucgggugugaaacaucagaucagccacugaccuuuagcaguuuucccuugcucaguuagugcuggagggcaaguucccuggggccuuacugauuccugcaggcauuugugacuacugauuguagcugugucuuaaguguaggaaacaccaagcgaugugcuaacaggccuggcuagcauuuuaaaaacagaugugaccagugaagaguggccugcaagguaaguuucaaagguggucuuuuagguugagucuuuagguuugugcugccacauggccacugagcuuugaccaaauguaagauuguucuaauuccagcucuucccuucucuuuuggggcaauaccagggauugaaguuagggccuugguauauagguggcaagcacucugagcuguaucuccaaucuguauguauguauguauguauguauguauauauguauguauuuauugaaaacuuugagacagggucucccugaguuaccauaagacaacucuugagcuugugaucuuccugacuuagccuccauugcaauugguuuuaccaaucuaugcuaacaggccuggcugucagcugcacauuuuaaagcagauguuuaguguggaaaaacucccuacuccuccgccuggccugcaaauagaacagccaccaaaccagaaaugacccagaagagggcuucuuagaagugacaagggcagugcccacugagucaucacugcuccuccggcucccuccugucaccucgccagcucacacgcgcuacucucuacucccaagugaaagccaccaucuguuccuguaucuggucuuuuagaggaaguguggugagccaguggugucaugaggcuuggcaucccuuaauaaugagagagaggauugaggagcuuuugggaauaaacaaggguguggguccaaaagggcucaccaugccuaggcucuucuguaaggugcgaaucuaaagggggccuggaaggaaaugagggguauguguguuacuguauguaauggggaagagucuuugcaggaucuaagugugccuguuugagaccaaagggucaaugugguugaaguggggugggugguggaggggguauggacagggacuggacaggaugggguggggcggggcggggcggggcaggacgggaugggaugggacgggacaggagagaugucaagaguuagcuggggcuggaucccagacgcgaccauauugacuuuggagcuauuggaaaucagcuccaaaauuggaaugaagcacaauggcucauaucgauaaucauuuggcagcugaggcaaguggaugagccugaacuuaaaggagacugaaaaacgacaaaauaaaaaaugcccgaaaguucugauuucuuugcuuuugugcagagggcuucuuaucguucagguacugaaguuggugacaguucugcagccagaaugcagugggaagugguccgugcugggagcagagggcauggcaaggcucuuccugcuguguuuggucacuuggugaucugggacugccugccaaguuacacccacgcucuaguuucaagucuccaaaauggggagguuggugugcuccuugacagacggugaggacuaagugauuauguucagaagccguggauggcaugccccaggugugucacuguuucuaagugaggugcagcugugcugcacaggauugggccuugggagguucucuuugcccaguggaguuucuugcugagccccugguaugaucccaguacuugcagagcaggacucuuuagacaugucauauggugguccagguuggccuugaacucaaaguaguccuucugccacaggcuaccagccugggauugcaaguacaaguccuggucugccuacgugguuuuugugaagaaauagcauguguagccucugauaaccuuauuaacaucacaaaccaacaagcugagcugacuguucagcaguuaaaaugccagcccucccuguguccagggccauaaaggaagcacauuggguccccaaagaauuggggccuugcuagcaagaaguuuugagugggucccugugcuagcauugccuuccugcauccucacagcagagccugugccacacacuggcuucucccuuuccuucuuugggacagucuccuguugcucagguuggcauugaacuuaguggucaagggcgacccuuaacauuuggcucuuuuguccccaccugguucuagcuucaugucacugcuccugguuuauacugugcugggcaguauugaacccagggcuucuggcauggcacucaugcacucccagagcucuucuguggagcuaggauucugugcacuggguuccagcacacagcuuugguuuuuuuuuuuuuuuuuuaauuuuugguacuaaaaaugaacuuaggccgacacacauugagggaaaugcccagccguugaacuuuaaugcagcccucuuucuuucuuaaguuaagaauaaagcaagagagcauccagaucauuacuguuuacgaugagaaacuaaccuuagucuuagauaaaugcaccaguuuacacacacacagggaacccacguggaguaggucugcagucugagugguggaguugaguugagcaaagccacauuuugggagauuccugguagcugugugucuuagagggcggguauugcuugcuuauuagaguucuggcuccugaguaaccaggcagugcagguuuaccuggccacuguuugugguggcagcuguuagugguuacauuuggauaguuuagggucggggaggcucagcugcuggccuguccagaggagacaaccaggaggaagcugucugucuuuguggucuggugucguguaguccuugguuguguugugugucaucuccccccucccacuucagaugggguguguguguguuugugugugggaggaggggguggggacaggggcagggguggggacgugggugggggugguuuagguaugaaguguguccccucucccuccccugaaaagcuuuggucucuagugacagaugaagucacugugagguagcuggguuaucaaggaccuugauguaauaagggaauuauucacagaaacauucauaguuuuacagcacgccugggagacaacggcagugcugagguggugccuagauggaggaaggggaucaucagggugcugucuuguucaggccugcccaugccuuccacuuucccuuauucccuguguuuuguggcucagugagguuaguagccucacccaucgaauaccuguugcagugauauuuggucucaacuuaggcuauagcaauggggccagcugaccauguacugaaaccuuagaaaccaagagccaaagcagccccuuccucuuuuaaauugucucacauguuaucacagccaugcagaagcuagcacugugugugcaugcauacgccaugcuucagugccucuggaguuguagcuggagcccagaugcaucagcauccugguggguguggcccaggacaagggucugcccuugccucuccuccacccccuucagugucauguggcauuuuucuugggaggccucaagccggcuugucuuuuuugugaauucagaucuuaagcaaucuaaauccuugugcuagaucacagugcuguguuccucaucuagguuccuccuuauucgugaccuuuugguuugcucgguuuguggacaaggaaguauauggauuccacucugcccauaggcccaggucuguguguucuucuacugugaccauggugccuuuccagaggcaccugggcucccucuuccucacaaugccucugcuaaaccucccucaugauguggcucaaagacauuauugggcccugguugccugccagcccugucucucucugccucugaaaauggacuuaggugucacaguugauuuagggguucaggcuagaccccucuuuacccaauugauuccugcauucagagccugugcagcucucugggaaggcagacuaauaaugcccagcacucccaucugcaccuucucucugugauuaggcuucagaucuuuauccacagucuuguggguugguuagaauaggaagugaaguacuuccuauauaauccugggcucugcugugucaaacucaugugcuuuccacugucaucgucuggucagggugagucacccugccagaccagauuuuguucuuauaguacacagcccacaagauacacuuuucucuaccugccuugcuguaggcccacuagggacccuaucuugucccuuccugaucucucaguagagacccgugugcugaauaugagcugaaacacuggugcugaggaagaguaagcagguugcagcuugugugcacugcuggagcauucuggugugugagcccgaagcacagucacauuuggaaguucagguugagucagauuugugcucacuauagagucagaaagcacccccagcuagugacucuacugaguguguacuuugcuguguggaccacuaacuuguuuuuuuaaaaggaagacagauuacagauucauacaugcaaauggaaaggucaggagagaaccucugcugccagucuuugccuuaacuguagcugugauacaagguccuuguguuucucucuugugcacaccaggucucaaucucuuaaaggggugcugagcugacagacuuuuggcuuuagguggguucuggggauuuuuuuuuuuuuuuuuaagaaguauguguguguaguuuuguaauuuuaaaaaauacuuaaaacauggugcacaccuuuaaucccagcacuugggaggcagaggcaggcgaauuucugaguucgaggccagccuggucuacagagugaguucuaggacagccagggcgacacagagaaacccugucucgaaaaaaacaaaaaacaaaacaaaacaaaaaauuccuuaaaacaauuuguuauuuguuguguauguguuguguaugugauaucuguuucccauggcacauguguggaggucagacaauacuaaggaaauuguuucuuucuacuuugugggucccagggaugggccucagguugucgggccuggcagcgagagcauuacccauugagcugucuugccuuaacugcccaguuguuaggacacuucaccacaugcaguuuauuguuuguuuuguuuuuuuuuuuuuuuuuugcauauagauucuuggggaccucauaucuguuaguaugaaagcagcccucuuuuguguagcuauugccuuagccuggcuuccuuucgaaugcuuuguaaguaguaguucccuggaagugaagugcaggugaccuucagaguaguuguggccaggcgcucuuaguaguuuagacugaagaacuuaauugaagaaagcaguuucugugucccagaaccauccuguuuuguaauauuuuugagacagucucauauagccuaguaugauccccaacuugcuauguugcuaugacucuaccucccacaugcuaggauuacagacauguaccaccgugccuaguuuauaugugcuacuugggauggaacuuggggcuucuggauuaguuacuuugauaaaaugucaagaccaaagcuggguguggcugggaauccucaaagccugcccccaguaagaagguucuuucagcaaggcuccaccuccuauuguuucauaaucugaccagagcaccacuaacacgugugccuaugcgggacuuuuuucacucagccaccauagccucauguaugguagguaagccuuaauacuggcugagcgauguccuuagcugagaaugggcuguguguuucccugcuggcuaggguucuagaggcaggaguuagauuccagaggaacgaugugucaggucacagacaccguauaccugugcuaagaucccucccacuucuacuguguggcuuaguggagccauuguggcacaugguaucaagaauuggagcuuuucaaggguguaugaugaguugggaaauuggggauuuaguuugcuuuucuuuacuuccauuccuuuuuucuuuuugaaaugaugucuucagcccugacuggucgcucagugaugcccuugccuguguguccugcguacugagauuagaggugugcacucugccacuucugagacugaugcucacguucagugccaagguuucucaguagagcuuagugcucagaaggguaguucuagcuacaacucgguguucucauuugaggagagugacugaauuucucaauggugggacaacgggaucccugggccuugcagguucucccuacuccuccuccucaaugcccaaggcaguuccucaaaugagcuggaacucagagaggagccagugacaguaagcaguacugugagcagcaggugagggacuugacuccugugcuguggcucugcuguuguagcaggucugccugcuacuugggugcgaguggagcccgcccgcccgccugcacagcacagccugcaccgcgcuuuucucagagccuuguguguuaagguuaaaagcuucacuuguguaaacuuggguaaggguggguuggggccuuucagcuaaggggccuuucuugcucagcacugaacuguuguuacaggaugggauuuuaauuuuggcuauccauauucucuguaaauagagauuuuuuuccuaaaagacaaaauuuauugccccuuaaagaugcaaccgcacacuuuaaugcccucacuccgggguucuuuaauauggucauacugauuuuucagccuuuuacaaauaucauuuuaagaaugauugcagcccaggccauuuuggcugcuuggccuuuguaugccaggaaauuuacagucaucuaguuuguaauuucaaaugugacaacuucuacuguuuauuuuugcuuucuuuuucuuuucuuucuugagacaaggucccuggucccugguuguccaagaacucugaauguagaucaguccggcuuugaacucaacagacuaucagcuuccagagcaucgggauuaaaaacaugcaccgcucugccuagccugaaaugguuuccugccuagucugggcuggccuaggccucacuguguagccagggcugucugaacuauugacccuccauccuucacugccuguaccugcaccauuacacuuggcugcaaacaugcggcccucuccuuaauaaacauggcauuuguuuaaaagaauugucauauauuccuaccacucuugggcuuauuauaaacuaauuuuaaaguaauaguaccagagcacauguaucugcauguugacucacuuucacuguucugcagaacuaauuaacuauuuucccaugagguuccugacacauuauuucaguugccugauugugcucaggagccaagcauguuggauuguuuuaaagcagcugcaauguuugcuggaauuaggccuucucaaguguuaauagccugcaggucaucagguuucaguuuaggaaacauugcaacuguuucuuugcucuugagugaugugacuaagccaagcuagugcccuaccccccacccaccgggaacugugggccaauuugauggggcugagugcaugcgccuauggagggcuggcgccuauggagggcugccugugagccgguaagucaguuccagagaaagucuauucaagaacuaaaguaggugauaggcucugccuucuguauguauaucaugacuuccauuuugauuuuguaugagacacagauagaagaaaaguacgcuuucagaaagcagccuuuccuccugaccucugugcagcucauuucacccuuuucaguuuucuucugucugcauuucuuuagaccugguucucauugcuaacuucuuuucugugguacaggcaggcacuucagucaucggacugggaggagcuguaaugaugacaagcuaaggguuucagugaacugccugccagcuuggaaaaacuuaaucacaggcucccaaugagaguuuagcauuucuguaacagaaauguacugauaaccuacaaaucacuaccuaaacguuuaaagaaaguuucuaagugccgagggcugcauuuguuucaaauauauuuaaagacugcaggacaggcguggcuucuguggccuccacaccugccgcugacucaguccugcagccuaggucaaguagcucuccuuucuuuuuucccccaccccuaaagcucugcugcuugucugucagggcucagaagaguaaguuucccagccugacauaguuacggggucugucuguuaccuucgguaaugugccugcucaguucccagcagagcuuguccugugccgaguucacuuacuuuccuucccuuacuggaacagguuagcaggaagcuggggaacuguugccaucuuauacacuuuauacacuguugcguuucucaagcaguaacguagaagcucgguaguggggagacauaggaggaaggacauuuacaauuccaggcuccccccccaaagaaaaacaguauacaccgugaaacaaauuaaguuuccugcugcacccccuacccccccccccccgccccccaaaggaagaaggaacaaggcuuuauugaugguuuucucugggucagcuagauugcuugagauuuuuuuccucuggcauaaucguccuggcucuggagguaaucagucugucagaguugaguaguuccugcuuuaaagccugacaucaccccaggcccagcacuuaaguaaccaguuuuucagguuuguaguaucuuaguggccacaaauucccugguccugccagaugcuuggauagggaugcuuuggggugggaugggggagggguggaggucugauuggacuccagaccuaagguuaagugaguugucuaauagcuguuggugcuggggcagggugggggugguggggguggggacggugggggacagacaggacagugccugguagcuuugggaacuucugugaggccauacuuaaaagagccaaaugugguccacugggaaugggugggagcuggcucacuucccuacuucuggguaaguuuaucccagcaaaucugauuuagccgcucaggcagcuuuguaccuauucucuuccuuuccuccuuguacucuugcugaggaaaugagucccaggaagaguagaggauugaggaugauguacuuggggcagaaggaacaccccucacugauuuuaccccgguguugagguugauagauagcucuuagagugccuuuggcugagcucuguagugaggcagccugcaguagaucuuaccucaucgugaggcagauggcaguucuuagcauggcugucacgucaggacuguagucuguaccaaaagcaggccugcuuacacauuacagcuaguuuucaagaacaaaagaaucccaggacuggggaugaagcccaauugguagagugcucgccuaauguucaacuaagccuguguuugguccucagaccacuuaagucuagguguggugguguaagucuguaaucucagcauucaggagguggaggcaggggcaucagacguuucaccugucucaaagagguuaaaaagcuugagaguuaagaacagucccguggagggacuggagagguggcucagcaguuucccuggcugcuguuuuaggagacuuagguuugauccuagcacuccuuggaaccucacaaacgccuguaacuccaguuccagagggacugacacuuucuggacuccuuggguauuguacauagguggcgcacaauagacauguuggcaaaacguccauacacauaaaauaaugauaauucaaagcaaacuaaaauaauagucauuugggucuucagaacucuggggugacuggaccagucccacuuuacacacaguguauucuaguaucugcuuaauggcguugauguucuuagaacaaacaugggguuguguagucugagggcuuccuagccaucuugaacuccuuuccaaaauguuuugccgaauuugacuugguaucugugguuaaugggaguaacuucuuauuuguaguagucaaagcaaauauggcuagaaugccagacuagagagaaggugauuauugucagaucaauaacaaugacaagcuugccuccuuuauuucuuucuaguuacacaugggaagcuguugacuccaaaaacaaugcaguuuauaagaucaacgucuguggaaauguggguauuuccagcugugggccuacaagugcuaucuguaugugugaccuaaagacagagaacugccgcucaguggguaaguaaagcuguccugugagcaugcccugcgguacagcuguguacacagcugcaugguuaugauauaguaaucaaugcagugucuaauagacauuuccuaaaagagcauucuggcugcuugccuuuugaguucaggacucugcuggggucagauggagcuggggcugccaggugguugugaauccccaggccugggugcugggaagaggaucaagugcugugccugcagagccaccucuccagcuccuagguauuagaauaccuuaaaaaaaaaaaaaagcaggcuaugcuuucacugaaagugucccaccucuuccacacccagguggcuuuuauaauaguuaaaaaugguaaaagacaguuuagggcagguucaaugcucagugguuaagaacguuauuguucuuccagaggaccugagguuuuuauccagcacccauguuggauggcucacauuggccuguuuucuacuggcuaccacaugcaggugacacacaaacugggaaaaaauuuauaacuuuaacuugauuuuucacuuugaauauccaguaugcgauaacaagguuauuuccaugcagugaguagcaugcagacaauaauuagggaggauuauaggguggauauugaauauggaaggauguuuucuaccuguauggcucuuccuucucaccuuuuuccuuaaauuucuuauuuuauauguauggauguuugcuuucauguaugccuguguacccacgcguaugccuagugcccuuggaauucagaagaaggcauugacuccuuggggcugccauguggguucuggcaacugaacucugguccuguccaagaacaagugaucuuagccacugagccauccaucgcuucagcccuaaauugccuuaaauuguccuccuccuucaccuccauuuccuuguaccucuuggaagcgaugguguuguggccucacaguaaaggacaguuguuggacucaagcccuuccuuucuuguuuccuugguucagucauucuagaguauccuuuuugagggucaggaccgcuuggugaggaacagguuccacugagaugggucaaagcagaugugcucaggaggagaggacucugggucuuagcuaucuguggucaguuuugcccagggagcgggaauagugagauuugcacauaauuaacagauuaaucugggaaagagcugaaggcagccauaguagguuaugaguuagggugaugguccuguaguccaggcucauuuuauucuugaccuacaccaucaaaacuuccugagagauaguugugagcucuuucuccuguugauaacugcguucucugcuauuuuuuaaaaaauguuucuuuuaaaguggggugguccaaguuauuacuacuuuaaauuugauuguaaucaucuuuuugucauuaaaaauaggagcauuuaaaauaucaauaguggccauuuaucaauaucuaaaaauuaaguuugcuaaaaauggacuaguuuuucaguaauuauauuaaaaggcauaucaaaaauaggcagagaaaaauagacaaacccauguuuauaguaauugugccgugacuuuagacuucaguaguacauuaguaaaugguucacauuuaaaucacauuugugauuucacaguuuugauagaaaaaaauaccucuuaccucagagggauuaagagacaguuuauuauggagccaaaugugagugacagugccaaugcuaaccuugggcagcauguucccauguggaacaguaaaucaaggcaaucaagacacagcauggugagcgcagaggcagggugcagcagcaggccugccucaguugucaccugauugacucccaaagguuagggcugcugcagagcugggcaaggaauuuuuuuuuuuuuuuuugugguguguguguguguguguguguguguguguguguguguguguguguuggugcugaggcuaaagauagcccccaaaagaaauuauaauuaggcugugggauaggcauccuugcauacuguccauagucauacaaguuuuuuuauuaguauuuuuauuaguagaucaguuuauggggagagauucuuuccaggaauucaugauugaaguugucccuguuggcaaagcaccacaguucaugcugggguggaguuggcccauuucaggaucugagagagaugaggcugagcugugggcagcacacgagucuuuaggaggagcccacaucugaucagagccauuauggagccuaucagagcguguguaacuguaucuaccugacggaaugaagaagggacacuggauguacagaaccaagauuuacuuacugacugcauggcucccuccauguaguuugugcuccauaaaccaucugaccuaaacuuuuaagugauuagaagugaaaauggguccuguagugacucuggagucucuacaggauucauuguuuuaauuagcaaaauacaaauauuguuuuuaguauaagguaaguaugcucuaggacaucuuggugggcauuguaagaagugagggaagaacucagacuccaucuugaguggcugaggcugcucauugaaacagaaugaagguuagcugccuuugaggggcugagggaaauaugcacaccacauacacacagcgcacgaacacagagcuaucaggaaguuacagcuguucuugugguuuaacugggaguagggugaguugugcuuucuauacccagcauauuuuuguuguugcuguugcagguggagggauaggugaggcuggguuaucucccaguacagccugacucaaucccucgugcccugagggcauuacccagcauccuggcucaggagcaaagggaaaacguuucugggagacuacugucuucuaggccuuagaaucuagagguuggcugugauggucucaaaggugguaggggcucauugaccuucuggguuguauaaggacugguacccuuuggccaugaagaguuugugacugucuuggcaauaaaaacuuggagccuuuguuggaggaacuuaguuagacagcugaaaaggagggccaaacagcaaagcuguaaaagugaacauuuggccugccacaugguccccaaauaguccagguaucucaaguguuuucuacucucucucuccuaauaaucguuuagccuuuccccugccgggcuggaugguccugugagccagcagucuucccuaggaaggcacagaugcuccgcuuccagcagcuguuacaucuagugcccacucuucuggaggaucgcuguagccagggcguguauuggauuuuguaaggugaccauacuuugcuauacuggggucaggucuuuccuagucuaacuggucaguugucuguguuauaccuguuggagcccugucacuggugugcucguagcugauggcccugcuaggucuuucccagguggacagggaauagcuugaaguuucucuuucucugacuguuauggacagauaagaugucuguagacuucccaccccuggaacaucuuaguccagggugagaaagaguauccucuggaguagcaaucaugugaguguuguccugaugugcacauaagucccaaguucccaaggcaaggcaaauggggacaauuuguuucugguacugaauuuaguuggucuccccagcugucccagccagggguccugcuaacagauuuauauguucaugguuggugugucuuaaguugaaugccuacccuaguauaaguuauuuggcagcccucagacaaauccaggaguccuuccccagcccuggaucagagauggcuggaauuugccaaugguaguguuucuaugagaggaguguugagauuaaagaaggggugacuguccuugacucucuuugugguaucucagucuugagguuuugugcucaucggaacagaaaugacaguuguaaaguuuggaggaggcucuuugccccauggauguauaagcccaauuugaaguuguagguaccccacguggaggguuuuuuccugggcaacucccaaauuaugucauccuuauguuacccccuuccuguaugggacucaacugcuugccccuuuguaggugccucugccuguacuccugggcuaacaaaaucaacacaacaguauuugaggaaggacuaguaggugucuccccauccacccuuauguuuucaagggacuguagguugucauauuguggcccaggagagguguuggcuccaguuccaauaccacuggaaugaaaaauugcagggcucuuguugagggaauaauugguugggauccaggaaguggguggcccauaggagaauaaggcuguccaaguuaauuugguaauuauucagucacaggaggguagcaguggaagaagguuccagacaggaaugucaacagggggauuucaggcguuggggaggggccugggccugagagccauuuaaacuuagacuguacaguguugcagaugauaugcucaucugaccagagugaaggggaugucaagggguuuuggaaaagcugccaugguguguacugggcccagggccaguuauaggucuuucuguauuguauccaggaaaagcagaacuuggaauguacucaggaaagggagcagacaaagaaguuggugauuauuccucagcgauugauaggaacugggaagucuguauauugugagcuuaaaagguggggcuuagagguauggaaugaaauugggggaaccuucuugagccuggaaagauagacaggguuuuaacauuucauuuuguggugguaggggccugccauuuauguuuuagagaggagugggaugggucugagacacacccuauuuggaucucagggagaggugaguaggguaggauggugucuuacuccagguuucucuugcugugaugaaccaccgugaccaaaaagcaaguuggggagaaaagggcuuauuuggcuuauuuccacaucauaguuaagcaggcuaggaaccuggaggcaggagcugaugcagaggccgguggugguagggaugcugcuuacuggcuugcuacccauggcuugcucagcuuccuuucuuauagaacccaggaccaccaaccaacccagagauggcaccacccacaauuggcugggcccuuccuuauugguuacuaauugagaaaaugcggccuuacagcuggauuucauggaggcguuuuccucaauugagucuccuccuucucuagugacucuagcuugugucaaggugaucccaagauguaccagccaguacaacagaggaggugggaacaauggccugauuaauuuuuuucaggguuuuggaccgagugauaagaacuacuaaggcuuuuuaguaacugagaauaggaguguugugaugagaacugguggguuguuaaaagagcuguuuguaguagccacuuagcaauagccuaaagaccguagugggugggguaccacgugggugguaggcaugaggauaauaauugguccuggugacaaagucagaagggucucuccagguucugaaaaugggaccagacuagagggaauaggugggcccagauauagaaugucacugagaggucgaggguacggauaugaccggacagauggcccaucuuccauuagccccauugucugcagcucagacaagccuuggguuaaaggcacuccuuagcacaauggccaacuugauugcaucgaauacaauguacagucccuugcccagauuugcgcugaacccuagcacaacuaggcaacauaacaugaaaccugaauccacucgaaaugcgcucugaggguccaacccuuugaacucucccuuuguauagaauauggcaccuucaugugccccugagcacagccuggauagugcagagcccucugaauccuccuguccgcuaguggggcaccuucauuugcauggccaaugaggaacccuaaucuugcgcaggaguguggcacccucaugcauagccaggauagcgccaaacccugcccuucccuccgucuccugcaacgcggcacuuuugagcuugccucucuugcaacguggcacuuuugaguucaucucuccuguaacauggcacuuuugagcguuggcccugaucacagaacccuucgaauccuccccuugugcaguuugcacccucaggauaccucggaauccuccgagccgucucuuccccuccccucgcgcaacuuggcauaaccagaaucacagcccaaccggaaucgcauuaaaacccuccgaaccuuugggcagcgcggcaccggggcucacgcagugccgcggaacccucggaacccugcccuugugcagcuucgcacccucaggauagcucggaacccucugagcuuucccuucccuuucccucaccgcaacucagcacaaccaaggaucacggcacaaccggaauugcuccgaacccucgggcagcacugcggcgcagugccgcggaacccucuaaacccuccgaauccccuccuugugcagcuuuucacccuuagccucucucgcaacucggcacaaccagaaucgcagcacaauuggaguugugcuaaaauccucugaacggggggggggggggggggcagcgcacacgccagcacccuggcucgcgcagugccgcggaacccaccgaaccuucccccugccccgcaaaccgcggaucaggucguguagaaauccuccgaucuccacccccccccccaacucuccagcagcguggugcccuagcgcgaaccccugcuccccuugcgcagcguggcacccucgugcucuagaucgcccguaaaccccccccccccccagugcagcagucggcccgcgcuggacgccccccucccuucuccucuugcugacgcggcauggcggcagcgcggcuuucggcuuucuaccggcccuaucggcccucguguaguucagaacacuggugagcaguggggcacccuagugcugaguuuucuuguagcccagaaaucuucacccuagcgcugaaucucgcguaggggaaccuuugagcggccuggaacucuuggucggagcccucgagcugccggaucaguggaacccucaccucgcguagagcccuucccuccuguggaacccuuccuuugcggaauccucuaacgcguggaauccuccccuugcaacggaauccuacccucaucugcagaauccuccccucgcauugccgcgcuucacgcggggaacccuagcuuaccucaguuccccaggaugucugcgugguaacuggcggugcugugcuucuugcugcccgcuagagcaaggagggauagauauaauguugaagccucggcaggggguggagauuauuaaguuccgccccaacugugucacuuaauccccccugcucagcccaaccucaccaggcuuuggcuccuccucuugcuccagccuggagccuguguuuuagauggccuuacaguccuggaaguguuucuauaaauugccugcugagcaggucagaaagauuuagaggaacaccagagagaccagauauuucaagcagacuugaauaacagauauuacgguuauguuucuucuucuucuuuuuaaaagcuguugucuaauugaguaguccuugcuugucuugaaccccgagagagauacacuucucuuagucuuuccauugcuuggaugcagaguaugcagugccacuccugugaagguuuuccugaccaccaagccaccaaaagcauaguuuuacaggacauaaacaggcaguucucuuccacacaacucaguugccaguauugguucaaaauuugagacuuacaguuuauuuuaggcacauuuaagcaaagcacaauuaaaaaaaaguucucugguuuuaauuaacuccaucccauguguucaauaaaucuuuacuuaugacuacauugauucuuuugugagguucaagugagucuucuguauagauagauucuauagauuaaggaaguaggcucaugggaggagucugggggaagcaggcucaugggaggggucuggggcagcugcuguggccuggccuuacagaaauagcacagaggucaccaggcuauuaaccaccccugcccccagccuccugggcuggaaacagguuaucuacucucccuuugaagagacaacccugcguguuuaacauuccuggcuugccuagugcuuaucugugagaaaagagccuacgugcuuuuauguuuguucauuguguguucauucuuauccucuccaaacaggugacucacuuuugagaaguucagccagaucacuccuggaauucaacaccacuaugggcugccagccuucagauucacagcacagaauccagacuagcauuacauuucugugugggaagacccuggugaguggggcccucuucaagcucuuuguuaagaacauuuuccccuucugguguucuuguuacaggaauucugauccuggaggacuaaauggucaauuucccccuccccccaauuuauauucacaucacgucacuaccacccagaaccaccaacuaaaugugucuuaaagauggugagaauuggagugaaacuugaguuaggaugaauguuaauuuuagaccaaccuauaaccacacuauugugcaaauugagaucuuaaagucuguuuguggcagcaugaaccauggaggucauguugcagagcaagcuagcugcugauuuacuucuguugauuguucuuaagagcuugguguuuacuguaggagaaacaggacuuggaggugaacaccuuggucuuucucaugggcuggggaagguagaaguuaacuguugcucugcagggguuaacuagaguuaacuggucugguugccagaaggggcugucuggggugggaucuggugccucugcccaggcucugcugcucgugggcuccucggggaccuccuuacaggauggaugaagucauacuuucuggcccugauuuugcuguuuuuugguucagagaccauuuggcucuugagaagaaggcgaaggauaauuucccaugaguuuacucugcuuguggaauuggggcagcugggcagucaguuagacaggaugucuggagacucucaucucccaacuuacuuuucuguuugggcggauauucuuggugaacuuguugaaguaaggcaguuauguuuccucuuguugcacccuuauuuucaggagauuuuacaauguuucagguuuaaaaacaaacuuguauuacugagugguguguuaacauucuuuuuuuuuuuuuuuuuuuaauagggaacuccugaauuuguaacugccacagacugugugcauuacuuugaauggaggacuacugcagccugcaagaaagacauauuuaaagcugauaaggagguaaugggguuugagacuauuuggucaugaaaucuacucuggagagcuugaaagucaggguguggauucugcuggggaggaggugagagagggaaaccauaaucagaauguguccugaaaauaaaaaucuauuuuucaauaaaagaaaaaaagauagaaaauuaaaacaaccucuuacaaagaagguugugacuuugcgauggaaagauuuaaaugacuuauuacagucucuugaggugagaguuuguuucuguggaugugagguuccauuugcacagagguaccacgagauuuaauuguuaaaaacgucuaggccagcuucuggugcacacagcacagcacagcgcagucuguuuuggcuuuaggguuugcccugcaccccuugggcccucaggaaccugacugcuucaucuuccucuguaccugcucccuacccaugaaacaucucacuuggaugauucguucucugccaguuucuuuucuuuucuuuuuuauaaaauuuauuuauuauauguaaguacacuguagcuuucuucagacaccccagaagagggcgucagaucuuguuacagaugguugugagccaucauaugguugcugggauuugaaaucaggaccuuaggaagagcagucagugcucuuaaccacugagccaucucuccagccccuuucuuccaguuuucauugucagagucucauguaaccuagguagccccagacuugguauguggcuaagaaugaccucagaauuguaaucuuucugccuucaugguaugauuaaaucaugaugguuuacuugauagaucuagaauuaccauggaaauaaaccuuauggguaugugucaggguuucuagaguagauuaauugauguaguguggguggcagcacgcuaugggccgggguccuggagugcguggaaaacagaagugagcugagacuagcauccuucugccuugcacuuccuuguagauuaaaugugacagugacuucccacuccuguuuucuaccaugaggagccuuguucugaaauccagaaccaaauaaaucccuccuuccuuaaguugcuucaaaacugagaaaaguaacuaagauacucugccuccugagugcugggauugcacguaugagucacugugccuggcugugcucugaaguuuacagcucuccucucuucucagccaggggccuggaaugccuguugaguagaacucugucacaguuccuggggacaguuuucccugccuuccauucucuacacugccaccuuguugcuucugcuacuggcuuccuuccuccuggcuggagggcagcugcuuguuuuccauccucauagcagauagcuuguugccuucugagugaauguuucuguguguucuugcuuuugguggugacacugaauugugggauuuggaguacuuggguuugcuguucuuucuggcguuuuugaaauugucugggagucauuacauagcauaagcuguccucaaguuugcaggauucugucucuucuucugaguucaggaauuauccgugccuugguugcucuugacugcagcccaaauagaaaaccuuuuugccaccauuuuucaaggaauuugguauuuaacuggaguucucugccugcuccuggcugucacagguuacuccaccucuagugugugucagggaggcuauuuggcuguguggaggaggcuggcagcccuguggaguuuggauuuuuacuuccugcauaguaaggaccuuuuaaagcaggcaauguaugcucugguuuuugaaagauucaucauguaauugugaugauguaaugggcgaggaaggggaucaaagcuggaauugugggaccuguggcgacuguuggauucugguaguuuggacaaagguggugacucagguggaggugacaagaagugaggacaugaaggacugacagaacuagccacccuuugaaugggggcugaaguuagaugucaugguuuugacccaggucacuuggugacccuccccccaucacugacugagaugaaggagagcaugcuguugggagaaaacuguaaacauacuuuaguauuuugaaaugauuucuguguccaggcagcaauguugguggugugguaagagcaguagauccuucagaugugggucaucuggcagguauuugagccaggcaaaggacagccagggaugacuccuggaacaggacaguaggaucagguguaaauuugggagcacuucuguauuauuauuauuauuauuauuauuauuauuauuauuauuauuauuauuuugaauuuuguuuauugaauguacacgauaugugugguugcaugugucauggugcacauguagagaucagaggacacuggaguugguucucaccuucuacccuuuaaauucaggucuccaggcuuguauggcaggggccuuccuaccggaaccaccucugcauuuagaaucagaaggguggugggguguuuccaggaugcauuugaggcagcaggaaaccagguaucucuggccaggaauccaaaguaaagggggaugaagggcuuuauugaggcugugguucugagaucagggaagccuaggacauggcguucugaucugguaacaggcaaagucagcugucagguaugguuuugcuguggugaagggcagguacccagauauaacaguguuagcaagaggagacaaaggacaggggugguucaggaguuuuucucuaagcuacagagaugggaagguagcugagggagagccaggaacuagaaaagauccuuguaagucaguggauguuuguagcugcaggaaguggucuaggacugggaaagaagagggauguagaugggaggagguacuugcagacauaagccuuaagaaggggagagagaccuugggaaugguacagagggcugaacuguuuuuugagacagggucucauucacuuuguagcccuggcuggccugggaacuugcuguguaaacuagguuggccuugaacuuacagagcuccuccuaucuuugacucuugagugcugggauuaaaggcuugcacuaccaugucugacagaaccauguuuauucuauauauaagggacagaaaucacuguucuguauguucaucacaaguuugagaucuaucagccccauggggugaaggaagugucucacuucuucucugcuuccucagguaccaugcuaugcauuugaugacaaguuacagaagcaugauuuaaacccacugaucaagcuaaaugguggcuaucugguagaugauucugauccugacacgucucuguucaucaacguguguagagacauagguaagaguugguuuaggaagaagggugggguguggucagugccugcccugaccccuuugacaugcacauccucauuagaucucugagaacgcuauuguccugaaaguguucucuggagagcuucguuugucucccucagcaaaucugauccuuuccuuccaccaaauacaaauucuacucaagcuauugauggagguuuucucugccagauuaucugaaaaccuucuguuugacauuuccucuaccagacacucugggauuuggggcuccauggugagcuuuguuucaauuugcuguguuuacccaaaccuucuggcuuuaaguuggagaguggguaaaagggcugagggaugacaaagacucuaagagugugguuguggugugugcuuggggugggauaaccccucugguguucuccguagaacuaugcgagaggccagcauaucucucuuugauagacagaggcuguaaaugaaggucucuaucuuagaagagggguacaguuuuacuauguauuuauuuauuaccugcuaaccucacuaguuuuugugcuucccuuguggguucaauacugggagcccuguagaucaggacugcucuuucugcuguguuagcugugaucacgccauaaagaaauuauacugccaaguaaggaaauuuuaaaaagaaagaaguaaagagggcauacauuucuuauguuucaaucuuacuuucucucucuguauauaugagauguugggcuuaggaaaaauuugcaggaguauaagccaguucaguauaugauacuuagugggugguaggaauagggccgauuuauaguucuuuauauuguauacauacacauuccaucuuacuuguauauucuaauuaauagcuaaaaaaauaauaauuacacucuacccagaacugccagugacaagugguaauuucagguuucucaugcaggguuacagcaacuuaaguuugguuauaaacuucugcaacagugcacuguuucaauuuggaaaacacugagauuucuaguccuuaaauuugauuaggaaaauacauuucuguuccuuaaaagcaaauccuucggaggcuuauuuuaauucuuauuuuagaccccuccuccccaauuuucuggcaguuugggagaaaucagccuuuauggucuuuaaggaggguuguguguccccacugcgcauucuucagccccaggaaacugcucagaggcccaagcuaacuuugaaggugcuccugcugccauguauucacgucugacccgugacugguauuuccugucuugagggggugguacuugccucuccuccuccucugggguccaggcagucucucugcuauuaagguccgugggugcaguagccucgagugaccauugcuguguguggaagcaggcggcuagaucugaguuuucggaggcuggcaggaggcacgguaccguuccuacuguggcugagguggauuuugaguccuggggaugugcagugguguuuaagacucuggccugaugccacuuuagugguucagucguacagccuuaauuguucucaaguuuccuggagcuuugggcugggaggagcaagcaucuggagcgggagugaagugucuggugggggaggcagagauggggaagggagggagggaggaagucauccuguaggaugucagcagcccagaccuaucugugguuucuuuccauugacauaggaguguuuuaacccgucccuagaaugccucauuuucuagugucucaaacucaaagggauagugcuaaaguuagacuuuagggccgacggggacauuucuuaaacacaggugacaaaggaaugucugucaacugggccucuuaugugccagggcagagagguaccugguaaccugcguguuacauggaaaggugguggucucauccagagugagccucagaacgugaagguggagaucgugaagucugucuauggaagagacuggacccgagaauuccuggggugcugcuucugugacgugugcuuuaaaaucaucugugacguuuugcagacucccuucgggaccccagcacacagcugagagucuguccugcuggcacugcugccugucugcugaaggggaaccaggcauuugacguuggccgacccaaggaggggcugaagcuguugagcaaggacagguuagucugugaccaccaugguggcucauuuuagguccucaacaagagaaccugccuuauagccagacuaauagagaagagaagggagugugagcuugguaauggguggcuggcaugaucaaagaaggcagugugugugugugugugugugugugugugugugaaaaugccauugugagacccauuguuuuguacaauuaauaacugguaaauuaauacugguaaauacaacuaauacugagaaaagauacaagaaagaaagacuuugacuucuugggaggaaagcauguuccauuuccaacaggcguauuggucauugucuggucuuaggcugguguccuguugcucacuuacuucacuuauuggaguuuggucccugcucgugguuuucauugugugucacuugccggguuaucuguaaccuuucuuuuagagugauagguggggcagugugcugguggccuuccagcaaugugguuucuuucuaguuggggcaugugggcaccaucgcauaccacuuuuuaauauauguaaguuccugugucacccaugggccucaaugucaagagccuguuccccucucccguccccaaaucccgaccuauuguuccuguauagacuaaaacuuuuuuuuuuaaacuaaauuuauucaauccaauaucagcucuuccucuucucccaguauccacacaugucuucccccauuuccccuuugcccuuucuuuugagaaggggaagucuucuucuggguguuacccccagcccucccccuucgcccccaauccugcauaucaaguugcugaggggcuagguucauccucucccauugaggccaggcaaggcugucccuuuaggggcauggcauucacagucaggcaagcaacaggcuuagggacagcuccugcaacaguuguuuggagaaccugcacgaagaccaagcugcucaucugcuacauaugugcagggggcguagguccagccuguguucgcucuuuuguuggcgauucagucucuaaggguccagguuaguugacucugcuguucuuccuguggagucucuguccccuuuggguuccucaaaccuuccccuaacucuuccguaagacccccugaccuccuucuaagguuuggguaugaguuucuguaucucuucucauuggcugcuagguggagccuaucagaggacaguuauguuagguuccugucuuugcaggcugucccaggugccucugauugccuugugaugguuguaggaaaugaugcaguacuagauugcagacuugugcggacuguugaagcagggccugaauuggaaaaugcugggaguuuucugugucuguauuaaugugcucacaaugccauaagcaaauacuacaggguugggccuuugaacaauaguaguuuauuuccucagcugcaauuucagagacuaagaccugguaccagacagguugguuuccucuuguuuuguuaguggccaucuucucccuaugucuacacagucuucucuggucuguguucucaucuucucaagaacaauagaacuggcucgugagggucccauuuguuaaccucuuuaaugugccugugguccaguaguuucuguugaagcauguuugucaaggcugcaccauugaaguugagagagauugacgagagugacaaguugguaagagagggccccaggugaugccgaggguucagggaaacguaggaugccaggcuuagcaugacuugucucuugucagcacacauguggugguauaugggagguaggugugcaucccgugggugaagcagaagcuaaugacuaguauucgugcuuccugguagggacaugaguugggcuuugggggcagcaauucuagcuuguagcuguuguaucugccaucuugaucagucagccacagguugcucuuuuguuuguacguagauguuagagggagaucaugggaccucgugggcacaguuguauuaugucuacucagcuaugucggucuuguuuuauuaggucucuuacaaaacuguuccuuuaugaagacagcucccuuugguauucuuaguuugcauacugaucauguucauuugacuuucuacaggaagauacacugaaguuuauacuauguucuuguuaauacguggaaauauaguuguaguuguauuguuucuucugcuaccccacccauccuaucuaccccugaggugcacugacuagggcagugcaucaauuggaaaguaaccuacaaguauguaauauaacuucuccacauggcuuuucugcaggcucguucugacuuaugugaaggaagagggagaaaagccagacuucuguaauggucacagcccugcagugacaguaacauuugugugcccaucugagcggagagagguaaguggcuuguuccuaagugacuuuaaaguuagugauccucagccacauuugcccaagugacgugucccuauguaugaguguaguuugcguguguagguaguacaugaagaucagagaaaaccuagggugucauuccucagguucccauaaccaguuaugccagcugauuugcucagugagccucagggaucugccugccugugccuuccccguguugggacuccagcugcguaccacagugucuaugcuuccccuauguauggcuuuguaaaaaguacggguucuggagaucaaaauugaauggcaguaacauugaaugcuaagcuaucuucccagcuugggauuccuguagggagaaaauaaguccggucucccauuuuguuuccugucugccauuccucucacucacagcuauaggcagauugaccucuuagcugcuuuaauuuucauuucauuuauuuaugugcuugcaguugagguugagagccaugccuugggcgugccagcagcuucuuugcuggagaguuguuuuuaagucuuggagagagguagacagucaggugucucuuuugaaugcauaguugauuguccauacauaauaaaggggguggggauaacucauguggaauaaaucuaacaaccuaacagcccaccucuuaagugaugccaccaauauccagaggcagaguucacuuagggacacuugcuagagguaguggcaucaggcagguuauaagucugaugucccaaugcgcagucaacccccauguccacauccaguguuggggaggucauugaugggaugcuggcuccacugcagaugucccuugagagugacgaggcuaacugguaacagccucaguugugcuuagccaggucagccugcaugcuggacacucaacacccacaagggucagagccaggccauuggcagggcaucugcugggagacacggucaccuaaagggucucuuguuagagucaaagcaugguuccuggagccuggauuuuucuugcagccccucugguccaugcucaugaguguuaugggucaccugaucgcagggcacugcugguuacacuugaggcaugcacaucagcacaucuugaugucaggacagagcagaagggccuccauucuaagucuuucuuuugaccuaaguguucacuacaccuugcaaugucaugagucauuccaguugucuucacuugugccugccaggcucguuugcuaaucaagugagaaaagggagggcucuuuuuguuuguuuguuuuggugugugugugcccuuuuguaguagaaauaaagagguuugaauucuuuugucacugaccuguugguaccuguguggaggucauugaacaccuugccguugagcaccccgucugguuuuccuaucucugucagcuugauggauacugucagauggucgagauguaugugacaugaggggcucauguguacucugcaguuggaucuguagacauggacucucuuccuggugagcugcucugguuucuaccaggaugauuaaguaccagcagucugcuugucuccugcauccucagagagcuccaaagcauuucuuggugcuguuugugggccuugagguucuuagcagcuauuggacagaaugugugcuuguguugacucugcuugccuaccauagcccuuggggaguuuguacauuuuuuuuguuguuguugacuuguugaaugcuuuagcagcugguauuuuuuuauuagauauuuucuucauuuacauuucaaaugcuauccugaaaguccccuauacagcaccccaccccugcccugcuccccaaccuacccacuccugcuuccuggcccugacauuccccuguacuggggcauauuaucuuugcaagaccaagggccucuccucauaugcauacauaugcaacuagauacacaagcucuggggguacugguuagcucauauuguugcuacuccuauaggguugcagaucccuucagcuccuugggugcuuucucuagauccuucacugggggcccuguguuccauccuauagaugacugugagcauccacuucuguaugugccaggcacugucauagccucacaagagacagcuauaucaggguccugucagcaaaaucuugcuggcauaugcaauagugucuggguuuggugguuguuuaugggauggauccccaggugguacagucucuggaugguccuuccuucugucucagcucugaacuuugucucuguaacuccuuccauggguauuuuguuccccauuuuaagaaggaaugaaguauccacacagcagcugguauuuaauaaauauuuuucuuguuauauucuuuuugcaacagauaauugaauuuuuacauauuguaaaauucaaaaauucaccuguucuggguccuagcauuuuuuuucccuuaauuuguauccuuuaccacaauuuaauuuuagaaaauuuccaucucuccccucccuuaggaaugcucuugccuguuagcaaucaauuauucucuccucuucuucucacaacauacacacuugagucugcuuucuggcugugaaugaagcuguguuguaugugggucucugguguugaccucuccacucagcucugcaguuccuuggcagcucuaccgagacucaugcugggaagaagcaucaaacuuuaguuaagcaggggaggguugggccugcacuucugccagcuaauugugugaucuaauaugaaccauggcuggccucuagcaggugcuuaggaaauacugagggaauuuaggugccuagaagcaguacugcuuccugguccucagcccauggcuuaguuucuccaaggguuaaaaaggagacacugacuugugugggaaaccugcuggcuuccucuguaguucccaccaaagauugaagaacaagauggcauaugcugaacuggagaagucuucgcuccaucuggagcagcuucuuaacagaauuguuaaaguuacccuuguuugugugcacaugcauguguaaggguguguguacaugugguaccuggacaggacagcuugguucucuccuaccauggguguccuggagauggaacucagaucaucugccaagaguagcagcagggaccuuuaccugcugaaugaaccaucucaccugcuacagaagaacucuugugugugugcauguuauguguguguguuguaugugcacagugcauguguauacgguagccagaggacccugaguguucuuccgucgcuuucuacccugcuauuucaagaaagggucucucucucacugggaccugaggcuugucagauucacccagguuagccagccauugagccucaguacuguguguccaggguguguacuaucacaugugguuuguuaccuggguuuggguauucaacucggguuuucuuguuuuuguuuuguuuucuguuucucuuucuuuguucucuauaucucaagugguuagaaugcucaucuaaccuuguaaauagacuccuccucccccacccccaaauuggguuuucauacagcaaacacuuuacugucugagcuaucucccuagcccgcauuuuguucuuuuuuuuucgagacaggguuucucuguauagcccuggcuguccuggaacucacucuguagaccaggcuggucucgaacucagaaauccaccugcgucugccucccaagugcugggauuaaaggauuaaaugugugugccaccaccgccuggcccccacauuuguucuuuugagagugucuugcuuuguaggucagcucaggcuuaccucagacuuacagaguuagguuucuagugcuggcaaaaugaguauguauguccauacugggcucagagaggacaggguuuggagccacccauaaugcuugccaggguggcaaugauucuccacugacacaguucagaguggacuugguaagggaagcugguguuacucaaggugaucagaaacgguguaggcuuauaacuaagugcaguuacaaguucaauggaaggaaaaagguuaacgaaaguuuuagauuauggugagauggcccagccaacaaacugcuuucugugcaugaguuugaaccccagucaccaugucugcaucuucagugcugggaauaggguguguuaggaaacuggaggauccuugggucucauugaccagcuaguguagcagaaacagcauucuccaggcucagugugauauucugccugcaaaaaaaucuacacacacacacacacacacacacacacacacacacauaaacacacaaaaaaacccaaacaaacaaaaaaucaaggugagaaauaugagaggaagacaucccagguugacccauagcucauucacaugggugagugcacacacacacacacacacacacacacacacacacacacucccccaccuccugcucucaaacagcacacauaugcacacccaugcaguuaaacgcagaauucuaacagccugucuuugggcuuuccaggaauaugggaaguauggaugaauuguaucuaaaucucugccuccuuucacaucgaucccuauaggguaccauuccuaaacucacugccaaguccaacugccguuaugaaguugaguggaucaccgaguaugccugccacagagauuaccugcaaagugagagcugcucccucagcagugagcagcaugauauuacuauugaccuuagucccuuggcccaauauggagguaggugugugggccccucuguucucucccaugcuuuauagaggagccuagcugggagaggggagagaugggcuuggguuugccuaaaacaccacacuuucuggguuuuguuuguuuguuuguuugagacaggguuucucuguauagcccuggcuguccuggaacucacuguauagaccaggcuggccucgaacucagaaauccaccugucucugucucccuagugcugggauuaaaggcgugcgccaccacgcccggcuagaacaccacacuuucugauggugaacaaacacugcugcuuugugcuuuuucuagggucccccuauguuucugauggaagagaauauacguuuuuuaucaaugucuguggggacacaaaggucucacucuguaauaacaaagaggcugcuguuugucaagagaaaaaggcggauuccacucaagucaaaauagcaggaagacaccagaaccagacacuccggugggugagagucaagugguuguguggacuugugagccauggcucugcccuucuuuuccucuucccauuugcccugagcacaagaaagucagagccuagcacggcuuccugugcacuuuggcaaguugccauuugucccugagcaguuggacggucuccugacuuugauaagugcacaucugcuaggacuauggguuuguaaauguauuguuucugggagcauauuguagagaauuuagguaguuuacaguuuauguggcuauuguuuuuguccccccucuucugugccccccccuuuggcaauuugggaaucugaaauacuauuagaauuaugcacaaguuuaaaaagcuaaaacccuacuguaauucuuagaaccuuaagcugcuaguuggcuucacaaaacuaggaacaagagacaguuuucugaaauugagucuuagaccaaaucuuguagauggugguuuuggacguugcuagccaggcugucugacuggcauuauuuauguuguauaaagucccagagugacagcaagagcagcucugcuugccagcagaguggcugccuucccuccaggccguuacuuuacagcaaggccagcagccugagcauuuggaacucauuuccgcagggugcugcccagcuggcuacggagccugcuguuuuaugucaguagugauuugugggugguaugcaaaaggcuuaacaaagcaguuuuuuaaacuucaaauuuuuucuugguucuauaaaacacuguauguucacaaccuagguacucagauggagaccucacccucaucuauucuggaggugaugaguguagcucuggcuuccagaggaugagugucauaaacuuugagugcaacaaaacugcaggugagugugugugugugugugagugugugcugcccaccccugcuuugugugugugugcacugcccaccccugcuuuguguuaguggcuuguguguguacccaggugucuuccuggaaguggggugcugaguagggagugaguuggcugccuuugggccuggccaccuucaguccucaggguuuucuguugcaguaauccucucccuucucuuccccuccaggaugcauacauacauccuguuuccaucuuucucugcucuccauguuuguuuugggaaucugcccagcccuggguuugcugggagagucugugucuuggacucugcuucaggcacacucagcagaggagggaggcccgguggaggcggcuuuggcuucaaccagcagcuucaaguguguccaccuucucauuuaacaaucuuuucagagugauggagugguagaguuugaauuuggaaaucuugggauguuacuggaagaguccaagcugaggucaugccuuccuuugggugacuagaagcaccccugagucacuggcuugucuacuuuucauguccugauauuagguauuccuggcaccuguagagggaugauaaaguuagagaucugucuuguuuaagcuccuuuggcucugucucaggcaccccuggcugacuugcuucugcacuaggcucucauccuguggcugggccugguuuccauuuucauuuguaugcaauuggcccaagcucucauugccuguugcccuugaguguguuuguuuuguauguuucuauggucaaccuuggacgauuugaucaugguccaguuccugugugauucauaguaggaucuggaagcaaccacugugccuagaguuaaguucucacaaacuugcuaguuuuuaagcagaggguagguuaggagcuggacuagggggcucugaaccacaagacucagaggacccugagggcuguggcuuacuggggccuucuuuuuccauugacucuuucuuaucacuuacagagcuugcaugcuuucaugccuguuugcuaaggcacucuccacaggguccugauggugacagauggcucccugggaguucacaggcuagaaacagagauaaggguuuuuauggcugagcacaggguauagugcuaaggcagaaacacugacugcagaguuuuguuaucuggaguucuaggucauucaggucagugugguuguggacagggggagcugguacugggguagccaagggacagauggccagaggagauguugcuuuagcugcccgauggugaagcgcguguacuguagggaagcucacucccaucuuccguagggugaagccaucucuguauggcuguaaugugccccuggcugagugagaaaauagacuuuuuguugggugccucuccacacccacauccaguuuccuucugcucacuucuuuggaaugggccuuaggcgacuugcuuggaauucuggauccuguucugucccugggccacaaagccugcuguugcuucuguguccucagccagcggacaccaggcugggugcuagcuucucugaucuggucucucuugcugcuugagucacugucaggugcugugacuccccaagucuuuucugccucaacuuugcuuccuguagucuugcucagggcuuuuacuaaagcuugagcugagggcucguuuugggacgcugggaagguggauugauaaaccaggagaggacaggucagaggauagaagauugauagacuuauuuauuguugagaccaugacaacguggaacuaaaguccacugaguuaagauuggaauuuaaugcaaaagccuuuuguuuuucaucuuaacuuuuuauuacaaaaguuuucagauaugcaaguaggaagaacauuauaaugaaguuuauacaguugucucuauaaccgugguucucaaccugugugucaugacccuuucacaagcgucacacaucaguacccugcagagcagauauuuacauuacagucauaacagcagcaaaauuacaguuacaaaguagcaacggaauaauuuuaugguuggggucagaacaugaggaacuguauuaaggaguaacagcauuaggaagguugagaaccauggcucuaaaacaaucauuaauguuuuuccacauuuguuuugcuuuaacuguuacugucuggcucauauuccacuugggaugaguuugcuuuuggucguccaauccuagugauuuaguucaagacuuuauagaaauuacacuugagaacucauuugcuuuuggcuauaaaaccuaauuuccccuuuccuuagaacaugaaacugcucagacacaccucaaagauacaggcagacacaugggaggugcagccggccgggauuaugaaaccaccaacgguggaaaaaagggcagcuuugugccaguggccgccgcugggaaaggccgagggauaggguuuccagagggagggcaguucuuugcccaauccuaggccagggagaaguggccugcgaggagcagagccaucgugcuguucuggguagugcauggggccucuguggguggaggaggaugugguguugacucuaguagggccuuacagacacauacacugaaagguguuggugcagccagcauugggaaugugccccuacccuuguggaggaaugugagguccugccuuccucuagcugaacaaggaacugcucugugcuuuugccucuguuugccuuucuggauagguguuggagagacaucaggucuugcucacucacuagucuguguucuuggaacuuggguuccggggccuguacucuucucuuuguacucuggugaguucuuugccaugugacugcagccuggagcagccaaacaucgacugugguccauggcccucauuaauucucucuccaccuccucccugagauacggaguaccacugcacuaagauggucucuggacagcuaggugauuccugggugugggucaugucaccaaauugugugcuuuccuguggcuuugcaugucuagguaaggaugggagaggagagccuguguucacaggugagguggacugcaccuacuucuucacaugggacacuaaauacgccugcaucaaagagaaggaagaccuccucugcggggccaucaauggcaagaaacgcuaugaccugucuguguuggcucgucacucagguauugcuugccuuuccgaggacagcagucaccguguucacaggagaugaccccaaugguuuggggaaacauuuuuuaauugccaguugagucaugacccccauucccgucuagccacaguacaaaauauaaggaacacuaguuaggaggugaacuacuugcaucugaaccucacuuuuucuaguugaguugucuuggcucaccuuacugguucaguuagaauguccaggaccugcuaugacagguauugugcacugugcuuagagacaguuucuccagcaacuuuuuuggguagugacugaggagguugguggagcuucuguccuuucauauggcugccucuuuacugccacugaaagcgggucagcaugccucugaucuauaguccugggaggguuguccagcauggaugacauggugaaucagugugucagugacaagguucauugcagaaacuggcagagccuguguuauguugaaggugcuggguaacugacuaccacugagagcccacaugcuacaccucagaaaugaguggcaucuugccgaaaaucaaugagguagaugagaguaggcuuauaggagccuuacauccccuaagacagagugacuugcaucaguaccaguuguaacugucuguucuauugucuuuggaggcuuaucugaaaaguacuguuggaggaauaucuccuguauguccgguuuaagaucaggguccacaguaaaugauuuguguuagcugauugcuuuaacaguaagacaucuuuaugguuuacgaguuaagcauccuggaaacuguagaaacacaggaaauuucuguaggaguuaaaauagcuucaggaagcugggacugaaucuuguguaugugugcuaaugaaagguuggguuucuacaauguggaagacguucuaaucucugaacuagaacucugccaagacauguguagcucuagccaauguggacuuuagaaagcucucuagucccuagaaaagagcaggaccauggugggaggacucuagugagcaccgcuccucccuucagcucauguguguagcugaguuguacacagcaacacagcauuuucuguuuuuugauuuuguuguguuuuguuuuuaaaguaaaagggggugcauuacuuccaguuuaagaagggauauagucuaucacagcgaggaaggccuggcaauaaggagugcaaauggcugaucacauugcaacucccauuaggaagcagagagagaaacacuuuuuguuuuuuaaguuuuaagugucuguguuacaagacauaaacugggaucuugagaggugauacagaggcacauuaaugcccuuagcagacuaugcuauagucuggcuuuugaggaaucuggaguguuucuguagcauuugcauccagagagcccagaagaugcugugagcugaauguuccgaaagucccacccuggagauugcagcacacacccccuccagccaaugcccagugcuuuuggggaaacuugggcacacaugcugucucucagagugugucugcaggcucuguguggacuugagaaccuagcucuccaaaaacauuggcaagcugugggauuuuacuucugguuaccaacuucccaaaggaucauuucagacaagaaugugugccagcucuggguguccuucagggcagugucugaagugauaggcacauucucaugacuacucuuuucuuugccugauagauacccuuaauacccaguggugguucccuugacacaaacacacacacacacacacacacacacacacucacacacacucacucacuccacccacucacucucuacccauuaggauccauccuuaccuucugugagccagaccuuccacccugcucccagucauccuguguagaagagguagacacucucuuagcugcacaggcccuugugggaucugaagcuuagcaugugaccugugccccuucacuaggcucaggacagcaacugacuuucucauguaguucagaaaacauuguggggaauggucuguuccugacacagucagugaggaaguggagacgccaugacugucuguggaguacuagagauugucugaccuuggcuuagucgcuguuuuaagauaggacugcaagaaaauguuacugccuuuggcuuaaaggacuuuggguuugauugcagaaucagaacagaauugggaagcaguggauggcagccaggcagaaucagaaaaguauuucuucaucaacgucugucaccgggugcugcaggaggggaaggccaggaacuguccugaagaugcugcugugugcgcugugggugagugacgucaguagggacccucucucuaaggugugcagauucccacugcuucccugggggagacauaaaaugugguuugcuuaugucuccugccuugcauaaauacuaaggacgauaaagcguuuuaaaguuucagugucaaagccacugaaguccugauacuggcagaggcguuacuaggcagaaagaaccauguuggaaaaugcuccacgaucuaucuucauuuuguagacauuugaagaauaauaauacugucaguacuaguaaaacuaacuuugaguuuuccacagccccuggucagacacuuaggggaagcaggauaccugcuggugcauucaguggagcagcauguccgaguguuguucuugcugucauuguuggucuuguaugucacauagagguguucgucuuagagacacugagguucgguguguggugugaugccaggaggaggguaaggagaaucuguuacaaauauggacgagagauuagugaggcuugguuggauuuuggggauuacccuggcauucagaacuagagacgcaucucagagugacugaggucuguuuuugucuuacuaagggcucaggcauagacaucuucagaauucaguguggggugccacaguggggugagugccacacaggugugaguuucugcuuggucaugaguaaagcuugugacuugggccgugcuccucagcugcccacguuuaagggcagcugaggcucuagaugcggaauagugucuuuuacagauaaugauggugcccacacaacccuguccuucagaugccuuugggggaaucccauguaucauuuucagcauggcaggagguggccucgaugugauugauaaauuuuuucuuuuaagaaaauugguuuccaucacagucagguuaggugggcugaaagaagguccuggugacccgcuggcauucggcugagucuugguauacuuucaaauguuuacaugaugagaauuuucuacuccaccuucuuuuuuuucccccagauaagaaugggaguaaaaaccuuggaaaauuugucucuucuccuacaaaagagaaaggacacauacagcucucuuacacugauggugaugacuguggcagugauaagaaaauaucaacuaacaucacacuugugugcaaaccagguaaugucacagaagaagagacauacccacauuuuccaucauuucuguaguagagcugggagcaagggcggugcugagcacugcuaguacuagucucuggugaugggaaucaagucguuuggauuucagccuagaaauggagaaaccauaugcucuccacagagaguugugcugacacacuccaaaggagucgugagucucugcaugacauccuguucauaaggacugucagaagaucagggguguggagugcugaguuuccuccacggggggaucauaaacggcuuagaaauauuuucuugauugcagcaucucacccguggcugucccuccccucuugaguuucugcauuugugcguguauuucaguguucccaggaugcuguguuccacacuccacaguucuguuuaugauuucuagggauuuccuuguugacauggcauaguuuuacuauuuuaaagcauuuuacugcugggaauuuagauguuccauauccucucuacacccaccccguaaaguuuccuuuguauaaauucgcagcugugggaaaaggacacaagcuaggaauguuuuguuucuuguuuuauugugguagacuauauauagcacaaaacuuauagauguuacugucuuaacugguuucagauagguagcugagugcuguugggcguuuguggcuguuacugcuguucauccagagagcuuucucaucucuccacacuuaaaccugccaucuuggaaauaauaguacucccagaguucuguccccugcaucugacaccuaccuauuugccugucuguggaguugcccacucuaggcaacuccuaucaacaaagccacaugguauugugggagacuccuuuccuauccacaaagccacacaguauuguaggagacuccuuucccuguggcccccuuucuugagacaagauuccacagagcugaggcuggccuugaauuucuguguccccauuuccaccuucugaagcacuggcauuguagauaggcaggcccugcauaucuguguuagacagugcuggggauggagcauguggcugugcuggcgaagcacucugcuguaugagccagcuguaucuccagcucuguacggccguucuuuaaaccaccucuuuccuaggacuuuuaacagggaaaaagguguuagaaucggcaaauaaguguuugaguguuuuucuccuccccccccgcccccccccgguccuccuuucccuguugacaggugaucuagaaagugcuccagugcuaagagcugcaagaucugauggcugcuucuaugaguuugaguggcauacggcugcugccuguguacugucgaagacagaaggagagaacugcacgguccuugaugcccaggcaggucugugccuaagcagugccucuguugucuggugugcaugacuuagcauggcuguuaggaguaaccugaugcagaacuuuguucaugccacuggacagagccccaagcgucuucuugcugugugcuugagcugcggcggcagugcccaucuugaauuuguggcucugcuggauuuacugguuccagcacaggaggauucccccccuacagucauucaaaaggcuuuuagaugcggccucggacagacccccuccauaguggaguuuacaagaaggccaucauagugugguugcuuggcuaugccacauuugugagaccuggagcuacagguuugaacaggguuguagggcucacacaguggaaaagggcaacggcgaggaccuguguccagguaggagauagucacugcaggaaugguagcuuaaaggcaaagugaccuuucuccuucagcgcuguuuugcucuggcaguaguuucugucugagaagcuugcgugguccgcuguccccugugccaugacuggccugacauaccuguguuguguuuauguuacucaggguuuuccuuugauuugucacuccucacgaagaagaauggugcauauaaaguugagacagagaaguaugacuucuacauaaauguuuguggcccuguauccauggauccuugucagucaaacucgggggccugccagguagcgaaaaggcaaguaaccugauucuggguuugcucuuugggauugugggcuagcaaauguuucguacagagguaguuagguuucucuuggacaccauugcuugacaggcaucuaacuacugagaagaccuggucagaagaaucgcaggaccccagagaaggggccaagccuuauccuuaggcugagagaggccugggcuuauugaugcucaccugggaacuugagcuuuacuguuguugcauacuuauguauguaguucuccuuacuguauagaauagguuuaguuguaaugaauugagcugcacuacaggccaggaguacugagagaaaguugugugugugugugugugugugugugugugugugugacuuuucucuuuccacagccaaaagagccacauaugagauucccagggacugcagugucuuggucuggccuugcuuuugccccuauuuguguagccuuagagaacagaacuccugccccauggcacucacucccagagugacauuucuguguucauuuuagugguaagucuuggaacuuggggcugaguaguacuaagcucaccuacuacgacggaaugauccagcugagcuacaggaacggcacucccuauaacaaugaaaagcacacaccgagagccacacugauuaccuuccucugugaccgugacgcuggagugggcuucccagaauaucaggugggaauuaucuugggaaauuuuccuggccauaccugagccaguugcccacccuuucuguaggaacagagcuauuauuagucugguuuucuugccaaacuaucacauaaccauuccuuuuugcaguuuucaggguaccuaggcaguauguaguuacugguuaagcuguuuauucagaggcccauuuaucuuaaugcuaguccacagcucuguugguuguauuagaaaacaugcagaagcgauuucccuucccccaggccaggcuccauccuagugcuguuguuaagcuaaggccaguuuugcugugggucuuuggggauguuacagauguagguuguuugugcuauccuuuccugucuccuucuugucuugggauuaggaagaggacaacucuaccuacaacuuccggugguacaccaguuaugccugcccagaagaaccccuggagugcauggugacagaccccuccaugauggaacaguaugaccucuccaggugagcacuuguuuuagccgauggcaguagguuugugguggccccagggugcaggguguggucugaucucaccagucugugguaucaauugaucuuugucauagcaaacacucauuguuuaaaauacuaacucaguguaaggugaagguguuggcagggcccucugcauguggagcuucagacuguccaaauguuaugacauguccugugagucauucaccacauaguuugauucauuauccauugauagugucuucauuucucuagugacuaaacaugaacugcugacuuuagcuaguucaccuuuguaaaagcauacuuuugugugaaaacuagucuagugaagucugaagguggcucuggaggaaacugguaugcuauggaaaacucccgggaacauguuacacggaggaaauacuaccucaaugugugucggccucugaauccugugccaggcugcgaucgauaugcaucugcuugccagaugaaauaugaaaaucaugagguaugugugucuuucucauguuuucucucgacucugaggccuggugugugaaggcauagugaucuggaauucuugaucagaacaggccugcugccugcccaggugcagucucugaggaugugccuccuucacagaaacacaucacuugaaucuguucagacgggcacuggccaugguugauccaguacuuugcagggaaagcucuuagugguuaugcuggccugaauucaggugccugcgggauucugcagacauccauagcucagagccuccggugcccuggagucagucgcaugugagaguguugcuccaagugacccagaugcacgugguaaugccacucugggcgcugagugcuuuaucaucuacuggcagagcguucacaucuuuccugugguccuuauauguggugggcuuuggaaguugcacacagaccccagaaguugacuucugcaaaaacaacgugagcaauugcuuuuguugcauaugcuaguggugcccucuggugccucagaggcauuugaggcuguauguguaugaguguguguucucuaucacaacagcagcuucgggguucagccagcccccacucagggcuucccccccacucaaggcuucugcauuuuguuugccugcuuacacaguucuuagcuguggcuucauuggcaauaacuacuguaaguagcaaguugacuuccugaggaaggaagccaaauccacacucuguugcagggcuccuuggcagagacuguauccaucaguaacuugggaguugcaaagauaggcccugugguggaggagaguggcagccuccucuuagaguaugugaacggcucugcuugcaccaccagugauggccagcucaccaccuacagcaccaggauccaucuugucuguggucgaggauuuaugguaagugcugcacaggagaguggcaaggacuucagaaaagcaccagggccaguguguacgauucuauacuuuguuuuaaguugcagcaaagucucuagggcucgaaauuggucauuuuaggcauuaccgaguuaccaagaacauugccuuuaucaugaguguugucccaccaaaauccauguugagaacuuugugugggggucauuuuuuguuugagauuugcgucucacuguguggcccugucuagccuggaacuugcuauguagaccaaacuggccuugaacuuguguagcucugccucuugagugcuauggcaccuaccucauaucuagagcuguuauuuccccaauccaaccuaguuccugcugccaccuuuuuccucuuccucguguauguguguguguguguguguguguguguguguguguguguguguauguuuugggggacaagauuucaggcuggccugaaacucacuauguaaaccucagacucagagcagggauuaaacguuugugccacuguucuuuguagacuccuggauucuccugagcucagugcaguggaugugagaccugguguccaggcacccugcagacaugaaauucauuuuguccuucucugagguuacgaaaugacugaggacagugucuauccauggguggcagacaugcucccuuaccuacacgauccugggcugcuggguguuuguuuguuaguucauuuuguuuugucuuuuccugcuuuggggaagagugcugcccccuuagguuggucucauuucauagccuggcagcugccuccuaggugugaggagcccugccaucgaccauucuuugcuuuuccuuuuuugcugucauuuagaaaaugcauuuaguuccagaaaauucuuuacaacacuucuuaguuuuccaaguauuuucugacaguggcugagcugguuuugccuaugggcuugguguacaguguggguccugguaugacucuugguggagaggagaggaggccagguucacagaguguaccacaggcuagagccugggucuuucuuauccuuagggagccaggguccuuggguugaugagcagagugggugggacauacagguagaaacucugggcugugggcugagaccgggugaauaaugccaguaaagucuuggugugcuguccaguuagcuaacugagccacugcugucuaugauggagacagcacucguggaauggaaugaggcuuuuguggggagacuuuuuguugaacccccauguaucauaagacagcaguccucacaaauuagcacaucuguguaacugaaaccugagucacugacacacagccauuuuuuagaagauuuauuuauuuuuaugugcauugguguucugccugcaugucugugcaagguucagacucuaguuacagacaguugugagcugccuugugguugcugggaauugagcucaggaccucuggaagggcagccagugcucuuagcugcugagccagcucuccugucccacacaagucaguuuugccuuauuccagcugcugucuacaacuauguauaguaacuuucuggcugcuuugucagacucugguuguacaggcuuggauucaagcugagcuuuuccauguacugcuggcuugagcccagaugugcuaacuaaugucugugcauaugaugcccuguagggguaauaagaacagugugguauaggaaggaggugcauaucaggugcugacccauugaagacugccaguggauucuagccugccugacauacugaugcucaacugcuaugcugauguccugcugauuucucuaugcccugugaccuuucagaacucccaucccauauucacuuucaacugggaauguguggucaguuucuuguggaacacggaggcugccugcccuauccagacaaucacagaaacagaccagguauguguguugucacauugcccaugcgcacgccgguuuugaguugcuuccuagccuccuuucugacacaugugucaccaugcucugccuccucccuacuguggguaccuagaucuucaggaccacccauuucacuucuugcucaccacagcccccuucaacugucccuuuccaaugccaaugcauccuagugagcucuccauaacugccaggaucugauggauucacauugcugcauuccagaacauuccaguaucuggcacagugaugcuccugaaguccuuauccacaagauggagcccaguacuucaugugaugucacugacagaguaaagccaugugucugcugugaccacccuccugguggaaccuagugccucaugggauguuacaguuagcacccaggguagggcuuagugaucaugggacccgagccugggauaaagcccauguguccgcucugcccuuccuuagcuccagugugcagccaggcgccucaugcugaugaggucuggacggcagacuccuuauccucugcugaaggccaugcacuuuguuccuagcaucucuccacugcuggcugcucuugucugggcgcuucuccuggcugcauucucugcgguguagcagcauagcagcacacugcucuuugggcucuuugcuacgcuccugggccaggaaguuguuuuaugguacugugugugcccuucuuuauggaggaacauguuucccuccccauccuuuuaauuucuuaccagacuacagagucuggaagagaaaccuggccugauacacaugaugaugaucucagcucugggccaguaguaucuuaggcacccuguccuuggucagggccaugacugcuccccugaccuugguggacauuggaggcugacggcaaacuuagaggaagggagggacugucugugaguuaaccugguuauacucccauaggugcacucauagcaaugagagguaauucuucaguuuuauuuuuuaauguaaaaaucacuguuauucuagcuccaccuacccuucccuuuccccuuaggaauuagugguagccuuacucugcuuuguaguagcucagcacccaugggguguguuccauuccuccacacauacaucccacauugaugcaggcaagggacugcaugagcauacugcuguucucauagagauuuaaaaugagcggcaauggguuucugcagggucuucaugucuguuuugcucuuguagaauugguuugaaugcauuuccuuucuuguuccugauaggcuugcucaauaagggaccccagcaguggguuuguguuuaaucuuagcccacucaacgauucugcucaaggacauguggucuuaggcaucggaaagacuuuugugguaagugaagcaguaaauuucuaguuugcuuuaaacaaggcaagcugcauucaagucacgugggcuguggguuugggaaucaggcauccuuagugcugagagaaggacggcugcuucaccacaagaaaggaaauccagguuggggggguggguaaugagcuaacaucaucaccacaguccucaugcaguuagaugggcaguuuucccuccuuaccugcugcugugcaucuacagguuuccaagaggcagcagcauggugacaguuaggacccgagcuacauaaagaguccaccagaagcaacccagagaggcccugccucguguacuaaccaugcugucaggagccagcgugccgccgaggcucuugguugugggugacagaccaauguaauaauagcagaaauggagcugccuggaaggccgcccgagcuuguggcuugucugcugggccacaccgcccaccagccccucucuuagcaucacagcgagggcuagacuucugcuccuuacucucccuaucuccuacccuacuggguucagcugcccugcacauuugguggcuuuguuuucagucagacuccugcauacccuucucugcacgauuaaagacacaauaaagugauuuguuuugcuucuuaguguaugcuuuauaaucacguacaguaauuauaucuacagauagaaggcaguaaaauaagaguauaaaacacugugcauuuaaccuugaaauuuguguaguuguuauuuggauuuguguuuuugccuuucugacuuaggaccgagaugcccugaaguugauaaacugcuagugagaaccagauacuuagcccauuguugcuuuggguucuaggaauuuuuuuuuuuuuuuugacaggguuucucuguauagccuuggcuguccuggaacucacuuuguagaccaggcuggccucgaacucagaaauccgccugccucugccuccgugcgccaccaugcccggcgguucuaggaaucuugucugugguaagucuuggaaucuaaaugggccuguaaaauuuuuuuuuucccuguuuggcuuccaguucaauaucuguggugcaaugccugccuguggaacgguugcggggaagccagccuauggcugcgaggccgaaacucagauagaagauauuaaggaccuaaggccacaaaggccggucgggauggagaggagccuccaguugucugccgagggauuccucacucugaccuacaagggcucuucucccucugacagaggugagcugagggucacuuggacauaugcauaucucccgccccuucuuuuuacuugcaccucuagcucuucagagguggguguugauuguccuucucuaggugcuaaggaggggaugaguuuauuuauuuauuauuuauuuauaaguuuauucuuuuccuccuguuuuuuucuuuuuaaaaaauuggugauaugguuucuuauguaacaguuuggguauguuaagcuuguuaauacuuauuuuguuaguaagugaaaggccaauucugagcccuucaucgugucagcagcugugacaguggauagccccugcaggugacguguaccacgggugcuauauguguguugucuggugaauucccacgccagcucugugagucuucucuuuuucuuuugucccuuugagauaggcucuuacugugugguccuggcuuucuaggcugguuauguagaccagucugucaucaaacucagaggucuuccugccucugccuugcugggaucaaaggcuugggcaaccacaccuggcuuauacuucuccugugcucaguuaaugcugcacuguacaggugcagcacuggaaggcagaaagucuuauaccuaggacagagccugugcuucaugaggggcagcuucagagugagauccaggggguuuggauucuguucuagguucugccaccuguuuauucuguuuuacagauaaggaaauggaucccagggugagguuacuucacaguccacacuguugauaggcagcaaagugacccucugaccccagucagucccauugaacacugggguguuggugguuugugcgauggguugcacaccaugcucaagcugucugaggggcacaggaggggguggagucuuccaugcuacaugguuugcaccgacacugcagucuuacuuuuucuacuucacuucuccaguuagcagauacuggaauuauaacacuaucauaacuguauuccguagaauacaaaugaucauuaaggacugauguaaacaacuguaugccaacagccagacagagucauaccuucauaucauaucuucauaauaaaaucccccaaaauagaaauacagguaggucaugaccacaccauaugaaacagggaaaacugaaauaauuugcucuaaauucaaaaacaagacagaaugucaagaguuaauacuacucaguuacagaucucagaugugaauuugaggaaauccuaaaauauaggcaacaaaggaaaauucuuugaauuuauuacaucagacuuauacaaauuuuaugcaacaaagacacagucaagcgaggagaaucaaugggaugguagggaacacuacuuacaguuacuucugaauauagaaauaacucagcacaaaaacaucagucagagugaaaaugggcaagggucagaauaauaauacauuaaaugcuaaaauguguguguaugugucugucugucugucuuauuuauuuauuuauuuauuuauucauucauucauucauucauucauucauuucacauggggguaaugcaaguccaaaaauaagggauaagggauggauucucucaucagccaggacugcugcuccugauagaaaagcagguuaugcagggagaaggccggguacggcagcugucaaggaagcagcuacaaauggagcaugguuacaaugcccagugcuugugagguggagaggcagaguucaugucugaggccagccuggaauacaugcagggccuuguuuuaauaaguaccuugugccaaugagauguuugacucaguaaaggcgguugacugccagaugccagccaucaaguuguccucugcccuccgcaugugcaccauggcaggcacacucacagauacacacaaauaguaaaaaagaagaacucaaguccaaaaucaagaaaaccaguuauguagaaacauuguuuaaguucuauagcagccccagugugguauauaugcccagagguauugagcucagcacaucagauacuguacguguauuaauugcagccuuguucacagcagcccauguauaaaauugaccaaguuuuccuugaaugauggguggauacauagagaaaaugggcacacaguggucaauuacuaaaaaugagugaaaaccucuuauuagaagcaauuugcaugucuagaagccguguuuagugaaguaagucagacacagauccuccuguuguuggcaguugaaagcuaugguaaguacuugaucucggagcagacaguagaguagagcuguugagagucugggguggggagggguggguuugaauagcaggguuagcggugugcgggguaggaagaguaaugcucuaaccagcccaggaguuaaguugaccacacugauugugguucugaguagcuaguagagaggagugcugagcucggcuugaggcugcggugaccgccugcuggaugcuuuggcugaaaugugaucacaagucccaugaauaucuaguuacaguguguggcaguuagaaauuaaagauaaaagugaauugaaaauguuuugaguaagcuucugcaaauguaaacauaggaagggguuccagcgcagaaggaggugaggcuccuuggugacaaauaucucuaacacgccauuuccaggcgcgagugagccagcgacuccaguugggagggaccauugugguuggcuaaagacauagucagagugcaguucgugaauauguuugcugccuugaggguggucaggccagccuucaguguccuccacguggguguuuugaagggcugugugagcacaugauuucccagugagcacugcuucagggccuccugaguggcacucuuggaacccuuuccuuggguagaagggguuccgugcucagccuaggaugguucucugggagggaagcucaguuagcacgugcggagggaccacggugggcagucucggcaagcugcuacuguguaugaaaccucuccgucucaguauacaaagcagggugcuuccuuuuguagcuacuuugcucugcacuugcugaccacucguuuaaacuaggaaugcuuaaucauuuuucuaucauguucuuuugaggcuugaguuuugaaagcauuucccacccagcucuauuaacauuggggaacauuuaaugacuggugaggcuccaggcuuggguagcgccgaggguccaguccacuuacaugccuccuuaauuuguucuuaccucauuaacccuguaaagugguugugggggaggaguagguguguagaguuuguggaaacaaaaaagucagaaaacaaauuugcuuuaucugauggaaugauaaacuugugcgagaugugaauucauucugauaggaagagagguaagaucugaucccuggccuaagcuugucaugccacaccagucaauggugcugggacaguccuugcacuggcuccccuuugugauuaccccaggauggcuaugaggccucuugcugcccuugcuguccuaagugugagacccuccugacugguggcuuucuugucccacaggcacagcauucaucauccguuuuauuugcaacgaugacauuuacccaggagcccccaaauuccugcaucaggacauugacuccacacgagggauccggaacacuuacuuugaguuugaaacugcauuggcuuguacuccuucucuaguggauugucaagugacuggugaggccuaggaguugguaggcuggguuucagugaggggguaguguguguguguguguguguguguguguguguggguggguggguggguggguggguggucugucugucuauauuucuuugccucugagucucuacgugcuugaaugugagcuagccguuuguagacguggcacauaugcuuugcuccguaggauuuauagcgauuguugccuguuaaaugaugcuuagugauuauuaaaugaugcuuagugauacaagugcuucucuugaagagaccccuucccacuuacagcaacgguuuaaauugugguuugcgggucagaugcugcauagcaaucuugaagaaaacucaaguuaaaaaaaaucaaauacagauguauguccaaaguucauaugaggaaggaaaaagacauaagaccuaagagcugcucaguugugcccugagguggcugugugcucugacugcuuagcgugugugcugugcugcugugguuuuuacagagggacaguuuggacagcagggcaggaguaugguucugcaguccagguuuccuguggguuuccuugugucuucacacgguggggaaaguggucccagaacaaacaggaaagcgugccuccuuuuguguuuccuuccaccccagacccagcugggaacgaguaugacuugagcgcccugagcauggucaggaagccauggacugccguggacacgucugcauacgggaagaggaggcacuucuaccugagugucugcaacccucugccuuauaucccuggcugccacggugcgcuggaguccuguuccacuacuuccccggggucugacuggaacccaaagcagccuuuccucauucgccauucuugucuguucaggcauugcauugggguccugcauggugucagaagacaacaguuuuaacuuggguguggugcagaucaguccucaagcuacuggaaaugggucucucagcauccuguacgugaauggggacagauguggggaccagcgcuucuccaccaggaucguguucgagugugcccagacgucggugagugugcaccucagcaggaaacgcuugcuuggugguuaccucuauucccauuuccccuuaaucuuggagucuucugugcuguuuaaagucuguguuuauagaaaugggggcauugcuagugucugacuagaguauacuguuuuccucaggcuuauaaucguccgucaguacugaacccuuggcuuaagcgagcgagagacuggagacuuccugaggcucuugcuuguuuucacaaaguagcauacagugaauuguuggcuuguguugcagggcucaccuauguuccaguucgugaacaacugugaguauguguuuguguggcgaacaguggaggccugcccugugaucagagaggaagguaagccacagguugcugccccugaguugcuguacauaucuaguggaauauaugugcuaaacccaggaugucucacauaggaagcccuguggugguggcugccuguggggucaggaggugccagugucugggucaccccuuauccuugaggucuuuauuaagccacuuguuaauuuuuaccacuggccuuucucuaauauacuuggauuggauuuuguuuuuucuugaaaccaguaaagcagucaggaugggcuugguuuauuaaucugugggugucccugggcucgcuccaaaacugucugucuuauacauaaacaagacaacagagaggcagaccacuuucugauagccauugccugacuaaaacuuguaaaacuugccuggucugguggugcaagccuauaaccucagcuuugcaggaggcugaagcaggaggagccuuuguucaaggccugccucccuaggcugugagugaguuugaggccagucucaguaacuuaaugaggccuagccucaaaucaguaaauagagcuaagaauguagcucaguggcaggauaucugcauagggugugcugucucagggucucaguauugcaaagcaaauaagaaauuuuauuuuaaaaauuuguucucauuuggaacuacgaaugccugugugauagcauuugcucuuggcuccuguauguucuugaaggagacaacugccaggugaaggaccccaggcauggcaauuuguaugaccugaagccccugggccucaaugacaccaucgucaguguuggcgaguacaccuacuacuugcgggucugcgggaagcugucaucagaugucugcucugcccaugacggauccaaggcagucucaucaugccaggaaaagaaaggaccacagggauuccagaaaguggcagguacugguguuuucugucuucagcuguaacacgucaagaugugacgccaaggaccacauuucucuaacucgggaggagcacgugcugagugacagacacaaggaagcaagcuuccaucugccuguccauccgcccguguaucuuaucacugagcacaagugcaggucagagaacaauuugcaggaguugguucucuccuuucaccaugaggcuccugggaaugaaacuuaggucaucagauuuggcagcaagugcccuugcccacugagcuaucgugccagaucacugaggacaauuugguuagaguuuggaaaaaacagcagggcaaggcaguuggaagucauggcacuugccaggagaaggggguuggaaaagaggagagaaagcuaugcuuuuugcauuaugcugccauuuucagcuggaggcuuaagaagcagccauaaggcagauaggcagcucugccuagcaacugggaguggggcuucagagaaggagugaggaagcccagaguaccagggaaagcagagaaagaaggcaaaguaaaaguuaggacucagcugaguaggccaugaacugcagggccacagaguguuucugacccuaagcccauagguuuuucuugggacacaccacaugaggugaugaugagugccuccaagcagucuaucccagggcugcaucaaagaagguuagauggaaaacugacaaggcuguacuuggcucaguaguuaagaguauggccugcuguugcagagaauugggauuccauuccagcacccacaugguggcugacaaccaucuguaacuauagucccaggggaucugagacccuuuucugacuuuccaggcauaaacauacaugcaggcaaacacacuaacacacaugacauaauaaaccuaaaacugacagaguugacaugguggugucuguuuuugcauguacacugucacaggucuugcauuagcaccgcagcccaggagccuuacagaugugcuuugucuggagccuuacagaugugcuuuucuugagcaggacuccuuagccagaagcugacuuucgaaaacggacuguugaaaaugaacuauacugggggggauaccugccauaagguguaucagcgcuccacaaccaucuauuucuacugugaccggacuacacagaaggugagccccuguggcacucccacugccgucccacuccagcugcuguucuuucagggcuagucuacucucaacgucuauaagaugcauuauuuacugagcaccuguuugcauggccauccuucaccugggcucccauguuuacauauuuucuccuuaaccuuuccagccaguguuucugaaggaaacuucggacugcuccuauauguuugaguggcgaacacaguaugccugcccaccuuucaaugugacagaguguucuguccaguaaguucacauaucuauuggcuuuuuguguccuuccuuggcaaaauuuugcuucacagguagugucuuggucaguucacccacuucuuuucacacuggguagauggcuccagauagccacauguggggcugguacaucagacgcacauggagaggaggagucaaggacagaaacagagguucggagccuuccugguuuguaaggauggaguggcuucaggucuagagagcaggaggcuuggugaggcagcuuuuggaaauggcugugggugcauacgcuccgagugccaggggguggcuucugcuggccacugaguuauaauugucacuggccuguguguggacagacuuuuccaaacuuggcuuuucagauagcucauuuuguugaagugaacauggacucaucaaagcucaaggcugugccuugcucacucugcauuuggaaaguuauguucugcaguaaagcuugauucacaggacaucagggacacauugaugcuugagcccucugaggagagugccagacaugucauuggagcuaacuggacccugauugugguguucuguucccugcagggaugcggcuggcaacuccauugaccucuccucacugucaagguacagugacaacugggaggcugugaccaggacaggggccacugagcauuaccucaucaauguaugcaagucucugucuccacacgcuggcacaggugagaagugacccucuucuuguagggugguggucagguccuuguagggagucuucugggacagacagagcaggagaggccucaguggaaggaguuuggccuaggagcagcaggggaagggccugagggucuuggugauugauucccauauggcccaggcucuguugauacugaagacucugcagggaacauauuagccucaugagaaccugacuauggguacaaagaaagcaggaugggacacaggaaggggcccacuguuuauccuaucaaggacuuguaccguuucgagagcauucucccugagccugcgaugagaguggagacuagaagacacaugguggucagcaguuuuccagggaauuccuuggaauacugaaggggaaagucacccacagucccaccucagggugaugcuuuuuuaacuucauucucaggguauagggcacaggugccuggagaauaggaaugcugaguuccuaguaauguauugacuaaagagugagaauguaggcucugagagugcucccuugcguugaggacucugaccuuaccuugcgcaguguuuugaaaugauggcgcgggguggguguggagggguuggauaauaccauaccuugagcugcacuuugcacuguaggagacugcagucaccccaggagacucugauuguaucuuguguugcagagccaugcccuccagaggcagcuguuugucugcugaauggcucuaagccugugaaccuuggcaaggugagggauggcccucaguggacagacggugugacuguccugcaguauguggauggugacuugugcccagacaaaauucggagaaggucaaccauuauucgcuucaccugcagugacaaccaaguggugaguuaauggcacccaguagagugugggacccugagccagcgacaaugccaggcugcuuuugggugcaaguucgccugcaugucaggguggcaugguuguggugcaugcugguugcgaggucugugauuuaggguccaugcguccccuugcugucugcuuaggcacacaguccgacacuugcaagugcagggcuaauugacucuuuugagucuacucuggauccuuaaagaacagaagggcagcuaacacuuggcugcuugucccauguuugucagcaagauguagagaggagacuggaaguucccgcaugacuggugcagguguuaugacuggcgaucuggcugcucuccuucugagcugccuccuuacuugguuguugguguuggcaucuagcagguguggguagcauggguagcuucucugacacagaggaacuucuuucugugcuucuguuugugaugggacacaucuguauuggagaagcagggucaucucugaaggagcagaugccuuaugggccaggauacaggcugauguacuggaggguggcgggccugccucugugccucagugcugagaacugugcaggaaggagguagaguugggcaaauggucucagcuccauaaugaugggaaagaccaggagugaucgguagccagugaccagaagaguuaguauuagggacccacucuuugcuggguccuuuuguuuuggcuguaacaggcauuugcuaagcauuggccggugauuugcucauggaguucuuugccugggcuccuugggucuaucauuagaaaaugucuggcucgcuuagcuagcuugugguggucccugggguauauugcugacuuacuugugugagguccauaagaacuuacucaccuuugauuuuuuuuuugaccugugcuuaccucacagagacaccccaagacuugcugugcuuggcuuugccaagcaguguuguggggcaugaguggguacccccuaggcguaaucaguuauucugaagugguucucucugcuugcccuagaacuccaggccccuuuucaucagugcuguucaggacugugaguacaccuucuccuggcccaccccuucugccuguccugugaagagcaacacacaugaugacugccaagucaccaaccccagcacaggugagggacagacaaccacagccccguacagggagggcccuaggagguacauccguugguguuuggcaucuuuggccuuuaaagagaaaaggaucuugugcucauccuauggaggcagcuaccuugugccugggaaagccagucuccaucuuguuuuguacuaugcuccuggcucgcuuggcugaugguacaugagugcuaaggucuacaaagcuggccaccuuucagagccaacagggcagccaccagaagacuucugcccuuccgcuuugcugaguaucaagaggaauguggguggcaggcugcugaccauuggagagaugcgucaggccaaugaugacagcgacaguggcugcuggggcacacagaggacggagaccgugguccagugacaggcgcugcuaugcuaguuggaguauuuuagggccuugaugagugugugaaggaagagucagaguccccacugguuggcugaugugagcuggcucgucacagcccuccuggucugaagcgcccucuucuucucaccuggcaggccaccuguuugaccugagcuccuuaaguggcagagcugguaucaaugccuccuacagcgagaaggggcuggucuucaugagcaucugugaggagaaugagaacuguggccccggaguaggugagugccauagcuccugugcccgcugcugucccuagggcuggccucagccccauucccacuucuaagacccacacucccggcccuugcaguaguuaggagacacugcguucuucugugaaauuaaucaguuagucacugaccccuuaccagcucuuucuuuauccuuccaugugcugcaggggccugcuuuggacagacgaggaucagugugggcaaggccagcaagaggcugagcuacaaggaccaaguccugcagcugguguaugagaauggguccccaugcccuucccugucagaccugagguacaagagugucaucagcuuugugugccggccugaggcuggaccuaccaacaggccgaugcucaucuccuuggacaagcagacgugcacacucuucuucuccuggcacacaccccuggccugugagcaagcggugagugacugcgacgcagcugcacccacuccaguuugcugguuccuagcaguccaaggcugggcggucuuggucaguauuccuuagguuuuuauuuauuuuauuuuaguuuuuauuuuaauacuacuucuuuuuuuccuucuuuuggggguaagguucuuuuuuuuuuuuuuuuuuuugguuuuuucgagacaggguuucucuguauagcccuggcuguccuggagcucacuuuguagaccaggcugaccucgaacucagaaauccaccugccucugccucccgagugcugggauuaaaggcgugcaccaccacgcccggcggaggguaagguucuuacacuuuauccaaaguuggccuucaacucacucuguauuccaggcuagcuugaacuguggcaauucuccugccucaguccauugagugcugcuggaacuguagacauguucuaucauaccuagguuuagcuuuuaagcugucauucauggucauuagaaaaaaaguuacuuguagacucaaauguagucuuuucuuuugaacagacggaguguacugugcggaauggaagcucgauuauugaccuguccccucucauccaccgcacugguggcuacgaagcauacgaugaaagugaggaugacaccucugacaccaccccugacuucuauaucaacaucugccagccacugaaucccaugcacggagugcccugcccugcaggugccucaguaugcaaaguuccuguggacgggcccccuauaguaaguguguaaggucgggguuggcaaguuucuagucauagccugugugcugggcucagacagcuaagugugagaucgaaaguaugagaguguacauggagcgggcggccaaccaacaguacuggccagggagucugagcugcuugaaaauugaauaguugcuuccauuugcauuuugaaaauacauguguaugugugagugugugcuguacauguauuuagccuguggaggcuagagcagggguuugugugagugugagcuguacauguauuuagcuguggaggcuagagcagggguuugugugagugugaacuguacauguauuuagcuguggaggcuagagcaggguuuuugaucuugugggguuggaguuacaggcacaugugagcugcuugaugcagugcuaggauggggaccugagcauccucuggaagagaguacaaguagcccccucauacauuugguauugguggucacaugaccggcauuaacugcuucaggguacuuuugauuaguguggccaucucuccagauagcccagaugcaauuucuuuuuuaagacuuuauuuuguuuuuguuuuuggguacauguauauguuugugcauggguaugugcaaguagguacagugugcagcagacauuggaucccuuaagcugugcuuacaggugaucaugagcugccugaugugggugcugggaacugaacccagguccugugcuaaagcagugagcacuuuagccauugggcuaucgcuccugcuucccaguuaugcuuucuauguuaaaccugaccaagagagguguuaacagagcgggcaucaauagcacuggcacagcacaugcuucucuuucaagcacuuguauaauugaaaggcuuaagugacacaaguucuuucuaguaacgagugacaauuagggcaaaaccaauuaugaauaauaaaaaaauacucugcccugaaaacuuacaguguagauuuggauguguggaguucuauuugugguuugccaagcucucgugagguuuuaaacuauaaauuccccucuguugugaguuccauugcaggacaguagguguccuuuuaaauguucugugaaguggaguaucucgcagaggaccaccaaggcaugagcuacauuuuaauaggaaguucuuuauggcacucugccuggccaucauuucccagaaguccgauuggcuaaguuuucccacuuggccauccuuugucagguuaaacuuuugcuugaguucuuugauuggugaaggucugacuucaucugcuccacagcaaugauccacacaguacacaugcucaugcaugcacucuugcucauacugguaugaacauacugccacauggcacuucauacacaugcacacaugcaggcauguuuccuguccaccugccuuuuauucauucauuuauucagaagaacugacugaagagguauuguguaugucugccgcuguccuaagcaacaacaugaguaagcgagaguuguccccucuguggacauucccaucagacacugcugagaugagcaagaggcaaucucaggguaguguggauaucggaacacuaggaagggccuugcccaggcuccugccuuccuccuucugggcccaggacuguggaauucaugcugugagugaggacagaaguccuuagugcucagaaucugaaagcugaccaugaguaggaacacccuuggccuuuguccaugcaucucugguaucucugcaugcuggugaccuuuuugcaugccaaucacaaagcaguacagguauuucucuaaggcugacagugagaacugcugcaguuccaugugaauuccuaaucugccaaccuuggcaugguuguaaagcaccguucacuucuucuguucuaggauauuggcagagucacaggcccuccaauauucaauccuguggcgaaugaagucuaccugaacuuugagagcagcacucauugcuuagccgacagauauaugaacuacaccucacucaucacauuucacugcaagagaggagucagcauggugagugcccgcccugucagcuucacuggaacccugcuuugggcagugugcugaaaccacccgagaacaugacuuggggcgugaguaagucugaguuaacauggaugcuuucuguuguucaaagucauggaagcuuugagaguagaaaucauuuauugagcacugauucugaacacauuaaaagguuggguugaaauaucuuuauuuuuuuuuuuauuuuuuuuuuaaaagauuuauuuauuuauuauauguaaguacacuguagcugucuucagacacuccagaagagggcaucagauuucguuauggaugguugugagccaccaugugguugcugggauuugaacucgggaccuucagaagagcagucggcgcucuuaaccacugagccaucucgccagcccccauauuaaaaaaaaaaaaaaaaaaaaucuuuauuuuuuuaaacuauaaggugaucgguuuucugauuagacuuauuuuuagcaugugccaucauucauuacauagcuuuauuaucucucaggaccagaugagcaggugggacuguugucugcuccgaccugcugacaucugggaugcacugagggcuugucauucacagggcagcaguguccugagcagcugacgcucuguccuucucaguguuuuccgucuuuaguagaagcucuuuccccauauggcucaguauggagcucagcagcaaguguacagaguuccuacccaccuggcggcggcggcuguggcuguggcugcugcugcugagugauggagagcuaugcucucauucagaguucauggccuguggcacauguggcugaaauacuuuugcccucauggcauuccuggugucuagauaugcaggaugcagaccugcucuuggauucugcuaugcuugcauuuguacuguguggcagggguguaugucuucgcuauucccaggaaagaauaugguggaucuuguccucacacggugguuuuuaagacuaauguuuuucaccaguugugguggcuuacaccgguagaaugugcugaaggaggcagaggcaggaggaucacgagaucgaggcaaaccugggcuacacauuuuuuaaaaagacucauguuuuucuuggccacagggaacuccuaagcugauaaggaccaaugacugcgacuuuguguuugagugggagacuccgauugucuguccugacgaagugaagacacaggguugugcuguaacagaugagcagcugcucuauagcuucaaccugaccagccuuuccacaagcacuuucaagguaagcuugccuucccauagccuugccagccuccagagggcuaagaugcuuugacacagggcuggacaagaaucaguaaccugugaggcaggcccuggaguucugugacacaaguggauaauaggcagagugacuugaggacaugcauuggaacacacaccucugggccagggcaagauuucuauaguuacugggagccacagaggaucacugaguugccagacuuagcucaagguaaagagaugcggucugccaaccacagagacaagugggagaagcagcaucgugcgagccuuucaugcaugagucugugggcugggggcuuucacugagccuggugagugcugaguucugaaccuuucucagggcuugcugccugcaguucagggauaguuuucuacaugagcgcagugagugaggaaagcgaggcccaugcgcacgugggcugucugcucugcaucccaaaggaagggggaaccugggacucagagcagcagccucaggcuggagaaagcagaugguggcugccugggccaccagggagaaggcaagauagaaaagagacuggcccaggaugacuucugguguucucuggagguggucuuggccaggaaaacagcaggggucaugguccgauucaguacagggaugugaacugugggagccugugcucuggucacagcagucaguagccacacauugccauuuguuguccuugcagguuacucgggaugcccgcacauacaguauaggggugugcacagcagcagcuggcuuaggccaggaaggcugcaaggauggcggugucugucugcucucugggaacaaaggagcuucuuuugggcgccuugcaucgaugcagcuggauuacaggcaccaagaugaagcagucauucugaguuaugugaauggugauccuugcccuccagguaacucuucacaguauggucaaguucaaauuucuuguaaauagauugacuuagcagaaaaauacuugaggaaugaagcuucagaccugugagcacuguacccugccacaucuccuucccugguaugaaugccugugucuggaacaugaugcugucuguugcuugucuguuugggugaauccugucuagcagggcagguacacagcuucuuagggagucuuuggguggcaucuaaggcauggcugauucauugacgcuuguguauaauccaugccucuuuccuuccagaaacggaugauggcgagcccugugucuuccccuucauuuacaaagggaagagcuaugaugaauguguauuagagggacgagcgaaacugugguguagcaaaacugcaaauuaugaucgugaccacgaguggggcuucugcagacagagugaguggguagcugaauuugggggaggggagcagguguuguucuauggguggccaagcuaauuagugauuauuauguaaguuuuguucuuguuggcuaaggaugauguucauggagagccaaauuugagcaccauagcuccuuugcgacuuagggguggaaagagaguggcgugaaggcccacacucuguaguucucuacaugaucgaggacaagcauuugacucaugacuagcuccaagucuucuauggguggcccugaaguuuugagguuguuacagaugcuuggcugauucuuuaaauucuugccauuauuaauguguaggcaaguauugaaugcuuucccaggagggauuuugguguggucugaggaacugaguuuguaaguggauagauuaaggagugagacaaacuguggcuggggcugcacuuggggaaacagccaggaguaauaaagaggugggagaagucaagguuugugccccgcccuaggucugaccuuugcacacuauugcuccccagccaacagcuaccggaugucugcgaucauauuuacgugugaugaaagugaagauauugggagaccacaaguguucagugaagaucgugggugugaggugacauuugaguggaagacaaaaguugucugcccuccaaagaagauggagugcaaguuuguucagaagcauaagaccuaugacuugcgacugcucucaucccucacgggguccugggacuuugugcaugaaggaaacucgugaguaugccacacugccuguggucccucaaguuuucaaagucaggaauaucacauagcugugggguuugaggcuuucauugagacacagccuagauugucaguguauggggaguucuggugagcacccacagagaccggagcccugacaguugcucagguuugagggcaggauagguuuucuaagacuuuugccagcucuuuuagcacugccuuugcuuuuugaacuaauuacccugacuguuccauguggggagugccugcugugccagggacccugagccucacagggucugcugcaaaucagggcugcuaugaauugggggacuuaggugagugccugcuaucccuccauagccuuuucuccugucuguacugugucagggaugcauggggacaugccacuacaugugagcccguugagucagcuacucuguauggcugcuucacucuccguuucuucugcacccccaaggcuaucagggagucaguuaccuuccaagguaguguggaguccacaggucuguccaguguacucgaaguagaacuuucauuugcccuuuuuacaccccuuugugucauucuguagguacuuuaucaaucugugccaaagaguauacaaagguccccuggacugcucugaaagagccagcauuugcaagaagagugccacuggucaaguccagguuuuggggcuuguucauacacaaaaauuggaagucauagguaaggcucugggguguuuguacuugacucaguugcugcaucaagauuggcaaggugaggcugucccuggugugauggagaaagugccugagcuuugguggaaacccggugacuaguugaagcauuucuacccccuuccuggaacaugaaguccaugcuguuuugauacucugaggcacagggagccuguucaaagcaccuucgcugaucauguuccggaugcacauuggcuucucaauguacaucuacacacaucuaaaaaagcuauggucacacagggcgcuguacagauggcuccguguucccuugagcucuuggcuaggaaucaugacacgaucaucaagggaaggaagggaucggcuguuagaggacaggcacauuuucccaacuaagggagcacacaaggaccaggcuguguuggggguuagacauucuacucugccucuaaggcuagaguaggaucccgauugcgcuguuugaacuacaaggugacauggauauugaaauggagaggggauucugagggaauucccauggccuuuaauaacaaacucaaucaagaaaguggccucccuuugagaauuaaaaucucaacacaugaaccagcugggcaaacucacaucuuaggaauucucuauucccgaaguuccugacuacuguagagcuggaugcuagucauauagguguggccauggaggcuuagcauucauuccugaggauccaggaagcucauggucuugcugcuuccuuacuuauggugguauggguugaguguaugggccaguaacugccauugaguauggagggcaccuuuagacagccggcacuugccuuugcaguagauuuuuaagccccgauauuguucugcagugcacuagaaauaaugccaacucauugucucauguuucagaugaaacggucauuguuacuuacucgaaaggcuauccuuguggugggaauaagacugcaucgucuguaaucgaauugaccugugcgaagacugugggcaggccugcauucaagaggugagccacaggcgagcacacugugcucucugccucccccauuuccacgugggaguugggaaugugcacacagaggagagggugucugggacuggcacuguguguggcagaaaugcccacugagacugaggccuuagaggacagauugucucccacaggagguaccccuacuccaucugagggcuaaggccaccucagcuuuuuuagccugguuugccuuaagaaacauacuccugaaucagcuuuggaggugcugacgcuagccugagcagugcagaucuggcugcugccccucaucaugggagaauuaagggggugcugauugcaccaccaacaagcagguucuggguguugcaggcaguuguugggugauguuagagggauuguggccaacagggggagcaugugaacugcuguuuuggaaacugcuuugaaagggucuuuaauuucugagacuaagagacuauuuguacaagucucgguucagagcuuccagcuucauaugcuaaggcauuuuuauugaguuugguuuuucucuguggggauggggguugaaccuagggcuucgagcaaaccaggcaggugcugugcucuugagcgguaguuccagcugucuuguuguuugacacaggaugacacuaacguguccagguuggccuuggauuuguucuguaacugugacaggaacuugccaccuuuuaccucugucucaguggcuggagucacagguuugugucccuagggugagcaggcacugcauccucgucugcuucccacguugcuaauguuauccucguacugugcugaagcauagugaccaggacagucguccuggcccagagcugucacucacacaguccccguggggaccaacagcgguggcucccaaggacccuuaagaacccgggcgacugccucuugcaggccucuccagcuauguguguggcagccuugcuguguguggccccgagguaaccgugucugcucccucucagguuugacagugucagcugcaccuacuacuuuuacugguacucacgggcugccugcgcggugaggccucaggaggugaccauggugaacggaacgcucaccaacccugugaccggcaagagcuucagccucggcgagauuuauuuuaaguaaguggaagccugccuguuuggcugacacacacuccgagggaacaagaccguaagucuugcccuguaggcaugcugccagguaggcagucuaggcuucagugacaguugggaagugaccaaguuuggcuuacaccaagcaaaaggacugcuucuuugucauuugacacucaguggugaauuucuuauaaaaagcaguuucccucugcccuuacugcuggagccaagagucucgggacacagagagaacaaggaacucugggcugaccagcauguuagcuaaaaguaagguccaucucuuagcggugucacgggcugucuuggggcaagugcacugcaugugcuguccgcagugugugagauagugcagucauuccaggaggcggggcugggcaggccgauguagcguuaacggcaaggaguguuagagaagggcuggagcaugcagaggaaggaguaugaccgcugugcucuccucugccucaggcucuucagcgccucuggagacaugaggaccaauggggacaacuaccuguaugaaauccagcucuccuccaucaccagcucuucuuacccugcaugcgcuggugccaacaucugccaggugaagcccaaugaccagcauuucagcaggaaaguaggcaccucugacaugaccaaguacuacguccaagguaacucgcaguuuccuguuagugguuccggguacagcuuuucacagggagagcuucccgugcucauccacacacccacggcauggcugucucacacacccacggcauggcggucucacacacccacggcauggcggucucacacacccacggcauggcugucucacacacccacggcauggcugucucacacacccacgcauggugagcucacacacccauggcgugacaagcucacacacccacagcauggcggucucacacacccauggcguggcgagcucagacacccauggcgugguggccucacacacccacggcauggcgaucucagaccuaugucagcucccuuuacgagcuggcgcuacucugaugggccaaggcaggagacgucacagggcacacucacugcggccuggcguuaacaugcuacauccuccuucagaaacggcaaggaguguuagagaagggcaagagggagcuggucaguggggaagggcccucccggcugccaagcccgaagaccugagcuucacuccugagacccacacgauagagggacacacacacgugcaugcgcacacacacgcauacgggcgcgcacacacaugcacaguggaggaauccuggcaagcucagugagaugggugugggaagguuguagauggcaccaggcauucuugugcucuugugacuauguuccuggcaggucacauguguaucuguauuuuaaauaacuuaccauucaccauauaauucuuguaauuuguuuuuuugaacuguguggcccuaugaacuuuuaaaauagcauuuugagaugaucaagagaacauggacugauaagagugagguuagaucaggguccauuuauacaccaaguacuagcucgguggauuuccacuucagucccauuuggaaaugugauugaacacucuuggaauuaacugaaaacugcugucuugaugcaugcaguugaucacaguagauguuuaguagaugguagucacucaugacaagaugcucauggaagggguggggucauguacagcucuuccucuggccucuugcugggcugcaaccacuguggggacacagugaggugugagccucuccuguggaccgaggcugugcugcagccacccccauagugaggugugaggcccugcauguauugcuggccagcugaguuuguucgcugagccucacaacuuaggaccuugcugaauuuaagugucuaggcacaauugguugguguccugguggucagucuugcucuccagguagaaugagaccuccuggccagccaccauaaauuguccuagcagccaaugagguuaaagucgucccuugcuuagggugcuguguaaagcugugaaggcagagugcacacaugggccuuugcggguuugcaccuuuaacauuaagccugugccagcuuugacagaccauugaagcauccucuuggugggugcuaauagugcuugcugucuccuuuccugugugacagauggagaucuggaugugguguuuaccucuuccuccaagugugggaaagauaagaccaagucuguuucuuccaccaucuucuuccacugugacccucuggugaaggaugggaucccagaguucagccacgagaccgcugacugccaguaccuguucuccugguacacuucagcuguguguccucuggggugagugugaugcccaugucccucucacaugacuguucaggaguaagcaugugugugucuccuagguagaacacuggggagguugugggugugcccacaagauuggcuugcugcuaucuggucuguggcaugguuaccauugcucuuugucccagguagcauugacugugcuucccucagcuguuggggagcagggcuggcuguacccccuucagcauucucugugugcucuagugugcacuugacauggcgaagccaaugagaagcucccucugaaugccugucgaguguacuccagaggcuggguuugguggguagcaaggggagugcacuucuguucugagaccuccaggccagagaggaggaaacugguggucuuguguccagggccauauuacaugugaaaacuaaaacccauuuauuuauaaguaauccuaaguuucaaugagaaaucaaagguagaauuugaagaaauuuuaaagucaaccugucauagauauccccucuacccagaagcccugggguuagguccuaaggugacccaguauaggagaagcccuacuuuugccuggcccagaggguuuugcagggcugggcagacccaaaagaaaugauguccuuggcugguccacgucuucagcuccugguauuuauuuccugaucccuaaagcaguaccaucugcagucggccuguuccugacugcuuuaagugaagucuccaggcauuccacauguuguuuucuaugucugguggauggcguguccuggggggccuggcucagcuggcauugguucaguaggcagguccuggucccugggcuccugggagagcuguucgacacaguuccugacaaagcucccucuccucccgugugauuucuuucuaguguggacuuugaggaugagagcgcagggccagaguauaaaggacucucagagcggagucaggcuguuggggcaguccucagucuucuccugguggcgcugacuggcugcuugcuggccuuacugcugcauaagaaggagagaagguaaggugggcagcacaguaggaggacuggguggggcaaguagcacauugaugcuuggacacaggcuuggguuuugagccugacacagcaagcaucuagauugagaauuccaggaguggggcucaugcagagcaguggguguauuucugugggaggggccagugucagaguaggcugggcacaugcacaguguguuccuacugccagccuugggaagcuuaaggugcagcaagacucauucaucugccucgugcugggcccugugguucuguuugugggacacagcccuuaggaguugcacagacucgacucagggccagcuagcugggucccuugucccugcucauucugcuguggacuuacugugcucuccauuuugacagggaaacugugauaaacaagcugaccagcugcugcagaagaagcucgggcguguccuacaaguacucaaagguacuguccgcugagucgggcagcugcuggcugagggcugccccgugcugccucagccuguucugcaugcugggaaggaagaguguguugguggcuuggcauuggaaagaaaccucucacccugacaccacuucuguggacuuucugccuucaaguuucucacagcacaguuccuuuagaugaccugauaucagucuguucccaggcuuuggaggauuuuuuuuuuuuuaaggggaaaaaaaaagccauagugcuggaauuucuguacuccuggcauuuggguaauuucagauaaacuuugauaaacauugaaaagaggccggucagaggauucagaugugcugcuaguuuucauacacaccgccaaaucacuucuuaagcuaaguugaggcugggaagauggcaugguugguaagcgcuugaaaaggaccagaguucaauccucuaggacucaaauaacaacaaaaaccacaugcuagaagcccagcagguagggaauucaaaacggguggggcucugggccuguguggcagccagccagccucgccugcuuggugagcucuaggacagugugagugagaccuucucucaaaaccaaagcaaagcagaaggaccaagguggauagacacccaagccucuccuaugugugcacacuuaagugaaccugcacacauuuggaauacacauagauaaauacaauuuaaaagcuaaaugcccugauauaagcccuuccugugucuucuccuacacacuggacgcccagucccuagauacaguggcccaggagagucccucucugccagcacugcucaacagucaugagcccugucagguccugucugccuggccagcucauuuggcuaugaggcucuugccacaggcucuacuuugcagguucucaucucauaccccagagagaggcccugggguggccuguaucaggagagcucuccugcagcagacaggucucuuugcugagucucauggucucugcuucuguucccuguuaggucagcaaggaggaggagacagaugagaaugagacagaauggcugauggaagagauccaggugccagccccaagacuaggcaaggacgggcaagaaaauggccauaucaccaccaaggcggugaaagcagaagcucucucgucccugcauggggacgaccaggacagugaggaugagguccugaccguuccagaggugaaaguucacucaggccgaggagcggagguggaaagcucacagccccugagaaacccacagcgcaagguccugaaggaaagggagggugagaggcuggggcugguccgaggugagaaggccagaaaagggaaguucagacccggacagcgcaagccaacagccccugccaagcugguguccuuccaugaugacagcgacgaagaccucuuacacaucuaacuccguggugccuacagaagaagguggagccauggacagccaagcaccuccaaccaaauaagacuucagcucgaugaugcgucugucauuuugccuuuaacaaaacugcuucaaagggaagaguuucuguaaugggggagaggaugggggaggugggcaccacuccuucaugaucguuuacagucaauggaacaagguguugcuugaaucggccaaagggcgguacuucgugcccagggguuugccccaaguccucacuuacgaucauagcugcugugugcuuccaacaggugcccaagccacaugcaucucacaacagagggcuguguuugaaaaaaacccuugcugcuuuagacccuacggggugaccauuuauauuuuuagcauuguaauucucuccccuauuuauugacuuugacaauuacuacucagguuugcgaaaaaggaaaaacaaaaacaaaaacaaaaccaguuucuuuugccagcaagggcauaaggugaagcuggccgucugccggagccguuguccauggcuccugaacugguccuugaugcacacuuagugagcugcaguauucuauucuucgcuuugcauuuugugagggcacacacacaugcacagguccccgagugccuagguuugggaaggcccaccugcuccgugcccuaccucaucucuguaguugcagcucuuugcacgaaucccucuggguguugcucuugccagcuggugacucccagcagcucacccaggcgggcguucgcgcacacgguggaguggaggcucuuggggaggagcugcgcuucagguuugagcuguaggucucaucucuucagggucucauagugccaccuuuacugugcuuuuugcuuuuuuuuuuuuuuuuuuuaagggggaaaauguuuaucacccauucgaccuauaagaagccuuaauuugcacagggugacuuauuacagacaccgugaaacgcggugggccaguguugguguagggccaguguugguguaggggcugugcuagggcagugucccaggauggaagggcaggcccaguccacuggcuguggauucuuuucuugauguguucagugacuugucacauuauagaguuguauauagguggcauuuacauacccaaaagcaaaguaccccgcagaauuucuugguuuaugccugauuuugcuagcuuauuugauuucacauugaguguauuuuuaaaaauugauuuuucucuucauuuuuaaucaacuugacuguaauaugaaguauucaauuucaauaaagauaaauuauuaacuaggu

SEQ ID NO: 12552 - RNA, 25742 nt, Mus musculus
cgggcccgcccuucucuccggccgcuucccuucccagccccgcugagcuugcagagccccgacggggccggugcgggcuuccgcggacugucuccgugcggcggcggcguagugccgcugccucuccgcgccccgaggucccgagcggggccgagccggccgccccucgccccuucucuccagaggcgcccggcgcggugaccgaggaggcgcccgagaggcgcgucucgggugagugggccacgggcggggucuccgcggcgcgcucggggcggggcgcaguccgggcggggcggggccggcggcagggccggcuuuccucccucagcgccauuuuguggcugcgagacccgcaaauaaagguucucgccagcgcugcggcgggaggagcgcgggggggccggcggcggcgcggccucggccugugugacuggcggcgcccgcgcagccucgggcugggaagguaggugcagcccgcagcgggaauggccacgagggccuguggggccggggagcgaggcgcggccgcccuagacccggggaaaugcacuccgggccggaagggcgaccgggccugcggccgugcagguuucccguuaggcagagcgguuugcugcccguggggauccuugcaccgcuucgcggccauucuacuuccgucccugacggcaggggacagggcgggcguucccgcggccggggaggcggggaggccggaggccgcccucucggggcugacuggccaugccgguccuuuccccgccucugucgcccccucccaccuuccaggguucgucaccggggacccagagguacccacaguucuguauggcacaagugaagcauucuguuuuguuuuuuggguuuuuuuuuuguuaaaaacaauuccguaccacguaguagcuugucuuugcaaccacguucaccuguggacuuccauuuuuacauaagugcaugcauugugagaguaguucuuuuuuuuuuuuuuuuuugacagcuuaguggaauuuuucgugaacuucuagucuaguuuuggauuucuguauggcugauuugaccguauuuaaaauuguuuugcauaagacagcgggugcacgguagaacaagaccuaaguuuuccucucuguguacauguuuuaugggcguggggggcggcuaggccuugugcaugcacgcuaggccagccuucugccguucagcaauuccccgagcccacaguucuugguuugagaaugaggaagucaguuaauuugaccccaaaggacuaagaauacacuguaagcugguuguaaagaucggugagccuguuaaagcuucaaggagcauguuauaauccucuacguuuuauuuacgccuuuuucaucguuuucacgcucuacccuagccuuuucauuuaguuaauuuuauuguuuggaaagauagguggaagucacagaucaguuacuacaaauucuaccuuucuuucccuuuagcuuauguuugagcuuugggacuggagaguuggcucagcaguuucucuuccagcaccggaaugauggcucuugaccauccuuaacucuuguucuggaauuuugacuucccacuucugaccucaguggguggcaucaggcgugcacgugaugcacauauauacgugcaaaacauucauaaaacauuuuuaaaugcggucuggagagagaugguucagcgguuaagagaacugacugcucuuccaaaggccugaguucaaaucccagcaaccacaugguagcucacaaccacccauaaagagaucugaagcccucuucugguguaucugaagacagcuacaguguacuuaccauauaauaaauuuaaaaauuuuuuaaaugccuuuuuuuuaaacgcuuuuuuuucuuuuaaaccaagcaucauguuuucuuauagguaaacauguagacgauuugaaacuauugaaaacagacauuuuugagguggcuagguuucacucauucauucacuacugcuggggcaaguuaggggagguugcagucuacaggauggcuucugauaugauugaaacugaauuuuaaggauuugggcagauggguuucuaagagugcuuuaguucuucacucuuaaacagaugaguguguuuguacacuauguuaugacuuguauuuuuuguuuuuguuuugguuuuuuucuaguucauuuuuuuccuuuuuuuaaauuucauuuacauuuccaaugcuaucccaaaagucccucacacgcucccccacccacccacucccacuucuuggcccuggcguuccccuguacugaggcauauaaaguuugcacgacuaaugggccucucuuuccacugauggccgacuaggccauuuucugauucauaugcagcuagagacaggagcuccagggggguacugguuaguucauauuguuguuccaccuauagguuugcagaucccuuuagcuccuuggguacuuucucuagcuccuccauuggggcacugugauccauccaauagcugacugugagcauccacuucuguguuugcuaggccccgguuuuguuuuucuuuuucuuuuuuuuuuaauuaaagauuuauuuauuuauuuauuuauuauauaugaguacacuguagcuaucuucagacacacuagaagagggcgucagaucccauuguagaugguugugagccaccaugugguugcugggauuugaacucaggaccucuggaagagcagucagugcucuuaaccacugagccaccucaccagccccgguuuuguuuuucgagacaggguuucucuguauaguccuggcuguccuggagcucacuuuguagaccaggcuggccucaaacucagaaauccgccugccucugccuccggagugcugggauuaaaggcgugugccaccacgccccggcaacuuguaauuuucaagccuccucuugucauauguaucuaauguaggcuccucuuguaaauguuagccaucuagauuauugguguauaauagaguuguauuucuuguaucguggucuuuagaagcuuuacuuuaucagcuuuagcaaaucaagauauaagauagcauucuuaucuuuaucuccacuuuccugccucuaaauacuuuauauuucuugucacuaacuaagcuuggggaaauuuuucaguauucccauaauugaauaagcuauugauacaggguguuaggcauuuguucuuugccugaaagaugauguugguagaguuuauuuucucuguugauuguguucaaacaaucuuuguuuauauaguguuuuuaugguaccaauaacagaucugcagcacuuuguacaccaagcaacacuggcauuuucuuugacugauauggaaacugaagcccaaaguauuaagugacuugaucaaauaaagcugugagacugaaauagcauucugauuucuaacgaguucucuuacuccugcagugcugauacuucagcacugccagacgaugccauuucuuacaucgugauuuauuuuagcaaggcauauacauaccuucuuucauaaacuuacuuuggccugugauugccuuucuccagagaguacuaaguugccuaacuuaggaucauaguguuaugaucuggaaugcuaggcacuuaguaauuccauaacccaagcuaggcuuuaagaguagauggcauccucuauauucuuuauacugucuacacaaauaacuuaaguuuaaaaauauauuuauucgguuuuauguuauggguguuuugucuguacgucugucucuguaccacaucuaugcugugcccuuggagguucagaagaggauaucagaucccuagaacuggaguaacaguuguuaugagcuacaauguaagugggaauugaauccugaaagagcagucaguauucuuaaauucugagccaucucucuagcugcuucccaccuuguguaauuuuaaaaucagucauuggacgcuugccaaauuauucguguuuuaauuuuucuguuuugcuuuuguuuuuuguuuuuuuguuuuguuuugauuuuuuugguuuuuccagacaggguuuucucuguguagcccugguuguccuggaauucacuuuguaggccaggcugaccucgaacucagaaauccaccugccucugucucccgagugcugggauuaaaggcgugcgccaccacgcccggccuugccuuuguuuuuuaaagaauuacuuauuuagguguaugaguacacuguagcuguccugagacgcaccagaagagggcaucagaucccuuuacagaugguugugagccaccaugugguugcugggaauugauugaacucagaaccucuggaagagcagucaguguucuuaaucacugagccaucuccccagguguaugucuguagcccuggcuggccugcaacauccuugcuguguagaacuugaaacucuccagccucugccuccugcgugcuacugaacgauguaugcugugcuuuucugggguuuguuugcuuguuuuguuuuguugagacaggguuucucuguguagcccuggcuguccuggaacucacuuuguagaccaggcuggccuggaagucagagaucugccugccucagccucucaagugcugggauuaaaggggugcaccaccaccacccggcacagugagauuuuuaauagagaagauuuaauuuaugauaugcucauuuagaguguuuuccuaaaauacugguuucuucuguacaacagaccugauugagagccaaggggucagugguggugugacuagacuauuucaugcauaugggaguauauguaaauugauaauggaaaaaucuuuauuaugacaagucaaauauucauuaagaaauuaaauaguuuuuaaaaacaguauaacaaaauguucagucaaaaucuuuuuuuguuuauuuguuuuguuuuguuuuuuugagacaggguuucucuguauagcccuggcuauccuggaacucacuuuguagcccaggcuggccucgaacucagaaaucccccugccucugccucccgagugcugggauuaaaggcaugcgccaccaugcccggcuucagucaauaucuuaaucauuuagaauuuugagacagucucuauguagcuuuggcugucuggaacucucaaugcaggguggcuucaaaauacagggguccaccugucuauccuuucagagugcucaaauuugaagcauauauuaccacacccagcuuauaguuuagaauuuuugauagguauaguuaaguaaaauaaagugggaaaaauauaagguaacuuugggaacuaggaucuaguaauaacugacuccuuguuaaguuugaauguuagaaaauaucagguguguuauuacaggaacuuuuuaagauuuagucauugcauauacaguauucugcaugcaugcacacuugcaugcuggaagaauggcugugagccaccuugugguugugggaauugaacucaggaccucuggaaaagcagccaguuguccuaaccgcugagccaucucucuaggcccuaaagauuuauuuuuaauucugugugugugcuagugugcauaugcuugucuguggaggccagagguguugguucucccuggaacuggaguugugagccacuuuauaugaauucugggaacugaacuuagaucuuugagagcaauuaacugcugggccaucccuucaacccaagaauucaugguuuuuguuguuguuguuguuguuuguuuuuugguuuuuggauuuuuucaagccaggguuucucugcccuggcaguccuggaacucacucuguauaccaggcuggccucgaacucagaaaucagccugccucugccucccgagugcuggaauuaaaggcgugcgccaccacacccagcagaauucauguuuuaauuguguauaaauuauuacuucaaaacaauuuagauuuaaaaaaaauacugucccucaaacugagucaaguaauguuuagugcucaaaaucuucaaguggagguuuuguauuuguuagguuagcugucccuauucugucuauuuauuucccaacuuguguagugcauuguuuaagguccauuuguuacaugguucugucuuuaagguauauauacuuuauauuuaacaucguuagaguguagugaaucacaugauggcuucugcuuuacugucacagcaaugcuguacaagucaaggccagcaaacugguggccggugcugcccuucuaggccuuuagcaacaggccucgguggccuucugaggccugacuuacacuuuuuuaaaaauaauauaaccacgaugaugaaagauguuagcaaagaggaaauuuggugaaaguuacggggguacuuaugucuuuugugcccuuuuuuuggugguuguuaauugaagcuauccugggcuaacuaaccuaaauugugaagaguccuagguugaaucccuuucacuaaaaugaaugaagggaccaaagugcugugaaauacaagauuguuuaauaacuauuucacaaaacaguuuuguuuugaggagaaaaaacuuuaauugaaagaaaaucaacugaaaaucuuucccccacccccaccccuuauuuuucagggugcaagaugaccaacgaagaaccucuuccuaaaaagguaugucagcagcuucaaacccuccuuucuuagaguuuaaggggcuauucuauguccuuauuuuccacuuccuuuaccuuguacuuugcaucaagggacuacagcuuuaagaugucucuguaugugcucaguuucacagcuuuuagaaggcauuacaguauuccugugaucuucacuucuuagccuguauuacauuaccauauacacacgugaacaauuucugaauauuuuacagauuuuacacacaucuauacacacacauguauguauauguuccuauuuuugcuccuauuuuguuaaacccccaggguuguaacuuaaaucuauccaccugaguauuuuucaaggcuacaccuaauuaguucuuguuuuuuuccuuuauuuucuaacuuuggauguucuggcucuauaguccuuuacugaguuuagcuaucauuacuuauagguaauaacacuacauguauccugaaguucuguuaaacagugugcuauaggcuauggaaggauuuguaauucaguuuggaaaagcguaauguuauauaaaauucugccuaaaguuuuggagucaacauuauucaggagugaguaaugaacugugguuugcuuucucagguucaguguuuuuuccuguuuuguauugugacacuaguguuacugguuaauacuuagaaacucuuuaaaguguucucugugcuucuaggaaucaaagucugcuucuugcaugcugugcaggcaguucuccuuuugucuaggcucccucuuccaagaauuuuuuuguuuguuuuuucguugguuugguuugguuugguuugguuuuugguuuuucaagacaggguuucucuguauagcccuggcuguccuggaacucacucuguagaccaggcuggccucgaacucagaaauccaccugccucugccucccgagugcugggauaacaggcacacgccaccacugccuggccaagaauuuuuuuuuaauaagagaaauuaauagagccauagaaaaagcauuucuaggggcuggagaaugguucagugguuaagaacaccgacuacucuuccagagguccugaucaauuggaagcaaccacaugauggcucacaaccaucuguaaugggaucugaugccccucuccaggugagucugaagauagcuacagugcacucacauacauuaaauaaauacuuuugaaaaguagaaccuaaguugaaauuguuucaaacauuuagaaaugcaugcaugcaugcaugcuugcuuucuccuuucuuucuuucuuucuuucuuucuuucuuucuuucaagauuuauuuguuauuagguguaaguacacuguauccgucuucagacacaccagaagagggcaucagauuccauuacagaugguugugagccaccaugugcuugcugggaauugaacucuggaccucuggagaagucagucaguacucuuaacuguugagccaccucuccagcccucaaacuauugaaaguuguagauugauaagauguuuaguaacauucuaugagcuucuuucaaaaucagcaucuggauuaauaguuuaaaacuagggaacugguacacucacaaguuuuucaaauuucuucauuuuuuucaaacguucucuauacaacugcaguuguaucucaagauaagcaucugaauccucaccacagggcacuuugaugcccucccucccuccuuccccaggcuuguagugauaauccauuuuccaguuucuuuaacuuccugagugccucaggaaggaaaucaggcauguauguccuccuaagauuaucuuuucacuuuguauugcauaucaguaaucuuauuucuacuugcugcugaagaauauugaauauauggcuggaucaguuuuucuguuuuauuuuuuuucugguuuuucauaacgauuucucuguguagccuuugcuguccuggaauuugaucuguagaauaggcugaucuuggaacguacagagauccaccugccccuguauuauaauuauaguuuuacaagcauuuaccuguuaaaggacacuuggacggcucaaggaugcaaauacugguugauguggugugugaaaguuuaaucugacugaugugaguuuuuuauuucacuuguuuguuugguuuuaauuuuuaauuuuuuguguaucuguauuuugggaaugcucugaaguggagaaaugguguccuuuggagcuggaguuccagacaggugugcacucugacugauuagguauugcgaacuaaacugguucucugaagaguuccaagcacuguuaaccgauaagcuuucuccaaccuucacauuuaguuuaaagcuauuuucagaguuguuccuguggaaaacacuuugcgcucugaaagaauacucagucuguuuuaaauuuucuuucuagguccgacugagugaaacagacuucaaaguuauggcacgggaugaguuaauucuaagguaaaauguucuuucaucaaaaauacauauacaucauacuaugacuaccuacuuaccauuaugccaucccuaguuuggguuugcuuguucugugggguuuucuuguuacugauuguuugagacagugucuuccuauggaaauuaagauccucuugccuuagcccaccaagggauaggaauacuggcauguuuccacuacaguagcugacaugguuguuuguaguguuuguuuggggguuggcuuaauuuggguuuuuuauuuguuugguuuugggggguggggguugggguauguauguggggaguuuuuguuuuaaaacaugguuccuuuguguagcuuuggcugucuuggaaccucuaacccagaguuccaccugucuuuaaaucccacugcuggaauuaaagacgugugcuauuauuaucugauucagugugacuuuuuuuuaauguuaauauagccucaagucacuugaaauauuuuuuuggauauguuuccuaugauucuucaguauguaagcaagaagaacuauaauauuaguuuaggugauucauagauugauagcaaccaaauuuucuuuuagagcuaaaauacucaagauuaguuacacagaaagcauuuauauuucauauauaccuugcuagagaauguguuuaguuuaauaaaucagcaagcucagggagggcacaaugguucaguggguaaaggcccuuucuguguagaccuagcuguagcccaagcuuaaucccugaaaaacaaaacaaaacaaacaagucuacaagacgguuccuuagucucuuccacauguguaccauggcaaaugugagcccauauacaauaauaaguuuuuacuaaaaacuauaggaaugggggcuggugagauggcucaguggguaagagcacccgacugcucuuccgaaggucgaguucaaaucccagcaaccacaugguggcucacaaccauccauaaugagaucugacucccucuucuggagugucugaagacagcugcaguguauuuacauauauuaauaaauaaaucuuuaaaaaaaaaacuauaggaguggguguuuuucugaaacaggguauauucaaguuggccucaaauuagagaucucccuuagucuucugaauauuagaaauacaaggguauauauacuaaaauagucugacagguagucuuauuucaauacaauuucaaaggaugaucccuacccccaccuccagccccaccccuaccuccaccccuagguuuuucacgaugggguuucuauauguaguccuggcuguccuagaacucuauaaaucaaccaggugggccucugccucccaaugcugagauuaacauuaccacuaccugggucuuuuuguuuuagucuugcuaaggugccaagcuggccuugagccuuuguagguaaccuaugcccaaccuauguguauguucuuuugccuuaccugucuucuguaaauugugaagaagcaguaaagcuaaugaaugcauuugcucauuaaacuauguuuguaauuaugucaaaguuaaguauaauccagcacaguuuuuacucuaugauaaugggugugcuuuccuaguguauuuaauauaaagguaauuucaauguaaccacuaauaugaauuuccuuuuuacuuagauggaaacaauaugaagcauauguucaagcuuuggagggaaaguacacagaucuuaauuguaaguuugauccuuccuagauagagauaguauaguugucuuuuuuuuuuuuuuuuuuuuuugugguuuuuugagacaggguuucucaguguagccuuggcuguccuggaacucacucuguagaccaggcuggccuugaacucagaaauccgccugccucugccucccgagugcuggcuucuauuuauuuauuuauuuauuuuuccuuugucgauuuccgagacaggguuguugcaggaguauucuugguuuuguuuggguuuuuugguuuuuugagacagguuuucucuauguagccuuagcuggccuguuacucuguagaccaggcuagucuugaacugaucuaccugccucuaccuccagagagcuaggauuaaagguguguuccaccauaacccugcuugagacagggucucauacuauguagcagaagcuauccuggaauuaugaucuccugccacaggcuccugagugcugugauauagccagguuucugcucugccaggccaguuaaugucauuguucuauugaguggguuagaauguauuauugugaguuuuauauauuaaauauacuauaaaugaguguaggcguguggucuccuguguucaggugugacugguggaguacagaagcagcucagugugacucccuggggagcucuuccgagcaggaacaaauaacuuguguccaaaacugaaaacuuaaaggcguuaaaggcggugaauuuuuugauuaaucuugacaagagaauuuucuuuugguuagugaaauuuguaauuuugauuucuuuuacucagcaaacgaugugacugguuuaagggaaucugaagaaaaacuaaagcagcaacagcaggagucugcacgcagggagaacauucuugucaugcggcuagcaaccaaagagcaggagaugcaagagugcaccgugagugucuuuaaauagugauaauagcaaauauaaguguacuguuuuuaaaggguacaauggagagugguugggaauggagguucuuuuugguguguuuguuuguuuuuguggguuuuuuuguuuuuuuuuuuuuuuguuuuuuguuuuuuguuuuguuuuuuuuuuuuguuuuguuuuuuuuuuuuuugagacaggguuucucuguguagcccuggcuguccuggaacucacucuguagcccaggcuggccucgaacucagaaauccgccugccucugccucccgagugcugggauuaaaggcgugcgccaccacgcccggcugggaauggagguucuuauguuugcuuccaucucaauuccuaauuucuauggagucuguguaccuuuugcuaucauuaggcaauuugugcugcuugcaauugaauaugcaacuguugugcauacaguggcacuuugagucaccagggcuuugaggacgauggugcucccaucaccuuuugagauggguuuuagguuuuuguuuuguuuuguguugcguugggauuuuuuaucuaucuaucuaucuaucuauuuugccuuaagcuuuucuugucguauuuuuaauauuuauuucauguuuaugagcauuuggccugcauuuaugacuccgcacuacauguuugccuggugccuguggaugccagaaguaggcauugaauccucuguaaaaggaguuacugaugguuauaagccacuauguaagugcccgagcaagagcagccagugcuguaagcacucaacacauuguuuaugcccuucccuauguaauacagccauuauucuucuaucuacaauucaaaggugaggcuuugcaggcagcacuggggacaaaauagggaaaggauacauaaaguuggaguuacggguauggcugaaacuugguuaaggguuuagggacuuguuuuacccuagguauaaguaauagcuggaguuuuuugguugguugguugguuuuguuuuuuuaaaguuuuguuuugugugacaauaugucacuacauagcucuggcuagccugaaggacuccuuauguagaccagacggggcuugaauuuacagagauggaccugccucugccuuccuggugcuguauuaaaggugugcaccacucuguacagcuacugguggaaaauuuuucagcaaaagacucaugagguugguuaagucacugguaccugggaagggugucuuaaauagucuucuaggcacagucaguaggaccugaucaauuagaucuuguggggcaagcuauuuaauaagucauagguaggucucauguuuauacugugugacugugaaagagauggaauuuagaaagagaagagcauaaugcuagggaaacaggaacugcaaaucaccucuucuguccacccaccaccagcucaccaguuaagaaccacugauaguuagauguaggcuagagaguugguucagcuguuaagaguacuuguucuugaagaggacccagguucaauugccagcaaccaaaugguggcuuacagacuaacucuagucccaagggacccaaacccuuuuucugacuucuccuggcaccaggaauacaaaugaugcauguacacauguguaggcaaaacacaacauguaagaaaauguaaaucuuuuuuguuuugcuuuguuuuuugagauagguucucuauauguaguccuggcaguucugaaacuuacugugacacacugguuucagacucagaucugccucugccacuugagugccaggauuaaagaugugcacaccacaccuaaaaaagaagugucgaggcaaaaguuaguuuuaguaaaaauaggaauugaaaacuuuuauguuuagcagucagaaagauaguaggcuacuuuuuaguaggaccuauugcuuugggggcuaaggauaaaaguaagaauggaguaauuaaagcaggugauaauuucagauaguuaaacagaacuaagagaaugucuguaggguucagagccugaguucagaacugcaguaccagguaaagagcugcacauggagagcccugaggagccaguggagcgaggcagaccucuggggcuuccuggcugcagucaacaagcaacaggccagugagauacuuugucuccaaaaacaaaguggauguugucuagggagggaaaauacuagagguguauagccaggcuaacacucaagaugguucucuggccuauacagaaacacagguuuacaucuuuaguaaaauuguauuuaaugugaaagucagaggacagcuugcagcaauucauucucacccuacagaucuuggggauugaacucaggccaacagacuuagcaacaagugcuuucccccauuagaaaucuugcuagcccuuaagauuuuuuuauuacuauauuucauuuauuuauuuauggauauuuuaugaccugcguauuuaaguuagaggacaacuugugggaguugguucucuuuccaucauguggauccugggaauuaaauucauauuaucaggacugacagcaggcaccuuuagcugcuuagucaucuugccagcccuaaaacuuuccuccuguuuucuucccuggcaaaggggaguuuguucugguuacauucgucuccuuuucuauucgccuccuuuucaugaccaaaagugcuaacuguugggauuuaguuugagucaguguugugagauuguuguaaccaaugaggagagcacaugagacacacugacgugauguuauuuaacucuccucuuaaaauacuuuaguagcgcugggcagugguggcacacgccuuuaaacccagcacucaggaggcagaggcaggcggauuucugaguuugaggccagucuggucuacagaguuccaggacagccagggcuacacacagaaacccugucuugaaaaacuaaaaaaaagggggagggaaaggaagaaaaaaacaaaacaaaaaaaaaaccuuuaguagcuagcaguacuuugaauuaauggguaaacuuucuguuuaaaauuaauuucuuuuacauuuuuccaaaggagcugggcaagaugaucuaaugguuaaagugcuugcuuacugcuugugcagaggacuggaguucccuuuccaguacacucaguucccuauauaaaugcagccccagggaucugauggucucuggggguacccucaggcacaugcucauacugacauacagauacaaaaauuaaguaaauacuguuagagcaagcuugggcucauggugcuauccugcuguguacaguauggaucucugaauuccaggcuggccaggucuacauaauuagacuuugucucaaaagaaaaacauaguaucuccauaaauauucuuuucuauuuguguacagugaacucauaaauaaauguagucucaagucagucaguauacuugugucuucuacuaaauuuaugguaaggaauuuaaacuucauuuuauuaaaacauaggguaggguagaauugacuauaugacucaguagucaaagaugcuugcuacugugcuauauagccugaguucaacccccaugacccacaugguuagaggaagaggacugcacuuaccccauaagcacaaaauaauaaaugucccagcacuugggaggcagaggcaggcggauuucugaguucaaggccagccuggucuacagaguaaguuccgggacagccagggcuacaaugagaaacccugucuggaaaacaaaacaaaacaaaacaaaaaaaagaugcuacaaaauuucacuaauauaaagauauaaugucacuacuguuuuaaauuuagaaguggaaauugugugaaauuuaaccuuucugugggaguuuuauguaguuuaagcaaaaaguaagcaaugagaaacccugucuggaaaacaaaacaaaacaaaacaaaaaaaagaugcuacaaaauuucacuaauauaaagauauaaugucacuacuguuuuaaauuuagaaguggaaauugugugaaauuuaaccuuucugugggaguuuuauguaguuuaagcaaaaaguaagcuaagaccuuaccaguucuucuauaauaaaauuuuaaacuuugcuucuuucuagcaauugucaguccuuaaaauaaaaacauguugcuuguuuuuugguuuuguuuugaaacuagaucucacuguauaacccuggcugccuuagaacucacugcauagaucagacugccucccauguuccaccauggucaaguuugguuuggguuuugguuuaaguucuuuuuacuaauguuugugucuguggguuucugcugaaggaugccacagguguuggauccacccacccacagccccacccccaacccugguggaguccuaagcaguuuugggcuguccauugugggugcugagagcuagaauucuucauccucugccucuguaagagcaauucaugcucuuauuuauguauuuauuuauuuacuuauuuccauuuuaugugcauugguauuuucccucaugcauacuuguguaugugugauggugucagaucuuggaguuauggacaguugugagcugggauuugaaucccaguccucugaaagaaaagucagugcccucauccacugagcuaucucuccagaccccaguucauccuucuaacugcugagugugauggcaacccugauuuggcuugguuugguuugguuugguagaguuugguuuucagacaggguuucucuguaguccuggcuagccuugaacucagaggcuugccucugccuccuaaguauuggaacuaaaggcaugugccaccauuccccagcuuaugauauggccucuguuuuguuuuguuuuaaugcuguuuugguuguacagugaaaguaaccucaugaauugccuuaaacaaagacguguguuuucuuuuguccccguuuuuccuuugugguuguagagacuaaaacguagggccuuuuucauauaaugccagugaucugcuacuaggcuacauccccagccuuugguagccuucuuuaauuaagacacagucuuuuuuuuuaacucuuaggaagcuuaaaauccucccucuacuuccuaagggcuggaauuauaggcauaugccauuguucucaguuuugguacuuuuucuaggguuuguguuguuguuugaaauugugugagauuugacucaagggucuuguucuguguguaugcucucuguuaaagagcuacacccuuaacuuuagggagacuuaauaucaaagggguacagaccuaacauaggcugacugaguguuuaauaagaguguuucuccucuuagggguucuuugguuugguaguaauuguacccuuugcuuugcacagacucaaauccaguaccucaagcaaguucagcagccgaguguggcccaacugagaucaacaaugguagacccagcaaucaacuuguuuuuccuaaaaaugaaaggugaacuggaacagacuaaagacaaacuggaacaagcccaaaaugaacugagugccuggaaguuuacgccugauagguaaacaaaucauacuccccagucaagacuucccugacagucccaccucgagaaagcuguggugggacagccaaguacucguuuccacaccaagacucagacuuuuugagccaaaaaagccacauucuuauacuguccagcuuguaaugguuaauguaaaacuuagcagaugaaccuuguguuucagcuuuucucuuccccucccccuugcuucagaggccugaugccgucggacuauuccgaagaagaggccaacuccgaaaaauuccccuucuaggacauguagacacuuugaaaaguguuucuguuugaagaaaauagagggaaaaacagaagucuuaagucuguggcacacugugucuucagacaguuucgaggauugaaauccuagagguuuuaaaucaugaauugaacauguaaaauuccaguaaaauguaaaaauggaauaugcaucgcucuuagccaugagcauagugacuuagagacacuguacaucaguuaugccaauaagacuguggacuucaugauuguugaacuacugggucaaaacucaaaugaggugaauuugccuuuaaaggacuuacuuaugcuaagaaccaacuaauagccgugagacaaucacgucauagcuaccaguacaaguagagcaaauauuuauccauuuagcucugagcucuauauuauauaauggagccuuaaaucuaugugguuuuuaucaaugguuugucuuuugaaugguuguggaaacuguagauaaccuuaaccaaggacuguacaaacgugaagguguggucucacacuucagguuuaaaguguuugaagcauuauaagcauucauuucacaacuagauuguauaugguauuuggcugugaugagacucccauuauucaguaaacccucaucucauucagcaggcacauguuaaacagcauugucguuggugugaaaugggggaauguguuccuucauuguauugggccuuuuguaucuaucgaauuccugauauuaaauuaaaugugccuugaaauaguuggguuuuuuuuaauucaaggaauacucugauaauuuuguuguauucaauauuuuacuuuggggggcuauggagagcagaucaacacuuuggaaaauuuauucugugcucuucaaagugaagggaaaggcugucucgcuuaaaagacuauuccagaugguauaaaagacaaggagacuuggcauuuggccccaggauauuacaguagaacauauugugggacagucucacaaggugccugccagaagauuggggaaauaauguguuggaucucugggcuggcccaagugagaugguuugugaauugaaaaagguauagugaucauuucuagcaaacucauuugcucauuuagauaaaugaggcauuauauucuucaugcuuccauccaauccuggaggugaauuuuuuucgucuauaagucaccaguuugaauuuucccuuggugauaauggagucugagaugaguagaagauaaauguuccagcaugccccaacguuuaagugcaguuuuaacaagggugacuuaaguucucucuuaaucguuccaaucaauuguaaguaugcuuauguuugugcuuuaguggacugacugugggcagggugggcuggaggaaugauguguauaauuuuucaggaacaagucugcuucuaaaauugucacuggggguuuggaggguaaguaaaccagucuguuuaaaaguaguuuauugugacaaaauuggaucuuuuguauuuauuucaugcauuuucagguucaugguugaaaugauucugaauauaguuuuaguggguugaauaguaauugguaaaauguauugcuaguauguacucagauuuagccagucuuucucugcugcuugaauacagugacuuugaggccugugggccugcuuucuuguuauuguuaaucuucucucuuaauaagacaauacauguucauguauacaaaugaaauacuagagaaagaugggagauggaaagugucacucauggaccugaugucaaacuaccccauucugcucuacaggaccaguaccacuguuaaauaucuugggugucaucgagauaauuuguggauacacaaugauuucauguauauugguuuuaaagaaauguaaucauaugguacauacacaugcuucaaagcuuuauuauuucccuucauuuuuaucuucuagguauuuuuuuagcauaucuagauuacuaccuuuuuaauggucucuuaguauuuuuuaaucuuauuuuaacaacccaucaaugagguuucauuauauaaaacuaaaccaugugauauaaugaaucaaguacuaaaacuacauuauuaauuugaaaauaaguaguacuuaauuaguaauguggaaugauuccaaugauuggguuguaagguuuccuauauguauaugguauuccugcccuuugcugcaggucuaauuuugagggauaaagaucuuuuuagcuggaugugguggcuuaugccuuuaaucccagcagugaugaggcugauacagaaggagaggggacuuaggaguacguucauagauuuguaucucaaagaauaaacaaaagaacuacuaagaaauggauugugauuccuuccauaauauugucagcucuacacuuucauuugacaacacaaucauuguaagaguguuuaggaauauacuggucauuuucaacuuagucauuuaggcaguuguauguacaacucuacaaaguaaccuggcuuccuucccuugauuauuaagguaauauacugaugccccuuguguuuuaaguauuuccuguuacugggauuauuugguuuuaggagucaccucagcacuuaggaggcagaggcaggcagaucaggaaguugaguguagccaggacaucacauugagaaacaaaaggaacuagaggguuuggcccagugguuaacaacuggcugcucuuccagaggacccagauucaauuuccagcaccuacauggcaacuuacagcuuucuaaaacuccaguccaggagaacuaauaugcuucccucuagcacccggcgugcauguguugcauagacuuacaugcaaacaaaauacccacacucaugaaaagagaacagaaauauuuuuaaaauacaaaggcauuuuauuuuuuaaagacuuauuuguauguauaugugagugauuugucuacaugucuuucucuccaccaugugcauauggaggccagaagaggaugucagguccuuuagaauuggaguuauagaagguugggagccagcaugugugugauggggaucaaaccuggguccuguaaaguagccaguguucuuaacuauugaccucacuuuccagcaccaauuuuuaaauuuuuuuuuuaaugaaagcaauaaccucuacuauccauuuuaaaauaguuguaguuaaguucucucucuuucuacuuauuuuguguugcugaggauuggaucuagggcuuugacauggcuagaugagcacuuuacaauagagcuauauccuuagccuuuucuuuggugaagaguacuaaggauugaacccaugaccucacuugcuaaauaaacucagaguacacucccaggucccucacuguuuuauguguggaguguguuuaugugugcuguuauaaccacaaguacagauuuuauacaacauaguugcuaacauaaaaauuaaagcaguuuugagguauuuuagagguacuccuugagacagggucucucugugugucuagugcuggccuauaaaacuaacuucaguuuaugcuaggacaauaucagccugcuaagcauuaagcuauguuacacauuuuuaaauaaaauacuuuaacauuuuugauauuuuuguauggggcuaaggcaagugaccaauuaauguauuuuauacuuuuuuuuaaagucuuuauuuucuggcuagaaaaucuguuguauaugauuccaagaaacagguagccauaacuuuaauccaauacuuacaaaguaauacaaacuguaagaacagucaguuccagggcagccagggguaguaagaaucuuucucuccccucacccccuuuuuuguuuuguuucauuuuguuuuuuuuuuuugagacaggauuucuuuguguaguccuggcuguccuagaacucgcucuguauaucagguuggccucaaacucagaaaucuugccugcugggauuaaaggcaaacacguguugggccagacccugucucaaaagaaaaaaagaaacgaaguuauuggaauauggguagccaacuagaaggaagaaggagcucuggugucuuuggcagugguguccacaucuuguuuccuuguuagauucuccgugcuuguuuaguggaggcugaacucugaggaggucgauaggaaauguggguagggauguagagcuacaauaacugaaggcaaugguuaaacaaagaaaacuuaauacaugcacucagggcuucuacugugacuccuuugaacauuaguaaccuggguuuuauuguuccaaaaacaucuguaaggaaauuuuaauugcacuuuauuguuguuauugaacuguauuauauaacaugagcuguaaguuaaggaacccuacaacauuaccuguaaaagaguugucuacaaaguacuacuauuuuuagguguuccuaggaucagaugaaaaucuguguaucuggaaagugcaagucccgcuauauaugggaaaaaaaacacucuaguaccaaaguguuccuaacacaauuugaagaauguuaaacuguuccuaugcaagucucaaaguuaguaccacaguuacauauuaaaguuauuucugcuguuauugcuaaggcugaaagcagugagauuuuuauugguuuguuacuugaaauuuugauuacccuuuucaguuguuguaggaguugaauaguuaggacacuauuauugaaaacuaaacuguucuguggcacucauaaucuggcagauaauucaagguuuggaaaauagcccaaaccuuugugacuugguauuauacagucuaaaucacaucccaguauuauauguucaucaggaauaauggcccacaccuguauuccugguguuuaagaaguaggaggauugcaauuuuaacaucauccucuacuacacagcaaaaagaaaggaaauuaugucucaguuaaguuaaauaaggaauuaauggauuucuauuugggaagucuuuuaaaagauacauucuuguauagaaguuauaugugccagagaacugccuaguuaaaggaauccauuauguguguuuccuaguaagaauauauucuuauucuuuuauagguauuuuauagaugauaaaggggcaugcguuuguaauugauacuacacguauuuucuuaaagaaccuuucuguuugaugaauuaguaccuugguguuacauuaacaguuaaauccaacauacacguuaaauggccuauuucuucuugaaaugauaauuuaggaugagaaccuugauacaguaggaacaaaaaguggcuauuuggcacuuuuuguuuaagguuuauuuuugcuguucuugguaaaaauacugaagugcagaagauggacauguuccagaaaagaagaugguaauuacaggguggcaucucuguaacauaguuauguucuguacguguugaugcuccaguuauuaaauugugagcaaaggcuagagagagcuuugucuucaucuugugaugauaggcucuuuccuuugcagccaaacaggcaaaaagcuaauggcgaagugucgaaugcuuauccaggagaaccaagagcuuggaaggcagcugucccagggccguauugcacagcuugaagcagaauuggcuuuacagaagaaauauagugaggagcuuaaaagcagucaggaugguaaggagguuuuuauuuuaacuuugcacuggcuuuauagcuaccagccuugugguggaugagauucugugcauguucuuagaugauggcuaccuaaaauugugcauguaccaccuaccauugacuuaugaaacaaaaccauugaauguuaaaagagugcuccccaagguacuaauagcaugcagggacauuuuucuaaguuugugugugugauguuuuguuuaagguguaagaauugauaacucagugcaugagcaucacuaacagugucuucuaaauauaaaucuuggaaacuuggucauuauacuuccuuaagguacucuucguuuaaaagaggauuuaguauugaaauuugcugagacaaacuaaauguguuuguuacuauaguccuuuuuugucuaaguguagcugcauuuuuuguuuguuuugugaaguggauuaagaguuaaaaauggauccacacuguaaacugagaaccaguguaguuaguugguucuugguugcaaagaaagccaauagacaauguuguugucauuauuaguuuuuacugaguaaacauggaaguggggagaguuuauguaguuuguuguucuuaaagccuuaaagacaaaacaacaaaaaaaaccccaaaaaccuuaaaauugacuuguauacuuuggcaagccccaguuauuuuuuaugauuguguucuuguauguggagcagacuuugguucguacacauacaucuuugugagguuagaguaaaaaaacuaacacugucuugagggcuagagaugcuguagauuuaauuuaaggcccuggcuaagggugaagaaaagggacacagauaagauuuuacaaguuaucaucaauuguaugaggcaggaugguugcaaucaaauuuuagcuugauuucuuuaauauaguauuuaaaacaucaggccacccuccaaauguuuccuucuuggugauuaaaauuccaaguaaauucuuuaaagaaucuauuuuggggucuugguggucaacuagccuagccagaaggguagguuccagguucaaugagaaguaaaaagcuguagaaaagagacaucugguguugacuucuggccucucaaugcacacacauacacaggugaguggguguguguacauacagcagagaaauguuuuaaaauguuaagauauuagccgggugguggugguggcgguggcggugcacgccuuuaaucccagcacuugggaggcaaaggcaaguggauuucugaguucgaggacagccugucuacagagugaguuccaggacagccagggcuauacagaaaacaaacaaacaaaaaauuaagauacuaaaguuuggcucuccuuugcacagaacugaaugacuucaucauucaacuugaugaagaaguagaggguaugcagagcaccauucuaguucuucagcaacaauugaaggagacacgacagcaguuggcacaguaccagcagcagcagucucaagcuucagcuccaaguaccagcaggacuacaucuucugaaccuguagaucaggcagaggucacaagcaaagacugcagucgucuggcaaauggaccaaguaauggcagcuccucccgccagaggacgucugggucuggauuucacagggaggggagcacaccugaggaugacuuuccuucuucuucagggaaugguaauaaggccuccaacagcucagaggagagaacuggcagaggagguaguaguuacauaaacccacucagugcgggguaugaaaguguagacucucccacgggcagugaaaacucucucacacaucacucaaaugacacagacuccagucaugacccucaagaggagaaagcagugagugggaaagguaaucgaacuguggguucccgccauguucagaauggcuuggacucaaauguaaauguacagggugcaguuuuguaauauuuuuccagaaaauuuuuauacagugucauuuaauuggggaaaggauacugucaaaaaauuaaugcauacuuuugucacaauuuaccuuuuuguggguguguuuuuguuuuguuugguuccuuuuuuuuuuuuuuuuuuuuuuuuuuuuuuuuuuuuuuaauugcuucaauaccucugccacuuugaaaauuguaacaguuaauuacuuugaacauugcuaaaaggacauuuuguguagggucaaguuauuuuuauaugaguuaaugugaaguuguaaaugggaaucuauagcaaugaugucuguauaaaucugucuuaucuagaacuugugcugucagggcacucuuccucacgcuguuguuacucaugcaccauucagacuuguuagaguagauguggguuuaggacugccagguuugcccaguauaguaguuuuuaucacuaaaaaguuggacuuggaguccuauaguaguuucagcguuagauaaaguuuuuccaccauacaucuuuaggugcauucaucuuuaggugacugaauguuaagaaaucugugugcauaguuacuaaguuuuuaugaacuguuguguccuguuaaugcauauugcccugugacuccaguauaucucaccuguacugaccaaaccuaaauaaacauuuuuauuacgac

SEQ ID NO: 12553 - RNA, 10282 nt, Mus musculus
uacuuuguuaccuuugcuuuuauuaguauuuuccaaauaucuaaaacaugcauuuuacaauaaaacaacacucaccuuuaaaacugauaauuuacuacagcuaauccugucaggucuaacaguauucaagaauacuaacagucacucaaaacaaaacaaacaaaaucaacaacaauauuccucaaaacaacaauuuuguaaauguaauuuuuuaaauuuaaucuguaaaaaucagcaaauauggcauaaaaaucacguuaacugcaccaugaacucaccgaggucaucucugccaaacuugcaauaaaacaguuuuaaacacuggaaggccuaaacauuagacucaguaaaaucacuguccaugguacucauggcaggcggcgccucucagauaaacaggggcuucgcugaucuaaagagaucuuauuacaaauucacauacuuaggaauuauaauuccuugucugaauuguaauguccuuauaaauuaauguuuaauaguaagccuauuucacuaaaugguuaaaaauaguacaccaucaaaacaguucaguaaugcugucuacaacauuaaauauaacaaggacccaaugagccaaagaaacguauacacacucaggaauuaacaguaugcuguacuguuaugaaacaacuugccacuagauuaaaagcaagggaacccuaaaugcugccagucagaaauccaaguauuaaaauuccaaauggacacgauagguuugggcauauaaaagcugccugugcuuguaugacuaucuuuuuaucaaaaucuacucuaagaaaggaaaagaugacacgagugagcacugagauucucuguuuaaaauaauaaaaaggucuguuuuguccuauucauguguguguguguguuguuaacuguuuucuaaugggagggagaaagaaaagguguggauuuggguggguggggagguagggaggaucugagaggaguuggagaagggaaaacaugaucagaauauauuguauaaaaagaaguauuuucaauuaggggaaaaaaaaaaaagaggguccaggcuggagagaugacucaacgguuaaaagcacugacugcucuuccaaagguccugaguucaauucccagcaaacacagaguggcacacaaccaucuguaaugggauccaaugccuucuucugguguggcugaagacagcuacauugcacucauaugaauaaaauaaaucuuuuuuaaaaaaagaaaaagagcagggugugguggcacacgccuuuaaucccagcacucgggaggcagaggcaggcggauuucugaguucgaggccagccuggucuacaaagugaguuccaggacugccagggauacacaaugaaacccugucucaaaaagccaaaaaaaaaaaaaaaaaaaaaaacuugggacaaauuacaaaauacguuuaagaaaacaaucaauauuaaaaaaaaaaaaaaaauuccgggggcuggaaagauggcucagcgggcaagugcuuauugcucucacagaugauccaaguccccgcucaaggccaccuguaacuucuccagcucuaagggacccagacccaacaagcucuucugucuuccaugggcacaaugaacagaacauacacagacaugcauaauuaaaaagaaaacaaaccuuuaaaaaauacuccacuaacaaggauuugcaugcaugagaggcgcccacggccuuuuugguaauaaacaacaauuaaacaccaacaaacuauugacuauugagcaaccgauaaaacaucacauggacauuaaggaugacaggaagauggugagacgaaugugaaaaggcaaauucacuaaggaccccugugacagauaucuccacagugcacaggaacacagucagaagcacugugucaccuugucagggaaagggcagccuucuauugaauaacaauacaaaggcccucuugugacuguaaguucuugaaacuaaagaaaaaugaaaaaucugugucucuaaaaacuaauguucugaagacacccuacugaccucacucagaaacccauuugccgcuacugagaaaggugccaccacacccaggguccaguucuccagagauauacaauucauggggcugaauggcuucccagaaugcccuguggccuagugcccauggcugacaucaucggacaggcccuaccuacuuuguccaucuugaacacauucauacagcacacuguugguuuguaaagacaagauuagcuguuuuugcaugucugccuauagaaaacccagaggcaccauuaccuuccucucauaauaagcacuccucaagcaggagcaaagcuaugucuguugaccuuuuuucauuacugagguagagcccagggccuugcauaagacaggcaaggcucuaccacugaacuccauucacagccuugaguuacagaguuugagugaaaaaaaugguguacugugaaacugugaccauaaacaaagacuacuaggugauguccacuaaauagaggauuacuuacaaaaaauagcaauuuuuaauagaaaagagaacuauuugguucucuauuucacuauucaacaacucagggggcaggggggaacaacucaacuuuuuuucuaacugcaguagaacaggauuacagacucuccuacaggccccccaaaacagagaugggauauuucugauggucuuauaaugacagcuauagcauccaagcaauucaaggcucuaacgaaaauguucaaucaagagcaauucacacagaguaugcgcuguucucaaauaguugccuaagaauagauuuaauuaaaauaagaaauuaucauagaauuaucagguauguggaaagacaucaauaaagacuacagcaccccagucauagugcugcaaugcucuacacuacuauaaaccagcccggagccuggcacucaauguggccgugagugagguuucacuucuugcaagcuguguaucuuucaguaacauucucccaguugauuacauuccaaauagcuuucagauagucaggucugacguuuuuauacugaagguaguaagcgugcucccacacgucaauccccagcagcggaauaaggccuaucagaaagagggaaaaauuacuccuaaauacaacaucauucacuugcuucuuagauaacugaaaauuugcauaucccugcaaaaacauguaaaguuuuuauuuuggaagaaaauauaauaaauaaucugaaagagccccugaaaggucaaguuaaacuacagaagcuuaaucccugaugcuaaaauagcaauaguggcgccuagcgcugaagcccagccucccuccuagucucaggcaggcaccacaagcgaaagagacagcuaaggcccgagcuuccauuccagagggcuggagggcaggaggcuaagaaacugcuucuauucuccaaggguacuuucaguuuucuggaauaaacaucaaugagucacuaaaaagaauugauuaacaagaaguuaaacagaagcaaagaaaaugaacacuaccuucagaaauuaaaugguauaaaugaagaauuuaguuccauacguuaaaaaaaaaaaaaaaaguaaguccucaagucaguuaugguagcauaggucugugguaacagugcacggaggcucaggcagaagagcacggaauaggccagaccauccugagccucaaagcaagacucagucuuaaacacuucucaagccuuccuaugaaaacaucuccaccacuuuaucuagguaguugugaggaacagaagucauuacuaauaaaguagcaauauuuugugugacuuuucaucccagugugcuuucuguauguggaggagaagggcaguggaagccacaccucucaguggguacccgaggagcaggucugacugaggaacucacuguacacaagcucaccaugggcuuaacagacucgguggcaucucguguacaugaagaacgagugacacgguagaggugagaagaggggccggaacuaauguuugagaugucacagcagagacggaagccacagacaacugcuacacacgguggcucuccacuucccucagucuucagugacauauaggauaaccaguucaaucagacccagggaacaagaaagcauuugcuaagcugagagugucacacacugaagccaugcagggagcaggaccgaggcccugaguccuggucccaguuuuaagcacaacacucacgaggaaaggaccuguuccagucacccucagccuguauuccuuucuucucuuauugcuuaccuaauaaucucaaguuuuuauuguagugcauacagaaaucacccacgcuuauuuuacagacuaucagucaguuuuuacuauaaaaacuccggguagaauuuacuaacauuugcucaaauuaucacacauuccucacacacuuaacucugcuaauuuaccuuacuucuuagcuuaguccuuucuaggaagccauggcacugacaugggaagaguuuuaaagcucacucaccuguuguuccuugcaauggguccugauuagagcaggcagcaaucuguaagcgaccuugcuccuuauugaagccaagccagccccagccugaaccuuggacucccacagacacggcugucagcuucuccuuaaacuucucaaaagacccaaagucacgcuugauagccuccagcaacucuccugaggggaaaaaaacaaagccagaaaagacuucaaacacuacaauaaaauguuagguucaccacacuaaaauauucuugucaaaggaccaacuggaccacaccugagagaagaugccuacgucccaccgcaaggacacugggcugagguugacuagugagugcaaucagggucucucugcucccuguacuagugaagaaaacuaggaagggaagagccuucuccaugggccuccuuuccguuucucccauuucacaguuuuauccuauucuauaaccccauuuggaaacugaaaguuacugcugcuauucaacauccuccaauccuagaucuucccaucuuuaucaucuuguucuuuaaaugaaggcuucucuuguuacugagcuaaugguacacuuaagagggcuggaguggagcucaaugaacacaccuaauagucacgaagcccuggaguugaccacaacaaaguaaaggaaagagagagagagagggcagugagggaaaauacuaacaaacacgcacaccuggacucaaacuucugagucuccuaccucucccucccaaaugcugggauuacgggcauguaauaccccuccccuagaaucuuuuuacucuauagaaauauagaacuggagccgggcguggaggcgcacaccuuuaaucccagcacuugggaggcagaggcaggcggauuucggaguucgagaccagccuagucuacaaagugaguuccaggacagccagggcuauacagagaaacccugucucaaaaaaaacaaaaacaaaauaagaaagaaagaaauauagcacugauucuacaugaagcaaaucaacugaaucaaauggguccaacaucucacuucucucauucuauuggcuaaaacauaauuaucuuuuacaaacauggcuaaugcuucaggugggacaaacuguguaacagaaacaucaacaggagaaagaagagaaggagggagaggaggaggaggaggaggaagaagaagaggaggagaccucaacacaccuuauauccuggucauagccaaaaccugacaaguaucaagucauggucaaagugauuauuacuagugaguaagucaggcugccuuuuacaacaugguuuacauaaacagcacaagcaacauuaugcugggaauguagcucagcagagaagguuggccuagcaauggaagaccacguucaaucccagcaucaccaccacagagaaaaggacuggagaagaaccaacaaaaccagaaauuuaaggcacaugcaagagggagaaaaaaucaagggaggagaucuauacuauagcccucaccucccuaaauagaagauaacuaaagccacacaggaagucagaggaaccauggcggccauauaacuaucuaacgucuuacagaaaauauauuaguguacagaguggcuaaagaguagagaguuugguuuguugcuguuguuuucauuuugguguuuuguuuugcuuuuuaggauuuccuuuuauuuauuuuauauauaugacuacacugucacugucuucagacacaccagaagagggcaucagaucccauuacagaugguugugauccaccaugugguugcugggaauugaacucaggaccucuagaagaguagucaauguuuuuuguuuuuuuuuuuuuuugguuuuucaagacuggguuucucuguguagucaaugcucuuaacuacugaaccaucucuccaccccgaggauuuguuuuuguuuaaagacaaguaaacugucucuucauugcacaaaguuuuucuuuuuguuguuuuuguuuuuauuuucauaaaaaacuuguuuuacuggggcaagugaguucuucacauuagaaauaauaaucaaaagcacuacucuaagcacuuuacauauaacacugaaagcagccccauaauuacuccuguaucccauggauggcuacgugacuacgugucuucuuucccaggguccagagccagcaguggaaaggucauagucucuaaauacgagguuugcccagguuuuccuuaacacuuauccuagcagugggcagugcaugcagcauuuugugugugugugugugugugugugagagagagagagacaccucccugaacacacacacacacacagagagagagagagagagagagagagagaccucccugaacacauucucuauuccucccuuugaaacuuaagaacguguuacaaccugacuguaaaaaaaaaaaaaacaccaauaugagaacucagguaauaagaaaacgcaaaguccucuggaggcagucaauagguacauacuuuggcauagagaaaauacugaguucagucccuagaauaaaaagaagaaagucaccuccacacacagauauauauauauacacauaauaaaaauuauauaauaaacugccucaaaaaaauaaacaaauuuauaaagacugucuacauacugauuuccaagaacuacacaguaaaacucuuguaaaagaaaauuuuaaaaguuaagaaagagagggggaaaaaaccaacaaucggggcuagugagauggcucagcgguuaaaagcacugacugcucuuccaaaggucccgaguucaaaucccagcaaccacaugguggcucacaaccacccguaaugagaucugacgcccucuccuggugugucugaagacagcuacaguguaguugcauauaauaacguacauauaauaaauaaauaaaucuuaaaaaaagaaaaaacaucaaucauuccuacuguccaccaaauaugaagcuguagcagcuuauaccaaccuuuggguucuccaccacccuuagggcucagguuuguccagaaaauggugugauuaauaugucccccaccauugaacuucagugcaggcugaagagcgaccugaguuguaacaucuccugaaauauaaaauaagcaccuuuaaaaaaaccuguccucagccaggcaaaccaagccacaguuuucuuauucuugacaacauucacuaaacaaacaaagcucuggcuccacagaaggauuacaaucaagaugucuggacaacauuaagaagaaaguuuucuagaugccagaugucaccuuaaaggaaaugcuuucccaacugggcuauuccccugcuucacuauuaccacauccuccccagaucugcaauuuccaaaaaucccagucucuucccguauuuaagauuugugugauuugcuuauugcaaguaaaauuuccagaaugugguaauauuucccucucuuggauuggccacuuacacaauuauguugaaauacuauacuucuccacuagaugccccucgucagccagaugucacuaacauuuuacucaaccaauuucccagauaaaaguacauuuaagaaaaggugacucagcaguuaaaagcaaugacagcucuuccaaagguccagcaaccacaugguggcucacaaccauccuuaaugacaucugacgcccucuccuggugugucugaagacagcuacaguguacuuacauauaaaaauaaauaacaaauaaaucuaaaaaaaaagaaaaaagaauuuuacuaucugguuuuucaagcaauaugacuaacauagagacaugacuacaaauuaauucuccuuguaaaaaacaauagauuaaaaagacuauuuuguuaaauacuauuuuguuuagccauuaaaacaauauucccaggggcuggugagauggcucagugguuaagagaacugacugcucuucuggagguccugaguucaaaucccagcaaccacauggugguucacaacuaucuaucuguaaagagaucugauguccucuucugguguaucugaagacagcuacaguguacuuacgcccucugucugaagacaguuacaguauauguaauaauaauaaauaauaauaaaaauauaauaauaaauaaaucuuccaaaaaaauucccagaaauugugguugacucaacagguaaaacacaaaaaggcucuugccaggaaaaccugacacccugacuugaauugacaaucugagcuuaguuucuggauaccacaguggaaggagagaaccaaugcccuagguuauccucuaaccuccacuggcuccgugugucagcacgaauccauucacacacacacacacacacacacacacacacacacacacagagguuuuuuaauacuauagcauucccauauacaucaucuaggggugcaaacacagaacucugcacuauggauuuuguuggcugagcgcuuaaaaauauagguaaauaaauaagcuugccuacuguuccauucagugacagauacucaguuucucacaaaauagcuauuuuucuugugaacuuugaccccaaaaguaccaagucuagccuguucugcagcuaagugcucguuccugucuuuuccuccccccccccccaaggguaaagagugugaaacaggauguccagagauauccaaggggucagggagucccagcccuagacugaacuaauccuauuguuguccacaacggugacaauaaucacaacucggacugcagucuucugaugccacuucagacccucuccugcaccugcugccaggccaccaauaucgcuugcucucagcaaaaccccagccacuucuagccccaaccacccucucacccaagggcaccuggcugacccagcucgggcacucucaacccuccugcaaauggcugccaaggcuaccugaaaaauaagcaaaacaaacucuccugaagccacguuauauaacaaccgcauauuuuaaauauucauaugcaaaacaaaaacuaaauauucauuacgcaaaaaggagcagcguccgagagcugucuuuaaaggaccaccaccaaugcuagcuagcaacacgggugacaaaaaaggacacaacaguaagguccgucaaguacuuucgugagguccuguguuuuccgggauaggaaaggacguuuaugcgaaccaacggagguauuccccggcaucgaaacagaccuccguccggccaccgggauccucgugugcaggggccccgcaccuacccuuggccagagccucgugguacuucuccucgguggcguugagauuguucacguaggccgcguggugcuugcuguggugcagcugcaugaucugcgcguuaauguguggcuccagcgcgccauagucguaaggcaggucugggaggcugugcuugugccgggagcccgcggcaccggccacagggcccagccuccugcccgugcugagaggaacagagaggacggcgggucacgccacugacacggcgagccagccacgcccgccgccccgagacccacccguaggggacgccgaggccccggggcccugccgcucaccugcacgccgcccgacacaacauuauugagguuuacacgaccgcugcucuccucagaacacggccguucgcucgcaggcgcgcgucugcuaggcagcguccgcccggcguccgcaaggacacagcgaagcggugacccugcccgcagcgcccaucagcggaggggaggacggcgacacggacggcccggcgcauaacggagcggcauccugggaaggcaacgucuccccug

SEQ ID NO: 12554 - RNA, 4371 nt, Mus musculus
uaauuggucuguagucuuuacuugggguuaagaguucugugaacaagagggaacagaaaagucaaucagguagacagccaaauuuuuuuuauuggggaaaugggucucuaggggguaggccuaggcccucacugcacagcuuguucauuggcacugccuccagaauccuguggcuucaucacaucuggaagcucuggagggcuggaaaagggcucgaugcggagagcuucgaaggugucaucuggggaagggguauagaagauucucagcguuuccauucauugacuuguaucaaccaucaaggccauaacccuccccaccuugguugccugacuuggcaaugguaugaugacuucuguccucagaggccuaacuuugccucugaccccauuacaugucauugauaaagacccccaacccccagcuuugugcuugucuggcaaguaucaaccucagaauucuuuaauccugguuuccaguguccacagucaguacaaaacaugaacuccacuuucuaucuuuucuccuguuuguguccaccuagaaauuccuuaccuggcccucaaugcuacugguugguaaaauuaguaaggaagacggcaaagagcugggguuugaucaagaaagaagucaaggauguagaugugcuuucuauuaagagcaaagguuuagaaacugaccaucagccaagugguggugguccacgccuuuaaucuuagcacuuggcugggcagcuaagguuacacaaacuucuggggguugggggagaaugaauucucauuccuguuacuggucuaguuaaaacgccauuugccaaaccuuccuaauagccuucagccuucaguauggacauuugaguggcagcagcagugaaagcaaccuaauuagguccagaaaccuaaugcugucagcugcuuccagaagugcuucugcaaauccugccauuaacacauuccauuggccugagggguaauaaagccucugguccagucuugcccauaucuaaugccauaucaggaguugugugcccuuagcuuugacauaacaaccuaacuuagcuuacgcagacaagcuguauuuuagccacaggaacccacgcaaaaggggaucuaucuggcccguguaucuucaccagcccuauaagugccucauugcugacucacaggcuacuaguuaccuuggagcagauaccucccaggauauuuaucgugauaaaaggauauuugcagcaagcccuugggggggggggggcuauggagauggaaauuccaggcuggguggggcagggacaaucggcuaugcauaaggauauauagcuuggugagcugagguuuacuuuacaaaaacuaaaaaggauaauuuacacuucuauuucuuuucccaucuuagccucuuucuagaguauguauaugggcuuucauguauguauguaugugugccaaugaaggccaaaggcacugauuuucuggaaccgaaaugaacaguuguaaacuaccauguggguacugggaacugaacccagguccccugcaagagccaguauucuuaauugcugagccauuuuucuacauuuuauuccccauauacacaguccuugggguucacagcugugaaaacaaguccgaggaccaucccucuuuaaaaucucagaggcaaauaauaaaauuauuaaaucucuaccugccucucauugccuagcuguccuggaacucccuguagaccaggcuggccucagcauaggauuaaaggcaugcaccauagguauaacaugaucuaacuuucccaaaucacuugcuucacuugucgugucuaucuggcacaaucugucggggugugguagcacacaccuuuagucccagcacucggcaggcggauuucugaguucgagaccagccuggucuacagagugaguuccaggacagccagggcuauaacagagaaaccuugucucaaaaaaacaaaaacaaacaaaccccaaacaaacaaaaaaggugauuugcuaaaucuggcaugguaucuguuccagccaaguaagugcauuauagucugccugucaucuauagcacuucauuguccuaguuucaaaaucugcaaagugaagacaauggccucacaaggcuacuaugaaaaaauuaggcggagcuggguucaguggggaauaucuuuaaucccagcacuugagaggcagagcaaauuacaggucagccaggacuaaacucugggucuaaaaaacagaaaaccaaacuauauagauaaacucuuucuagaaaacaaacaaaaagaucagguggaauaaggccauggacucaauaaauccuguuaaaaaugugggugguaccaggaaccuacaaguuaccuuuaauuuccacaccucuuguuuauguuucaaguuuuaaaaauuauguguaugggcccuuugcauguaagucugcuccaaguacaugccuggugcucaagaacacuaaagaaggcuucaguccccugauguacaauuacacuucugaccuagaauggaacccaacuccucuggaagagcuacccuuaaauugcugagcuaugucuccagucccuaugcuuuguuuuuuaacaaggaaacaaauacuucaugaucuuuguggacugaaaagguauucccuaaaagcucagaggagcaguauaggcuuccaaaguuguuguucuuuggauguuaccagaugcuagcuaccauccauccagguuagccaucuuaccugcucggaaggccaggcccacuguggcuggggccuguggccgugcugucuggcuagugaagccacacucgcccagaguuuugccaucaucaaggagcuggucauccugaagagagaagcaggguuuagggagagguccuaaggucccaaagacagccaacuuaggugaggaacuuaggaagaggcaucccuaaguauaaaacacauauuccaggacuauauccaagaauuuccagcucugacugcacugauggcuuacagcagcuaaaagcucuggcagagacuuccaagggcauuuucuagcacccauauagauugguucacaauuccacuuccaugagaucugaucccuuuggccuccagagcaccugagcaccuggacuguaugagagcagguaucacacacacaaaaauaaaacucacaggccucugaauucuggcuuuuccaagcucucuagauauaucuaauucaaaagguaguuggaauuuuuuuuuuuuuugagaaaauaucucaaacaguauuuuguucuugaaauucugauccuccuacaucuagcucccaaacaggauuauugcccaguuuuuuccgccuggugaucuaaccuaggcuuucauacagguuauguuaacacuaaacacagcugcaccccugaguccuaucaaguuuuucucuccacuccccaccuuucuuuuaaaaaucaaccuuaaccuuaaaacgggaauuaugaggagcauagaaagcagcacuaaaaacacuaugugguuccuagaccagcagagggucuuucaagaaaaagaucaguggguaucagugagaaaagcccuuuagagacaugaauccaggcucuaaucuggaguuacagcuggaauuagcucaauguauuuagauuacuggcacgcuucugggaagccugacucgggauuggggcaugaggacccaacuccgcaggcuagcuuauucaaaacuggagcuggcuucuggaggugagcuugaaugccaaguguuucuagaacaucagaagacuggcgaggguaaacacuggcugggugaaucacuggugggaucuugaccuaucuucuaaacaacacuugcauuccucgaguuccaccccacccugugacagugggauuccggugggcucccgacaggccgaagguggcuagccaggaacaaacccuggcucugccacgaccuucggcugcguaagauuaucgaggccucgguuuccccaaccgcugagcaagacggccuggcagggcggggcggcugccgggagaccugaugcugccggcucuucagcacgaucaagagaccuccuuguuaaguguccugucuggacccccgcgcgcgcaaccgccacgcccgcucgucgcaccuuguaaagccgcugcuccucuggcggccgcuugaggaugcccucgacgaugcgcuucaguucgaacacggugcucgacuccuuggcguccguaaagaugguggucuuguggcgccggaucaugagaaacacguccugaggacggcgggcccgcgucagcgcuagcccgcggcccccggcguggccccggagcccccgccgcccccggccccgcgccccucccccccgcgcccgcucaccaucccggcggcugcuucuggcucgac

SEQ ID NO: 12555 - RNA, 4371 nt, Mus musculus
gucgagccagaagcagccgccgggauggugagcgggcgcgggggggaggggcgcggggccgggggcggcgggggcuccggggccacgccgggggccgcgggcuagcgcugacgcgggcccgccguccucaggacguguuucucaugauccggcgccacaagaccaccaucuuuacggacgccaaggagucgagcaccguguucgaacugaagcgcaucgucgagggcauccucaagcggccgccagaggagcagcggcuuuacaaggugcgacgagcgggcguggcgguugcgcgcgcggggguccagacaggacacuuaacaaggaggucucuugaucgugcugaagagccggcagcaucaggucucccggcagccgccccgcccugccaggccgucuugcucagcgguuggggaaaccgaggccucgauaaucuuacgcagccgaaggucguggcagagccaggguuuguuccuggcuagccaccuucggccugucgggagcccaccggaaucccacugucacagggugggguggaacucgaggaaugcaaguguuguuuagaagauaggucaagaucccaccagugauucacccagccaguguuuacccucgccagucuucugauguucuagaaacacuuggcauucaagcucaccuccagaagccagcuccaguuuugaauaagcuagccugcggaguuggguccucaugccccaaucccgagucaggcuucccagaagcgugccaguaaucuaaauacauugagcuaauuccagcuguaacuccagauuagagccuggauucaugucucuaaagggcuuuucucacugauacccacugaucuuuuucuugaaagacccucugcuggucuaggaaccacauaguguuuuuagugcugcuuucuaugcuccucauaauucccguuuuaagguuaagguugauuuuuaaaagaaagguggggaguggagagaaaaacuugauaggacucaggggugcagcuguguuuaguguuaacauaaccuguaugaaagccuagguuagaucaccaggcggaaaaaacugggcaauaauccuguuugggagcuagauguaggaggaucagaauuucaagaacaaaauacuguuugagauauuuucucaaaaaaaaaaaaaauuccaacuaccuuuugaauuagauauaucuagagagcuuggaaaagccagaauucagaggccugugaguuuuauuuuugugugugugauaccugcucucauacaguccaggugcucaggugcucuggaggccaaagggaucagaucucauggaaguggaauugugaaccaaucuauaugggugcuagaaaaugcccuuggaagucucugccagagcuuuuagcugcuguaagccaucagugcagucagagcuggaaauucuuggauauaguccuggaauauguguuuuauacuuagggaugccucuuccuaaguuccucaccuaaguuggcugucuuugggaccuuaggaccucucccuaaacccugcuucucucuucaggaugaccagcuccuugaugauggcaaaacucugggcgaguguggcuucacuagccagacagcacggccacaggccccagccacagugggccuggccuuccgagcagguaagauggcuaaccuggauggaugguagcuagcaucugguaacauccaaagaacaacaacuuuggaagccuauacugcuccucugagcuuuuagggaauaccuuuucaguccacaaagaucaugaaguauuuguuuccuuguuaaaaaacaaagcauagggacuggagacauagcucagcaauuuaaggguagcucuuccagaggaguuggguuccauucuaggucagaaguguaauuguacaucaggggacugaagccuucuuuaguguucuugagcaccaggcauguacuuggagcagacuuacaugcaaagggcccauacacauaauuuuuaaaacuugaaacauaaacaagagguguggaaauuaaagguaacuuguagguuccugguaccacccacauuuuuaacaggauuuauugaguccauggccuuauuccaccugaucuuuuuguuuguuuucuagaaagaguuuaucuauauaguuugguuuucuguuuuuuagacccagaguuuaguccuggcugaccuguaauuugcucugccucucaagugcugggauuaaagauauuccccacugaacccagcuccgccuaauuuuuucauaguagccuugugaggccauugucuucacuuugcagauuuugaaacuaggacaaugaagugcuauagaugacaggcagacuauaaugcacuuacuuggcuggaacagauaccaugccagauuuagcaaaucaccuuuuuuguuuguuugggguuuguuuguuuuuguuuuuuugagacaagguuucucuguuauagcccuggcuguccuggaacucacucuguagaccaggcuggucucgaacucagaaauccgccugccgagugcugggacuaaaggugugugcuaccacaccccgacagauugugccagauagacacgacaagugaagcaagugauuugggaaaguuagaucauguuauaccuauggugcaugccuuuaauccuaugcugaggccagccuggucuacagggaguuccaggacagcuaggcaaugagaggcagguagagauuuaauaauuuuauuauuugccucugagauuuuaaagagggaugguccucggacuuguuuucacagcugugaaccccaaggacuguguauauggggaauaaaauguagaaaaauggcucagcaauuaagaauacuggcucuugcaggggaccuggguucaguucccaguacccacaugguaguuuacaacuguucauuucgguuccagaaaaucagugccuuuggccuucauuggcacacauacauacauacaugaaagcccauauacauacucuagaaagaggcuaagaugggaaaagaaauagaaguguaaauuauccuuuuuaguuuuuguaaaguaaaccucagcucaccaagcuauauauccuuaugcauagccgauugucccugccccacccagccuggaauuuccaucuccauagcccccccccccccaagggcuugcugcaaauauccuuuuaucacgauaaauauccugggagguaucugcuccaagguaacuaguagccugugagucagcaaugaggcacuuauagggcuggugaagauacacgggccagauagauccccuuuugcguggguuccuguggcuaaaauacagcuugucugcguaagcuaaguuagguuguuaugucaaagcuaagggcacacaacuccugauauggcauuagauaugggcaagacuggaccagaggcuuuauuaccccucaggccaauggaauguguuaauggcaggauuugcagaagcacuucuggaagcagcugacagcauuagguuucuggaccuaauuagguugcuuucacugcugcugccacucaaauguccauacugaaggcugaaggcuauuaggaagguuuggcaaauggcguuuuaacuagaccaguaacaggaaugagaauucauucucccccaacccccagaaguuuguguaaccuuagcugcccagccaagugcuaagauuaaaggcguggaccaccaccacuuggcugauggucaguuucuaaaccuuugcucuuaauagaaagcacaucuacauccuugacuucuuucuugaucaaaccccagcucuuugccgucuuccuuacuaauuuuaccaaccaguagcauugagggccagguaaggaauuucuagguggacacaaacaggagaaaagauagaaaguggaguucauguuuuguacugacuguggacacuggaaaccaggauuaaagaauucugagguugauacuugccagacaagcacaaagcuggggguugggggucuuuaucaaugacauguaauggggucagaggcaaaguuaggccucugaggacagaagucaucauaccauugccaagucaggcaaccaagguggggaggguuauggccuugaugguugauacaagucaaugaauggaaacgcugagaaucuucuauaccccuuccccagaugacaccuucgaagcucuccgcaucgagcccuuuuccagcccuccagagcuuccagaugugaugaagccacaggauucuggaggcagugccaaugaacaagcugugcagugagggccuaggccuacccccuagagacccauuuccccaauaaaaaaaauuuggcugucuaccugauugacuuuucuguucccucuuguucacagaacucuuaaccccaaguaaagacuacagaccaauua

SEQ ID NO: 12556 - RNA, 46566 nt, Mus musculus
ggcccguggaguucagagagcagcacagacagcagucagacagcuucuuuauuugacuuugucuugucuguuugggguuggggcagaauccaggcuagagcugcagaugagcccacagaagcaggcaggugccaucacauacauucucuuucccccacccgccaugggggcaagccccauuggugggcuuguccaguaacuucuuggcaucuuucaucccacaguaguccugcccuugcucagaucugaaaccagcagaucugcgugcugccuggccccagacaagggaggaaaacaaggccacgguggccccaauugcuguccagcaccugcccgaggccagacucggauccaguaauagcugcagcuuccccuguaccccugcccuggguaacaauggacccauuuucagcccaaguagaaaauacugacauacaaaaauauauacauuuuaaccccauauaaauuauugaugguggacauagaaagcagaugguagcuagagggcaaguaugcugcagaaacaagagagguaauaacuuaggggacggauaaaggagaaguguagcuuagcccucccuccagcuuagauuuuuagcaagaggagauggccaccuagggguagagcugggcgcagcccgcugaaccugaggacuuggggggagggggggcgaauaaauuagcaucuuggaggcuggguacucacuugguccaauacugcuguguccuccuguggggaggggacccuggguccuggcuggccacacagccuuuuuaaagugcagaagccccauauguggacagguaaggaaggcagcaauaccuguacccaaaagaacuggcaugcagccguucugccuggcccaaccuagagggcagcagaagguaauacugagugguguccacccuggcucugagaggccagugugaagcucaggcauucccagggaagggaauggccaagaccccuagggccuaagugcugcugggguggaccuuguuauuaggccacagggacacccuguuggggccuacagucugauccagccccugacuggcccgagaaaggcggcugggcaaagcuggcugagagccugggaagcagccaggggagggagaggaaggagguccauugugcccauggccuugaaggcucuggaguuguugcuccagcugguagacguccucuguggccugguugagucggucaaacuggacaagcagacuuucaaacacagcauggaggcgagagggcucugguuccagcuucagcgucgagcggcuuaagcuggcgcucggcccgucugguuggcuggacgagguggaugggugugaagcuucugagccugagcuaggugggagcacaacuggggaugacuuggagccccuggaugagcgggaaggcaguggauccauuccuucaaagcggacuuuguggcggaacugggggcggcacaggggcucggucaguccggcugcacccugggcucgcgagacccagggugugucccucucccccccacugggccguacccaccuccuugaccuugcugaagcccauccagagccgaagccuacgcaggaaaagcuccaccaucucauaguccugggguucccaugcugggcgguagagcucgccacgcaaggcgugguaccgccaacgcaggaggauagccccuaaccucagggcaccccacacucgcagagcccagagccccacacacagcagaggggacagguaccaggacucugaagggcacagaguggggacccucgccccagggcacagcaccaggaaggcacgggccauguuguagagagugucagcaccagaggaaauaagcuauggaaaaagagaugcaggugaaggcauagccugggggaggcccuucccugggauaccacaaacagcgaccuaccaggauggccaucugugcauaggccacaccaagcagcaccaggcccaagguggcucccaugagcucgggcaaggcccgacacaaugucuugccaaaaacagaccacuggcgcacaaaccgcagcugcugggcagccuguggauaggaggcagucagcuuucuccccagccauggcagucugauccuagucaccaccagaccccaccuuugaccucaccuugaccaaaagcaggaagaguagugaagcugccaggccacgggccacagagcccagcugagccacuuggucgaagcuagugaaguggcguggaugguccugcacaaaauggguccacuggcgaucagcaaugcccagcugggccaggcguacaagcccuguagcugcugucaguaucaccaguaggcaccgugcccaggugucaggccuugcugugcacgcacacccaucuuugcgccaggucugcaccucggccauggaaaaguauagggcaaacagcagcaagcacaccuggggguggggggaggagguugaaaggagauacgugacggguguugucaaguguucagauuccugugggcaugaucaggaucccgaggaaagaugucaaguagaaaggcauaccgaggugagcagugguagagacaggccagugcugagucgccguaacgcaaaugggcggacacugaaggcagccagugcauggccggcuacagggaacucgaggcgcaguguaacagcagcauggagccccacagcagggcuguagcgggugaguucuacaaacacugcacggcuccugcauggagggugcugucagcaugaggggccgugugcacaggagcauaggauacaggacacgggagacaccggagggagggagggaggggcacaggggauucagggcuaggcaugggggcagcaggcuacaagugaggcucagagccugccaagggaguggcuacuuuccuacccauuucccaacucagcacccaccugcugucaagccaguugugcagcugcaggaagcccagucgugcacggcucuccuccagacucaguccuaacuccuguauguagcccccacugucauacacugcacaguagccccaguaccaggcgcuguggagacagggcaggguuggaaacucccuaguccugagaguaucugauaggcaugcccccaagggggccagaagauucucuggagaacgucacccagguggggccuuaggcucuuguucuacucaccccagcagguccggugcagaguaggcccaugucucagagccauuuugcaccacacucugccagccaaugccauagucacuggugcucaagcuuccugccgcugaacacaugugcuccgagcuagaagggucugggcagaaugcuagaaagcagagagccaggacucaggacauacccaaugggugacucgcucuucaacugagcggagguccugugcugugaccuccccaaaucuccuagccaaccaugaggcaauuaugauguuauaaaaaagcaaaagaaggggcuggagagauggcucugcgauuaagagcacugacugcuuuucugaagguccugaguuuagaucccagcaaccacgugguggcucacaaccaucaguaaugagauuggaugcgcucuucuggugugucuaaagacagcugcaguguacuuacauguaauaauaaauaaaucuuuuuuuaaaaaaggcaacagaagaaaacuaacgaggacaaaaguuauacaguuaaguagaguucaaauagcucagcugcagguugcuaaggaagcagaaggaugacagagcauggaccaccauccccagcagggugacagaacauggaccaccauccccagcuuaccuuccugcagucgcaccugccguagccguggagggcccagcucagggcuagacugguucccauggacauagggcaagaacacaugugacauccauggccagaacucaucagaccugccaacaauagucaguaacugagaucaaggcugucaggguccaggaagugcugcuguagcagcaggaagggauaaagcugggcccauguuucccuacuucuggacugaugucauuugggacagauaauugcccugauaugcuguguaccacagaagacuaagcaguguuccaauucccuacccauuggguaucccagcacauuucugauucugaccaccaagcaguaucuagaucaggcaucauuugcuucucugggccacacagagguuuccauuacacggguucauuuuguaugacauugugacauguuguugucuauaaagaucaugcuugagagcuauacaacugaauuuaaacggaaucagaaauaaaaaauaacaacaacagaaaaaaaaacccauaaaacaucucaugcuuuaaauagaaaauguaugauucuguguuaggacucacucauagcuaccccagguuacauguggcucaugaauuguaggacacccuugauucuagacacuuccaaauauucccuacagggugggauggacuaaagacaaaacaaaagugggcauuggugggcauaagugccacccugucccagugcaugaauguauguguccugagugucccuaccgggugauggccagaaaggcuuggcuauccagcuccugcuugauggcgcucugcaggcgauaggcgugaccauggcaagaagcauccccauaguuggccagcagcgucaccaguaagaaaagcauguacaccaagagucucugggggacagggauagauggcugaucagcugaucccaucccacagggcuagagcaugguuuuaagacuacccuuguugggugucuauacuaaggaauggcaguaucauccuguggucuuauaguccuauggcuaaugagccucuugggggaagacacacagaugcuguaaacuaaaauggcugugccuagcacccuauaagcuaggugggggcaggaauuugaguguacauugacaccaauaggggcagcaggugacagguggacagguaguccaaagcccugacuauccauuggaggucaggagcaggauagacaaggggaagugaggaggggcugcugguggccggggcuuaccuucaacaugucauggagccucuugaccuuucgagcuuccuccuuugccaagaagagugcaaaaccaugugggggccgcacacggggcacacgcucacuuacagggguuacagcugggcucucuaccagagugucaucuucaucagggugaagccgcuuggccacaagggagaaguagagggcuuccagcaggaccugggaugguagcaugaucagcuggcaggcacaagacugguagccccucuccuccaggaacccucucaccuuaaggggcucccagccaagaaaggaggccaggaagcuggagcugcuugagagaagccacaugacacucacgcugggagggaagcuggcaccaauccacccugaaacugcuacagcuacagcuaccaagagcaggcugagcccaugggccaguggggcacaccaggcaggcagcagucgcuucugaaaaccuuccaccaguccuggagacacacagacaacugcauggcugccagccccagaaggccugagagggauguccugcucugugugaguauaccuguccuggaaagccuugucaccggggacuguucccaacugaggcccaugcuggcuggucucuccucccccacugucugcaguaucagaguuucuguuuucucuccaggaacacuggaccugcacaggaaaggccaugaguguuggcacauccuccgaggaagaagccacaguggugugagucugcacucaucugggagcaguugcuucagcauccuagagcccugaaccaggagaugugaugcugggcugcaugacaucacggccacucuccuugcuuccuguacauacacccacugcccaggacccaacuaagggacuacuaaguccaucgcuuacauguucuguccuggcgugacccaguggcccuucuccaaccucaugccagccacacaggacuguguucuaaacccugcaugugcucuccaaguccugccuuguaaaaugcugcagaggugcacacuccugugugcuuugugcuuuuaaaaagccaaucuuagccgggcaugauggcgcacgccuuuaaucccagcacucaggaagcaagaggcaagcagauuucugaguuugaggccagccuggucuacaaagugaguuccaggacaaccagggcuacacagagaaacccugucuugaaaaaccaaaaaaaaaaaaaaaaaaaaaaaaagaaagaaagaaagaaagaaagaaagaaacagggucucacuguguauuggcucacuguguagacaagacuggcuuuuuuuuuuuuuuuuuucgaaacaggguuucucuguguaguccuggcuguccuggaacucacuuuguagaccaggcuggccucgaacucagaaauccgccugccucugccucccaagugcugggauuaaaggcgugcgccacaaccacccgguugaaaaccuguuucaaaaacaaacgaacgaacaagcaaacaaggaagcaagucuaagagggcaaaaagaagacaugagacugccaugcugucugaggggacauuucgauccuuacugguacuuucuguguccccagggcucuuaauuacaugucccacaccaaguguuuaccugccacugagccuugcuaaaugucucucgauucuugccacuuaaugagcaagguuuaucaaggcaagcacccacagaacagcaaauaaauggaaauguuuuuucuuuaaauugacuuugcugcugaacaucaaagucauaaagcauuuagcuaagaguuuaaaacuugacauuuaauaucagcauucucaucuaaugaggaauaggcacacuaacaggcacacuacuucuuacaauucauccaaccuguggcugucuacagagcaccuauggagacaaauacugcuaagaugcacagagcagcagguuuucacagacucagucagcugcauaagcaagcuguuccccagaggccuccaucccugcugaggcugacaugggaugaguggagucaccaggaugcugacuguccuguaagcauggaauauaagguaaugugugauagagugagaacaugagggagccaggaaggcagggucagagaacuaaagagcugguagagugcccauagagcaggcuguacagagcccagagagcagguccuagcagugguccaggcagaaaagggcaugaggccgggcagugguggcgcacgccuuugaucccagcacuugggaggcagaggcaggcggauuucugaguucgaggccagccuggucuacaaagugaguuccaggacagccagggcuacacagagaaacccugucuugaaaaaaaaaaaaaaaaaaaaaaaagaaaaagaaaaagaaaaaagaaaaaagaaaaaagaaaaaaaaagaaacccugucucaaaacaaacaaaagcaaaaacaaaacaaaaaaaaaggaaaagggcaugagauggaagguacagcugggaacacacgaguccccgaaucuggaaagaagcuuagagaaucuauuaaugaaugauggcaaagagucacacaguacagacuccugucucaguuaccuaguagggacagaaucucucugggggacucggcccugggcuguagaagagcuucugguggggagcugguagugacucuuagaucacaggaaaucccauaccauggucaguaauucagagacaucucccuuucuacauuccaguauaguucacacaucacuaauuucugguguuugaaauuuagaaugagcuaggugguggugguggugguggugguggugguggugguggugguggugguggugguacaugccuuuaaucccugcacucaggagacagagggugguagaucugugaguucaaggccagccuggucuacagagugaauuucagaacagucaggacuacacaaagaaacuguuuugaaaaacaaaaacaaacaaaaaauuuaagcaaaaauauagauauugacauagauacagaugagaaaaagaauauauaauucuaugcaaacucuugucacugaaucaagaaaaccaagaaaucuguuaauuuguaagcauucaaauaguuaaguuucaaaaugaaaaugagguauuuaagaauauuuccaugauuucucaauuuugacuccaaaaucaaaguuccuuuauggcuaugcaguaagaccuugccugaaaauacaaaccaaaauaucuccccagaccaaguccuugagguauacguacgugcuugucaccucuuguuucucaaauaucccaugccucugucacuucucuaaaggaugcugggucccuaaggauccuaugaacuucccucuacagagaggccaagcaacgcaggcacaguaucacacugguuucagugcagccagggccucagcguccugaggcaggcacagggccccacgacacagcuaccccaaacacccugccuccuuccaaccacgccaggcacucacaggcuaguaagcaggucuguuucuaggaggguguccuggguaggaaccagguuguuggccccaucagccaguaccugauggaucaggucuucaucuagagagaacaaagcauguugaaguggcaugacacuugguaccuugaauuccccuagagcucugaagccauuccuucccaccucuggcucaccugaggccgacaaguauuuggcaggcaaggaagggcuaaccagagaggcaccaucuuccucugagcccaacaugcagccaggccugcccugggucaaucgcugcagugugcugcucacaacagaugggucacugagcaggucuggccaacuaagaguacccucacuggacggccagcacaccaggcuguaggcaacguagacauuguuaccuguaccuggccuaagccuagucacagagacacagaaagcaucacacaaagacaccagugagaguucccaaagacucccaaaacaggacgagcacaugcagcccaccaucccaacacggccugccaggcaaugcugaguuaggccaaagcucacaguuucuuuaggcagccucaccuuuuagcaucuuccagaaacaagucauucuucacuugcccagcgaaggccugcuuagaaggaaagagcacgucaggaugcucugcagcagcagagaggacagcccaagcaguccuaaccagcucagccugcccugagucccugggagagccuucaccucugugaggccagagagugugaggagggagcugucuagcacagauggguccagguagcugucaacaucuagggccugcugcccugugggugugggguuuugguccccagacaccugugaggagagaacagugaugugagucuucaauggcugcuagaagccacuggccuggcuugucuuugugaugauucucaaugacugacuugggcucuugcuauaggggauccuugaggguuguuuguuuguuucuuugaaaacagggucucucuguaggccuggguauccuggagcuugcucuauagcacaggcuggccuugaacucaaagauccaccugccucugggauuaaagguguaugccaccaucaccuggcuacuagaguucuuuuuuaauugacuuuggcaguuugugucuuucuagcagucaacugcuucuucuagguuccuuaaucuguugguguacagcugcucauggaauuugcuucuagccucaucuauuucucuagagggaacaagaugccuccuuuaauucacacuucgguaauucggaccucuuccccuuuagucacucuagcugauggcuuaucaguucugucuacccuuucaaagaaucacuucugguuucuggacuuuuuucucugacugccacaaagaacaacacaaaccaugcuugaccucagaguucugaggcccuuacucagcccaccuuacuccgagacauccggaagaggaacaggacagccaaauagacaggguagacuaccacacuggacacaaggccaauagcaacugugucaacaccaggagagaucagacuggacacaggucccaugcugaggugagaaagaaaagaaugaagaaguuagagagaagaguaggaagaagucagccaaggguccagcaaaccucacaggaccuaccuguagguggugucucucacaacuccguaccacacagcauuggcagccaggaagaggcagaggaggagaacacagcagguaacccucuggacucuaguaaagcggcuacgaggcggccggucccauauggagagccagaugugcuugucaaagaagccucucugcaacucagccacgaggagccgcuggaacugccacagcgcagcuucaucuggggagaguuaggagggugcagcagggaagcagugagccgcccagcacugccauccccuccucccugucuccaccucagcagguaguaggcuuacuugcugcaagcaccuccuucuccacuaggcccccguuggccucagucuccacagacagccagucauugaccaaaaagaaggugcugcgggcacucuguaggucccggacgauaauguguugcaggaaccaggcagggcugagcccuguggagaaaaacaccucagugaggacugaagcaggcuggcaggaugcagggugacaccaguuaucacccagaccuuuguuaucaugccacacucggaucuuccacacgcugcccaggcugugcgggguggcaauuuggaagauguccaggcuguuucgaugaaaggcucuguccccaucuaagugccggugaccacuacgguuguccucuccauacagcaugaugccgacgugagcagugguaccuggaaggcagagaacucuaaggugugccauucauuauaaaaaaaaauucuaugggucaucugugugccaacaaaacaggcaguccuuggcuuuaaacaaguuuuaaauuuuuccuuuuauaguaaugcagacugaagccagggcuauguacuguaggcaaugcccuaccucagagauccaucccuagccguuuaaaaaaacauuuuauuuuaauacagaauuugacuaaguugcccaaacuagccuacacuuugcccucacuugccugaauuugugacaaccccccaccccuacccccacccccacccagcucagccgccgaaguagcugggaugacaggccuacaccaccagguccaggcuguacagaucaaacagacacaagccucaguuucugaaaucuguuaacaaauaccaagcccacaguagcagggcuuccaguagcaaggacuauaaaccuugccagucuaucaagugaugggauacacaucacuaguaaccaggccuccucacaguucagucacacagacaacagcuacagagcuaggaagucuccuuuucucuauagaugaauucacaacguuuaaaacugggcacucagaagagagaacuggcagcaauaaugaaagcauggcaaagaaagaaacuggcggggcuggggucgugcucaggcacauagcaugucucaagcacacacauaccaugagggaaaaauagcaacacuggaaauaaauuuagaauaaaaaaauaaauaaaguuguugaaguaaaaauucuugccuuggauuuugucagaaaagagacuuuucauauaaacaaggaaaguugucaaaaaaaaaaaaaagcgggcugucugggcagaagaagaaaaaagagcaggcugucucggcagaagcaguugguaaaagcuccccaaagagcucugggggcauuucacaacauucacagcaaacagaaaaugcugaaagucaaucugaaccuggagcaugucacuugacagagccuacucugucucagaggucacuggaguagcugcauucacaauuaucugaagaucccaaaaguaagcaaagcacuuucacuuccaggguguguucgugugucuauaguguuuggaauaggccuuacuaugaagcccaagcuuguaaacuuuucccccuaagacagguuccacugcguagcucugauuguccuggaacuugcucuguacaccaagcuagccucaaacuuagagauccaccugccucugucccaaguccugggauuaaaggugugcaccuccacuguucauccaggcuugugaauuuuaagugaaauauuggggaaguauuaauauccuuaauaccucugauuaaaaacagaacagaacaaaaccacuuguacacacggauacaugccuagcccaaucaccaucagauggcuuccucaguagcugaugggagcagaugcagagacccagagccaaauauuaggcagagcucaggaaacugugaggaagcgggggugggguggggggggggaaggauuguaggagcuaggggagccaagcauaacagaacacagccuacagaaucaacagagcaggacuccggcucacagaaccugcaagggucugcacuagguccucugcauaugauguuggaguuguuuaacuugggguuuuugugcaacuccuaacagugggaauggggcugccucugacucuucugccugcucuuaggccccuuuuccuccagcugggauguuucacccagcuguaauaugaggucuuacuacauuuauaccauguuuagcugaucugcuuggcaggccugcuuuuuucugccaggaaauggaggaacaguggcugugaaggagaaggcauguggaagaggaacugggaggaggggaggggaggggagagaggcugcgguugggaggcuuuguacuagagaagaaaaaagcaaagcuccaccuauuuuggggggcauuugcaucucagcuuacugauggagacagacgguaacuuacaggaguugguucuuuccuuccauuauguggaucccagaaacaauucagguuugauuaagugccuuuacaacccauuuuuccaaucuauacaaauagugagcuuuuuuuguuuuuguuuuuguuuuguuuuuuguuuuuuugagacaggguuucucuguauaguccuggcuguccuggaacucacuuuguagacuaggcuggccucgaacucagaaaucugccugccucugccucccaagugcugggacuaaagacgugcgccaccaccacccagccaaaauagugagccuuuauuuuauuuuuucccucuuuuuuuuuuaauuagcuauugucuuuauuuacauuucaaauguuuucaccuuuccugauuuccccccaaaaaauccccuauccccucucuccucccccugcucaccagcccacccacucaugcuuccuggcccuggcaguacccuauccuggagcacagaacccucauaggaccaagggccucuccucccauugaugaccgacuaggccauccucugcuacauaugcaaauagagccaugagucccaccauguguuuucuuugguuggugguuuagucccugggagcucuggggguacugguuaguuaauauugaugauccucuuauggggcugcaaaccucuucagcuccuuggguucuuucuguagcuccuucauuggggacccugugcucaguccauauuuuuuuuuuaacuuuuuuuuuuuugguuuucugagacaggguuucucuguguaguucuggcuguccuagaacucacucuguagaccaggcuggccucgaacucagaaauccgccugccucugccucccaaaugcugggauuaaaagcgugcaccaccaccgcccgguuuaacuuuuguuuuuucucaaauuuugagacgauuuuacuauauaacucugaaacuuccuauauagaucaggcugaucucaaacuuacagaguccaucugccucugccuccugucugcugggauuaaaggcaugagguuccauacccaccuaaauaccuugguuugaauuuguuuuguuauguuuuucgagacaggguuccucuguauagauaucccugguuguccuggaacucacucuguagaccaggcuggccucgaacucagaaauccaccugccucugccuccugagugcuaggauuaaagguguggucaccacgcccggcucggaaggucagagaauugaccacagggucuguucucagccuaugaagccuaggaaucaaacucagguugccagguguaauaguaccuuuuccugcugagucaucuuugcauccccaguaaugaguuuuaguguuaauaagcaucagcugggcaugcagugcacgccuuuauccuuuaaucccagcacucacuuuaauccacagcacaggcagguggauauuugugaggcuagccuggacuacacagggaguuccagaccagccagagcuacacagugagucugcucccugccgcagggagggagacaauaaagaaagaaacauuaaggaaggguugcagagcaacuauaauagugcaguuugaauuuguguaugaggcugcuaugcagagugaggugcaccuucuuggcucuuggaccuguuguuuuucucaggaaagacaaaugaaucuaaguuucucuuuguauuugugcaguacuguggcugaaacccagggccuuguacauccuaggucacuguucugccauugagcucuaccuacaauccccauuuguuguucucaucuccaagguguguccuuauuuacacugaguccugagcacuugcuuugugguaacagucuccauaaucaccagacaggguccaggcuggagggcuuagaccaggguagacgccauaucccuacccaaucacccaucuccuuaccugaaccucggcuccagccggucuuaacaaguauuucauauuugaagcggccccccuucccacagaacgggaugacacggacacggcuaacauccagcugguccagcuugcgcaggaucauagccaugaccacauaggucaccaggcauaugacacacgucaggaggacaauguaguugaugcuugcagaugguuccugggaaggaggagucaucagguacagguggcuucaggucacacucuuuuaguuucuaaggauggaaucaggaggcccucucaauaugaaagggcuccaggagcaggggcacuacucacaggaaagaugaacuggacauggcugggaggcacaaaaaggcuggcaccgaaggcagugagguggcgggugaggcagacagccuggcugggugaggucuccuccagggguacaaugcccucaguucuccacaucaucaucuccucacugaaguacuggcacagggauguauagaggcccacagacaccuccagggcagaccaguggaaauggcucgucagguucagguaguaacuccuguccaaggucccaguucuacaaggauuagagcagugucauggccagccuuccugcucccugguucaauaaagcccacacaccugucacuaauaugggccaaguuacauucacccuucugccaccuccuuccccucugcaaggccuauuucugugguucuggugggaggcacucacccuggggcaaugaagaagguguagagccuguggucagcacccuccagcaccuccaggcugauccuccugcuggccgagcaguuguacucauugggcugggacacugagugcagguacacagccagguagggcucaggcuccgcggacagauagcgcucugggggcaacauacacaguaucagccagccaccaaaaggcucaucauccugaggacacccuaccgguuguugccguggggcuuaagggccauuuaagcagaggacuauaggaaauuccauguggaagucaacacaugcuucucucuggccacagguauguggguuuuauagaaccaggacagcaagaaaacugaguguuagccagaccccuaggaccagugacugcauaaauagccccuccccagggacaaggagggaagaaaggcaggcaggccaugugcccaucccugacacccaccauuaagcacuguguaagugauccucagaugcaggccagcuugaggguuacuguugucugcagugaccacagcgcugacagaggucuggggcuguacaaugguagaacccacaggauugugagagcucugggcagccuggucugaguuguuuggcaccuucacugugauggcacgcucugcagccaacugcucaauagggaucuggguaccagucugugucuggaaugccauagaugccacuuugguggagacaguguaguugcuaauguagccaaaggggaagggguuggaauccacaaggaagaugagcugcaccacaucacugagguucgacagggccccacugaaggccucaggaauggagaaguggcagcugggccccaaggcuuugccauaacacagaagacugagugggucugagcgcuugccuagggccacaaucuccucgccagccagagucagaggcuccucauugagcacucgggaacgcaugaggauacgcaugagggccgacgagagguuguaggccuuagaagccaccaucagggagggcggcuccacccccagcuccaagggcugugggcccugcauguccaagcuggccagguggaugaggucaccugggacaggcaaaggaaguaagggauguuaagaagaggugguaagagcuggaggggaggccagaaggugggaggggcagcuugugcaccugugauauugagaaugcugucagcaaugguggugggugucaaggugcccucagugguuucagcuugcaagaugcgcaucaugcccuccagcuucugcagcaucuucuucaggcaggagcggcacaugagcucccugcuggacaccuacaaggaagaucagugcagugucuaguuccacccacacauagcuguauggcucugccuccucauacuggcugggauucgaagcagcuuccugccucuaacccugaacugagcaacugccuggaugcaaaucuucuaggcaugcccugcuaagacuucuguggcuccccccaaccccaggaugcagccaaguucuuccuguggccuauauacugaucaccccaacuaucuguuuccauagcuaaaaguaaggcagaugugucaagggccuggacaaguucaaaucuacauacacuccaggguauagaaagccacaugcugacagugaccucuaccaagaguucucugaaucuuuguccucugaggacuugacuauuguccuggccccuauacugauucugacccugacaaaguguguugcccaucaguuauggcccacuugucucacaagucuauagcuuggaaaacuuauacuucauaggucaggaaggccaugucagguaagucuaguuaaguggggcaugauggcaggccugaugagaaggcacacacaccucgacuacucuuuccaucuggggaugcccuaaagucaucaggaaagcaugugggcucauauugggaaacaacagagaggaugcagaaaacuggcacaggcugggaagaacaccuagucucaaagcccuuacuccacgcuaaacguaugugcacucaugcacaaagggcugugcauggugcagaaggcugcauucaucugucuuaccaugcacugggcuaacgcagcaguaaucugcuggaugucauccacaguguugacccgcagggagaucagggucuccgugauguucuuacgcauuugggcucucagcugcugcucaacguugggcucugacacaucuggggccugcucauacuggaggagaaccaugaacggaggaugggccucccugugguauaugggaaggguucuagaguagaguaaugaggcaugggcagggauuuaaagaucaaggguaauucaggucacguacagggcucaggguaucaagagaguaccguggguacggugaccuugguaagggcugaggguaggacuuggcauucuaagacauuagggaacuucacugguuugaccccaaucauggagcacaugugcaggauccuuuucaguccauaugcacugaccucauugagcacaguaaugagggcuaaagaguacucgaugacaugcugagggucagccugcuucaggagcccaggcagcacacuggcagucaggcugugcagccaggguacgaggucugcaggauuuccacuggguucugguaggacaauggucagagaccuagagaguggaagcagacuguaagcaguugguggucagcuuguguucccuccccaggguuaagcucaccuguugagugcaacaacagcagcacccagcuggucuuguacaaccacagcuaggcucaccacaaaaaggggcuggaauccaggaggcaggacagccccauagguggaaagacuacccuuauagaugcagaaauucucacaguagcucugacgacagcgcuucagcaacagagcauauaccaguggggcuccaccaucuucugcaucacgccaaccuauggacaauugcgucaguacagaguccagguccauaggagcauuuccagguaaucuacacuaaccugugcacucgaagugaaccuuaguggugaggccacgcacagaauccaaugggaauaggcggcaggagccuccaaguggggggcgguugggugagaggcggauugaggcacagcccucuucuuccccugaguggcccagcacagugagugugaagauguagcccuccccaucacgcagugcaccuggccgcacuaccagauucaugccggugcuacccguggauguugucgucucguucagcaccagagucuuauugcugaaagugcgagcggcccaacacuguaugauggaagcauggaggacauggugagagugguguccuggaugcuuccccaggacacuugccaucuaacaauggcuacucaccccuugcuuguagccucugcugcaguuguggcagugacccuccaaguacacauaggaacuucggcucacuucauacacugcuugugccuugcaggacacacacucaagggacacaauggggacucgcccacuucggaucaguaccuggaagggacaagcgugucacagggaggcuccacacucuguguaugcugggaaagcuuccuggaccaggucacucccauuugaagcaaauuccagguugugccucuggagugaaguaagugagcuaacuagcuaaauccagaagggcaugugaguggaucagcccagggccuugcugaccuggcaguaggagcccaugggcaccacugauagaaacaaagcauccaggaagucaaggucaguuguuuuuuauauagcucugucccagagaugcuggcugacuugagugggcccuggaacagcucagucaggcaggaccuacugaguguccucuuccuaccugagaaggcuuaauacuggggaaggcagucccacuccgaggcaucaggacugcccagccccccuccacacacacuggcaggccucaucagccugcaggugaagugguccuuauccuuaugaaagguccagggaagaaguaugacagcaagaauggcucacugcccccagaagcaaggccauguuauguggauaggugcugcugccuagguaggcaagggccuugcuuucucauuacuugccuuucaugcugguagcauaaaguucauuuuucgaaaagcagggugcuuguaugacuuaagauuuuguuuugguuuucagacacagguuaucauuguguuggugagauuagaacuuccagucuuccugccuccacucucaaagugcugggaugauacagguggcaccaggcuaaccuguccucucaaauuucacacuacuaaucugcuguguccuggauuuucagauagaagcaaugcugaguuugaucauuuaucaagagaacucagagccccaggggcugaaaaacaccagguuggaacugguacugcucuugcaugaggacacacuggagggugggggugugacucacugucugguugguggcuucuuccuuccgaccugcuuuccacacuaugagguugaagguauauucuacaccagcuucuaggcguuccagggggauggugaccacacugcucccacggggcccaaaguuuagcacgcagccaccugucucacucugugacagcaaauaaggaaauggggcacaagauuguuaaccacccuuaaggcagagccuggcuuagaaaaccuuuuuuaugcuaggccuaagacccaccccaggaauaacccaagugcuaggcacuuaauagacaugaaacacaagauagaagagucagggaggaccuguuacucuaaguccccauggcugaccuguguugaagccacgcaggcccaauggaaguugagcggugucugaucaccauccucuaaauuagggucauaggacuugcucccauccagcaccagguccugcgugucugaccauacccgguaugagccaccuucaaugauggguaccagacgcucagcagccacugucacauuggccuggaugcuccgugccaaugguguguccccaaaugaaaccacaaacacaaagcaguaguggcccacagguagugccagccguggcaccaccagcuggggucggcucacauccacaccaggcaguaccauuugagccauacguccuggccguuggcagcuggcaguacgauauaucucccaccgauauucagucugguaggagacacaguugcguagaucaacaugggccuccagguaguugcgcugggaacgccgcaucagcaccugcagaggcagugcuaccuccacuucaggcucccuacaggccagcaccuggacagucacuguggccugugccacaaaaaaacucacuagguuuguagcauucaccucuacaugguaguccccaggacgcagguaguagugaucagcccagaauuccucuguuuucuguaccggagucccauccccaaagucccagugguagguuacacgccguggacuggggcuuguagcagccucaaaccuggcugagcgguugguaaagcagcggccacucugaaguguuacauacuggaugauauccuggacuuccaccaugagugugagguucacaccacccaguucauuaaaggcacgcacauggaucuccaguaacccugcagccacagguguguaggugacaucacggccagauaaaauaaccaaugagucacccugaaccuuuugcaaggagaaauaccaggcauaggcaacucgggaaccucgcugcacccgggcugugaaguucuucucagugccuguggccaugccuggcucacagcaguuggguaccugcagcccaacaacagccuccagcacuaggaugcgaaccugugccugggcaugacucacgugguucucagccugcacauucaccagauggucuccaacccgaaagaagcugugggagaagugggggcuagggagcacuucagggacagacccaccaaccugaagucggaaaguaagagcagagccagcugccagcaggauuucaaaguggacuggcugcccaggcgccaccaccuugcugcuggcccacagcaucagguucacaauggguuccucuacugugagguuguacauggcugagacccaacugacugcauuggaagcauugagcugcagagagaaacugccagccguggagaagcgcacagcaauguacuggcuguccuuacucccaccuggcaagguccagcaccaagucacauugguaccuucagccagcugaccccagaaggguagaguggagccagcugccacaaagaugcuaucuggcucacugguucugauacucagaccacccacaggcaccuguauggccacuucaacuguggcauugacugagcccaacugguucucagcugugacucugaccaagugcaggccaggugcagcaaaggugugggugguagauggcauggaggucuuccaacucaguccuuccuccagguaccaaguguaaacaacaccacugccaccagccaauucagcacaaagggugagacucauguugacagcagcuggauuaggggaugcagauaggauuagacucuccacagguuccacaaagucuauaguacgguuggcugcggcacuacccaacauguuaguggcccuaagauggacauaguaggugcuagcuuugagugaagugagagaaaagcacuugccacugccgaagagugugaugaggcugcccuccugcugcgcuguccagcuauaagagauguuggugccaucccuaacugcagcuugcagcugcaguguguaguugguagggaagcagcagccguuaucacccccugccaccugcagccccucaaugaacuggagaacauagaugaagaugcuguccugggcagaacccaccucauucucagcugugacaauaauauugaaggugcccacagagcggaagguguaggaaauaguggguccgccuggaaugggugugcaucugucacagagcacccaggaguaaugcacaucacucccuaccuccaacaagguacuaaagcucacacugccauucaggggcaccacugugcggcuggcauugauggugaggccccgcacacgcugcuuuacggugauguugaguugggccucacuacggcucaccucauuccagccagacacccugacagugaaaucaccggugcugcuguagauaugggugaccucagggcccucacucuggcugccgucucccaguucccauagguagguggcagggcucccacugcccauggcugacaacagguaaggcugcugcagcucuaacacaugggagccauugauccugaugccagugacuaacacaggcuccuggaccuccacaaaagcugagucauugguagaagagauguuguuggacacagugacuaucaccaaguaggagccugguucucgguagauaaauuucacuucagagcccccaguuuggguguggguagugucuucagugccaaagucccagguauaucgguacgggaaugggggccaagaauaggcaaccagccgggcuucaucccccagcuucacaaacugccucucaggcugcagggugauguuacguaucucagguuccacacagaugcugguaaaauaaugugccuuguucacauggcuugacaaaaccaaugccagugggaauaugccacuccuagugaaguugugugucacugauggaugcccauggacagucacauuggaggagccaucuccaaaaguccaaucaaagagguaauggacaggguccccagugacaugggccauaagcugggcacugggcuguguggggaugcagguagagggcucuauguguaauaccuccaggacaaacacuugcacaugcaggcucugggacaaguggccagcaggguuggcugcuucuacugucacugugaaguucugggcccgcagguauacauguuguacuguagccucagggccugugaauacugugccaucucccaugucaaauguccauguaauguugucaccugacuccacagaagcacugacuaccaugggggcucccugcuccacagaugggcucaaauacacagucaggccaugcaacuccuggaagacacggaugucugcaugugcugucacgcugcucacuguguuguuaaccuccaaggugauucuguaagcgcccgucaugcuguaggugugguugaguacuggcuggcucuguauuaggacaggugagccauccccaaagucccacguauauaggacaccaucaguugagggcagcggauauggggaaaaggugauggguuggccggccaccaggacguugcugcucaugccaauagccacguugggaagaacagugcgcacacuuacugucaccugcugcgucagauucucauagguauuggacacaaggacggucaaguuguacucaccuguggagacaggcccaagugggacuuccuacucacagaacccccaccaagcaccuguuacuccauggacacaguguucacacccaggcauauacggggcagagcacccaagaguccauaacgagcaagaaaauggauaggagcauuucuaagcacaacugcauaaaggugaacauggaagcgaauaccaacacaagcaugagugagaauauagcgugaguaucacgugccaaguggagcuggcguggagcuguuuauggugugcagcgucgggcguuuuuacaauuaaacaaugaccccaccuuacucucccuaaggaaauuuuaaguugaggccucagggacccugcaaacccccaacccucgaugucugggugccccuccuuuaucccaguaagggccuuacucuaccacccaagcuggaucaaagagggaacaauaugggcagccauacucaaagguaggcuguccaagcucaggaccugaaaggcaauggccccaccccucaccugggguaguguaaauaugcgugguauuguguuccaccagcaccugcgccacuguggggucuggaaccuggaaggacucgucguauggaggcuugaacuggcggaguaccugcuccccauccccaaaguuccaccugccagggcagcagacagugaguaagcgagcagacagggcgccccugguucuaagugaaucucuacaaucacucuuuccugggucauggcuucaagguacuauauaucuacuauagcaagacuuccaggccccacaugguccuacccacuaguauucucaauagagggggaaauugaagcucuaagccaggauuccaggguaaaugcuaggggcagaaauaagaaccugaugccacccccagcccaggcccuguucagcuaggcccagaagcacucacaggaaggccaccuccacagcugaauccaccagcacaccaccugucagugccaguguggcauugggggguaacacagucgguacugcagauacccacagcccaugcaucuuguucauccgcuccacagugacauuguaguucacggugauguugcucacaugguuagaggcugucagcugaggagacaggcaucaguggguauggcccagaggcagcaaggacagaucaaugggugaaaggccucgagcccugacucagcagccuccccacacucacccacagcugcagcaggguccucaggggcaaagcaaagcagaacagaaggcaaaagugagcacccagauaucccaggaccccaugccacccugcacaggccccugccuaccgagagcuugaagauggcagcacucugguauauuacauugaagacaguguuguggaaagucagagacugcuuaucaucaaugguccaccggaaggcuacgucugagccagccucuaccauggggcuguaccgcuagggaaaggacaugacauuggccaaagcuaugauuuuguuccagccuaaagcugacucugcuccuggucccaucugucccccucagacuuacugaagaauuuuguguguggugcaggguagccaagggggucuaccagcugaacccugacugcaaggcacccagguaaaggagagcaaggaaguaccagggaucauguuggcuuagaagcuauauaguauaggggccaagcuuggguacugagagccagugucaaggucaccucucuaaccuacagucaaauggccuuaauuauaccuugaccucucccucaaucccugcaucugugaaguggaccuagcaucagcaacacagucacccugaccagccaguccucauaagcuuccuucucaguggauaaucuuugggaaaacauuugaaucucaauggaccucaaucucggagguuuacccaggucagugcagaacagguauauccacaggggaagccaucauauacaccuggacaagucaugagagauggacagaaauggcccuuaagugaaugacugcuggugcuagggugggcaugcccaagaugaggacaaugccauccccuuaggauaaagcagauagcuagaucuugagguuucagaucccauuucaacaggcacaugcaucagguagcuacaagcaccacagauggcccagaaacacauggggucucguggaggcucagggaaggcuggggcaaaugugaugaagugcuuccuaaaaucugaagaguagaaacaucugagucuuuagaacagauguucuaacugugaccuucaguaacuuacaaauuguuaaauggggcucagguguacucacaacaaaagaaccugucuaucuugcacgagucccuagguuccauacccagcaccacuaaggagagauauaaucacuaagaagacaagggcuccccaacaggucccacuggaaauccuguaauaggugcuaucagcccuagaaaacaccugaaggucaucccuccucaauggggaggaggcuuccuguuuuuaccauuuagagggcuggguuguaggacacuuaccaccaggaugcccuguagcacucgggccucagggcuuggcacagcacggaggccacagaugggcuccucagcugucacucucaggcugagguuggccuggcuggcuccauuuugcgccacaaucuccacugugugaucccccuccuugagccugggcaacaucaacacugagaacagggugccauuggccucuucugugcaaucuugcuugagaaaauccaccucaggagggcaggcauccucgaagggagcacuaauauugcccccaaaccacugagcuguggcaguggcauuagcaccagaaucuaccugaagcaccaagacugagccguugguuggcacauagauguggccaucaagggggauggggugaaugacucucagcccagcuauuggagagaccacacugaagcugcaggacagguuuugccuggauacgcuguugcccacuguagcccggaccucauagugcccaggaugcuguaguccaggguuaggcccaaggcccagcagugguguaagccgcucugugaccaaaagcagcuguagggagcagacagggccagcccaagcuucuuccagauggacaggcagguuggucauccaaucugaggcauugguugaaagguacagggcuuggccaggacagcuggaagccaggggacacuguaggagaguaccugggccagcaucaugcuguaagccaaugaggucaccagggagcauaggaacauccuggcuguggagggugaccuauagaagagggaggcaguguuguaucacauccccauaauaaagacuagaaggacuacugagacagagaggacagaguacccauaucaggccucagcacugaaaauggugcuucguggagucccugccucaaggcacucauggcugagucaaacaggacauuguaauauaggggacaugcacaaggaagauauaguaagagugacugccacagguggaaagaacuuucucagggacauaaggcuagaaagcagguagcugcuccaaaugagagugcaaguucccccuuagaagacagaggacagagggcagaggcccugagaaggagaugagacugggcacuggcgcaggaugcaggcaagagcaucagggcaaggcuauugagcauauaaagaagccugcaagguaucuaguugagagaccaccaucuuggguagauagggggaaguagccucaagaauaggucagagacccacaccaggacacauaccaaguacugugugggaggcccugcaggcacagaaaaaaagaacuccuuccauaguguguagcuggcccuagagagucccagccuugacacagacccauugaugcagacaugagaguuacacgaagcaucaaaagguaugcagacauuggcuccuggacaccagaguuccucaggcacacacuugggggccggcucaguccuguugucaggcucacugcugccuucugggaccgcugcugggaaaggaaggaugucaugagccugauucacuaacaagcuacuaucagggaugcuccacuuacccauuauaaaaccaaaccuugauaagcaguuccccagucuccaccaucacuccccugccucuagaucauccccaaucagguaccacccgaucuagcuuugggacaagggaacaggaguuggcaacucugccaucauucuaccuugaggcuggaaucgaaggcaugagaaaauucagacaacccacuaagccuccacuucauuucccuuucagagccccaccugcuccuccugagggccgguacaccugcagccgcaucugggcaggcucuucaagcuucuggguagaaaacucugcugcagugagaaaggcuucccggcuagggcucaggccagggaacaccaugaccuggaggagaugagacagccucagcucaaaacaucuaccccuggcaguguaaggauagcccucucaagguuaaaccucauuucaugucacuugggaagaaaaaccaaaucaaagucagcugugaacaacaggaugccugaagcaggaagaucaugaguucaaggcuugcuuaggcuauacaacaagacuuugugugaaaaaaauaaaaauuuaucugagcaaagguucaggagaagcagaauuuuucagauaacagaacuagaugcuuuucauuucuucacucuuaaauauuuuucuaacugucacacugggcacacuaacaauuuuaacaacuucuaacaaaaccuacuugagggguuuuguuuuguuuuuuuaggguuaaggugcuaggaacugaacccagauacugaacccuauccccagcucccacuuugauuauuagcaacagagcaguaaaguaauguugcaaaggguucuagaacacagaaaggcuggccuaccuccacaggucgcagcgggcccuggacaguuuccugcugugccaauggaugcagagguccagacaggccuccaccagacauucccaugacaaaguucucaguaucccacacaggcccuaggggugguaaguaugcaaugagguaccagagccaggcagaggugacacuggggaaacauucaaguuggagcuggacuuaggacuaagccaccuagcaaaaccaucuggcccccucucaucuuguuuccucuguccuuauuuuuucugguuuugucccaacccagacacaagagcaaacauucauggucaguacugagcuuagaagacaagcacagagaaggauggcuucugccacacagcaguccauaccuccaggccgcagcucgcagacauaacuauguggugcugaacacaggucuguguugcauugcccagcaggccccaaccgcacacaaugcucugcuguggcuggguguggcuccccaggcagccaguucuggcagcuuuccaggcugaaggccucaccccggggauccaggccuucuguccccuccacagaugagaagccgauccacacauccaggcuccuauggccagauucaagggacggccaagccaucagggggcagcucugcuugaccucugaggacauacucuucauaauacccugguaaaugggccauaucagccucauuuuucaaguguuaaaacagccucagaaacauuacccaacauggaccacaaacccaggcucauagucacauucauccagaaucaugucuaugggaccagcucuucuuggggacccaucucagauuuggccaaggaucaugggccaccaccacaccugaagggaaacucugagggcugcagaagaggaccaagacugcaucuaugcaugcugcaugauaguacuaucaacacuggaaggccccuccagaggcaaaaucuagagguucacggccaaacguaggcacagguacauacccaggaacauauaugcacaaagguacaugcuugggugugggcacaaaccuagacacacacccugggagggagacauaauggagcccugguuccauguagggcacuauuacccaucaacuggaugauucuggagcaagcaggucuuaaccacucuggaccucuauuuccccuuuccaaccacacaggcaaaguaaagaaugugauuaaccacucacaagacagguauuccaauuccacccagggagcaaucacccaagagaguuggaguauacccuuacaacccacccagacacaggacuguagggcccaagaauauguucccacaagccugcgcagggcauaggagccugaaaggcuuuccacagaugggauagcauguggcauugggaagggagguacucaggggaugggguggggggugagcacagcgguaggaagaggagaaaauacaaucaacagugaccaagaacuaguccugucagcaggacccagggcccuccccuacagagacaggaaagucugggggccaggacccaguucuaccuuugacacuucccagaaacgguuagagaagcugccccuaccuacaucugccuuuacauacacagagcuggcagcaaaggccaccuguggggcuguacacaaaggcccagcugcccagcuuuccuccugagccucuacaggcuuaagggcuuuggccacacccagaauucugagcaacccccacccauuuugcccuuuccagcauagguguaccugguaaccuuggagacuaggaagugcuggauggcaggacuguccaccauagccaaggcagcuccagcccaaguccgacauugcuccugugcuugcagccagggugccuucucugccaccaggcgguagcagugcccauugccagggaagaucucuguguccaaggggcagaguggguggaccacuagguaugguaagcaaugaacaagacaucaggguaugcaugaggcugggugccaggcucugcccuaccacccagguuacaagaggaagcaggaggguaggcaccuugggcaggcucuuuauccaaagccaggaugcuauaggugaccucaagggcugagccuccacgaugccguaugccaaguucaaggcucucguuacugugcacaaaggaugggcacacaagcuccaggacaguagguguugcuucuacuugcaccucugucuccagcagagcugagccagcccccaaggccagcacaacugucaugugauagcucccagguagcacauagaaguggguggcagcagggcuagccauguccaccucaggugagccaucuccaaaguuccagcguguugagcuaaugggcagggaggaaguaauauggaagucugcuggcuggccagaggccagggguccauggggccccaccaggguagccccuggggaggcgggaaaggugugcuggagcaagguggggcccccacaggcagaguugagggacagugagaugcuggaacaccaggaugagcaggcugcagaagaguuagaggccuggccugccccacagaggcauugauucugcuccgagagggcugcaaggcccucaccagcugagaagcagaaggcacugcaggccucagucuccaguggucccucaugggcaaaguagaaggguacugcugccacagcaccugagcuguugucagggaggcaggcgacauauuccucaccugggaacagagagagacaguggucucaggaacuuacuuucuucuggcugcaucguguucccuuaccaacccucuuuaaaauccaugucagagcugccacccccaaagaugccuucuagacccuaucuggccacuaucuucccauguaugccuuucccugggccucaucuguaaccaagucuguggcuccacucucccuggguacugcccaauaagaaaaaaugucaucccuguccuauagccccacacccacugcacucaccacaggcauuguccaauaaggggauacugaggagagguuggccggccaguggaaugggcccccugcacgugguugccucagacuguaccacaugcaccugauguuccuuugcccagcguggcagccacgccagaccacaguugcacucaaauggguucccacucagguuucugcaggggaggggcagguguggggcaccaggccagcaggggugcaguucagcuucccacuacccacagcucucaaaacugggaggggcuagggaacagggcaagaugacagaggaggugauggggacaggaguccaaucacugagacccacuaaaaacaaagaaacuuacauuucacuuaaauuaaauaaauuagcaaacacgccuucuucuaauguagaaauccuauuguugcuuaagucccugcaagaaagaaagauggggcaagguguaaccuucugaugacagguagcucuuucugcuugcccugaguaaccuuuagugugacgggcaugucaugaggaaggggauacucacagcuccaccagugcugaaagguucaccaggagcccuauguccagcgucugaaguagguugugggacaggucucugaggaguaagugauagucaggagacgagcucugggcuaguugagggcauaucugguucucaccaggagauucccagcauucucgacccacaagccccaccccuauucucaguccccaagagggcuuuucuugcuggucuguguaggucuguguacuggggcacagccuggccagcagcagcaaaaguucucgugggagcucagaaugaccaagguguuacagaucucuaagggaaaguagagcaaggcaggcugcucuuccgugaccucugcugaugcccuucaguggcaggcacugagacacagcgggcagcuaggggccaaggucagggccaccaagcaggaagugguuguggucaaauucacacacauuuucucaugaaagaugugagaaauaaguaaucuggggaaacugcaguagaagagccaaggaccucagaaucugcaagcaacucaguccuguaccgaggaccauuacaguagccacacaaaauaacugacccgagcaccuucucugugaccuccacagcccuccuccaaaagaagaaccuugggcuaccuccaauacaauagaagggucccauacaagcaaggaccggcuccuuauacuuuuuuacguaagauucaggguuuaccagggcuggagaaaccagcugcuaguagaggauccucaaauguucacaagaugccauaggggcacuaagaugagcugucuaaggaagaguccugcuggauaaccccgcaccacagugcuggugaugacacacagcaaauuucuccaaauaaaccaucacaaacccuucauucaggauguggagauggcucagcauucugaaagcacuugccucagaagcaagaggacugaaguuuacaucuccagaacccucauaaauucuggcuggugagacuagccauacugacgagcucuggguuugauuagagaccuugccucaaagaaagauggaagaaugaccaaggaagauucccaacaucaaccucaggauuuccuacauccaucuguauacacaugcaaacauacacaagcauaccaccuacgcauaaaaauggggaggaaaggcaccccagacuucaaaaaagaugcuaugaagguuugucuagaaguacuguugagaagaauuaagacaugcgggaauagaauguggggagauagcucaaucuguaaagugcuugaugggagaccugaguuuauuccccagaauucacauaaagaagccaggugugguagugcauauuuguaauccaguacaaggagguaaauucaggcagaucccuggaaccugcuagcaagaagagauccugccucaaaucaugguggacaguauuccuuuuuuguuuuguuuuucuuuuuuuaagaggaucucacuauguggcucugguuauccuggaacucacuauguagaucagguuagccucaaacucacagagauccaucacucuugagugcugggauuaaagucauauacuaccacacccagcugcuguauuccucaggagugacaacuuaaauuguucuuuaccccaccccagaaauguugggacaggagagauggcucagagguuaagagcacugcugcucuugcagaggacucauguucagcccccugacauccacaugguggcuaacaaccaccugggacucuaguuucagggauccaaugaccuauucuguccucugugggcacuauacacauguggggcacugaaaaacuacaggaaaaacacucauacauauaaaauaaaacauacauaaaucauaaaaaauaaaaaggagccgggcaucaugguggcacacgccuuuaauccuggcacucggggggguguggggggugggcguagaggcaggcggauuccugaguucgaggccagccuggucuacaaagugaguuccaggacagccagagcuauacagagaaacccugucucaaccccuccccccccaaaaaaaacaaaacaaacaaacaaacaaacaaaagaccaugcuucuugcaaaggauguccuucauuccauuccagaauugaagagaaaaaaccuaaguggaagcaacuugccaggcgccggcacaaccuuuaaucccauaacuugaagggcagaggcaggcacaucucccaguuggggccagcccagucuacacagugaguucuaggacaaccagagcuaugaaggaagacccuguuucaaaacuaacaacaacaacaaagaauaagcagagcucaaucucuacuucauaggaugugaaccauccaagaugcugucuuuaggcaugcacauguaacagccuuguguacuggcugcuccacugucaucugucacccuagacuaagaaaaacauuacacauccuguggaagcacucaaagcaaccuguacuaagaucaauaagaaccaucucaaugaacugauuguagacugacacaggaacucggugccaugacgugaccaagucuuccuggccuggccuccauccccaacuaaucucccagacaccacccuggcccuuugcuaauucucaucucaccuccacuauccaagcuccuacaugugaggcaauggucauaccaggggaacuaucaguuagaccuaagcaaagacuguccaguggcuagugaugacaacaacagaaaacgcugaacuuguuagaagaaaccaggauguagacugagaaaaggcuggugagguaggaauagagaccaacauaggcaggcucauacuuuugucccuaacauggaggcuuucuagccuagccuucaagauuagaggacgaagaggaaggaagugaggaauuaucuccaaauuucauuuucuuagaaagccacccugaguguuaguugcuagggucaccuaagaagccagcugaugcacaucagccucaggguacuggggaccccucguuaucuaagaacacuucaaucccucauccaaccaggcucuccacugaagccccuucccgaaaggcugcuuuguagcacugguccccagaccucaucuggacuuggguuauuaacuagaaaagaaauggggccauagggaacuacucagcuaaacuccccaaacaagacagcuuagacacaacucugacucauaucucuggggcuagagaacagcaccaacagacauggugguaugaagggauguggggacaguggagagacacacgaggucccuguccaaagacccugaacagaaauuuuccauguucccaucuguuguugccauuacuguucugaaaauauggccaaaccugacuagccucaucuuugaaggccugacuuccugccagaugaugucacuguagucugaugcccaggaaccauauuuggauucucuguaaggaucugagauaaaacaaagccaggcacaagguauccuggcagaaggcacacagaaguagggggcagcaccacaggcccuuuaccugccaugaggagguagcagguagccuagcuagaacacuguaagcgggcuacacagagaagcccugucucaaaaaacaaaacaaaaccaaaccaaacaaaaaagaccuaacccaggcacuuacagaagacacaauagucaaagcuagagagaagcugaacugggacucacacgcacuggggcaacgggcaaauguccauacuauuuccucauauggcaggucaucauacugcuugcauucccaggaaagacagaacuucaaucuccacguagauguggaguguuuccagcuugugcugucugcugccccucuccugguccacaaagggugacuaugcuggaaauggugaauaaagaacuuccauacuccauacaugugagcacccugccuuccagaucagacccucuggugggacuagaucccaauauugccaccucuguggagcuaccugacuugaugacuucaggggcuggagagauggcucaacaguuaaaaguacucuuccagaguccugaguucaaaucccagcaaccacaugguggcucccaaccaucuguaaugagaucggauaccccuucuggugugucugaagacagcuacaguguacuuaaauauaauaaauaaauaaaucuuuuuuaaaaauuauuaagccaggcgugguggcacacaccuuuaaucccagcacuugggaggcagaggcagguggauuucugaguucgagggccagccuggucuacaaagggaguuccaggacagccagggauauacagagaaacccugucucaaaaaaacaaaaaaacaaaacaaaaaaaaaaaaacaaaaauaaauuuaaaaauuauuaaaaaaaaaaagggacuucagcuuuccaagcauaucugugggcucuccuaccccauuagacaucuuguuucugacucucaauuuuccucuaauaaagaggaacagggugcucccugggucuccacacauaggcuacacaaguuggggugacacugugagacagggaaagcaggcacucucagggcaaaucuuugagacaaggauagcaagaauauaaaggcaaguguauaggucuaugcaaagguggagagcaaggagggucacuguaaacaguacaagcccuuacuaagaugggccaguuguuaagaccaaccuuuuuccagagcugcaauagaaggcucucaacaggcugcccacaagcuacagcccagaccaagagcuaagcaaccuugguuuuuuccucagcuguggggaguggccuaggugcccgcuccuuagucuagauguaggggguaggaggguguaagggccagcuggagccccaaaggaaacaucugcacauuccagacacauguggucagcaggagggugagugccagccaccccccaccagcccauugcuggccgccaugcuggaaacagggcucagggggaacaguucugaggggccauuuguggauguuauguaacccaucccacaggagccagcugccuccucccucuggcaggcuaggccagcagaguaaggagaaagcccccaguccuccccccaaccccccgccccugaggcccagcuucaucuucucccugggagaacagagucccuucaaucagcaaggaugaucccccacaaauauuuccaaccagagauaggacagaaggaaauggaaaccaccauguaggcacagucuuaggucucagagacugaggaacagagccccuagacuggccucacucugggugccuuucagcacuaaugggccuuuuguagccuagcagcagagccaguuaaguguaauauccucacucuguuuuuguucucuuugcuuuuuguucccuucuauuuauggcaagcaaggcuggcuuccagggccggaaaugauguuuaaauuaaugaauucaaguuuaagagagcgagcugggggggcgggggagggaaacagccuagcacaguggcaucaguauggaugggguagucuccggauuauaccaauuguuaguccagggagaagggucagagaggccagccaugccuuccaucacucugcaugcaucuugaggcccaucucucuccuggcuucaaaccaggacucugcacacacauaguaaggagcucagaaaggacaccaguauucaggcaguggagauguccauguuaagaggcccucaaccaggcuacaggaccucauaguuccagggcacggagauagaauaagccccacauuguuacaagauguucuguaggguauuuuuguccuuacagaacccuucguuauaguccugaguacucccacaacuaaacuaucaccaguaugagaugccaggggugacauuaccugacuaagauuuucuugggaccuauauaggcaagagcgguaaucaaagacucagaccccaaaaccagaagaaaugugacaggcaguggguccuccuaauauugagagaacagcucagucuagcccaagaaauggcuauuccaagaguuguccacuguccccauguuaauaagaccaguuagggguggaaggcucacucaccuucacaugaauggggcauggaggccacucaaucagaccacaagaaggaaaagaaccagcacuagagacacuugccucccuccaaaccacauccugauguccauguacacaaugccaggaccauauguggcugcuaaugucccauuacacucagcaaaggcaggagcugcuccaaccuugauuccaugguucaaagagccugccucuuccuucacacuaccugacaugucuaacaacaaccaguagacuuaaguucuugaugggacucaguugcugcccugguuuccuaagacccugugguguccuguaauggacaggggccucagugcagcuguagucauaucucaacuauuugggaagcagaccuggacagcagcaagaaccagcucaauacccaggcaaugagcagcauggaggcuuaggccccuugagaccucucuacuccuaagcugcaagguggccccuuacaguaaggauuauuacuguaauccuuacccuaaaggcugcaaccaggagacacugccuuuagccacugccagaggaacaaagcucuucccaagauaguuccacaggauccaaccugccuuccuagcacuagggauacuacauuuugcuaggauccaacccauaggagugccacggagaagaacugccuaccuugaccccuaaguacaccacuuuccuuggcaauuagugccugggcaucacaaggccucuuuaugaaaaagacuucugccaagccagaaagaacgagguguuccgagaaaagacaugagcugcauuuuccagcuguaucucguccuucugagagacugcucacgcccuguggugcucacaccaggccagcuggagccacacagacagcugaggcaggccaggccuaagcauggaacccaaacagccaacaccccagaaggcagcaggagaagcagaguguuuucauuccaaagcacuaggcgggccgcugucugggcuccugcugcugauguuggccaccacaauguuccggaaaggaaaaugugucuccauccaaaauggcuuccucagcugaaacccaaccccaggcaggguuucccucaggacccagggucacuaugccccccucccucucagcagaaaccuugggacagaaaauaaaggagguagcagaaugggcccguaugcucugggaaaguucagggagguccaagcauaacucaaugagagucacaaaaugggagccggagaaggcagaaaaaggcuacauagggagcccauguggagacauucuguuugcccacuguugauggaaaaaaaaaagaaugcuauuagagaacccaaaagaggaagccuagcaugguggcccauguauugggauacagagcaggaaaacugaugccaaauucaaagccagacagggauaucuagcaagacucuaccucaaaacagaaacaaaaaaacaggaagggaaaauggagguuuacacauauucugguuuuccugaaaccucccaagguucacuggcauauagagcagaaugcagggcaguaccauaucaucacccaaaucaaagaauaaggugaacugagauagcagacaccacagugugcuaucucaacacagccuuacugcuuuauacaugcccuccaggacaugaaaagacaacauggaagcuaagauuaauaaggggaaaacuaaauauguugauuuuccacugugaucccagcaccagaaaugaugccaaguuagaagccagccuacucuauauauuaaauucaggccagccagagauacagaaugagacaguaagacccuuucucacacacacacacacauacacacacaaacagaaaaauaaaggcaagaaagaaaaacaaaaaggauggcacugucacucccaugugcagugucagcagcagcacaagggaaguaaaggcagaauaggaaacucaaggucuaucuucagugcauaguaaguuugaggccaacaugagaccgucucaaaaaaaaaaacuaaaaaaauugggggcugcagaaguggcuaggagcucaaagcuugugcugccuuccaaagauccuaaauucaguuuccagcacccauguuguucagcuccaggagauauggcacccaccuauugggguacuugcacauauguugcagucacacaagcacaccaaagauacacaugaauaaaaauaaaaucuagaguugggcaugauggcacacaucuuuagucccagcacucaggaggggagaagcaggugaauuucuaaguucaaggcaagccuggucuacagagcgaguucuaggauagucagggcuacacagagaaacccuaucuugaaaaccaauaaauaaaauauaaaaauuaaaguaaaauaauacuuuaaagcaaauauaaauuuaaaaaacuaaacaaagaagcuggguauaguggcucguacuuguaagcucagcuucaggaggcugagaugguucauagcgaacucugggccagaaagggcuacaaggugacaucaugccucaaaaaacaaaacuaaaaauuagaggggguccagcauacuugguacaugccuauagucccaauacuggcugaagcaagaggauuucuugugccuguucaagaccagccugggcaauggagcaagaaccccaucacacacacacaccaccaucacacaugccccacaccacccauagaggugagaggguacugggcuaggaguaggucucauaaauccucccaaugcuaaaggcaucuuaucuuugaggucagacuuccggugucccugaccuggacacugagguauggugucccugaccuggacacugagguauggugucccugaccuggacacugagguauggugucccugaccuggacacugagguauggugucccugaccuggacacugagguaugaauaagaauuugccuggucacacuggucucucuuucuguacagcaccuggccugagcacacaucccacauucaggcucucugcucugucugcagcaggaugcucuucagguacauuuccuguugguggcugguagguacggacaaggggaccuacugaaacaucuguagugcucgugugccagugccugaacuuguccaugcaccacaaucccuuaccucggaugcccccaacucacccuuaauaccccuuagguauuuauuuauaggcaaggaaauuaagacuugaggcugauugguugagccaaagucacauggaagugcaagguuugggacauaaaccuaagucugaugacagagucccaugcuuuccuccagacagagaacuggggcagggagcagaggcagcuuaggagccccaagggagcacacagcaaaccuucaagaagccuggcguaguggugcacaucuuuaauccaguacucaagagguagaggcagguggaucucuaucagcucaaggucagccugggcuacauaguaagacccuaucucuggggaguggcaggggugguggggagaagaagaaaaaagaaacuaacuagggacaaaguaccucaacaaucuaucccauccccugagugaguuccagggcccacaaaaggaggcacugucaucucuacuccuugccaucuauuaaccagccugagugcagucuugggggucagcugcaagacucucugaccauauuacuucuuugugacacaccagucuaugacucuaaaaacuaccucaacaccugggagucuuaguuucaaagucaauacaagaacaaagagacuucaaaccacaaccccacagaaagacagcacuggcagaaaggacaccuaaagcccagcauaagccucugagaaagcagacaaggaagagugugucuccuggauaauccccucagacuuguucuccuaccucucaaaauugggaggaggggguucuccuuacaugaaccaagcuggauccaauuuguagcaaccaucuugccucugccuucaaguguuaggaugauagagauguacuaccauaccugaccucccagugaccaaaaucuauuuuuguauaaacuuauuacuugguauaauuaaagcuuauuuucaucaacaacaaaauucaggaaaaaauugcauacuauaaaguucacauuucaaacuugacaauuugaugauuuuuagugucuuccuucacaagccuggguaaucaucaacacuaauuucauguuuucaucauuccacaaagaagcccaacgguccuugacuacuacccucaacacacuauuaaucuuuuucuaucucauuagauuuaccuauucuuaacuuuucuuaggguuauuuuuaaaaaagacuuauuuauuuuauguauaugaguacacuguagcugucuucagacacaccagacaagggcaucagaucccauuacagaugguugugagccaccaugugguugcuaggaauugaacucaagaccuuuggaagagcagucagugcucuuaacugcugagccaucucuccagcccucuuagggguuuuuuaaugcuuugaggguuuuggauuuuuuuaaaaacauauuucuguguauggccuaggcugaccucaaauccaaaauccuccugucucaaucucccccaguguugagauuacaaguauaaaccaucauaccuacuuauuccccucccuacuauuuuguuuuguuuuguuuuuugagacagggucucuguacacugcucuagguguguccuggaacuauguugaucaggcuggccucaaacucaaaaucuaaaaauguauaguaccugucaccagaaaugauaucuaaaacaacaaugucugaagccaaaaauaaguuuauaccuagugucaggugaauaucccagagaucuuucuucaacaauagaauguccugccuuguagucacuagccagagaggucccagagaccuugaaagaggugugacccaccacaacagagcuggagacacagaggacagagacaugcaagaagccaacaacucacagcucagucagucagaaacuggauacaggaguuaguuuuuuucaaagucaaaaguagaaaaagagaacuagaaaaaguguagccaucagcuagauucaggccaucaacuaacuguacuagguagaccuaauucagccccuaaauuaaacuaccaaaaauccagagucaggccugauaguacacaucuguaauucuagcacuaggaagacugaggcaggaggaucaaauauuugaggguucaaggccaauuuguacuacaugucuaaacaaaaacaaacaaacaaaaaaacccaccccaaacagcugggcaugguggcacacaccuuuaguaccagcacuugacaggcagaagcagucagaucugugaguuugaggucagcuucacaaaaauguacacaguggacauccacuaaaccuaaggaaguguuuccuaguuuagauguguuuucaguguuaaaauagauaaaagaauaagaugcuggucuuuggcucgaaauauaagacaggaaugacaggcaagaagggugagguucauuauucuguucugcauacuuuucacaauagcaaggcuuuaaaugauccacaguaaagcucagagugaguuaaguagcagcacccuuccaggaacgucaccuuucuuaagcagcagcaugauuuuaagccaagaaacgcugggaagcuaugcucucagaagaccagcuguccugcuaccagacauagccguccugccaaagagccacacacauacagaggggucugauaaucagaaagaaggcaauguuccuugggcaccuaagcacuagccuaagguugcugucuguguccuugguccucagagaaaaccaucuaucugaucugcaguagucuacagaauggacaaccuacuggacacaaacugaccuugagaagcaguagggggaacucaacaccugucccugaggccucagccgguuaagucucuuagaagcaguguuggagguagaaauaaaaaugugaauucuuuacccaucuguccacacaugaggucuaucagaugucucuucccacaaugugaggggcuaauaucuugagaaccguaugaagucagucaagcuauuagcucucagaaaaccccuuguaccaaacccagggcaaccgcucaagcuucacugccgagcagagcccacagacuuguaggcucucaucuuucauucccuagacagcuccugggaggucagcagagggugaagaaggagccaacaggagcuggaccugacuccuacagauaccagguagcagagagaaagaagugcccucauucauagcauccauaaaucuggaucagaugcaauucuguggauccuauuagauagcaaaaggggauccaucuccagagacagcugcaccacaaaugcuacaguggucaaggaacacaaucauaggaacccaaaucucagcuccauacuagggugaagucaccaagcccauuauaaaaaccagugaaagggaccauuucuacuuuaacaaguuccugagggaauugcagcaagaacuacuguggcugaagugcccaggaagucuaagagguuggaaucagccgggcagugguggugcacaccuuuaaucccagcacucgggaggcaaaggcaggcggauuucugaguuccaggacagccuggauuacagagugagcuccaggacagccagggcuauacagagaaacccugucuugggggaaaaaaacaaaaacaaaacaaaacaaaacaaaaaaaaaaccgguuggaaucaguuaauccugagacaaauuacugcagucugcaaucuccucuuaacauuuuugauccaacccugguugccaacacugcaaagguccaaaccuaagcuaugaugucuaggcugugauaccuugaaaauacaucgcaucuccaagcuucuuuccucaccuguaaaacagaggucuggcucuacgccagagaacuggacuaagaauuaagugugauaaucuauaaaaagagacuaguuaagccugguucaagauguugaucucucagugagauuugccuguuacuuucagaaggcaaaacugccgaaauggcaaauguuuuaaccccuccuggcaauuuccccucccuaaguaccacuagaggcccacauccaucacacccucuacucccuaacacuucuccagcagucacuauguguggccaaccucaggccaggccgcuggaccaaccuuuugucccuuaaacauagucaauucuuacacauccauaaaauucuugucgagacucuuccccuagaggccagcucugagccccaacagaaaucuccaaccccaggauacaccucaauuagucucuaauuaacguuuauuccgcaaccuccuaccacgccccacgcacuguuguagcuccuguuugaggagccccgcaacguaaaacgucagucuucguaggaacugggauuuuuggcuacucuucugggucacgccggcugagguccaagguuuuccuuauuuagucgggccgacaucccugcuggagccucgcccuaggagcggccaggccccgcugcgucuugcggcccgagcucaggaccgcgcccacgcucugcggccgacagcccggcaaagcuccagaagggcucuaucuaccucagcccugcucccgccggacccagucaugaugcucuagccaggccgcccgccgccauggcaaccgccugcccgccugcacugccucggcgcagcuacucacagcgcgguggcgucagccgggaugcgcagacucggcccuagcgucugcagccagcggccggagcaauugacgcggcaggcggcgucgggcgcagggccgcaaaagcaggggagcgggcaaggcccgcagccgcgcccagggucuccggccagcgcuccgagccacaggcccaggccuagggccagcgccaggagagcaggcgcgccgagcggcaucgucagcgcagcccgcgcauggccccgguuccccgaggccccuugcgccggcagccgcaguucaggaggggcccgcggaccucauggugcggcacggggcugaaugccgcggcggccguggcccgucugcggugcgacagcugcucagcgcucuggggcaggccgcaccucagggccuuggccgccugcucgcgcauucgcgcugcacugcagacccagcgccagcuccuccuccucccccaccuccggcguggggcggggcgcccucagacuccgccccugcgcuuccaaguuggcuguaggugggacuggau

SEQ ID NO: 12557 - RNA, 13782 nt, Mus musculus
ugcaguuuguggaaauguuuuaauuagagcauuuguagauacagugguuaaucuguugcccacaauuccuuaccaaugaggcuucaugcugggauacccuccaccccacccucuuaacacaggauggucacagaccacauucuuauguuacaagauucacaucucugguaauccaaggacugugguacaaaaggaacacuucauagcuggggucacuacaguuugcuagaaacaucaguuacuuuagaauacuuuaacuauaaaauauauugaauuuccauauauuaaccauauacauguguaccuauuacuaaauguagucaguuguuacaaaauaagacauucugagagcaggcuacacacacacaccagccuaagcuccccaggugaggccuugugcugcaaacuguucauccaagcucggcucccgacuguacuggcggcuaaacgugcccacaaggcacuggcaacccagcccauccaggugccaccagcugugugagcacaagccccuccaauuccagagugaagacuccuggcugcagaccuggccaccccuugauuggucccugaacuugagccacuggugccugguucccaugucaggggucuuccaggggccucaggaacaagucugauggagacugaucacugcgccuauguccacugcaccucccuguguucuguaagcccuaagaucacagacccagcccagcccaggugggccacugccaagagcagcuucacccagcccagcuccagcaagcggaguauguggacaguaguaccugaggucauccugugccgaggccacagcaggcuggucuccugggccguagggcagaguugaaugcaggucaggagguguaggagcugugugcucaggugcucuagaggacccgaguuugcccgggccgguggcagagcugccucuuccagguacaagggcagggcaccaaaaggccugaagcuagcauucaggccacagcagggcccacuguacagcuaacaggcagggagaucaaugcaggccaguuuguccuuggcucucaccuggccucagccuuggucuggaucagccagucuuucaccuuucuggguuuacgaaggcuggaugcggauuccaacuucaugaggcucucaacgcugccugguaccuuaaggcccaaagauccagguggggagaacagaacacaucccuguacacaguccuauuuacaaagaaccagaugaagauggagcugcauggggccugggcauaucccuagcagaagcugagaccuccuaggugcugguccuggggcucagccuuggugccuggcaaggacugcagccaugugaggagggccagguguacugagauagauaccuccucacauuuuaaugaugauaaugcaacaaaaaccuuuauauaaacaguuuauuuacucuaaacagcaacacagacgaaacgccauauaaacacaaaggaaguggugcaggauggaaaugcuggccaacuuuggaucugaggcucauaagcaacagcccagguuucugagaaggacgaggguagggaaggagggacagugugguucugucacacagccagauggaagccagagcucugaacagugggaagcaugccugcauccgagcgcgacgcaaagaaacuagcugcuaggggcuuaccaaguacaaaaguuuaucacuuuacagcaguugaaauacugacaucaauauuaaaauaaaagcaaguuuuacuuaauaaucaaaaauacaaaagacugaauaugccaguggcggaaauggaaaauggcgcccgcucaacccucccaggcgacuaguaacuguacggagcgacuuagaucugcaaaagguuguaaacaaguucuugccaagccaaucccuuccucgucauggagcccagggccgcugcuuaugagggggcaaacuucuucgcuugugcucggacccuuuucucauauuccacucuguuuuggcuaagggggucaagaggaaaaaaagagaguuagauagggcggcaacaugaccugcuugcugagauggagagaacccacccagugccugcccaggagcagggaggcaaagugguugguuauaccagguggcccugugacaggggaggggcgacaaccucccuggaagguucuauguccaccucaacaucaggaacagaacauaggcaaacacaugggagacagaguguccucggccucuugcagugucacuacccaugcugugcugagccuuuugcuagauagagucagggcuuugcugcccaggcucgagugcaauggugcuccaguagacucccacuacugccuaguaagugccgucuguggcuccacugcugggaagccacgucaguggugaacucacucuaccacggccucucagcucaggugggaacacaaguguguauguccaccuagcaaacucaggaagccugcucuuagacagguggagagcagcucacuggcacuggguuuuguucaguucugaagacagguaagagcaucugugggcuuucacuguugagacuucagaccuaggcuagccugcacugugaaugggaacagaaaagugauguacgggaacaaugugaccuuaaggaccacagaacaagaagacauuuccaggcugggcuccuuagagcagcaguccuuaggggucacagucaauaguccuggcauagcaugagucgcaacacaucagugaccucgcaaagugucccuagagcaagccugagcccaaguugccuggccucggagauuacagacagaguggcagguucuuguaccaaggucaccucagaaaggcccaguaucagaacccaaacagggaggacauaauacuuagaagcucaugcuaguccugggaggcggcugacauuaccaugaugacagcagcucagcccucaaccaagaguacugccauucacuaaacaaggcuaugacagcaaggccacucaggaaggaggggcaagagcuucuacauacacagugaaagcaggcacaaaacauguuauugacagaaacccagaugaugcaggagagaaaccccagcaccaaggacugcacuaagugcuggaaaaacagagccauguuagcuagccgggaaccacaccuuaaggccaaccgugaacagagcuuggucuaaggcagagugcugcugagcaccagcgcaaugaggggcuccaagggcuuggcagaagcacaccgcuucaugagcugcauacuccuugugccugugccuggugcaggcagcacaacacaacacugauggagcugaccugucacagcaucuuacacagggucaggccugaaagacccuggagcacaggcagucaguacacaacauugcaccaauggguguaagcuacauucccagggaugcuagacaggcuugcccuggccaccagagaaggcagcacacaaguaucaagguuggauaugcacccaauuuucuucugauuccuucccugacaauacagugcacacccacuccuuccugucccacauaguucuaguggguugacagaccucccuagagccaugggcuaagacaggggugccugggacucugcucagaggaccucugcucuauuuccauuggggugaguaggcgguugguacuugagacacagggagaacaguggggucaaggucccugcaguaacacuaaucuuaggaaugaauuccagccacaguaacuuuaguccuugccuagauuagcaggauccucacagucagcaaggaugaagcgugagugugugcacucacauacucguuggaccucuauuuuaaguguuuuccgugcugccuacagaacuggcucaacuguuauucaaguccuaacugaucaugggagguuauucuccuucaguagauagaaaaagagccaagagcacucuaucagcgaggcuguguuaugcaaugggccacaaccuuuuauacaccuaccacagaucacuccaaauggcccaucagugcccacaccaccuguucuaugcccacagucacaucugggcccuguccuugcucagaguaagcuccguguacacauggcucuguuccugaccagucagacaugcaguguccuugguggcucuuguggugcugccacccagugggaguaugcgccucuuccccgggacucccucucagcucucauaucccagagcuccaaccugacaggcagccagucugcacuuccaggaaaggaagguuagccagcuggcaguugcuacuaaccaguaaauuguguaggccucugcuugagcugggucuugaauauuugguucauuuagaaguucuuguauuccuaauaagaucuguaagagaaacaaaaacaaucagcucgccgggcaugguggugcacgccuuuaaucccagcacuugggaggcagaggcgggcggauuucugaguucgaggccagccugaucuacagagugaguuccaggacagccagggcuacacagagaaacccugucuccaaaaaccaaagcaaaccaaucagcuuacauugagagggcuugugaaaaacacuguuggcuacugugaccaggacaaaccccuaagagggcagucaggugcuacuccauaccuguuugauggugauagcuggccuccaguccuugucuuccuccaggauggacaggcacacugugccagaaggauacacguuuggaugaaacagugggggcucaaauuuaccuggaggacagggaggggaaggaauacuuuuggaggcagaugcuguccccauccugugcuggcccugaccggucuuccugacacuagagcucuuuuaaaagauacaaacucagaaacucaauagcagaggguccagaaagaggagaguacgccuuuccuuccugaggagcugagccuagacaaagcagccagaagacaccauggucaggagccagagggacuaagccuaugcucuucucauguucauaggaagaggaaagaggcuagaaugcaugccccaaagaccuuuucaguguacacaggcuucaaguacaccacauuucucuacaauaguagaaaaaucuacuccaaacucagguacuauucuauagcugauacuugagaaggugccucacuuugaucuaggcaaccuucuuucgcuuuauuuucaaaccuguacacccccaaaaguacaagucuaaaggcagcuuguuuuuuaguaaaugaaggggucugggggggcggggggcagcucugcggcagcacacuucccugguauacaucagguuuuggcugaguucccaguacuacaaacaaaugagcugagcagcagcaucaacuacacaccuauaccaacuacucuguaggcuaagcaagaagauuaugaauggaaggccagccuaggcaucuuagugauaucuuguuuaacaaacaacaaaacaggggugaggugggguuggauaaagggcuuagagguuaggaacacuaacuguucuuccagaggaucggggcucguauggagacuuacaacuacugcugcucuggggagggaaugaauguuuguuccuucuuuucuuucuuuuguuuuuuaaaaguggguuucucuauacagcccuggcugaccugccuugaacucuggugggaugaaagaugccacccccacccccaauuuuguuaaacccuuacuguccucgagcuuuaaauaaaagaaaggugggaguguagugauggaacgcuugucuagcuagcaucugugaggcccuggguucaaucccaagcaucacaaaaugcuaauaaguuaauaagaaugagacaaagcaucaacaccagcauuaaggcugaauccuagaaaccucccuaacugcucugugcagacagaauggcucugaguuacugcaugccucuccaagcagagcugugaggaaggaccugagagugacuuaugccaugggcacaaugauaagcaaauggagaggguuugggugucaagaccccaaacuaauuucaucaguuccuccagcccaucugucucacaauugggccaggccuccacagaggcacuucuggcagccaccuuaauuuuuuuuuuuuaaaacccacugaagagugauugcacacaccucugaucccagcaccugguaagcagaggcaggcagaucucugaguuugaggccagucugguauguggaggaacuuccaggacagccaaggcuacacaggaaaaccuguuucaccccaaccccaauuuuuucccuguuuuuaauauguguagauauauauguuuaauauguguagauauauauguuuguggaucauguauguguagcgcucauggaagccagaaaagggugucaaauccccuaggacgggaguuguaguggaacugucaugggauguuagaauccaaccuugguccacuagaggagcagcuaguauucuaacccagagccaacacuucugcuuuaaagcucaccuuaucucugggucccuuacucaucagugauucucaacacaagucugcuccagcaggcaucuuuccaauucugggcucuucuuuguguccuuuaacuuguacuuugcaaacacaaguuuacucuuccuugccaaccauguuuacuucuaccagccauaccuugcaugaaucucagcuggcccaugagccccucccuguuuuuagccucacucagcaauagaagcugcuuugagcugcauggaucagacauuaaggaacccaccauuuugcugucuggggguuuagaugcuccaucuugcuucccuuuaaucucaauuauuucccaggcugcuacuaauacacaccugcaccaacucuuugacuucugauucuuaccaaccuggcuuccgugguguuccugucuuugugaacaugugugagcauuucuacugguaguucuacagaacaguggcaggucagcuuuacuggugacagcagagaucuuccagagaaacagccuucacauaacccagcaagggccaagagcuucugcugcccagcccuuggcugccucaggucuccuucucgauaacccagaagagccugacaaacguguacucugcuccguugcaucccuagcuggugucuucuaagacugacuuaacuccagggucacaauuauagccaauccccaaggccaacaccgaguacaagaccucucucccauggcauuugguaccacuacaacagcucaguuccaaacgucugcaggcuaugcuccauuucuucacguucaccuuuuuccuccuaagcaugcuucuugguuuuccuagccaguuuugagagacuugucucauuguauuugcucaggauuccagcaccacacgaaaggaaagagaccaacaacucugucuaccucaauccuagcuacauaccccuuaaaagaaaaaacuaacaaaagaacucaggcagacaaggaaaucccaaacagaacaggcaagacuccaucuagugguucccaauaaacuauguuuuaguacuccuggggaacucugcaucagguaacaucuauuuauaaaccagcucagaccuggccuuacuuauccugggcagaauggugguggugggcacuguacccccaagcaaguucugcugagcugaacagagaucaguccagccuucucuucugaccccauggucugaaggccaugagcaucccacagaacacagcagauggggaugaguaagagucuccucucuccuuuagugcucugaauggaacucagcugauauaugcuaaccacucacguaaucuaugggaacuuacagacucgaguucuccugugggcacaaaagcacccagaagcuucagccugacacaacucucccucugccaugugugguacauccuaauaggcugggauuagagaccacacuaauuacaugcgcaucuacccugggacuugucauccaagacaacucaccaggaccgacuaucccagcacuggcaccugccuacuaggccaagcacucacagacauggcucccaaaggguggugguagugcugggaaguggacugcaggcucuuugcacaacuuacauuuugguggugaggacggauagucaucuuugaaaagcauccguagcuugaacaagccuccuucccauggagucuguggggagggaaccaagguuagaccaguggcucacuugccaagguaagcccaggagaaguuuccugaaaccuggguccuuugggcuucuucucuaacugcccuacaccaccauuacugcauacucugcaacugagccuuguauagaugaacccaaacuauguuuuugcucagacacuaagcugaccuagaggucuggguuuggugaaugccugaaguuauaggagaccaucccucuuacaugugcuggacaagggcagacaaccggcugcacucaggcccaugaguguaaagaaacacggccuggguucuccaugggcaccucaccauuggggcuuacugcuuuguagccagcaaccuucaccugcucuuuaccccugaccccgggcuguucacugauccagugauuugccaagguccaagccuccuuaccaccacaggccacuccuuauccaggggagagcugugaccuggcaggcuagcuguggucacaaauaugcaaacuuaggucccuucuaguaguucugcuccuucagaucuguuaaguuaguaggugcaaagccagcagucacccuuacccccuucuuuccagggauagcgcacucccaguucaucagguucauugugccaucaggguucuuuguugggacagcuacaaagcccugagaaagaacagucacaaaacaaagcagcucagacgacaagccuagcugucccccaguggccacaggcugagaccaccaccccaucagaaagccccuccuacggcagacacagagugcuccuuacaaaagggugguccuuccuccaggcuuuccuuuccugcgcaaggcggcugagggcgauccccgacauauucaaagucccuggaacagaauccacacagggaggguuagggaaagcacacacagaccuccucuaagccaccccuaccuccuaccccagccacagagggcuguuaccaagaagcagguaaaugaggcuggaguccagcugggcaagcugcccuuggagcaaguguagcauuacaccccucaaccggccccucagaacgccuccggguguagggagagcaccaccgcugucucucuugugcuuuacaaacucaacugcuggaagggucagugagaagagccugcacaaaggcugucaccucccuggcaggcacugagcaucucuggagagacuuggcacccacuccacagucaaauccucaggacaggcaggaccucccagguacugcacacacuuaucugaggcuaagauguauggccagcuuagaaucaggccugaaaggaggacaaucacuagauguacuagugagaaaaaucuauaccacagggcagagcguggucaacuuccauaggcagacugccccaagaggccaggcuaucagccuauagcuuaccagcucauaguucagagaucugcccuaugacccuaggggaaggagggcaagauccaggucaggccagcagccucugccagagaccaugguggcacacuugacaaggcccuuaggugaacaccucucuaccuaggcccacagccugcugcuuugacugugaugccaaccuggcuaccaccugcuugaguuuuuuuuuuuuuuaaucugcacauccuuuuuaauauuacuuuaaaaauaaaaucacaugaaacaauacucaagagacucccaaacccacagagcacagggauuuaggggugugugaucacaagaacaugaccccugugaacaagaaucuagcagagcaauggguauuucacacugaguugcuucucagagguuccauauuugaccccagcuucaggcuuccauuaggcuuguggguaaaaucucccagcuggacuagcacuagccuagucucucguuuucagcucagucuucacucugaggcggaaccuccaaccaccucuagacaagaguaagauucuugccagagcacaucccugcuacagcuucugccaggcuucaagcagaccucccaugaguucuugcuauuuagacuuagcucaggcugcccauuuuaucugcaaagcugugacuacccuaggauuuacugcguguuccugacccagcuaggaucccugggcuacaggugggcugaucagauaugcaccuccaucuguaagcacaguuguucugaaccugaacagacagacccacugggucaaagcauucuggugaguccugcacugaaguuacagaugacuuguuuuaaguucagagucucacacuguagcccagguuagcccaaaacuccuggcuagcuccugguauugggauuacaggcaugagccacuacaucuggcuccuagaccacuuuuucuuucuuucuuuccuuuauuuuuggagacagucucaccauguggccacagcuggccuugacagucacgcaccacagcaccuagacugcuugugaugacuguacaaauccaaguagagaggggcugggacugccaucagagguacagcaucaccccagagcccagaguucaggaaauacuucagugggugaggucauuguaagacaaacacuucauaucagcauuuuuaauauccuguacacucuaagccaacaugaagaaccucuuuuagaagcacaagcugggacuggcgaaauuaagaguacuagaugcucuuccaauggguucaacucccagcacccacaugccagcuuaugauugccugaaacuccaguuccaggggaccuggaugcccucgaacacacaaacauacagguaauagugcacauaaaauauauuaaaaaaaaaaaagcacaagccaccaggacaagccuugacaauguuggcauuccuucuaagcauaccuggcucuaucaaacaucccgauuccuuuuuuuauaaaucacaacagacaguacuuaugcuccacaaacuccaauaccaaaucacaaaguauacaaauuaaaggcaaggcuccucucuuacagaccucaaguccaaaacagagaguccagcccaaacccaacugucuuuuccuagcacaggaguagagccugucuaggaacaagcaccaagguucugccacaaaaccccaaccugcccuaauagucaucucuuaggcaauuuacgacccagguggcgcucaucuaagagugacuggagcauagggcuucacuuccaaugugucccucuuuucaacuucucaacgcacaggccugcccaaucucuuucucuagcaucuuccacugaagcagcuauccucauccagccaaucagauggcagaagauggcaagcaagucugggcaggguuuccuaacagguuucucucuggagcccggggccagugcucuggagaaagaagccuggacaccgggccacacaaagcuguugggacagcuguaacugacuucaggauaaaguugugugcccagagaacucuguccuagcauccaacugcagcuauccuaagugagaagaaccgagaagcuagcucaacugcucuugccuggacacucaguguuaaggagacagaaccagggaaucaccaagaguucaagguuagccuuggcuacaagagauccugucucaaaaacagggagaagugagagguggcucuuaucagaacucuuaaaggccuuuugccccacggucgaggaaaaggaacccuaggagcacccuggcaaugaucuaggcagaaacuuggggggcagugcugcugcucccgcaagcacuccaaaagccacuuaaacacaacuugccuucccaggcaaacagucacuucacgagcuaaaaguuuugugaugcaaugaccaaacuaaaccaaaccaaaccaaaaaaccauuccccuccccacuacuagagacaggaaggacauacagggaugggucuuaugacuccaggcuuccuacaguguacaguauuugucuggcgacaccaccuacuucagagcuacuuaccggucagagagccugugcaagguugcuuaucuccgcccaccucggcagagggaacauggguaccaggcacuacggcuggcuuggauagggcgaagcggccucuuuuacucgaaugcacacuguaggcccuaaggauccuucaguaaguauaccacgcuguuuguuaaguuuccaguggcagagacagccagaggagggcaggacugcgaucacucacagccugaauaccuuuagaaagaaaacaaacuccccuucgacgcccguuuucugcuaugcaggcagguaacuaacucauccacuaaaacaacaguuccuuaagaauaaaggaagguggggcagagaauauacacaagacucccccacaaaaacccaagcuacaagccuagcgucucgguaacgaacgaagccuucugaugugacuccgggugcuuacaggccccgacacggcccaguacucacggccuuccgcacucucacucgccuaacuacggagcccagcaccgcccagaacgcgucugggagcuacugggaagcucagauuaucuguugcggggucggcggaacucaguucgccaagaguaggggggcagugggccgugcucccaacccuguauucucccguggcacagcggcugggcccuagugccccgaaggccgagacucggaggccgcgagcgagaggaggccgccguggcuccgcucggcgccucccggaagcucacugggaacggcggcgaguccgggcgaagaugggagugcgugcgcaggccgguggcggcucaccugggcgaccgcggcccggaccgucgcggcggcagaggcggcggcgcuccuuugucucgggacuucccuccgcgcccgccgcgcgcagcacggagcgcaggaccccagcgggcggggcggggccugagcugggcugcccgccacacgccugcucagcuuaccgucccucccguccgguggccuacgcgucuacuuaaacacgagcuucccgcagcccgcacgcggcugccgcgcccucguugcccgcgaccgccuaaggagcccgagcccagggcgccuguccaagcaggcggugcccugaacggccgcacucuuaaaggggccgcguccuaggcucgagggagcgucugcaaacuccucuucgggaugagcgcguccacucgaggacacaucagagagucgugugaggaaaaagaagcauagauucccaagggucauccggaugcucagagggcaccuucccgggcacaggcucuggagguauccuugggcucaaggcccgagucccgggagcaaagaucacugaggccuaaacauccugggaaucgucgcaguacggugacgauccccggaacuuagcgcgcugugacacuuucugcaauuggccagcucaggaacuugggcggggugaaccucgaaacuauccaaugaacuagccucauacaaagggccaaacgcaagcaaaaccgacggggagagaaauguggaugcucccuaaccuacgaguuagcccccuagugggggaggggaaugggccugcgccgugggggaggggcagcacccgcggacccccccccccgcgcgcgcgccccaggccucuucccugugccgcaccccacaccuuaguuccaccugaaaccccugugcggcuucugcuggccccgcuggacacgcuuuugucacgccguggccuaguccaguuuccucggccaguccucugcaacccagcucggaugcuuccucaccgacuc

SEQ ID NO: 12558 - RNA, 13782 nt, Mus musculus
gagucggugaggaagcauccgagcuggguugcagaggacuggccgaggaaacuggacuaggccacggcgugacaaaagcguguccagcggggccagcagaagccgcacagggguuucagguggaacuaagguguggggugcggcacagggaagaggccuggggcgcgcgcgcggggggggggguccgcgggugcugccccucccccacggcgcaggcccauuccccucccccacuagggggcuaacucguagguuagggagcauccacauuucucuccccgucgguuuugcuugcguuuggcccuuuguaugaggcuaguucauuggauaguuucgagguucaccccgcccaaguuccugagcuggccaauugcagaaagugucacagcgcgcuaaguuccggggaucgucaccguacugcgacgauucccaggauguuuaggccucagugaucuuugcucccgggacucgggccuugagcccaaggauaccuccagagccugugcccgggaaggugcccucugagcauccggaugacccuugggaaucuaugcuucuuuuuccucacacgacucucugauguguccucgaguggacgcgcucaucccgaagaggaguuugcagacgcucccucgagccuaggacgcggccccuuuaagagugcggccguucagggcaccgccugcuuggacaggcgcccugggcucgggcuccuuaggcggucgcgggcaacgagggcgcggcagccgcgugcgggcugcgggaagcucguguuuaaguagacgcguaggccaccggacgggagggacgguaagcugagcaggcguguggcgggcagcccagcucaggccccgccccgcccgcugggguccugcgcuccgugcugcgcgcggcgggcgcggagggaagucccgagacaaaggagcgccgccgccucugccgccgcgacgguccgggccgcggucgcccaggugagccgccaccggccugcgcacgcacucccaucuucgcccggacucgccgccguucccagugagcuuccgggaggcgccgagcggagccacggcggccuccucucgcucgcggccuccgagucucggccuucggggcacuagggcccagccgcugugccacgggagaauacaggguugggagcacggcccacugccccccuacucuuggcgaacugaguuccgccgaccccgcaacagauaaucugagcuucccaguagcucccagacgcguucugggcggugcugggcuccguaguuaggcgagugagagugcggaaggccgugaguacugggccgugucggggccuguaagcacccggagucacaucagaaggcuucguucguuaccgagacgcuaggcuuguagcuuggguuuuugugggggagucuuguguauauucucugccccaccuuccuuuauucuuaaggaacuguuguuuuaguggaugaguuaguuaccugccugcauagcagaaaacgggcgucgaaggggaguuuguuuucuuucuaaagguauucaggcugugagugaucgcaguccugcccuccucuggcugucucugccacuggaaacuuaacaaacagcgugguauacuuacugaaggauccuuagggccuacagugugcauucgaguaaaagaggccgcuucgcccuauccaagccagccguagugccugguacccauguucccucugccgaggugggcggagauaagcaaccuugcacaggcucucugaccgguaaguagcucugaaguagguggugucgccagacaaauacuguacacuguaggaagccuggagucauaagacccaucccuguauguccuuccugucucuaguaguggggaggggaaugguuuuuugguuugguuugguuuaguuuggucauugcaucacaaaacuuuuagcucgugaagugacuguuugccugggaaggcaaguuguguuuaaguggcuuuuggagugcuugcgggagcagcagcacugccccccaaguuucugccuagaucauugccagggugcuccuaggguuccuuuuccucgaccguggggcaaaaggccuuuaagaguucugauaagagccaccucucacuucucccuguuuuugagacaggaucucuuguagccaaggcuaaccuugaacucuuggugauucccugguucugucuccuuaacacugaguguccaggcaagagcaguugagcuagcuucucgguucuucucacuuaggauagcugcaguuggaugcuaggacagaguucucugggcacacaacuuuauccugaagucaguuacagcugucccaacagcuuuguguggcccgguguccaggcuucuuucuccagagcacuggccccgggcuccagagagaaaccuguuaggaaacccugcccagacuugcuugccaucuucugccaucugauuggcuggaugaggauagcugcuucaguggaagaugcuagagaaagagauugggcaggccugugcguugagaaguugaaaagagggacacauuggaagugaagcccuaugcuccagucacucuuagaugagcgccaccugggucguaaauugccuaagagaugacuauuagggcagguugggguuuuguggcagaaccuuggugcuuguuccuagacaggcucuacuccugugcuaggaaaagacaguuggguuugggcuggacucucuguuuuggacuugaggucuguaagagaggagccuugccuuuaauuuguauacuuugugauuugguauuggaguuuguggagcauaaguacugucuguugugauuuauaaaaaaaggaaucgggauguuugauagagccagguaugcuuagaaggaaugccaacauugucaaggcuuguccugguggcuugugcuuuuuuuuuuuuaauauauuuuaugugcacuauuaccuguauguuuguguguucgagggcauccagguccccuggaacuggaguuucaggcaaucauaagcuggcaugugggugcugggaguugaacccauuggaagagcaucuaguacucuuaauuucgccagucccagcuugugcuucuaaaagagguucuucauguuggcuuagaguguacaggauauuaaaaaugcugauaugaaguguuugucuuacaaugaccucacccacugaaguauuuccugaacucugggcucuggggugaugcuguaccucugauggcagucccagccccucucuacuuggauuuguacagucaucacaagcagucuaggugcuguggugcgugacugucaaggccagcuguggccacauggugagacugucuccaaaaauaaaggaaagaaagaaagaaaaaguggucuaggagccagauguaguggcucaugccuguaaucccaauaccaggagcuagccaggaguuuugggcuaaccugggcuacagugugagacucugaacuuaaaacaagucaucuguaacuucagugcaggacucaccagaaugcuuugacccagugggucugucuguucagguucagaacaacugugcuuacagauggaggugcauaucugaucagcccaccuguagcccagggauccuagcugggucaggaacacgcaguaaauccuaggguagucacagcuuugcagauaaaaugggcagccugagcuaagucuaaauagcaagaacucaugggaggucugcuugaagccuggcagaagcuguagcagggaugugcucuggcaagaaucuuacucuugucuagaggugguuggagguuccgccucagagugaagacugagcugaaaacgagagacuaggcuagugcuaguccagcugggagauuuuacccacaagccuaauggaagccugaagcuggggucaaauauggaaccucugagaagcaacucagugugaaauacccauugcucugcuagauucuuguucacaggggucauguucuugugaucacacaccccuaaaucccugugcucuguggguuugggagucucuugaguauuguuucaugugauuuuauuuuuaaaguaauauuaaaaaggaugugcagauuaaaaaaaaaaaaaacucaagcaggugguagccagguuggcaucacagucaaagcagcaggcugugggccuagguagagagguguucaccuaagggccuugucaagugugccaccauggucucuggcagaggcugcuggccugaccuggaucuugcccuccuuccccuagggucauagggcagaucucugaacuaugagcugguaagcuauaggcugauagccuggccucuuggggcagucugccuauggaaguugaccacgcucugcccugugguauagauuuuucucacuaguacaucuagugauuguccuccuuucaggccugauucuaagcuggccauacaucuuagccucagauaagugugugcaguaccugggagguccugccuguccugaggauuugacuguggagugggugccaagucucuccagagaugcucagugccugccagggaggugacagccuuugugcaggcucuucucacugacccuuccagcaguugaguuuguaaagcacaagagagacagcgguggugcucucccuacacccggaggcguucugaggggccgguugagggguguaaugcuacacuugcuccaagggcagcuugcccagcuggacuccagccucauuuaccugcuucuugguaacagcccucuguggcugggguaggagguagggguggcuuagaggaggucugugugugcuuucccuaacccucccuguguggauucuguuccagggacuuugaauaugucggggaucgcccucagccgccuugcgcaggaaaggaaagccuggaggaaggaccacccuuuuguaaggagcacucugugucugccguaggaggggcuuucugauggggugguggucucagccuguggccacugggggacagcuaggcuugucgucugagcugcuuuguuuugugacuguucuuucucagggcuuuguagcugucccaacaaagaacccugauggcacaaugaaccugaugaacugggagugcgcuaucccuggaaagaaggggguaagggugacugcuggcuuugcaccuacuaacuuaacagaucugaaggagcagaacuacuagaagggaccuaaguuugcauauuugugaccacagcuagccugccaggucacagcucuccccuggauaaggaguggccuguggugguaaggaggcuuggaccuuggcaaaucacuggaucagugaacagcccggggucagggguaaagagcaggugaagguugcuggcuacaaagcaguaagccccaauggugaggugcccauggagaacccaggccguguuucuuuacacucaugggccugagugcagccgguugucugcccuuguccagcacauguaagagggauggucuccuauaacuucaggcauucaccaaacccagaccucuaggucagcuuagugucugagcaaaaacauaguuuggguucaucuauacaaggcucaguugcagaguaugcaguaauggugguguagggcaguuagagaagaagcccaaaggacccagguuucaggaaacuucuccugggcuuaccuuggcaagugagccacuggucuaaccuugguucccuccccacagacuccaugggaaggaggcuuguucaagcuacggaugcuuuucaaagaugacuauccguccucaccaccaaaauguaaguugugcaaagagccugcaguccacuucccagcacuaccaccacccuuugggagccaugucugugagugcuuggccuaguaggcaggugccagugcugggauagucgguccuggugaguugucuuggaugacaagucccaggguagaugcgcauguaauuaguguggucucuaaucccagccuauuaggauguaccacacauggcagagggagaguugugucaggcugaagcuucugggugcuuuugugcccacaggagaacucgagucuguaaguucccauagauuacgugagugguuagcauauaucagcugaguuccauucagagcacuaaaggagagaggagacucuuacucauccccaucugcuguguucugugggaugcucauggccuucagaccauggggucagaagagaaggcuggacugaucucuguucagcucagcagaacuugcuuggggguacagugcccaccaccaccauucugcccaggauaaguaaggccaggucugagcugguuuauaaauagauguuaccugaugcagaguuccccaggaguacuaaaacauaguuuauugggaaccacuagauggagucuugccuguucuguuugggauuuccuugucugccugaguucuuuuguuaguuuuuucuuuuaagggguauguagcuaggauugagguagacagaguuguuggucucuuuccuuucguguggugcuggaauccugagcaaauacaaugagacaagucucucaaaacuggcuaggaaaaccaagaagcaugcuuaggaggaaaaaggugaacgugaagaaauggagcauagccugcagacguuuggaacugagcuguuguagugguaccaaaugccaugggagagaggucuuguacucgguguuggccuuggggauuggcuauaauugugacccuggaguuaagucagucuuagaagacaccagcuagggaugcaacggagcagaguacacguuugucaggcucuucuggguuaucgagaaggagaccugaggcagccaagggcugggcagcagaagcucuuggcccuugcuggguuaugugaaggcuguuucucuggaagaucucugcugucaccaguaaagcugaccugccacuguucuguagaacuaccaguagaaaugcucacacauguucacaaagacaggaacaccacggaagccagguugguaagaaucagaagucaaagaguuggugcagguguguauuaguagcagccugggaaauaauugagauuaaagggaagcaagauggagcaucuaaacccccagacagcaaaaugguggguuccuuaaugucugauccaugcagcucaaagcagcuucuauugcugagugaggcuaaaaacagggaggggcucaugggccagcugagauucaugcaagguauggcugguagaaguaaacaugguuggcaaggaagaguaaacuuguguuugcaaaguacaaguuaaaggacacaaagaagagcccagaauuggaaagaugccugcuggagcagacuuguguugagaaucacugaugaguaagggacccagagauaaggugagcuuuaaagcagaaguguuggcucuggguuagaauacuagcugcuccucuaguggaccaagguuggauucuaacaucccaugacaguuccacuacaacucccguccuaggggauuugacacccuuuucuggcuuccaugagcgcuacacauacaugauccacaaacauauauaucuacacauauuaaacauauauaucuacacauauuaaaaacagggaaaaaauugggguuggggugaaacagguuuuccuguguagccuuggcuguccuggaaguuccuccacauaccagacuggccucaaacucagagaucugccugccucugcuuaccaggugcugggaucagaggugugugcaaucacucuucaguggguuuuaaaaaaaaaaaauuaagguggcugccagaagugccucuguggaggccuggcccaauugugagacagaugggcuggaggaacugaugaaauuaguuuggggucuugacacccaaacccucuccauuugcuuaucauugugcccauggcauaagucacucucagguccuuccucacagcucugcuuggagaggcaugcaguaacucagagccauucugucugcacagagcaguuagggagguuucuaggauucagccuuaaugcugguguugaugcuuugucucauucuuauuaacuuauuagcauuuugugaugcuugggauugaacccagggccucacagaugcuagcuagacaagcguuccaucacuacacucccaccuuucuuuuauuuaaagcucgaggacaguaaggguuuaacaaaauuggggguggggguggcaucuuucaucccaccagaguucaaggcaggucagccagggcuguauagagaaacccacuuuuaaaaaacaaaagaaagaaaagaaggaacaaacauucauucccuccccagagcagcaguaguuguaagucuccauacgagccccgauccucuggaagaacaguuaguguuccuaaccucuaagcccuuuauccaaccccaccucaccccuguuuuguuguuuguuaaacaagauaucacuaagaugccuaggcuggccuuccauucauaaucuucuugcuuagccuacagaguaguugguauagguguguaguugaugcugcugcucagcucauuuguuuguaguacugggaacucagccaaaaccugauguauaccagggaagugugcugccgcagagcugccccccgcccccccagaccccuucauuuacuaaaaaacaagcugccuuuagacuuguacuuuuggggguguacagguuugaaaauaaagcgaaagaagguugccuagaucaaagugaggcaccuucucaaguaucagcuauagaauaguaccugaguuuggaguagauuuuucuacuauuguagagaaaugugguguacuugaagccuguguacacugaaaaggucuuuggggcaugcauucuagccucuuuccucuuccuaugaacaugagaagagcauaggcuuagucccucuggcuccugaccauggugucuucuggcugcuuugucuaggcucagcuccucaggaaggaaaggcguacucuccucuuucuggacccucugcuauugaguuucugaguuuguaucuuuuaaaagagcucuagugucaggaagaccggucagggccagcacaggauggggacagcaucugccuccaaaaguauuccuuccccucccuguccuccagguaaauuugagcccccacuguuucauccaaacguguauccuucuggcacagugugccuguccauccuggaggaagacaaggacuggaggccagcuaucaccaucaaacagguauggaguagcaccugacugcccucuuagggguuuguccuggucacaguagccaacaguguuuuucacaagcccucucaauguaagcugauugguuugcuuugguuuuuggagacaggguuucucuguguagcccuggcuguccuggaacucacucuguagaucaggcuggccucgaacucagaaauccgcccgccucugccucccaagugcugggauuaaaggcgugcaccaccaugcccggcgagcugauuguuuuuguuucucuuacagaucuuauuaggaauacaagaacuucuaaaugaaccaaauauucaagacccagcucaagcagaggccuacacaauuuacugguuaguagcaacugccagcuggcuaaccuuccuuuccuggaagugcagacuggcugccugucagguuggagcucugggauaugagagcugagagggagucccggggaagaggcgcauacucccacuggguggcagcaccacaagagccaccaaggacacugcaugucugacuggucaggaacagagccauguguacacggagcuuacucugagcaaggacagggcccagaugugacugugggcauagaacagguggugugggcacugaugggccauuuggagugaucugugguagguguauaaaagguuguggcccauugcauaacacagccucgcugauagagugcucuuggcucuuuuucuaucuacugaaggagaauaaccucccaugaucaguuaggacuugaauaacaguugagccaguucuguaggcagcacggaaaacacuuaaaauagagguccaacgaguaugugagugcacacacucacgcuucauccuugcugacugugaggauccugcuaaucuaggcaaggacuaaaguuacuguggcuggaauucauuccuaagauuaguguuacugcagggaccuugaccccacuguucucccugugucucaaguaccaaccgccuacucaccccaauggaaauagagcagagguccucugagcagagucccaggcaccccugucuuagcccauggcucuagggaggucugucaacccacuagaacuaugugggacaggaaggagugggugugcacuguauugucagggaaggaaucagaagaaaauugggugcauauccaaccuugauacuugugugcugccuucucugguggccagggcaagccugucuagcaucccugggaauguagcuuacacccauuggugcaauguuguguacugacugccugugcuccagggucuuucaggccugacccuguguaagaugcugugacaggucagcuccaucaguguuguguugugcugccugcaccaggcacaggcacaaggaguaugcagcucaugaagcggugugcuucugccaagcccuuggagccccucauugcgcuggugcucagcagcacucugccuuagaccaagcucuguucacgguuggccuuaaggugugguucccggcuagcuaacauggcucuguuuuuccagcacuuagugcaguccuuggugcugggguuucucuccugcaucaucuggguuucugucaauaacauguuuugugccugcuuucacuguguauguagaagcucuugccccuccuuccugaguggccuugcugucauagccuuguuuagugaauggcaguacucuugguugagggcugagcugcugucaucaugguaaugucagccgccucccaggacuagcaugagcuucuaaguauuauguccucccuguuuggguucugauacugggccuuucugaggugaccuugguacaagaaccugccacucugucuguaaucuccgaggccaggcaacuugggcucaggcuugcucuagggacacuuugcgaggucacugauguguugcgacucaugcuaugccaggacuauugacugugaccccuaaggacugcugcucuaaggagcccagccuggaaaugucuucuuguucugugguccuuaaggucacauuguucccguacaucacuuuucuguucccauucacagugcaggcuagccuaggucugaagucucaacagugaaagcccacagaugcucuuaccugucuucagaacugaacaaaacccagugccagugagcugcucuccaccugucuaagagcaggcuuccugaguuugcuagguggacauacacacuuguguucccaccugagcugagaggccgugguagagugaguucaccacugacguggcuucccagcaguggagccacagacggcacuuacuaggcaguagugggagucuacuggagcaccauugcacucgagccugggcagcaaagcccugacucuaucuagcaaaaggcucagcacagcauggguagugacacugcaagaggccgaggacacucugucucccauguguuugccuauguucuguuccugauguugagguggacauagaaccuuccagggagguugucgccccuccccugucacagggccaccugguauaaccaaccacuuugccucccugcuccugggcaggcacuggguggguucucuccaucucagcaagcaggucauguugccgcccuaucuaacucucuuuuuuuccucuugacccccuuagccaaaacagaguggaauaugagaaaaggguccgagcacaagcgaagaaguuugcccccucauaagcagcggcccugggcuccaugacgaggaagggauuggcuuggcaagaacuuguuuacaaccuuuugcagaucuaagucgcuccguacaguuacuagucgccugggaggguugagcgggcgccauuuuccauuuccgccacuggcauauucagucuuuuguauuuuugauuauuaaguaaaacuugcuuuuauuuuaauauugaugucaguauuucaacugcuguaaagugauaaacuuuuguacuugguaagccccuagcagcuaguuucuuugcgucgcgcucggaugcaggcaugcuucccacuguucagagcucuggcuuccaucuggcugugugacagaaccacacugucccuccuucccuacccucguccuucucagaaaccugggcuguugcuuaugagccucagauccaaaguuggccagcauuuccauccugcaccacuuccuuuguguuuauauggcguuucgucuguguugcuguuuagaguaaauaaacuguuuauauaaagguuuuuguugcauuaucaucauuaaaaugugaggagguaucuaucucaguacaccuggcccuccucacauggcugcaguccuugccaggcaccaaggcugagccccaggaccagcaccuaggaggucucagcuucugcuagggauaugcccaggccccaugcagcuccaucuucaucugguucuuuguaaauaggacuguguacagggauguguucuguucuccccaccuggaucuuugggccuuaagguaccaggcagcguugagagccucaugaaguuggaauccgcauccagccuucguaaacccagaaaggugaaagacuggcugauccagaccaaggcugaggccaggugagagccaaggacaaacuggccugcauugaucucccugccuguuagcuguacagugggcccugcuguggccugaaugcuagcuucaggccuuuuggugcccugcccuuguaccuggaagaggcagcucugccaccggcccgggcaaacucggguccucuagagcaccugagcacacagcuccuacaccuccugaccugcauucaacucugcccuacggcccaggagaccagccugcuguggccucggcacaggaugaccucagguacuacuguccacauacuccgcuugcuggagcugggcugggugaagcugcucuuggcaguggcccaccugggcugggcugggucugugaucuuagggcuuacagaacacagggaggugcaguggacauaggcgcagugaucagucuccaucagacuuguuccugaggccccuggaagaccccugacaugggaaccaggcaccaguggcucaaguucagggaccaaucaagggguggccaggucugcagccaggagucuucacucuggaauuggaggggcuugugcucacacagcugguggcaccuggaugggcuggguugccagugccuugugggcacguuuagccgccaguacagucgggagccgagcuuggaugaacaguuugcagcacaaggccucaccuggggagcuuaggcugguguguguguguagccugcucucagaaugucuuauuuuguaacaacugacuacauuuaguaauagguacacauguauaugguuaauauauggaaauucaauauauuuuauaguuaaaguauucuaaaguaacugauguuucuagcaaacuguagugaccccagcuaugaaguguuccuuuuguaccacaguccuuggauuaccagagaugugaaucuuguaacauaagaauguggucugugaccauccuguguuaagagggugggguggaggguaucccagcaugaagccucauugguaaggaauugugggcaacagauuaaccacuguaucuacaaaugcucuaauuaaaacauuuccacaaacugca

SEQ ID NO: 12559 - RNA, 8816 nt, Mus musculus
auugccgggagcugggaccuccucuauggucacaaagucgcgagguuuccugggccaagaggcaacccgaggcggcauccagcaccaugaauccacugauaccaguuccugccagucaggccugaaaccuuggccccuggaagcagccagcaagcccuucggggucuucgucuuugcacggcugagccaucccacaucuggagcagagucauucagguacacgggcagccagugccaaaucccaccguccuaauccugggcaauucuggcccaggguggggcagaaaccuccaucggcaacccggugaggagggaggccuugauguggcuucccugggagguucugaaagggaagcugcaggcaugguucacacagggccucuggcuauacaucagaagcgccccuuccugcccgguucugguggcccuggacuuuuauguggaaggaggggagggucaaggucaugaacagagacagaaauuauacgguugauacucccugcuguaccaggacacggacaguccucccccagaaugauucuagguacagccuaguggucgguugugaggaacaugcauccugggcccagccaguggacauaaugggaagucaaggcgacuuggaugggggccaggugggccagggcagcacuggcuguggagggcuuuucugagacucuuccugcucucuaacaguaagccuccagggugguguuauuauuacuauuauuauuuugagagagagagauguggaugaagucagcguccccuggcccugcuggccugggauuacaagguaccaggaagagcacccuaucccggaaggagccguuggguagacuaugcccagcagaggguugucuugaugaggccuggcucucagggauggcaagaggagggucugucugcucacccugucuccaucaaugaagagggaggugaaggggagccggcccucccccaccccuuuucaaagagugcuuccugcagugauggagguggcccacauaggggugggaacucuugaaagggugcaaacugaaagugaaaggucuugccucaggaacuaaccgaacucugagacaggucaaagaggaaaacgggcuuggguguggcuauaacaccagccagccaauggcugagucaggaggaucagggauacaagacuuuccucaggcugccuagagggaaccugucugaaaugaacaaauagacagguagguagguagauaaauaaaccaauaaccaaagaagacagcaccaaagaguauggugugauuuggcacacugugugcuguagcagugagguacacuggggagacugugagagaccccagcucacuuccaagcagugguuggaaggagaggugcccuggggacaaacugugaaauaagcccugagacuuugucucaaaaauaaaaaauucugggccagugagauagcucagcaaaugaaggggcuugcagccaaguguaacaacccagguucuaucucuggaacccacaugguggaaggagagaacccauucccgagaacugaccaacuaccccuaaccuucacacacguucacacacacacacaaaaccaaccauaugagguccucuggccagcagagccaggggacgcugacuccacccagaucucucucucucuuaauaauaauaauaggaauaucaauaauaauaccacccuggaggcuuacuguuggagagcagguagaguaguacauauguaguguguguguguuuaauauauauguuaaaaacaaaacaaucauucugccagacaaaugucuuucucuggccacguggcccagguaaccauuucuuucugcuccuauuuuuccaaucuguaaagcaggcacaggcacuggccauaccuguguuaugaguauuuucuuuuguuccuucuuuccuuuuuuucuuuuuuugagacuauaucucacuaccuagccuuggcuggccugggacuccauauguagaccaaacugccaggauucucccaaacacuagaaucaaaccaugucccaucacacccagcacgaacgggaauuuucaacacacaacacacagcaaaguucuccuaaguggccagaguccaugguagaguuugcugcccagaggcccuguuggaaaacauucaugucccaccugggaggugccaggcugaggaagggaccggcagccucagaaaccccaggaagaaggacaacacacacacacgcacacgcacacgcacacgcacacgcacacgcacacacacacacacacacacauaccagucucugaaagcagcuucaugcuguccgggagugacuggaaagagcugugucuaugucgcagccuucucaagaccuugaccucgccuggucucugccuagcugccucaaugguccuuguguuuccccugaaggggugcaaccaggugcugaauucaaauugcucccaggagauaccaccaggcccucaagguggcagaacuuuagucccagaggauugcaaggucuuccugucaguugaggaaguggggugcccugcucugugguaaccagggcaacacucugggguuagucuccauuuuuccuccuugagacagggucucacuguauagccuuggcuauccucucuggaagaccagguuggcuugccugccucugccucuuaaguacugggauuaaggucacacaucacuacccgcgccucaccucugcuuucucucaccugucucugcaggugacaagugacgguggucuccaccaagaccugaaaaauggcaucuggacaaggaccaggucccccgaaggugggcugcgaugaguccccguccccuucugguaagagccuccugccccucagaaccucauuaaguacaagacuuagaaguacacuggacuggugugcgcacaugcgcauggugugugugcgcaugcaugcgcauggugugugugcgcaugcaugcgcguguguguguguguguguguguguguguguguaugugucacaggggcaggcagagggagggagggagggagggagggaggguuagaagaaccccgccuggcugccgcaguggaagaaaggaggaagugaccuggcuucuuacagucaggucuguggacagggaauggcauuaucaugaacucuggagaggaagugaaauggcugaccuuucucuucucugaagugguugggcguggagaucaggcuggucccuggacuugggguucacaucccaggucugugugagccgggugugguagcucaugucugcaaucccaggucggucaguccuacagaacgaauuccaggucagccugggcuugagugaggcagacuaagacccugccucagaacaaaaccaccaaucccuacagugcuugugggcgcacaccuuuauucccaacgccagggaggugugggaggaggaucucuaugaauuugaggccagccuggucaaggcuagcccaucaaguuccaggcuggccagggcuacguagaagaaccuugucucaaaacagugaaaaacaagcuauucuccuuugacuuuugaggcaaagacuccccaauuucaacuugguuccucccauuuccuauacuccaaggccucggguccacaucccacccagacagcucaggagcccugcagugagaauucugguuucuuacaaaauccaguuauagcugggcagugguggcgcacgucuuuaaucccagcacugggaggcagaggcaggcggauuucugaguucaaguccagccuggucuacagagugaguuccaggacagccagggcuacauagagaaacccugucucaaaaaaccaaaaacaaacaaacaaacaaaaaacccaaaaagacaaaaaacaaaaacccaguuacgugggucggagagauggcucaguguuuaagggcacuggcugcucucagagguccugaguucaguuccuagcaaccacaugguggcucacaacucucuguaaugggauccaaugcccucuucuaucgugaaggcauaugcgcaaacagaguacucauauauaugaacauaaaucuugaaauucauuuuuuuaaaguuauguuaugugaauauguuuucauuugaaucccagguguaggauaaggggcugcuucacuccgucccuagcugcuaacuaggauugucuugugcucuggggagaugugauuuuugccagcugcagauaguuuaguucuggggacucuggagagguuauaaauucgagaguucugcaagagagucuguggcggcggcggcagcugccccccuuguuacugcauuugcuacuguuggacugcuggauauucaaacaaggaagauuggaccugccccaagaaacccacugacccuaaucaguuugaaguaaccuauagaaggcuacaucccuuuccacccuaauuccuuucaacccuccaacauuagguaggagagaaagaaaguuagacaagaaagggggcauagaccucuuucagucaacaaaauacacuacuuccugcuggucagggugguuggguuccuuggggaaaggccaaucuuugucgucaggauauccagcaguccagggguagcaaacgcaaugaaccagcagcagcugccacaggcccucuuggggcucuccagaguccccaaaauucaucuaucuucagcuggcacaagucaugccccacuagagcaggaaacuucauggucagcugcuguggacagucugaagaagccgcccaucccacgccuggauuaaaacacaagcauccauagagcccaacucggggguuaaagaaaccagaacucccaccacagagcccaguucugggcugucauucugcaacaggcucuuccgaagagcagaaccgagagcgggcagagaugacaaggggacuuguuugauuaggauccuggccgggcccgagcuguccagcgaaggccaucuacaugcugggguggccaagaaccuggcagcugcuuggucacaaggcacaaaccccagaagucccagucuggugucaaagcccugaaggguuccuggacagcccugggucucugcacagcagaaggcuggggcagcugggugcugauaacaaggaaagcagcaacagcgagaugcaguacuuacccacaggcagugggguggaugggcaugggggagggcaggcagugggggagggcaggaagugaguguagacagguauguuuggggagggcaggcagugacuguggacaggcaguagggcagugacuguggacaggcaguaggggagggcaagcauugggggagggcaguaagugugggcaagugggugggggagggcaggcagugagggaggggaggcagugggggagggcaggcagcgggggagggcaggcagugggggagggcaggcagcggcacugcaacuggaaggugcgcucacugugaggaaggcccucccuucuucagucuuucuggcaaacacaguaggaccugcccagaggugacucuuaccaagcugacaaccaagacaacaaacaauuccucccaguuguccaggccgcaugaccccuguauacauggcuuagccccccacccccacccccgugccucaguuuccccaucuguaggcuggagcucccucaugugccaggacuaacucucaugcgggcugaaugcucacaugggggugagaguggggguggggaugcguccaaggagggugcuugggacagcuugccuuugcugacccccaguucugaucugcagaacagcagguugcccaggacacagaggaggucuuucgaagcuacguuuuuuaccuccaccagcaggaacaggagacccagggggcggccgccccugccaaccccgagauggacaacuugccccuggaacccaacagguaagcuccagccuugggguacaaguccugggagcccuaucagaccuucagacagggcuagguggaaagucugcccccaccccauggaggcgccccucugcccugagcccgguucccagugcagaauuccagcucucugacugaugcucaucccuacagcaucuugggucaggugggucggcagcuugcucucaucggagaugauauuaaccggcgcuacgacacagaguuccagaauuuacuagaacagcuucagcccacagccgggaaugccuacgaacucuucaccaagaucgccuccagguaccagcccauccuccaccccgcagacgcaugacgcagacucagacgcuccauaggaugggcuccccagcugaggaauggugucagggugaacauaccaacuuccgccagcccaauugcaacuggauggcuucuaagaggccaccugauaccgcaucccagccugccauaggcuaccacugugaaaccuagggaacagggaaaggaccggaagucagugucccugcuuugacgccacauccaaguuggcuugaguucuguugucugaucuuuaucuucugugucuggguguuuagcgugcauguauaugugcgcaccaaccugcgugccuagugcccaauggggccagaaggcuggagcuagaguuuacagaccgucaugagccaccaugugggugcugagaauugaaaccaggucuucugaaagagcagccaguauugcuaaccgcugagccagcucuccagccccauuaagucucauguagcccuggcuggccuugaacucuuaucauccagcuucggccuugcaagugcuaggaucaaucaugugccaccgagcaauguccuuuccuuacaccagggagucagcgucaggguagaucucaaggugguaguugauguagaagcaggcggcaaguuuaaguacagagguggcacauccugucccuguccucaggccccacuccguccccugugauuuggggaucugucguaaucucuucuguccuuuucucucugcugucccucgggcugccaggccagcagcaacaugcacagguaaucucccugucaccucaucuggucgcucuucccucucagcuccccccacccuuccuucucccccccccccucgccaugcagccagcucaucacaucaccccucccucacuaggcugucuccuuuccuagaaagccaggcucuuccugacgggcagccaggccaaggcagacuuucugaccuguccuggcagcuuagccguguagcuucccaucuggugguggagggguggaggucggguagaggaagaaggaaaggaccgggucucccaaggcaggcucuccgugacuuaugaaaaaacucuuugcccacagccuauuuaagaguggcaucagcuggggccgcgugguggcucuccugggcuuuggcuaccgucuggcccuguacgucuaccagcgugguuugaccggcuuccugggccaggugaccugcuuuuuggcugauaucauacugcaucauuacaucgccagauggaucgcacagagaggcgguugggugagugccugggcuugggaugucccaccccccaccccccaucacacccccuacccccaccccccaccccccugcugcaggggcugcccggccaggccacuauaacccacccuguuuuuuuuuccugacagguggcagcccugaauuuucguagagaccccauccugaccguaauggugauuuuuggugugguucuguugggccaauucgugguacacagauucuucagaucaugacucccggggagccccacuggggccccagccacgugccuggcuggacuaaaccucucucccuaccccacccccuaccccccaccccaacaguccucuccuuccuccccagggcaaagacgcuuuagcaaacaggcaccccugauuuggagagccaccgcccaggggucaucaauaccccaacauugcauggugcuacugaaccccauccugucucagaggcacugacugacgcacuggggggggugggugggggauggagaggcugggccacuaauucccagaaaacuagguuuguuuuuauacuacccuuuagauacaauccacccuuuuucuccacugugcccaaagucagaacauggagggcuuggggacuggugguucgaaccuguguucccaacacuccugcuacuuuggaaggucagcccuugagaagagaccugagcacaauccuugcccucccuacauuggcucccaagaccaacuguaggagacugcaugaccuacuucacccccaccucaucguccauuuccccaacccuaccccccacacccccuccccuccuaucuccuaccccaauccauccauuuuugccuuggcggcuggacucucagggauucugagcccagagugagggcagaggugagaguucagaccacagcugucugaacacauccaucaggcucuccaauccuguguccuuccugacccgugcucccaaccuaguggguaggggaagacgccacuuucuccccagggcucucaggugagccugccugcuggggcggaggccuuccugacagacggacggacagagccucagacucagccacuaugacaggggagggggugggcacucuuuggagguguccacacuagagaacuacuccagcagaagcaacuguggaccugggugcaguuccuccccggaaccuaugauuacuugaaccccaccuucacuccuugucugccuagguccuccucggguugggugggguggguguuuuucucugucuugcacaacauaggggugagaaguuuugauuaagccaaauguaucggggaagagggggaggcagagggugcucugugucuggaaauaaacugugcaaugcccccaac

SEQ ID NO: 12560 - RNA, 56962 nt, Mus musculus
ggggcgcugaagcgcgagcgggugucuugcggcgucggcgugcgcucccuccccggggagcggcugcaggaggaccgcggcgggagcagccucgagccgugcagccggcuccggcaccuugccgacgcucguaggagccgccgcggcugacaggggcggcgggucgcagccuccacaccugcgcggguggcgggcgcgggguccggucugccgcgggcgggcgcagaggagagcgugcggcugcaggcaggagcccccgcucggccaccuccucgccccgcugcugccgcuggaagaugucgcaggagaggcccacguucuaccggcaggagcugaacaagaccaucugggaggugcccgaacgauaccagaaccuguccccggugggcucgggcgccuauggcucgguguggugagugucgccgggccucggguuaggggugggguggggggacgcgguggagcaagcaggguggcccugcaugccugagggccaggccuguccccacagcucagcgaugcgcccagcggcaggaauucuccuccgggcgugucugggggugcagggggcagcuggagcgggacguguccugcaccccucgcccugcauacgcaggucgggggcgagccgugugcgggagcgggucagcugcggacgcggugggaugcuucucuacccugcgcucucccugcucccaagacuggcccucccggggguccucugcugcagcgcggccucaggacccugccuccggguaccgccacucgggacgcgggagcccugccccggggagcagacgagcugggcggagcuccagcgaggagcuguagggcaaagccugacccggggacugcggucaccugaacgaaacuugcaagagaaagcgcuccuuucccggaauuuuuuuuuuuuuccuuuuuucucccccuuuucccauuuuugcaagccuccaucgaaaaauccugucucaggaaacguuccuuugggauucgcacuugaauuagcagcaccccgaagagcuuaaaauaccgacuuuaucucggggaccacggugccagcuugcgugguguguuuccgauucgguugaaagcguauuuccuuuucggggagggaggguggcagcgccuugcaaggacgcuccagcucgccgcuuagucacauaccacugcucauuucaguauuguuugacaaaacaguuuuccauaccgagcagaggggcgccccucaagaucaagaagguaggacuagagcuggagguguagauagcuuuuaauugaaguaauucaugggggugcuuuucuuuuuuuuaagucccuuagaagauuugcggaguuuuaucagcuuguaaguaccgagguacguggugguuuucgggagauccuggaacauaggaaacgaugcuuuuuagcuuuccuuaacaccgggugggggagggggguaggagugggggggggccuauuuuaguuccacuauggcucucccugucuugccuggaacucaacaaauuuugucugccagcucugagaauaaaggcuuuugcuaccaugcauggcccugggagcagguuucagauuaaauuucuaccauaaaacuuccacuccagaaauguucuaaggaacuuugaaggauucacgcaguaucuuuuacuauaucuuuuagagcucccuaucugauaguaaucugauagauucaguagaugagcccuuccuguguuuuagugacuuacaugcauucaugguuuccgaaggagucugggaaaugguuuuuguuuuggaacaaauuccaggcuucuggaugugcuaaccuuuaaguaugaguccuguguuacuuaaagucauaucgugaauuuccuguuugguagaaucuucuggguaauugagauugugcaauuguguccagcaacagaucacauugcauuugcuggcucaagcugcuuaagcuauguugcagaugauaccaacuuggacaucuuucucacgagucuacagaauggcaguuuacacuuuaaaggaaaugucaauaauaucucucauguauuugugauugaucuguugcaucauuguuucucuaauaguuaccagcuccuuaaguaucuccauucuucguuccuaauugguacaguaccaggcguuuguuuccauuugaaugcucagggagugaagcucaggggcuucugggauggugaauuugcaagguuuccuguggacaccacuguccuggcagaagagccagcuucacagugaagugccacagugaaaccaacuccacuuccucuagugcugcuguuuucuguguaauauaauugagcacaaccucacaauuaaauagacuucuaccaaacagcuucuuaaacauagguagugcuggcccagugauggaacgcagugggacagcccuggccuugccugugggaggcccugcauuccagccccagcagcagugcaccacacaaagcagguugcuugaaauaagggcccaaaagguaugcagcaaaaauccuguuucugcucucagcccugcaugcuggucuuccagagacaaccacuguuuaguuccuugccugacauuccagagagguguaguuucuagcguagagauuuacuauguagccuauugaugaggaaaagauagcugaaauugugugugacccagcaaaugucaccuucaguuagauuugcaaguguuaacuucucucaaguuauuugaaauuguguuuucaauuagcuuuuuaggugugacugaaaaauacuuuuuuguuuguuuuuugagaugagcuguccuagaauucacauuguagaccagacuggccuccaacuccgaucagcuggacuuugccucucagagugccuggauuaaagacuugcaacacuacaccugacuucuugaauuucuuuuuuaauccacuuugaggccuguguucccuuucuucaccuucguucucugagauaguuugauguuggggaauaaugaaguccauuugaauggauauaauugagggggauuuaaacugagcucuugagaagagaggaggcuguucuacuggugacaguggaauaagucaggagggaccugaagucucuucaaaaaaggaaucucugaauuggacaugauacacuuugauuuguaacuuaauuuuuuucuuuuaaguuuaagauuaauuuuaauuuguauuaugcagugagcgacaguaacaaaaaacaagcagcaaacuguaguauuaccaacugugacucaaaguugaaugagagucuagaaauugagaauuggcuuguuuuuacaaauaucuuucuuuuuaaaaguguaaagggaacuaaacuaaguucucuaaguuuuaaggaacuguauuuacugccugaaaagggaaacaagcaaaaucauuaagaccacauuguugcaaagcauugauugugugguuugggacauaggggaaaaucuuuguggugaauuuaaggaaauacaaacgggaacgucagugucuuuccucuggggaaaggggcucuccagccccuugcuggacacacuuggguaccaugccuugggagugagaauuaagaauuacuucuagaucauucacagcuauuuauucauuagucuggauuacauaacaccaaacucuggcuagaaucaaggcuagauucuugagcuaaaaguacagaacgagacagcucauuuugucauugggcuuguagaagaauggauggauuuaauggcugcauuuuauggguugcuugcuguguuguaggcauggagaugcuuaguuuaugaucggcauguagacauguaacaaacuuguagcuaaacaugguaauuucuucuaacuaaaucugauuuagcaugcuauauaggacaagauuauuccaguaaauauaacaaaaauaaaugaagcuuuuuuuuuuuaaguauuaauagccauucaccauuaguuuuaauuagccagggaaaaaaaauaaaacuccacaauuagguaugacuuuucacucuugacgaccgagaaggcugggccuuuacuauuaguuguaauaauagccggucucucuuccuucccuuccugccuuucuuccuacuuuccuucaggacacagccuucuggucuugaacucuugauccacuugucugaggcucucuaaugcuagggucauaggagugggccaccaagcugcuuuagcugaccuaucucccauuuacuguuuugugacuaaaaguagacuaguuaacuggauguuaccagucuuaauaagcauuuagguuugaggccaaccuagccucacucagcagagugaacucagugcccuuucucaagaaaaacaauaaauaaacaaaaagugcccaccaaauaugauuggcaagaggguguguguguguguguguguguguguguguguguguauguauguguguguguguguguauguguuuagauuuauuuauuguuauuuguaugaauguuuuguuugaauguguauuucuacaccacaaagugcuuggugccucuggagcccagaaggggguauuggauccucuggacuuggaguuacagaagguugugagccaccagaagcccuugccagugcucauaaccacuaagcaucucuuccccagcucccggcaaugguuuguauggauggaggagaguucagcugagcuagcuguagaguuuauuuuguugaguuccguuucccacucaugaugagcacuacaccccaggccucugaguucugccacuuuucaguuuugaauauugaggaguauucuuuugauuucucuuuaauucagccucagagaugauauguguuggcuuugccuucuguggacaauguugggaauugugcuaaacccuuaaagcuuaggacucaaaugucgaggaguucccuggaugcugucacuuucguauuaacuggcaucuuaaugugauucuuugguuuaucaugaucuucauuuaaggcauuaucagucccucucuuucuagaguagguggguugcuuuuccuucucucucucuucugcaucuuuaguaacggaacccugggggcuggugcacacuaaccaugggauccagugagcugcacuccagccuccaggcuggcguuuuagccuaguucuguggaugagcugggguuaacagaagacccugugcuguaugaccaucagcuagagcugaauggaucugggagcaaucagaagggggaggguuugcagcugcuaggaauccuaccuggucauauuugccuuuguaaagaccaacuucugugcugaaaaaguaagccaagguggguugcagacagagcagagcuggggucuagcucccuagcuuuucauuucuguuccuuaacugaucgaggcacuaacuaaacuguuugugguuuauguaagcacaagagagauaaaucauggcagggacuugaccuaugcccuguacucuucauccacaaguccaaaagugccagagccagaauuuuuguugagcucggaaauucaggguacuccacuucagcucucuaaauaacaugcuuacuucaaaauuuuuuuuuguuuuuuuuuuuuguuuguuuguuuguuguugaaggguuuugcugccaaaaggaagggaucaaagagauuagcugcugaguucagcugaaaaagaaagaggagcugcuggcaggcugaguguuuucuaacaucuuugacuuccaggcuuuuucuuaauacuugcucauauuuuaagucacuuguaucuuccucagaguauccgagcauuuaaaaucacauuuaucuuaaucuuugguucugugucuguuuuccauuccugccuuucccucauuguguuacuuggcacugauguuuuugucuguaagacuccaaggaauguuaacuugaauagaugugaccaauaccugucuacagauaccuuguaacagcucugcucuguccugucuuggcugucuucaugugcugcacacucucuggcucucuugcucucgcucgcucgcucucucucucucucucucgcucgcucuauacacgcacacacacauacacacacacacacacaucccgccuacacacacugcuuuaucaucugguugcagaaaguaaguuccugaaaacagguucccauggcaacauaacagaaagguaauagaacaaauguuuauucugucuagaccuguugucugacuaacuguagacccugaacauguuugcuccugucacacugaacaaugugauuacagauuuccuuguuucccucaaaaccuccuccuuguagaucuuagugggguugccacugugcuugugacgugaaggaagcugugugugugcccuacugcagguguauacugguuguguccccaagcuugcaggccacagcuuaccuaaaacagcagcaguugcuccuuuguugucauaaguucuuuagcuuaguauugguaguguuaagcguuguuuauaaaguccaaagaaagcaagggaccuggggaggugccauagugcuugccgugaaagcauggggccgugacuuggaucuagacagcaugugaaagccggacacagcacaugugugagcucagugcuggggugcagagacaggaggauggguggagccuuuggacuagcuggccagcuagccuagccaaguuagugagguccagauucagugagaaacccuuucucaaaacacgguggaaggcaccuaaggucaaccucugaccuacacacaugcacacacaaaagcaggaagagaccuagguugcuuuggaagucuuuguagcuuuucuuucuuucauauuguucagugucaucaucucaaaacuaccuuuauauuucuaaagacagcccuuccccuuucaagugacauucuaguagcuugucaaaucuagggcagcuugaugccaggguauguauuggaaaucugugucagagaaccauuuccaucuggugauucagaucuggaaaggaugacaucagcgugugcccacaagaggucagaaaacaaaacaaaaccucuuuugaugugugaaggcucugggaggcuguuuuaguuaaauggggugugagaguaauuggucuugaucuugagcccuuugcucggauccacuuggaccauugucaugcucauaaucaggccuuugcucuuuccuguaacacgcagcuuggggugucuggcuugugcgaguacugaguucaucuuguauuacugcauuccuguagcagaucuaauuuaauucccagaaauaauuuuuuuauucuuaguaucuucaguaggugacuccucuuuacccuucccccuuaaacuucacuuagggcuuuugcuagcucuaacuuccuugaaccuagguuuagaaauacaucguuuaaucuaccaguugccagugaagacuuuaguucuuucucaucuguaaaaaaagaaagaaaaauccaacucccuaguaaucauugugcaauucugauguugacaucuuguguugacauaguugugauuaccugauuguguguguguguauguguguguguguguguguguguaaauguucuugcauguguguuugcauauaugcaaagaccagagguuaacuucaguuauugucgacuaucacuuucuacuuuauuuuuugauaguaucucucacuggaucuggagugcauggauugcuuagacuagcuggccagagguccucaggaaucuuccuguuuccaggcacaucgucuccuaccuguuuuuuguugcugauguuguuugguuuauguugauacugggaucaaacucagccuucauacuugcugcuggagcacuuuucugacugaacugucuccccaguucugcccuugugugaugcugcagucuggcuugcuuagguuucugauuccuuaugucguguucugagugcccuaugguugggugaucucuuuugaaaugagcgacucaauguuaaaugauacugauaccaggcaaaagguuuaaaaaguaacaguguuaucugagauguuggaaaaauaguugccugguuaagaacacuggcuguucuuccagaggaucuggguucaauucccaggacccacauggcagcucacaacugucucuaauuguagucccaggggauccaacaccccacacagacuuacaugcaauacacaugagaguuuuaaaaauugugaucuguuuuuuuuuuuuuuuuuuuuuuuuuuuuuuuuuuuuugguaucucugaacuucuuuacauccccaaacaugguguaacauaggguucuugguuugugccuguucugagcagagggugauacuuuguugugggucugacuggguauuauauauuuaacagcaguguuguccccuaaucuuaagauuuaugacaauuucccauugugacagccagauuugucuuauaaguggugccuuauguugggggaggguuggaaauuagucaccuuuaauugaaaacguuuuacacaacaguacauaucuagaauaauuggucuugacuaaaaccuauaggcuaacuugaacacuguaccugucagcagagaggaaugcuacacauggggcuuccuucagcaugaccgucauuaucuucaggagaacaugagaaagcauuaucgaggucccaagcuuacugugguuagaaccgcuugcacagaucguguguuggccacguggguagcuguauagugcugugaagaaacaaugaaugugaauaacuuuguuuuccuuuugucgugauuccucuuaggacuuguaaauguuucuggaaaggaaagcuuauugaguauguuagcauuaaguccaaaucugaagguagugcuuuucccagcaucucugguuuucuuuucuugacuuuuuuuuuuuuuuuuuuuuuuuuuuuugguuuuucgagacaggguuucucuguguagcccuggcuguccuggaaacuuacucuguagaacaggcugggcucgaacucagaaauucgccugccucagccucccgagugcugggauugaaggcgugugccaucaugcccggcuaucucugguuuucucgcccuuuuucuccuacuguaaucuuucaguagguagcucuuuucagaguucaaauauacaguguucaggccagccaggacuauauagugagacccuaucucaaauaaaauaaaaauguuagaaaagcaagagaauuucaugugaacacagaacaagaaguagcaguguuacccauugacgugaccagcuuaugcuugacacaguccagauauauaagccaucccuggcuuggagcauaccaugcacacuagccuggcugcagaucaugguagucuccuucuuucuaccucugucucugcugggauuacaggugugcaccacugcucuuauuuugaagguucuuguuagcauuuuagucuuuaaaguauuagacaguuacagagggugaguuuuuaguaaucuguggauuccagcaguaacaaaaaaauuagcuuuauucuugacucagagccuuccauuuacacucauauuuugguguuuccugaauuaaccaugguaaugcgugaaagguucuggcaugguaauaaauaauucuguauuagaauuuguaacuuuuaauauuuaaugcugugcuuuauaucuuuauuucuauguauaugugugccuguucacaaguuuguguggaagcuagaggugcagucuaucuucccucagacagagugucaucagccuggaucucuaguuaggcuaacuggccaacaagucccaggaauccuccucuucugucucuacacaguccuggaguuacagguacacaccaccacacccagcacuuaagugugguucuggggauagaacuuggguucugacagccccacuuugugucguccucauacuucaaagugcucuguuguucugauauccuguguuuaucuuugggcaguuuuacucaucaucgccaucaucauuuugcaucaugacucauuuuuaaguuuucuuuuucuauauauauccauuuugggcacauugccguacaaaaguacucuuggugguuggcacuccucuguugugcuaggaguggugguacagaccaguaauuccaguagucaagagguugaggcaggaugauuuugaguuugaggucagcguggggcaccuugugauaaucuuauaucaaaagaacuagggacaucuaaucuuguaaauuccgaguccacugagauguacaagauuuuguagcacccuaccuucccugauuaguuuuuauuuuuuuaaugauuuguuugcuuucugugcaaugguguucuguuugcaucaugugugucuuucuuucuuuuccuuugcuuugaugaaguacccugacaaaaguaacgugcaggaaaaagguuucucuuggcucaccucugaagaauacaguccuuuauggugguggugguggugguggugguggugguggugguggugggguuaaggcaacaggagccuaaagcagcuggucccagccaguccacagucaggaagcagagagugaugaggucaugcugcuguucagcucccuguucaggaucccagccagggaaugacuggguguucccagcccagucaguguaauaaagauaaucccucacgcccagaggccugucucccaggugagucuagauccugcucaguuaacagcacuaaccauuauaguguguguguuuauacacacuuagguuuaaguuuucgauuuacuguagugaagaaaauuuguugauaccuaucagacaguguuccagacucaccagcauguggaacagacugcuuagaaauaaagaaacugauuagggaacuauauucacauaguguggacauaaacccagaaguggugguugucugugcacuauaguauuuaggaugguuucauggaggaaaaaaguauugagaguuauuuugagagcugaguagacuaaucaguacagcaggagagaauaucauguaagugaacagaugccaagaggaccagccugaccccgcugcggcucucagcuguguuucacagucacucgggagucaagauguaggucuacaauuggacucagguaacugcuuucccuaauaguugacuuguguuccugacuagcagaacuucuguacaaagcagagagcuguuaucuucacuuauacaguggaagaaacaguaugccuuuaaucccagcacucgggaggcagaggcaggcggauuucugaguuguuccaggacagccagggcuacacagagaaacccugucucaaaaaaccaaaaaaaaaaaaacaaaaacaaaaacaaaccaaaaaaccaaaaaacuuccuguuugaaguguuggcuuggacugauuggaggaagaaagggcugcucuuguacagucggcugcaguuugucugcaggcaccccugucuuuuugacuccccagccuucucuauucuugaggucagcagugaucugguuuugguauguguuuguuauuuuuguuuuaugaucaggucauggcuaggugccaaggauaaaagauaaaccacagcuucugcucucucacagacuggaguaggaaacaaguaugcagaggaaaggugguucugaguuccgucuuuaaaggauuaguuacaauguacugccaacuguaguaguucucagguuccaucuaaggguuguagaauccauguacacuucuaacuuguagaaacuacagguauccauagauugacaaaucauggaggauuucaaggacucucaguuacauuuuaauaaucuucucuuuuuacuauuacuucagagauaugcucaacuugcagugugagagaaagaucuaaaaauacugagaguuuacuacaugggaagccccaugcuagagacugcaggcacagacuuauuuuauaguuggauauucauuucaacuuggaguauuuaaaacuaccuucuggggcuggagagguggcuuaguuguucagaguuugaacuguucuugcagaggauccaaguuuuauuccaguagcuuauaacugccugugaccucagauucagacauggccucuacagacaugguacucacaugcacaagcccccacacagacacaaacaacaguuuugggguuuuuuguuuuuuuguuuuuuguuuggagaggaaaggauuuauucagcuuacacuuccacauugcuguucaucaccaaaagaagucaggacaggaacucacacaggguaggaaccuggaggcagaagcugaugcagaggccauggacugaugcugcuuacuggcuugcuuccccuggcuugcucagcuugcuuucuuuuccuucuuuuuuuuuauuuuuuuauuuuuuuaauuagguauuuucuucauuuacauuucaaaugcuaucccaaaggucccccauacccuccuccccacuuuaguuuuuaauauaaagcacauucaacauacuuacuugagccucuucacagcguuuuaggcuaggcggggcuggugauuccuuguuuuauuccuuuggaaacagaugcguuaaagcuuuguuugggaucaucuccuaguaagugccaaacuagaacucauauuuugacuacugguuuguuuuuuguuuguuuguuuguguguuuguuuuuuguauugcaugggguacauuuaaauuugcuaauuggaaauuucuagaucaauaaaagauuuuuuuuuuuuuaagaaaaagauuucuuuuaugugcauugauguuuugccugcauguaugucugugugaagaugucaguuccccuggaacugaaguuauagacaauugugagcuaccauguggcugcugagaauagaacccagauccucuggaauagcagccagugcucuuaacugcugagccaucucuccagcccaauaaaaagguuuuuauuauuauuauuauuauuauuuauuuuuuguauaugaguacacuguagcuaucuucagacacaccagaagagggcauuggauggcugugagccaccacuugguugcugggaauugaacucaggaccucaggaagagcagucaguacucuuaaccgcugagccaucucuccagcccaaaagauuuuuuuaauguagagaaauacauuagaaauaccagcuuugggcuggcaagauggcuuagaggguaagagcacugacugcucuuccaaaggucuugaguucaauucccagcaaccacaugauggcucaacuacccauaaugagauuugaugcccucuucuggugcaucugaagacagcuacaguguacaguguauaauaauaaauaaaccuuaaaaaagaaaaaaaaaagaaaaagaaauacuaacuuugacuuaacauugguuauggagguuuguuuguuuguuuguuuggguuuuuguuuuguuguuuuguuuuuuuuuuuuugcccaaaagaaauccaaaccaaaaaacccgguaaguuggaauauuaagucauagugcuucuaacacaucuauccaccccaguguccugccuuagcaacagauuacacuguagugugugaacacccggcuuccugggacagaugcuguugcugagcauugggagagcaucugccugcuuaucaucagccuggagacgcucacgucagaauuccaaguaauuugguacugagugcuugccaucuucucagucuuaaagguguauagaacaaaguuggagagcaaauuagagaacaucuguagucugaauaaagaauuaagauguccuguugaggcagagcuuaguuccuuccccucuacugaggacuguacuugguggcucaguuuucuacuguguagaauguggcaggaaugaguggcugcagaaggaaugcuguaaaugagauuguaccuccuguggugcuuuuucccugggaacacugcugaaggaguaggauauccaacaucuugcuuacaggcugcuuugcaggccaugugcaucaggauagcuaugaauuccacccaacacaugcauagaugacaucauucuaucacaguucaggagguuggacaccccuauucuagagcauaguuucucagcucugauacacuuuggcauuuggggucaaauaguuguucauaauucuuggcuguuguaucuccuguaggaugcuuagcaagcagcaucucuggacaccaccuacuuggugccaggaacauucuucucuaagacuugguugugacaguccagaaugacuuuuggauguccucuagggaacaaaaucacccuuucuuuucuuuuuuaaaauaguauuuauuucauguauaugaguacacugaagcucucuucagacacacuagaagaggguaucagaucucauuauagauggcugugagccaccaugugguugcugggaauugaacucaggaccucuggaagagcagucagugcucuuaaccacugagccaucucuccagcccuaaaucacccuuucuaaagaacuucuaggggaagccugcaaagcagcccuguggagagcccaagauggcaagcacuacagcuaagagaacccuuggaaaaggauccuccagccucagcagguauaaaagugacuguugggcuggagagauguucagcaguuaagagcacugguugcuuuuccagaggaccuaaguuugguucuccgggcccacaugguagcucacacccauuuguaacuccaauuccaaggcaugugacuuccucuuuugacuacugcaugaacaugguacacagauauacauguagguaaaacacgccuucccaugaugaaaauguaaaaacaauuagaagagacuugcuaugguccaucucuucacugcagcuuucggggaaauagccagagccaccuugcuaaauagcuuccuaguucuugauccacaacaauaggagauaauaaaucagguuuaaagcuccacauuuugggaauauuuguuacccagcacuagauaauacccuaagugcuaucauaaaauguccagauauuguauaagguagaaaguucuguacuucgggaaguuagcuuguggagacaucaguccuuguguuuacccauaguuagguuuguagcucagauuuauacagagauggagccuaggaacuauugcuaugaaagcuuuuuccaugcugguagcuagaccauaguaacuugaguguaauaugguuagucugauauuuuagauuuauuugaagugaguuaauuaugauuacuuaaagaaauauuugcuauugagauuuugaaacagcaaaauggagaaauguuucuagugguacacuguaaugaggcuuuggaaaauagccccuuuuauaaaagaaggcacagugggagggacauaacacucaaaaaugcgguuuauaccuguguggaaaugaccuuauaaaaccccugauugugcuggagugguaaaauaagggccuuuacauuugucugaggcuagaggauccucuaaaggcaccuuacccguguggcuauugacagaaggccugguuacuaucuagaucucugcacagggcugcuacagucuucucuagaucagugguuuucaacagaggggacauuuuguucccuuggaaaccacauuuugaaagggagggggaaucugggugucauggcaugcacuuguaaucugagcacuggggcagcacagaagggcagaucuugggcuugcccaguccagccuacuugguaaguucuaggccagugagagaagagacccuuucucaagguaccuuuucaauuuaaaugaacuagacagugccagaauaguaguauguggcauagucacuuguugaguggauuguagauuccuuuccucugggcuuucaguuuguuuuuuagaugguuuaaggcuuuucuaggagugucugcuuuuggaaauuuauaauuuagagcagaaugcaugauuucuguucuuuccaaauacugcucugauagggagaggaagcagcauguuagugcauagagcucuagggcauuagcagccuuugcuggaggguuuccaacccacaagaacuaugucugaguaacuccugccugucuuguacauguaagguguauuuucaugggaguguguguccucuaugguaagaauuaguauguuguaaugagagcaugugauuagggaggaagcauuagacggucacugagcuggugcugcguuauaugugcggacaucuggugugacugcaucagugagaauaucacaaaaggcagauuugaaaauuacuugguaaaaugaaaaaugauugugauuuaggaauguagguuucagauuuacauauggugauuauguccguguaaguaucauuagaaggaaauguaauugcuacuaacuaguaguuugcacuaaguugaaaacaccacuaagugacagagcagcagugugagucacguaucucacucuacuaauggccuccaugagaaaugaaagcuuguuuuaagaaaaaaagagagagagaaaauggaaacauacacuguucaaaagaguguaacaaguuuaggauauauuagauauuuaugcuguaugaauacaguauuucccuaugauagaaucauuuucugcuucugaaacuuguucuuuugcccucaguacaugaaagagucuugcucuuugcuccaugugugugaacggagaauguacuagaauuuuaaaguccuguuguuggaauuucaaguaguuucuaguuuuccugugaccaggcugcaacagauauguacuuugaacccuauuuuguuuguaucugugccgauguuuugagauaugauuuuacucuguaguagacuggcuucuaccaugucccaucugccucugucuuccaagcagaaggauuauaggcaugaaccacucacuacuacucccagcuucagugugugugugugugugugugugagagagagagagagagagagagagagagagagagaggaaggagauccuuuuuuaaagauuuauuuauaugaguacacugucacuaucuucagacacaccagaagagagcaucagaucccauuagagaugguugugagccaugcaguugcugggaauugaacucaggaccucuggaagaacaagaagucaggaaaagaaugagagaaugagaaugaauaaaugaaugaguaugcaucauuacagacuuagacuuguggaugucggaggacaacuugcaggagucaguucucucuccuuccacuguguagguuuccggggcuguauucucaggccuggcaguaagugccuuuacccucucaucuuuucuuuaccugcugaaccauuucacaggccucgguauauaugguuuuuuaauccaggauuuggagaaauguuuaacugucuguuggcuguuuaauuggucauuccugguaucuugugcauuuuguuaucccagguagauaguaaguuuugugacaucagcuaccauauuuacuguuuucuuuuguauucauaaaauaaaauaacaucgcuuggugguaggggcacucaccuuuaauccaaggacuggagaggcagaggcaggcggaucuguguguccaagguuagccuggucugcagagugaguuccaggauagccagggcuacacagagaaacccugucccccaaaaacaaaaccacaaaaaaagaaaaaagaaagaagcccuauaaaccaggagugguggcaugugucucuaaucccaacacacaguaacugacaagaaggucauacauucaagccaguguagaaaauuuagccagacacugucucaaaauaaaacaaacauuaguaaaggguaugcggcucagcuuacugaccaguauuugucugguguguguccaacccugagggaacugggaagugcuaauugaggaaacugggguuuugagcccuuuguaucacgauggugagggaaacagauggacuucuuguccucaacuugcccagggcagguggcaguaggagucauuauuaaugucugauaauugaguuuuacaaaauuugcuaaaccugccauaaaaacuaguaccuuagguuagauacagacauuauauuuguuuuauauaugagguugguagaauuuaauuaacuuccucaagaguuauuaaguggcaaagcuaguauuaaaacccugauaguccucuuccagagcccagcccuuguuuaacuaccuggugggugguaaauaaacauauacuaaucauugugauuauuggggacuguagggucccugugcggcaucuguccuccacugaguggcuagugaagucagaggguggaaccugccccucuugcucuggagcuggcugcaaaagagccuggguagugaucauaaugggcagcuguucugcuauccagcugagcugaacuuguagguguggccacauccugcuggcccucccugcuccccacagguucauccccaaggagaggacagaguuacaaaggcugcaugaggcaugacacucagaguggaaguugaagaagccacauugugugggggccauggccauuuccucaguuucuaaccacacacugguaaagggaagguugucuuauggucuuauggagauaaagggugaaagacggagagugcuugccucagguggguaggaaccccuguggaggggugacucugccuauauauacuugaagaauaaagauuuaguuguggggugggugcggguaggcgagaaggaacuagcagcagcagauccaaauaguuuacagaacugaaagaagccagcacaccagagcaggccuguggugggggacuacugauugggugagcccugggauugggucaacucaucugaaacuuagacagcgguaggaaaugugcauuuuuauucuguauuacaagaaaauuccuugaguuuaaaauagucauuuauuauuuugaaauugcacgucggagggcagcuuguaggacggaucuuuucaccuugucaaguucuuaagaauuagguaucuucuggaccgcccacaguccugcugcccagaaaagagauuucaagaaaggauaggcuuuggggguuuuguguuuauagauggaauuuaacccgaaaugaccaguuguguaguuuucucaucccugcaaccaaacaccugagaggagaaaggagccagggcuuacggucuccauuucacagggcucccccgugcuugccuccauccauacccucgagcagagcacgugggagggcauaccgugggcuguucuguacaccugagcuggcaggaaugggacagaagagagggugcccaaccaaacuaucuccuuccagcuaagcucuaccaccauagugaaaacacugaagcuuuucucuuuuguuuaguaugaggugauguacuguguguucuugugucguggugugcguguauaggacagaggacauuuucaaguugguuuucgccuuuuaccauuugaguuccuggaaucaaacuuagguugucaggcuuguacccucauccacugagcuaucugcuugggcccucccaccuccaaagauuuuagaauucucucaaucuggaaauggcacaucuguuguuccaguguucagaagguggaggcagaaggaucaggaauuuaggauuaucuucagcuugagagugaguguaaggccaaccuggauuuaccuaacagcaaaguggugcuaccagcugggaaccaaguguuuaacccaugcgccuguggaggauaguucacgcugaacuguaacacagcuguaaaggagguuauaaagaugagaagaugaaagccgcccaggacccuccccugaagaacuccaucaucaggagcuuauguaguacaaguaugugaugcagagaaagucccagaaagccccauguccauuguaggauugacaggaggaagggggagucugaccaugccaaaugcuaggccagaacacuggccgucugacgugcuuaccgagcccgagcccgguagugggcuugagaagagcagcuccagcaggcuggauugaaggaugaauggagcugagaagagcauugucugucuagcugugcuucucaaacuuaggaacugugugaaucacauugucacaaugcagacucugcucugugggucaagauccugccuucucagggagcucccaggcagagccaggaccacuggucuacagagugcacuuugaacagcauagguguagguuaacagcucuuguuuuaguuagugcaugaaggcuuugagaauugcgcucucuucaguuucugauuuguagcucuaggaugguguguccaggaguuuccuuacuaauuaauccuugggugaagcugacgugaaugguucccauaccuugagaauuuggagauuauuaaguuuuggagaauuuuuuaaacugugaggaagaucaucaaaacuaguuaaugaauauggaaacuuucuagagcacauucugagacaagugagacaucaguguguaaauaacucagugguagagcacucgccuacccaggguucaguuccgugugugugugugugugugugugugugugugugugugugugcgugcgcgcacgcgcgcucgauguguguccauguguaugucccacgucccccuacgucccccuccuccccuuugugagucagcaacacgcaggaggaauguuguugagaagaugugggacggcuccaaagcacagucuuggguuugaucagagggcauguguuccuuagaguaagagagacuauggagaguguuggcugagggcaucuggggugcacagauccacagaagagauggagcuauauggaucucccuuugcuagcuucuguucucucaaggaaagggagggagagaagggauuggaaguuugagagguggaaaagucaugagaucuuuuuucagaguagagaaugaccuugugaguggagucacuguuucaguguuugcaauuauguucagaaguaaaaacuuagaagcagucugauuguacuuuuuuuuuuuuuuucaaccguagcuagccuuggguaauuaggugguuguggucaccuaagguuagacuugauccaaggagaggguacaagggagcaguuaggagguugaagacaggagagcuggagacacaauugaugaggucagcagccucgaugcacucaagguagaguagugaaagcaagccgaacgguuggaggggcagucggugcuggagagagauggcugaaauauggcccugcaugagguggaguuuccggagaggucaggaaacgggauguuggauaugcccuccagcuggaugauauaguugccaagaauguuaucaaaaguugggaguggagggguacuuuucugauaggacagacuuuuggagggugauggaaaauucuaguccauagauaauagcaacccugaagaaggguugcuagcaagggcuuuuagaaaacaaauagaaagugaugucuugaagugccguuaccgcgaagugccuguucugugagagaaaugucugugguauagccucagaaaggaggcugggaaauuccaagaguguuaccacaaaucaaauugauggcgaggauauguguagguuuggggguaaaaggaggacuccugagcaggacagacuggugugcaauuguucugcacuagccacugcgaugcugcacuggcgucauguugcugcucaucccaccuguguucauucaguggucacugugugcaucacuguugugagugcuuauucuccucugucacucuucccacacuugaggacuuccuacuguuugugcuucagucucugggaauuguccagcacuuggaaggcuauucuccuggaagcaccguaauuucuggggccuuuacuuugaccagcacauagucuuuaagauuaucaguguguuggcuccuuggacaggcugcugccugguuucaugaaauuuacuagaaaacagccauacccauuuuauagguuccuauuauuuggcugcuuucaggcaacaacuacaagcugaggaguugugucagggaccuuaccugggcuuuggagaguaaaaugcuacugucugcgccucucuggaaaaugcuuaccaacugcugauauagacaaaagaggcagaaagaagcaucucaaauaaauaggugccuucucuggguggugggugaugagucauuauagucuuucuuuuugugucuugccacaaauuuaauuuggaaaugaaauagccugaaaaguacuaaaaauaguauuuggaacacucuuuuuuuuuguuuuuguuuuuguuuuuuuuguuuguuuuuccagacaggguuucucuguauagcccuagcuguccuggaacucacuuuguagaccaggcuggccuugaacucagaaauuugccugccucugccucccaggaggcagaggauuaaaggcaugugccaccaugcccggcuuaaaauaguauuuggaacacucuuaaugguggguucuguuguuuuccuuacaucagugcugcuuuugauacaaagacggggcaucguguggcaguuaagaagcugucgagaccguuucaguccaucauucacgccaaaaggaccuaccgagaguugcgucugcugaagcacaugaaacacgaaaaugugaguaauuccuuuuccugcacacacugaaggcuuuguaugcaauccugccgguggaugcaugucacacugucagaguuggguucaugccgcaugagggcugcagcuuuggugccauggggcugucagaucaucgcgaggaugaccgagugccucuucccagaguuguacuuuuacuacaggaucucaagaagcauuuaauuuucuauuuuuauuuaguuaguuucuguguauguuugccugcugggguuuaugugaaucaugagaugcaguacccuuggagaccagaagaugucagaucuuuggaacuggacucacagaugcuugugagccccacugugggugcugagaaccaaaccuggaggcucugcaagaguaacccccacucuuugcuuagauauuaguguuugguguguuuuguuuguuuuguuuuuuucuagacacaggguuuuucucuguauagcccuggcuguccugcaacucacuuuguagaccaggcuggcaucgaacucauagagacccaccugccucugaacuucaaguguuugaauuaaaggugugagccaccacaacuggcugugauuuguauuuuuaacauguauguuuguuuguuuguuuguuuguuuguuuguuuaagacagggucccaguauguagcccugauuggguuggaauuacggagccacucuccagcccuguauugcuuuguauuuuugaacaaagcaggcacggggggaaugagaaaagaucagaauacuuacacuuaauguagaaauuaucucaccuuucagucuaucaauauuaugcagugaagaacaaagacuugggacugaagagaugucucagugccuaugcgcauuugcugcucuuguagaggacccaagauugguucccagcaccuacauugggugauucacaccugccuguaacucuggcuucauggguucagugccuucuuccucuucauccagggauacacacacacacacacacacacacacacacgcacucacgcacacacaugcaggcacauaggggcaggggagagaaagacagacacacacagagaaagagacacaaaauaaauauuacauaaggcaggaaucccaauucuuuuuucugucugauacacuacuggcuauguuaacaaauucuaaaaagauagacgguuuuuucaugguauuaugugacgugauaagcagguguuguggcacacaucuguaugaacuugggagguggcagcaggaagaucaggaguccaaguuagccugggccauaugaaaugcuaucugcaaacacccaaaccccagaaagaaaugauguuagcaaauauaagacagaaacacagucuggguagaaaaucaggacacugagcacauggguguggcugcacuuggaguuaguucuaacuaaaacacuggagugguacuguaagaagaccacuacuuucccacuguuugauuuuuauguguucuugcaggugauuggucuguuggauguguucacacccgcaaggucacuggaggaauucaaugacgugugagugaaucuucuguguuugcaggcucagcaagaggauggggaugagcagcccauggaacugcucagcaguauccaaccucagaagauuauucuccaccuauucugguuucuugggggagggauacauaaagugaauauuauguauggugcauuaggacacaguguggcccauucagagccaaugaugaguccuuacaaaaguuacacagagagggaguauagggaauuuugguuauaauuguuuuuccauaaaugcaaguccacauagguguuuccuucuuugaucccuccugaugccaggugauacugaggcuacauacugauacuuaaugacaucuuccagucugaugccuucuagaaagcagagccuggaagucccaggaaccacaaguagaggccaggagaaauaaaacagggacaaaggggaugguaaugcauggauguguuagugagagcaccuggcugggaacugccaggguguaggagcccuacagaaugcaccucggauggggcuguucuucugauugcaacuaagguuugcuccauuguucaugaaugcuuugcaugcugacacacaugugaugcaagacagcaggugucuugugcaaauccagccuucucaccaccauagcuuuccuaguaugauuaacacccguauuaauuaucaucuugacagaagccagaaucaccugaugggccucugggcaugcggggggggggggggggggcgguugucuugacuauuaauugacaagggaagagccaucuaaacugugguugugacuguucccuaggcagggcaucugcaguuguguaagacagaaaaggcagcagagcaguagcaucuaguucaucuugcuugcuggugcagugugaugacuguguacagcuguuucccuuaaaaugcuuaugucagcuuguuuaucaaaagaagaggaaaagacacagccccaccccaccuaaguaagagacacacugcgcugcagaaggggaaacaucuuaagcacagcuguacguuuggucuuguuaggauucucgaauuccuaagugcaaaggauguuuauuguaaaagcuaaacuguaggucaucacugcucuucccuaacuucuuguauuacuaagccaccuuucucuacgacaugaccaaagaaacuagcuuauguaaagagaaaaauggguuccuuaccuccugguuuuaaauguuucacaucauagucagaugagcccauggcuucuaggcuucugguagaggugccagguagugguagagaguguugguauaacagaaaccacucaucucauggcuaagaagcaaaagaaaggacggaccaggauuucacagucugcagucacaccccugaugacuuaagccuugccauguugugggaauuuggaauuuugguuuccucaagaaaugcugugcuucacagaaguaguguaugacuguuuuuguuuuagucccggguauggggauauggugcugccgugcagcagcugacugugauuugccuuguccucuagcacaguuuuuuuccagcuauagauaguuucugcaauuguguaauguuuggaauucuggaaacuuuuuacaaaguauguaagugcuagggccucaaugcuagguugauggugagugguuguuuaggagggcugguugcaguugcuaguggcagugcucaagaaaaaccagaagaaagaaauuagauucagggaucucucucucucccucccaccuucccucucucuaucuagugaugggggugagcccaggggauaaagggugggaaaaagaacccacaaaguagcaaagaccggcuacauuacaaagaccggcuacauuauugcccagagguuuggcugcuuuuguagcacccuuggaaaggaagccauugacaugggguugugugggguuauugcucaccauccacacuauaccaaccucacuccugaugcucccagugcaaaaccugcuucucuccauucuuucuuuggaauguaugcccacaccauuugucuuuuccaacagaacaagcagacagauacauuugcucucuugugucaugucuauagaaaagggaaaaacaagugaaugccaaagauggagcaggagaggagagguggcagcgggagggaaggcagcuuggccccuguacaggagcucaaccacauuagcucaccugcaaaugcaaguuuaggaagcaagugaaaggaagacuggcagugaguaagaacaguguccgccuguccugcaguccugucucagcagcagaacagaggcuccacccacacaggcugagcagacuacagagcccugcugcagccggugcuuggaaaagagaaugugguggagucuaaaugagaaacaaaugcugcugcagucuuuugugaauuacuuugaaaaacauuggaguuaggucugaguguuaaccuaaguuuuagugaggguagacucuaacagaaaaaaaaaaagauuuguggacuccaaguauuggguuuugcuuugauugagcauucuggaaucaaaaguggaccuauuuuugcuacauuaaaagggcacuaaugaaggcugaugucuauuugaaugguuaaauuuuauugucuagguuuaacccacccacuaccagcauuuaccccaguaaauaaaguuguauucauuuauuacaacuuuaaaguuagucuuuucaacaagagcagaggcuucuguuuuuaccucuagcugguuuuuaacaacuuuuuaaaagauuuauuuuuuuauuguguauaucugucuguacacauauguauguauguauguauguaucuggcauguacauaccugaugucuguguaggucaggaaaguaugucauaucuucugcuagaguuauaggugguugugagccacaguguggaguccugugcaagaguagccagugcuccuaaccccugagcccuccccaguccuagcucuuguuugagcaaagcagcucucaagugcugucugguagguacugugcccuaagugcugaguaccugcaagucaguuaacaugcuuuccaugagaacaguggagagccuguuucaguagggaguguuucauugcugacuguuugugauguugauaccagugaaaagguuagcacccuuccagaacagagcuuaucucuguguucuccacauacuauacgucuucacacagguaacaagaauagugaguguaguguugccgauugagccucgaaaccauuuguguucacuaagaaaaaauugucgugcaaacagcauacuaaggauuagagacuaaggcugccagaugcauagcaggcuccaggucugcaucugcacuucccaugcuagugagcaaggugugccacuggcuuuccugugcuuucccgagccugugcguuuauguuucaguuacugcuuuuccuuucaucagauggcucacauuuuugcuucaucugaaagaccacgcgugucuuuaagaaaggagcaauggacuggcaguggacuguuuuugcuugcaagucauggagguggcuugggaagugagcacauggaauucugacugcuguauaacagcaguugcaggacagguugcacauuacagagacacaaaugggagaucauuugagcacuucuccuguuguucuuaguucuugccuguacuggucaguguacagguaucauuguguauccugaauauuuacaaaugcagaaaguuucaaaagacuauauuacuuuuuuuuuuuuuuuuuuuuuuuugguuuuuucugagacaggguuucucuguguagcccuggcuguccuggaacucacucuguagaccaggcuggccucaaacucagaaaucuaccugccucugccucccaagugcuggcauuaaaggcgugcaccaccacugccucacagucucccaaacauucuuaaccaagcugucuuagcugaguaggcaggggguacuuuuaggacuuuuuggaaauacuuucuucaacuuucaggaaagccagcuuauaucagaguaaguggaaaugggacuuccuucccaacuuacaacuuuuccuccuugauuuuuuuuucccuuccuuuuuuccuuuucuuucuuuguuuccuucacucauuuauuugagacaggaucucucuguaucccuggcugaccugggauucccagagaucugccagccucugcaucucugcuucauucacucuuuauauuuguuaguuuaucuuugugauggaaucuccugcaucccaggauggcuucaaaaugacuguguaaccaaaaauagccuugaacuccagauccucaugcauuuuccuaccuaguuuaugcagugccgggaauagagcccugggcugcaugccgcugagcaagcacucuaccuccaccagcuuagccaugcucauuccucugcucaguccugaagagacaggaggagucucgaagucugcugugaucuagcggaugcacugcggggcacuuagcagcucucauuuuaauaaagcuggagagcaguuggucaccaagcuggccuugcuccugugcagaguaagcuugggcacugugguucaguuaacuagaacugagggcaucgagucagcgaauacauucugccaaacacgguccucauccuugaggaagacagcaaacauguucucuaaucauugaguuuaaauggccacauagugugcagugugguagguuugggagacccagcauggucuggcucugugcacucugaccuuguguaacccacuuuccacuugugucucucugucuuuguauucuuucuaauacagacaaccagccacaucccagcaaggccucugccugcucuccucacagccuggccucuccacacuugcugauugguuccccucagucccauacaagguucucuggaucagaaccuuuauuccucucuugugcccuagcugggcugugaucuccaggcacuaucugugccuugcucugccugguacuuugcaaauauugucaccauauauuucugucuguuuucucccuugccuuguaaccucuguuagaguagggugcuuuccuuuauuccuaauuguuaguguuuggagcaguagcaggccuaccugcagauauuauuuguagaagaaaugagugcaagaacuaacaaguucuaggacagccaggguuacacagagagagagaccuugucuuuaaaacacagaacagucaaucaaaaagcaugucccacucaaguggcuagaacuguaaaacaugcagauggucugugcuaucagcuggguuguuagcagcaucucaaacuuacagaggacuugagugucagucuugucaacugacacaacacugugauguagacuuagcaucucagguugucagaugagggaacagaucgaaaccuuuauugaauaagaaugugaacaaaacugcuuccuucuugguacucuggcuccauuuccuguuacauauccaaggccauaccugcaccacuguguucuauuguauuuaaagcccagugugcaacugagagccaauaaggaaguagccaguaggucagaggucacuggggaaaguaaggggcuggaaggauucucucucacugugaaugagggagaagugugaucauugguuaauugucagcuccugccgcuguuuuaagcccuguuuaaaucuggaagacaugcucugccuuuucuuaauuacuuuuggauagagcccauagugguggagaugccaagcuauaacaagagguuuuuguuuuguuuugaaccuucuuuguauucugauuuuaaaaagccugggauggugggaaucuuaacaguugguugucacccaaguguggcucuggagcagggcaguuuggagcucugaaaaucgucaauccugaguccuacuuagugcugguuaagagacagguuauuugucucacuuaaguuuagaggaugccacaucccaagugagaagcaaacuggaauccagucgggaacgucgucguuuuggccuugagcuuacaauauaaucucacuuaaucuuuuaaagaugagguauuggauagcuuucccacugcagugcacuccagccuuccuuaaauuauuuuaagaauuuacuauuuaguccagugauaauagcaagcaugucuucucaaaugccauuaaguacacucaccaggaucagauacugaagagacagacaaguggcucucuaguggugcccuuuucagauuauccauucugcuuuuaugguacugggguagaacaugugaggucaucugcguugugcuucuguauccugcugauuugagaaguggcuugccucccauagacaguaacuguggugcuugcuccuguccuaugauguaugacuugcuuuugaacuccuccuauauaugagcugaaauuugauacuuugguaauagacugaucuuggaucuugugggaccagcauggaauuauuagcugaaagaacuccaccauaaauacugcuuucggucaacuaguagcccaggaggggaguggugucuauuucugugcaagugacuaauuguacguacacgaugguuugaccgucucauccugcucuuacaaaugucugugauaaaauggaucaggagugcaggauccaccacuuaugucuccuagcucaucagagacaguugugugugauaggaagggggcugggagugaguuacauaggggcuguggagucuaaccauuugcugggccuguguguuugugugaugguugcagaugcgugugcacugugguauggaggucagaggacaacuuuaggaauugagcucaggcuuucauggugaguguuaccacccacagaguucaucuuaguagcccugcucugcauuccuacauuuaucagauuauaugccacuuugaagcuaaaaaugcacaguccugaagcagguguuggguuggcugccucuaagcccagcacucaggagggaggcaaaagaaugucaagggcagcucagguaaauagugagacccugucucacuagcuccaggcaugcgggaccucaguuguaagaguugcugccucacaugcacaagacacugguuccucagcaccaccaaaaaacaaaugacugggauaaggaaagacagucuuacuucauucaauuuugaggaacuguuagggaaauuguccaacuauggugacaucuguaaaauguuaaacuuguaugaguuuauguaugcaugccacagcaugcacguggaggccagagaacacccuacaggagccauuucucuccuuccauaguguggguccuagcaugggccucaggccauuaggcuuggcagcugccuuugauuauguucuuugggggcuuggaacaccacucaaaucaaaacuacuuugauaaaaacacuucaaagagucuaguuuacucuuuguuuuguuuuuuguuuuggggguuucucuuuguaucccuggcuguccuggaaccgcucuguagaccaggcuggccucaaacucacaagagaucugccugccucugccuccugagagcuggguuuaaaggagugcaccaccacugcauggcuacucuuuauuuuucuaaagaagguuuuguguguaugauagaguaugugucuguaugcacaugaguguagugcccacagaggccagaaaagagcauuaggucuucuggagcaggcagcucugagcugcccaacaugguuucugggaacugaacucaaguccccucaacagcaggaagcacuuucacugauaagccauuucuccagccucuuaauuuacucuuaaauuaugugugaaguucaccuuuuccuuaagacaaaauuuaggaaaauggcuaaaaucucauuuuuaaagucaaaacuaggccaagucccucuaaucuucauauagcagucaguccuccugagccucgugaggagaggaccccugccugcccucacuuacacaugcagcccuggugcucugcuaugcucugucccaugcugcugcugcaguaguagugagaguuuguguggcuugaguuugagagccuguuguccugaguguacucauacccucaucucacuccauaaagcaggacggacacucagcaucacaccugcgggagcucuggacugccuugcuccuccuuccuuuaagggagagcaggauaguacucauaagccuuuugcuagucauuuuugaaaggauuccacuuugaaaaucuuaaaacagccugggguuuaaugagguaaacauaggaugaugggauugcagauacgugauccuuuauuaugugaguacaguuaaucauacugcaaaaaugagacaauugaagggcaggggguguggcuuagaggccugaagcaucagguuugaucucaagcacuguugucuugcugugaaaaaacaacuuagagaggagagcauuuaauuuggggcuugguuacagcuuuagagguaggaugcuuucauggggugcaggggcugggccugguugggguuuugaaaccucacaguuuaucccaacgacccccuccaaucuuaguuaugguuaccauugcugugaugacaugccaugacccaaaaguaaguugggaaggaaaggauuucacuuauaauuucauauauaaagcacugagggcagcgacuuggaagccauggaggaaugcugcugcuuacuggcuugcucuucaugguuuguuuagccugcuuucuuacagaacccagaacuaccacuccaggggagcaugaccccugugggcugggcucuccccgaucaaucacuaauuaagaaaaugccuuacaucuagaucauguggaggcauuuucucaacugaggcucccuccucucugaugacucuugcuugugucaaauugacacaaaaguagcuaauacaccuacuacuccuucucaaacaguuccauaacugaggaccaaacaaaucuaugaaccaugggggccauucucauucagaccaccacaguggugcauaguccaucauacuagcacucaggaaguagaggcuggaaucagaaagccaaggucaucuuugacuaaguuugaggugaccugggccacauaagacuugccuuagaaaagagaagacagagagaaagaaggcacuuacagugcacgugcuuucugauagcguccauccaggugucucuucaccuccgugcuuucuuuacagaucaggaaaaggacauagcaaguaggagugguauaaauguggagaggauagugcauguaggaaggcaaggcuggugugguacuucuuaggcagucuuuccugcaucgguauauaacauacauacacacacacacacacacaccccuuguguuuccagguaccuggugacccaucucaugggggcggaccugaacaacaucgugaagugccagaagcugaccgacgaccacguucaguuucucaucuaccagauccuccgagggcugaagguacaggcaguagcuuugucauuuggggaagugaguuaucucucccguguaguaagaacuuagaaaagacaguuuuucuuaugaaaaacuuuuaaaagaguuacagaaucaaccaacccugcugcucuuguauuucccaggccaguuuacuagaaagcaaauauuguccuucccuuugauccuuuagucugaauauccaagagacuuuuagccacauugaaaaguuaguagcauccugauacaaccugguauccagucagugugauacugaggcuuuaaaauauucuucggggcuaugagcugcuuuuauauuccuucucaggacuugagagguagaaaaaagaaggaccacugugugcagccugagugccagccaccaaggcugucuggggcggggggaccucuucagaaccaccuuugauguuuagcacauuggagcccuuacugaagucauccucuagaaagaaaauaggcugacaacuccaguagguggagugggaauuagaguuuguguaauggcccgcugugagcgcgcacagugcuugacugaggggagagcacugcaagcacucuagaggauaugacaccaaaaagcugaagauggcuuucauucaaccuacuuucuucucuuuugcaguauauacauucggcugacauaauucacaggguauguauuauaccugacgugguaauuauuuugguaguguggguggggcuagaagagugacaucuaguucagaucucagccuuguaacugaaauagugauuuucugcaaccuuguucucaguguagaccugguaaaggaacacuugccauuugccugcucaaggcuuggagucugccuuucucucugagagcucuuccacaugugugcaucuuuaggaccuguagggagcagacucugugcauuguugauaagcucucucugcuugcuuuccaggaccuaaagcccagcaaccuagcugugaacgaagacugugagcucaagguaagaaagaagagauggacuguuugcuucucuuaaguguuccccagaaucgugaccaaccacacuuaagccacgacuugcuaucuaaaaagucauuuguccuuaggaauaucagacugugagacuugaacuaggcugaacaagcuguuuaaguaacuuuggaaguagaugucgguaucuuguuuucauuuuuaaaagauaauuaaauuagaaaugcaacacauuaauuguaauaaagggauauuauagucuaaaugucaguuaagccuuccuggaacacugauaauuagauagguuccuaaaaggaaaaauugcagaucucagaaugaucuaaauaaaaccuaaguaaauuaaaauuaagucuuuaaaaaguaaguagaggcugcccccugcccagacugacgagucagcccugcugucccgagcgccauguuggguucuucuagcguugccgccaugaagaaggugguucagcagcuccggcuggaggccgggcugaaccgcgugaagguuucccuggcagcugcaggcuugaagcaguucugucugcagaaugcucaacaugacccucugcugacuggagggucuucaaguacaaaucccuucagaccccagaaagucugcuccuuuuuguagucaucuaucuugagguuucucaaaccacuuuucaugaaccagugacuauucaagagagcuaaguuugaagucuguacaaaagcuucucuuuaacacgugccauaauacacuaucuucugcucgucaguccuuaacaucuaccucucugaauuccauggguuucugucucacaagguuuaacuauuuuauauacacuggcuguagcauacaauaaagcagcauacaaaaaaaaaaaaaaaaaguaaguagcugcccaaggagcuaaagaggucagcaacccuauaagaggaacaacaauauguacuaaccaguaccccccagagcuugugucgcuagcugcauauguagcagaggauggccuagucagccaucagugggaggagaggccccuggucuuucgaagauucuaugccccaguacaggggaaugccagggccaggaagcgggaguggguggguuguggagcagggcagggggaggauauagggaacuuucgggauagcauuugaaauguaaaugaagaaaauaucuaauaaaaaagaaaaagaaaaaaaggaaguagcacuaugcuuuuuuaugauuuuauuuauuuauuuauuuauuuauuuauuuauuuauuuauuuauuuauuuauuuauuuuggauuuggguuuuucaaggcagcaguucucuguguaucccugacuguccuagaacucacucuguagaccaggcuggccucagaaauccaccugccucugccucccaagugcugggauuaaaggcgugcgccaccacugcccagcaaugaauuuuuugaaaugucugcagggggcuagagagauggcucauuucccagcagcuacauggcugcucacagccaucugcaucuagagcaucugaugcccacucuucgucucuguggacacugcacagacuuggugcacagauauccaugcaggcaaaacacccauguacaugaaauggaaaaggaaaagaaauguacuucuuuguagaguguugcggccgccagcagcucgcaacaugaacgguucgacugagaaggcuacucgagcuguaagagaggaaucuagacggggcgaaagaagaaacggagccaagauaaauucauucugaucaaagcucaaauuuuauuguugggacacuaguuauaaaagaagggggaggggacccgauuuccgccaaauaaucucugguccaguaaaaaggugcacguguguggcuccgcagguucuagcagugggcgugacagaacagaugagcgggaagcuccaccccugagcaagcagguuucaggcugggggaggagagacuacaguagaguuguaauguccauguaaccacagugaugacauaguaaccuccauaguuucaaaagguuugaguguccccuccuagugacccaugacucucacccuucauucaaugcaggcagccacugacccaauucugacucuggauuaaucuuguuucguauaaauggaacugucgagggucaugcacauuacugaauugugugcucaucuguauugugugcuccagcauucccaguuguucagcaguuuccuuuucauaagcacaccaaaguuuguacgcugcuguccuauuagugagcacuugugguucggaauauaaaccuauugugaacauuccugugcacacccgugugggcauauguuuuuauccuugaguaaauggggggggggguugcuuugcuugaagcuuuauuuuuaaaguuucuuggaguguuuuaucaugucaugcauucuaagugaaaacuggggugcccucuuucugaaagugacuuuucugcuuuccugguugugagguagcagaacuugcugcucccaugccugacuucugcucuugcccuuagauucuggauuuugggcuggcucggcacacugaugaugagaugacaggcuacguggcuaccaggugguaccgagccccagagaucaugcugaauuggaugcacuauaaccagacagguacugacugcuucagucgccuccccagauggggaaggggugcucccuaacauggcuuucaggugacuuagcagcuggggccuuacuucuuacgucuuccgugucauucuuucugugacacuaccugaggggaguggucucuuaauccuaacaccuauguuuccugggaggauucaccauuuaccaguaacaaaguuuugccccuuugugaguugcuuauuucuuuuaucuuaauuauauucugaguugcacgaccuguggagucuuuucuugagugacaauuuuaauaaguuuguuucuauauaaaaaagauugucaaaccuugggugucuuaaauccugacuugaaucucucacucauaguuagagucauuuguguccaugaauaugaauagaaaccaugucggugcuuguauccucuuuacuguuccaguggauauuugguccgugggcugcaucauggcugagcuguugaccggaagaacguuguuuccugguacagaccguauccuuuaacacguuuuggcccuguuucucaugugugugcugugguagaugugugcuucccuaacucauugguggggaagacucaguucuuugcaguuccagcguggcuuuugaggucuguccucuuguugaguugcucaccuugccaagaaaaggcuuugggguugagaaaacaagcuuagaacucaccugucauauuuuugcagcaagucccuuuauuaaugaguuuagucuauuccugaaaauccuuggugaguguacacggccaccuguauucagagguaucugguucucacauuugcuuauguacuaaacagacugugggucccucugcugacacgcccgcugaguccuguccuauuugcugcuuaacaaccaacaaaagaagcaggaagagagaggcccugcugugugcucuuguucucuacaccuuguugucccuguuuagagccagccccacuuuagucccauacuuagcaccaucuggguuuugggcacuaagcacucguuccuaucuguugggcacuugucccauggcuuaggaauaauaucauuuaaugugauugugagaacgcccaccagcucugcuuaaggaggguguuaggugaaaauguuaaaacggaugcuuaaaauccaucuucaggaggaguuuuguaaaacucuaguagccugcaacugguuuugguugggcuuuuagaaauaccauagcgacacaugcuucaccuucuaacugcagggugagcucuugccuaacacauugagacuguaagcucaguugcuguccacuuaggcugcccuucuccagggacugccaugccacugugucugucgugacaguuuucugcuagacaaucuuuuauggaguggaauccucugcuccccggauaaugcugucugcuccugugcgugcugcuuggugcagcucacucuguuauucuccacuccaggaugucaucaccugaccaucucuauucccuugagauuuuggcuugcuuacaguccgagcucagaggguuaggcaggguuuaugaugcaccuugugcuguacucugggaccauccugaagcugaucucucuucucuuccuuuuccccugcugucucuucagcuguccuuuggcuagucccagagacacaugccuucauaggcagacagacuaacagaacuauccuuagggaagugucucaguucauugcuuuuguaguccauguaugcacaguuagaugcuaaggccuuggaauuucgauuuuagauuuuagcuuuuuuuacuuuugaacuauguggcuuugaucaaguuuucuaauauccacaucucucuauuuccuuaacuguauacagcucagugauugugacuuuacugaguccagagccaucaggaagugcuagcuucaccaguggcuguaucaguagcuugucauggccacagacagauagauaccugagagaaauacuuauuuugggcucauggguucagaagucucgguccaugaugagauagagcaucaggguagcaggagcguguggcagaggaggcugcucacuucaugguggccaggaagcagagagggaacgagagaagguuggggagaggaaagcauccaagaacaaaguaccuucuaggacacauucccaguggccugcuuccucucccagaccccaccuccuaauguucccagcauaaaaaaauagcagcgccagcuggggucagacgcgcaguaggagacauuugagguccauacuguuaauacuccaucccuaccuucugaaggccauauacuuagcuuguaguauaaaacacacucaguccauguccaagaauccagauccucauuagucucccgauacucaaggcaaacucucagcuguagccccuguuacagucaacagauuauaugcuucuccuuuucaguggcauaaacauucucauccaaagguaaggaagggccagaccaaagcaaggugagauggagcauuaaagucccauaguuugacauccauccuccaaggcuuggguggcaugagcugaguuccaaagagcuugggcagcccagcuccugucacccugcuggauggauccauaugccuucucucuuggcucacugccuguaacuguccacagcccacauucuggggacucacugggacaucccccucacagcuucauggaucacacugucaggccacucacagugauuccaacccugguguacacugcccugcuuaugccaccccauaauccuuggguucugcgugccucgaaaaacuagcaucgugcugccaggcugagcaguagcugggucuuuuuggaccguggcuucagagaccucagaguagcuaagcacuaugaccagguccuaaccagcccucagugggcagggggcucugagguaccuguucucuaggguguuuuggacgaguuuauacuuugcaucugggccuacaguaguuaggggucucuccaauauccagcauauuugguaucuuuccuauuuuuucaguacaaauuuuucuguuuguuguuauuggugguagacauuuguuuuguuuuguuuuguuugagacaggcuuucuucguagcccacgcucaccuggaacuauuguguauuucaugauagccauagccucccagugcuccucuugccuuggucuccugagcuaccgugccuuuuuuuuaugcuguguugggucuggaucccagggccuuaugcaugcuagaaaaccacuuuaccagcugagucacaucgcuaagcaguucugacagguguuuugaguaaaaguaggaguuuaccugugugcguuuaguuuuaacugggugaacuggaaaucauuagucuagugggccuauccauuuuucuuaaggucccaaggaguucuaaaguucucuucacuacucuguccugugguuucuagaacucuuuucaacgccucuaaagaacauacggaccccacuccagccagccuagaaggccugaggcuguagccugugugguuuguaaauggaacacugaugagacauuuugcagacugcucuuucguggaguucaauuuucuccauggguuucuguuuaccucacuuuuagucauugugccuuugaacuagugaucuuagcuucuaagagcugccuaauaagacuuuuugaggcaucauagaucuguuaggugugugcuguccuguguauggcucauaguugaggagcccgugugguuaauguaacuugaugauugauugacuuaaccucuacaauuuuaaaguuuauaaccuaucaguaucaauuagguucaugguguuggacagucguugccacugaugacugugcugugacuuagaaaacccuuccauccagcuuaauaagagugguugguguucuagugguuguguaaagaacaaagcucuucucuagaagccuggucggcuauaaguaucaagugaauucagcugauagagauuaauagcaaaagagggagcagggagccccagacugucucuccggguggaacccuuacuuacuuugauuuugaaaugugugguuagcuagguauggagucacugaugccagcacgucagcuucagcucaaggaccguaagcuguguggccuuuucuuugcuguauccaauauagacaauacauuuucauaccagagaucgcagacuugacuuguuauuuuccuguguaaucaaguauaaauuuccuucacgcauaaaagaccuuucccccauuguaguggaugugguacuccuaagacgugaccuauggucaggagaggcaacucagcaguuaaagagcauagcugcucuuccagucuccaggcugguguucagauucuagcaccugcaagauaguucaucuguaacuccagucucggggacccagugucuucuuuuggucucugugggcaccaggcacgcacauaguacagauaagcacacaggcaaaacgcucguacacauaaaaauaaaugauuuuuuacagaugugaacagaggguggagggcuucuggauuacacugcugcugcugcacugaucugcguacuguccuggguauauuagaacagucucagagcaguucguccuucuucaaacaugcuacggaacaucacagauagacaguaccgugcucuagugaacccugugucugcucugcccagagggugaaguaaaaugugggugguugagcaaacgcacuggagugcacagcauaucuagcuacccauugcucuccauuguuaaguuuccggucuuuuccucauuuuuaguuuuuucuuuccuuaaacucagggagggcuuauguaugccaggcagauacuguaccauugagcugcaucucuagaaguuggucucaguuuugaaaagaaguuggaccgggcgugguggcgcacgccuuuaaucccagcacucgggaggcagaggcaggcggauuucugaguuccaggacagccugggcuacacagagaaacccugucucgaaaaccagaaagaaagaaagggaaaaaaaaagaagagaaaagaaguugcacugcugauacuaaagccagugccuuaggguuggaaagauggcucagauaauuucugaauuaaaauuugguauuaucggggcuggugagauggcucaguggguaagagcacccgacugcucuuccaaagguccggaguucaaaucccagcaaccacaugguggcucacaaccauccguaacaagaucugaugcccucuucuggugugucugaagacagcuacaguguacuuacauauaauaauaaauaaauaaaucuuuaaaaaaaaaaaaaaaaaaaaaaaaaaaaaaaaaaaaauuugguauuaucaucuuacuugaaauacauuuuuuuuaagauuuauuuauuaauauauacacuguagcugucuucagacacucuagaagagggagucagaucuuguugcagauggcugugagccaccaugucguugcugggauuugaacucuggaccuucggaagagcagucaggugcucuuacccacugagccaucucaccagcccccuugaaauacauuuuaaacugaugauaaacuuacuucuuuguggggaaggaaaagcuaucccaguugugaaggauagcucacuguggaaauagcaggcuguacuaagucuugcugugcacugucacauagcuggguggcagcuuugccuuagcuccuaaggaggguuuucuuccauaauguguuuauuaccuuccaauucccagguuugcuguagcagcuccagccacagcccuccucgcugugcacgauguucauucauccuuuuuacuacuuuuuuuuuuuuuuaaauaaacugcauagaauguuuuucuggguuuugaggauaggucagaacagugagucaaguguuuggaucagucgguguuugccaggcuggcugcacugggcaaggcuggagagaugcugcugccacccucaaaaccaggguagucagucugaaccaaccagagugguggggugacugggacagaagucuuccuccgguggaaaagcagaauggaaugaggagugagaggugcagguaaguuacuucagagagaaguccaacauggaguaaaaccccaggucauuauggagaggagacggagacucaggaguccaggucaccucagccacauaguaaguuugaggccaucucaaaaaagcuuguccagaaagacuucuuguuagaacagcccuuggaagggacagugggaaaggaaaaggcuuaauacaggaagaguggaggcuucccuuacaacugcauaaagaggcauagaagugccugagaccuuugccuugaguugaagcuuugagccuauucaagaauaguaguuugaggcaagcagauaaaaguugagugacaggugucagaaaggcguggaugugagggugaggagcugguugugauuuagucugagaaugcucaccccugcagacaagggagaaagguauggaugagcccugccugcugauagaugcauguucuucaggcagcuuggaggugaagcuaagucaguuaggaaacaacccagacuucacuuuucccaaagggaauaugaaacuugccucuuuagaaaguccagcugggccgggcgugguggcgcacaccuuuaaucccagcacuccggaggcagaggcagguggauuucugaguucaaggccagccuggucuacagagugagugccaggacagccagggcuacacagagaaacccugucucgaaaacaaacaaacaaaaaaaaaaaagaaagaaagaaagaaaguccagcugguuaauaaacuacuuuggagucguacaugguaaaaucaccucuuggagggcuggaagagucuaauuuuuuucuauuaacauacauccucuugaaguggcuaaucagauauuccuggggaguagaaaugugaauggagcuagauuuauauaaacugaguagcuucuuccugucugcaaggaagaugcucaacugucaccauuagcaugucggcaguguuacggccugagugagucagugccagucucaguccacccacuguccgcaccuggagcaucuccucuuuuccauuuucaguagcagggguuuuguuuuguuuuguuuuuucuuuuaccauucuaacuucagaaauaucuugugugaguggacuuccuucuggguuaacucgguuuucuguaggaugccauuuuugggcacuggcucaucuuaucuuaaaaauuauugacuguugcaggccugugaaaacugguguguaaauacacgaaugcacggccuuguugcauuccaggaaaacuccauguauaagacaggcaccaggcuguaucuuccugucaccuuucuagaauuuucuucuguuuuagcaaaaaaaaaaaauguucagaggcaaaauggccaucuuguugcauaagcaguuccugugacuaggcaacuguggcuugcagacacuguucucuugacugacucaugcuuauuuugccucucuauaugcaagcuaaaucuucucuaucuguucuuuaaauauuguaugugccuuuuauguaucagauaaucuaaaauaagggaugggguucagccauacauuguagucccagcacuuggauagaugaggcacaaggacucugaguuaagaggcugcugggggauuuuaggugacacaggaaggacggcuaaugauccugcagaaccugacgggcucacacagucucccuaucucaccaucagcugagguauggagcagcuguucagaugcucaaaaggggcugacugaaggcagugagaguaaauggccucugauccuccggugaacacaugcucauuuguucugagguuuuggauggcagaaugacuauuccgggcccuuugccuuucugcuuuucaagucuuuagugaguagacuuugguuacuuuacauccguuaugguugcagccuggugucucccauagugggguagcacccucugccagcuggcugucccucacauguucugucuccuagaggggagaggggaaggucuccagagggcacacucaagugaacgaauggugucugggaggagagcaggccucccaacugucagauuacaaguuccuuaggucaggccuuagggggauagucacaaauagaugcauagagugugcuccgccucugcuugccagcacacucugcuuagcuaccuccuagugccuugguggaaggggagguggagguggaggcugggcucauggacugaguggcguggccucuugucuaagacccaaccacagugacuuuacuuccugcugcaugguggugacaaauguguguguguguggcgguuuuuugaaccuuucuacaggaggagcaagucaugcugaaaguggccacccuacagaagccuuccacccagaaucuuccaccauguuggccuuguuugggggagggggggacucauuuccauuauugagauuuuuuuuguuuguuguguuuuauuuugcucauuauuguuuuguuuugcuuuucacuuuuauuuugucccgacauuuuccuuuauaguccaccguuagauauugaucaguugaagcucauuuuaagacucguuggaaccccaggggcugagcuucugaagaaaaucuccucagagucugugaguugacgcuuugauugaauuacuacccucgggggccucugccacuugccuuccgucacucugcacucugacuuuggaaugcaugugugacgugugcugugugugaugugugcacacaugugagccugcaugagcccgcuugcaugcaugaguguguuuuauucuaaacuauccuuaucuggguguggacuuaagaucaugggaaccccuuuggggcaauuguaugcuaauaaaacugagaguugagauuccaguucauuccaagagauuaaugggaaauuuguguguguguccuccugagcccugacuucucucugaaguugcccacgugcuuaagagcccucucacuuucugcugagcauccuaaucucugacacugugugcuagucugaccuucccucucaguggugggugaugugugccuugucccuagaggggcuccuccugggcggggucuuuccaugggcuccucucccacccucagaccacacagaacagcuuccuccccucaugacagucugcagauggcucugaacuccuccaggaaccuuggucaauacagugaauagcaugaggggccacuuggaacuugugcuuucuccauggaggccauaagaaggugacucuguuuuacuuuagccaugguugguugguuuuuuguuguuguuguugguuuuuuguuuuuuguuguuguuguuuuuguuuuuugguuuuuuuuuguuuuuuuuguuuuuuuuuuuuguuuuuuugagacaggguuucucuauguagcccugguuguccuggaacucacuuuguagaccaggcuggccucgaacucagaaaucccccugccucugccucccaagugcugggauugaaggcuugugccaccauugcccagccuuguuguuguuguuuuuguuguuguuggaggauuuuuuuuuuguuuuuguuuuuguuuuuuaagcuguugucacuuucuggggccagaaacuuugaggaagcuaggaaagccccuccuuccucucauuuccgcuuagggaaauaaauggaggagcuaagccccagcugugcacgccuagguuccccuccuaccacuuccaauagaagagccuucugcucagcuaagaaggaaguuaaguagcuguaggcaaccagcaacacacgagucaccuccccugacaaaaucaggaccccgaaucugcaguguagcuauacauaaaggacccuggagcuuuugaaugggccuauuuuauuuuauuuccuuuacuccuuuaagauaagaaagcaagccaggcaugguggcguacgccuuuaaucccagcacuugggaggcagaggcaggcggauuucugaguucgaggacagccugggcuauacaaagaaagccugucucgucaaaaaggaaaaagagagagagagagagagagagagagagagagagagagagagcaagcaagcaagcuggauacauggccuaauaaugagaugucuuuuaucuuaacaugaagugggcacaucagauauuugaacaguucuagugcagcaauggacagaaucagguaccaagacaaacauccucucagugauaacucaguuguguacaguagugagaaaagagcuucccugcauaaucgucagaaauggguaauggcagucuaaauguuggaaaaguaugggcaagguuaaguuaguguugaugacaccacccaguacuuuugaaaucuccaaagcaccagcugugauggugcaggucucuaaccccagcacuuaaaaggcagaggcagaaagccugggcuuaauuuguaagacaccuuuuuaaauaaacaaacaacuauuguagauguagcucagugacgucaacauggccaugggucuaaccccagacccccuggggguggggagcauacaguaccuacauccgggugagauaaagcugacugaguaaaaguagucagaaaaauuuacuaaagaauuguagucaacagaacacugaauaacucauuccuucuggaaagaacagaacagggaagccaguguagacaaggacacggggucugaauacagagaaugcaggacagggagaacaggacagaaagcuggcagaggcccgaggacagcucacugcuuagugugcuggcaccuggguuaaccagccaaggaaacaaaggcauggcuccugcccucuucuucagagauacaucuucuugacucccagaugacaaauggcugauccuguacgugcugcccgcaaggagagcaugacaguugagcgugugagcucaccugaauccugcgugucuaguucacccuguuuguccccucucucaguaugcagagcauuguugaguguggaguuuucagagggaaguccaaagucuguacagagugagucagcccaucucugcacucagguagaagaagggcaaaugcauagcaguagucaccuuccagcaggguucgugcugaugugcaaggaaaggacgccauuggcuugucuauuaaagaugagauuccagcugaaggaugacuugauacuuaggugaggagaaaggaagcucacuaaaucauguuaagguuuaguuuaaaauacuaucaucaccuugagagggagcgugggauaaacuggcaguggguuuccauuucagaagcuguggccuguaccuggugaauugguggccuggcugagggaaguuaguaguccugucguuugaguaaggacacugagauggcuuagcagcagagaccugaguucucuccuagggcccacacagugggcagagaauucuacaacuuggagaucaauccucugaucuccauucauuagugguacgugugaccugccccucccuaccacacaaaugaacgugaaaauggaauaacggaaacuucauguaacuuugccccgucagauaaacacaguguuuuaaacuuuuuguucauugaaguuagugucuucccucacuacaggugugauuguggcauguucugaagcugucaaccagacuguagcuucgguuuugccuucgccaucacuccuaaaguacccuucuucaccaaccuauauauuuguggcaugcauuuuaaguauaucacugccaacgucuuugagacuugguguagcucagcacccacacuccaaguuucucagccuguaggggugugucucguagagccugugccaucaacacugaaccuccuccccagauagaucuguuagauguguuagguuuccagaguuucaucaccauuaucuccaucuucuacuuuugccacugcagcaaacagguuuuagccauugggacuugaaaaugguucucuggcuggcauccuggaucaaggcacagucugcuuccagagaaccuaaacuauuuaacauuaaaguugauacuuaagcaaaaguuuguuuucauguguguguggccacucacuggcuacaugccuaauagcuccugccauucuccacagaauguuacaacacgcagccuuaggcgcuggccuggugugguugggaguugcuuugcuugggauggcuuuugacuuaaacaacuggaguugauuuuuacaccgugucuuaacaaugcccuugacuaggcaucuuaagauauuaaccagcuucagcagauaaugcgucugacggggacacccccugcuuaucucauuaacaggaugccaagccaugaggugagaacaaacagcaugcacagggaagucuaccucggaggccaccuucucgugguagugucuguguauagccagcaguuucuaaugucaccgaaugcuugcaugugccccaagaaccguuaaagcaguacuggcugugugcuagcggaguguuggcauuuaggaugcagucuccugagccugcgaggcagcgaugcaguguagggcaguguucccuaguguuuggcuuucugaucuugugcuugagguaacaagugucguugcaguuguauguaguuagggugugcuacagccgugucaugggugcauggaacagaguucauuagugugcuuugcucuccacccauuuuacaaccaagagaagacugcaugcaagcacgcacuauaaaauuccuugugcuaauaggugugcuggguuuuuuuuaaacaagacaaguaauucauaguaaguaugaacaccuggggaaucgagcucuugaccaggucauaacuaaccuaacuccaguuuaugaucagacgugacagacaaacccuuguagagcauugugugcauuucagcucuugucuguauugaaaaauggcuuuucuuaccucuauuccuuuuuccauucuacgugguuaaguaggaagggauugcagccaugucugugucugguuccuacaacuucaaauugcagugaguucgucugcuucaguaccaacucuucuucaugacuuaccugauuaggaaaaugguccuggaaaagacugcuuggucucaauucugguuuuaagcuucugacccuuugaccagaaagcuaguaaagaguagcugauugauuaucacucucauccacaggaaacagaacucuggggagaccgcaagaauaaagucaguggucacaaauagagggggucaguggcuagaagaagaguaagccugaauugagcaucccagacagugguccauacgggccucagccuagcucauucccugagaucacuaacacuacugaacauagucauucugaaagucuguguuuuuacaggcaagaaacuacauucagucucuggcccagaugccgaagaugaacuucgcaaauguauuuauuggugccaauccccugggugaguugaucguacuuugauuuugugguauaaauuagaaauuugaaguuuugguuuugacuaaaaagaguaccuuuuuuuuuuaagauuuauuuauuauuauacauaaguucacuguagcugacuucaaacacaccaaaagagggcgucagaucucacuacagaugguugugagccaccaugugguugcugggauuugaacuccggaccuuuggaagagcagcccuuacccgcugagccaucucaccagcccaaaagaguacuaucuuuaaguaacuuuugggucuuaauaaauauagcuguuacugucugucuguauugucacauaaggaaauaucauacagugauaggcuuguaugcuuauaugcuugcagaauaugguggagaggcuaagggaagugaggaauggggaacagggaauuauggggacuugggggagaaggaaggaggugugaaccuuacagcugcuagugguagguggagcccagcugaggacagaaaacaggcacagacacaugguuaaugcccagcaguggguccugauguccucuacacucacagacucgucccccuuuccuccccucucugcccuucaggguguaagcagcugccuuugcagcauugauuugguggcuggcuccuugccuuccugccuccauuaccuccaggaucaccuggcagaggaagugacagugguagcucagauugugucagcacaggacagugugcuaagguucuaauuccucucucugguguaguaggcaguaguagauacagagccaucagaccaccaccgucuccugccaugagaagggaacaagcaggugguggcugcuguccccugccucucccauuccugcagauguuacuguaaagucacugcacuuaagucuucgugggucaugucccuuucugaggguucuagaagccaugugccagaguuacuuauccuuugaagggcugaugucuguggcagugauuucaaaagcugggagcggaagcuuucacgaacucuguccauagccacaauacugaggaguggcuguggcuguggcaaugauuccuguagcaggagaggugugugcauucuuggaggaggggguccagccuaugcuacaccauucaggccugagguguacaugguacugacagguuggguuagguuuguggcuucccugucaggcucacugggcucucuguaacuuaccuugagcuauugcaucagauaagggucuggggucucugugaucucuaaucuuuccauguugauuccaccccugaauccucaccagcagaugugcgguacacagugucugagucuucucugauggagcugguagagauccccauuuagacacugagaagagcugccuuacaggagugaauccaggcugcuggagacuaaaaggaggcucuggcccaucuggugcucuucacagccugcucacauccaaacgugccuggcagcccauugccaagugcuggucagaaggaacaugcuguuaccgauugcuagccuagccguccccaacaggcugcacaccagcgauauaaauauuaacagcccuguugucggucacaggcuucgcaucacugcuagccucaagacacagcugagaacuucacauugcccuuugaucuuagagugucuauuuaugucugccuccauacuugaaaagucuuguucuuacuucugaccuuguuccucaucuaagugcuuugauccugaggacguggaccucuuuuuaccccaggguagcaggcacccacucauucauguucaguauaaagucagcggauuuguagaacgugaggauuuguauccaggaaguccaccagugcuucaguguugaagacagagucauguggccuguugugccaccaugcucacugucugcagugcuagguuuagauccaaggccuuaugcacacuuugcaaacuuuacuggcuauaucccagcccuccuccagcacucuaaaacuggagagccagcguaugcauguuugcuguuuccucuguacccucaaagccugcguuucuguggauaacugguguucaggcuacaggguacauaaucacucagaggagcagagguauagcaucucuucaggaaguucuccucgacacccauggagccuuccacgcugaagaaaucaucuggagcuguagagauggccaacggggcccuuggucugagucccugcaccaacaggaugccucacaacugucuuuaauuacacuuacagaggauccagcgcccucugcuggcuuuuagauuuucagccagcaggcaugcacuguaguggagacauacuuaaaacuuaaaucuagcugggcgugguggcgcacgccuuuagucccagcacucaggaggcagaggcaggcggauuucugaguucgaggccagccuggucuacagagugaguuccaagacagccagggcuacacagggaaacacugucucgaaaaacaaacagaaaaaaaaaccuuaaaucuaaaaacuuguggaguuuauuucuguuuuacuuuugggagagaaaaaaccuggaagccauuauugaaaguaacugauaaucaccaggagacaaaccaucuccccauauuauucacuuggggagaaacggggaagagcucaagaugccaaccaccuuagcucagcauaaauggagcuccuggcuguggugccccaggucacagcaucaccuguggcauggucucacccaguaugccuaauuucacucuuaccaacaauugaggugguaaauguaaagacuagagagaaaugggagagagugcacacagcauaaggagaggggaaggaagccuccaugguggugugccacaccugcaguguccacaaaugaaaaccaagguggauggagaaggagagcugggggguaggaggggguguuuguuuauuauucuggguuucaaacccagaaccucaguaauguuuuuaaaaugugccauaggcauucaaugcguacauggagggaagggguuacaugcagaagcagacaccuuaaaggaugcuuuguguggaugugaaaggugcuuggaacuugcacagugguggcacugaugucauguguuuuccucuuuucuggugugacagcugucgaccuacuggagaagaugcucguuuuggacucagauaagaggaucacagcagcccaagcucuugcgcaugccuacuuugcucaguaccacgacccugaugaugagccuguugcugacccuuaugaccaguccuuugaaagcagggaccuucucauagaugaguggaagagugaguccagggcaggcuagcgugggcuuugagcuugcuuucauuuuauucauguuuuguuuguuuucugagccaggguuuuucucuguguagccacucagaggaacucacuuuguagaucaggcuagccuuaaacucagagauccaucugucugugccuuccgagugcugagauuaaaagcaugugcuaccaagucccguuuauguaauauuuuuuaacagugcuggagauuggaccuaggacucacacauauuuccaacauaccuaugaucccagcacuugggaaucagauuaaaaguuuaagguuaaaaaaaaaaacagacugaagccgggcauuggugacgcacgccuuuaauuccagcacuggggaggcagaggcagguagauuuaugaguucgagaccagccuggucuacagagugaguuccaggauagccagggcuacauagagaaacccugucucaaaacaaacaaacaaacaaaaaaaaaccaggcuguaaaguuauucacagcuguguagguaguuugaggcuauccugggcuacaugagaaccugucugaauaaaacccucguggaugguugccagcagcuuucugagcucacugccagggucucugaugcguauguucccugaugggcugcagacacagagugcagagccuucaaacugacagagcuuugaggugcuuggcgguuuuacguuuacagcaucuuuucaggauaaagagggucuggcguauuucagcacagaacuaggacaggaguuuuuuauagcuuacuuuuggccuaguuagggacugccaggaauggagccacaucuccacccccagucauacuccuucauaaagcacaaggucaguucugcaguuaggacugccucguugugugcagagugcagugcugcuccagggagcacucagaaggagcaccgugcaugauggaguggggagacaguucugucuguguccuugaacuggagcugcucugcugcagggcagggcaggagcaaggcaggugauguaguucaucagaccacugccaggagggaagggcugagugucugccugccggaguuguacgccucacccuuccuuccuucuuuccuugcccuaggccugaccuaugaugaagucaucagcuuugugccaccaccccuugaccaagaagaaauggaguccugagcaccugguuucuguucugucuaucucacuucacugugaggggaagaccuucucaugggaacucuccaaauaccauucaagugccucuuguugaaagauuccuucaugguggaagggggugcauguauguguuaguguuugugugugugugugugucugucuguucgucuguccaccuaucuuuguggaagucacugugaugguagugacuuuaugaguugugaaugguccuuggcagucugccugcuuucucagagucugggcaggccgaugggaacugucaucuccuuagggauguguguguucagugcaaaguaagaaauaugaaaauaucccuguucuuaguuaccuugccacuuuggcuucuccuguggcccugccuuuaccauaucagugacagagagaggcugcuucaggucugaggcuaucccucagccaugcauaaaguccaagagaaccaacuggcuccuggucucuagccugugaccggcuugcuuaauguccucagaaccugacagguauguucaaaacugucagucuguuugugccuuaaaagggugagaagggcgcguagauaguuacagagucucagcugcugacguucugagccaggcaagugcacggggcuguuggauggccaguggggagcuggaaaaaacaaggcagccuuuaggaaggccauggugcaugugugugcaugcguguaugugcagccgcccucccucacuucaggagcaagcuguuugcugugcuuacccuucaccucagugcagaggucuccagugccgagcacaggcaccugccaucaguaguuccugugucaucuucacaucuagcagagcacggauguguuugcaugcugugcucuuggagcuuguccugucuucuggaagcccuggacaaggcgugugaaggcuucccagaaguuccuguccacauugccuccgcccaccgacgccaugggcacacugcucccuccuccuccuccagcuacuuuguguugaacacaauugauucuccaggugcucauggugcaggaaaacaggacagacagagagcaccugaacccuugccaucugaugucaccaauucaggaaaacgaguccucuccuaggacuauccccgguucuggaaaucauguucuccucacucauggugacaagcuaagaaagcugaacaaagggagagacgagagcgccugaagccaggagcuccuuuacuaucuuucucaaaaggguuguuagacacaaaccaagucaucaaggccccgcuccucuccucggaagggucccccaccccccggcagcuugacacugaauccagugucaauuuggggagaaagcaguuuugucuuggaauuuuguauguuguaggaauccuuagagagugugguuccuucugauggggagaaagggcaaauuauuuuaauauuuuguauuuucaccuuuauaaacaugaauccucaggggugaagaacuguuugcauaauuuucugaauuuugagcacuuugugcuauauaaggacccauauuuaagcuuugugugcaguaagaaaguguaaagccaauuccaguguuggacgugacaggucuuguguuuaggucaaggugucuccucucagugcagggacaugccugcucuguggggcaggcgaggacccugaaucauuuggagcccagaaggaggcagacuggccaggucucaccaccucagugugcaguucaacuccaugccaucccaucaagauggguuaguagcagugucuguuuuugaaugccaagugugauuuccaacaauucugcucugguuauuucauugaagacaucuuugcacaugugaccaugcuguguuaggggcuguguuccagggacuggacucgaagcuagaacuggcagaagaguucuggcauccacagcgcaaugcugccaccacccaguuucuucaucagaagacaagggaacgagaaaacugcuguucguuuguauuugugaacuuggcuguaaucugguaugccauaggaugucagauaauaccacugguuaaaauaaagccuaguuuucaaauuca

SEQ ID NO: 12561 - RNA, 9738 nt, Mus musculus
aaucaucgagaaguauuuauugagcaccagcuuuggggucgggugugaggacucgggacaaugcagggugcugucccuucucgugagacgcuuacaaucugaguggagacagggagggagccacaauacauguucuuggggugcgggcuaaggguagacaguccagaccaggauguuacagaaacagggauguuuggggcuggagucagacccacuaagugcuuugacacccacgguauucaacacugagaaaggaucagccauugcucaguguccugugagcucccuuagcccccaagacaccaucuuggccuggcuccuuguacaacugcuacuaagaaaugggagaagucacugagaaccccaacugggguccccaucccagauaagcccacccccaccaccacacaccauagaaugcucugggaggccugucucaccaccaaggacccacccuagacccacaaugcaggggguugccacuggagcugccuaagguaagaccagggaaucccacuuaguguacccugcauauacauucccuuccaguccacugagcuguggggcaagugccuagauaugccuccugccgaccugcagaaggggaaguauggggugggggaaaagagcagcagaucaccagauuaacccuccaaaauagaggggcagcuggcagagacccacaggagaggugggcuccccaggaguggcaaaggggauccagaguggggaccauuccugucuucacaggucugagcaaugucaagagucgggauauuacgguugaguccuaacugccaucccuguucuaggcugugacugcuucacugucauccuagcuggccuuagaggugacaaggagaccccaaaguccuacucauuuuuccaaagugcuauucaggucugaggaucacccccagguaagaaguggcaaggaaccaggcagggaauggggggagggggguugggugaaacggaugcagauggguugauaucaguaggacuguuccuccgguauaggaaacacagagcuuggguugggaggggcuuaaauaauaauaaucuacauaauagaaaucccccacacuaagggcccuaccguccuacuaauuuagguuuguuuuguuuugguuuuuuuuguuuuguuuuguucuuuuuuuaaauaacuuuaaguuuggagacugggagagggcaggcagcguauauacaggagacguuuaaauuaaaacacaaauaauaauuaagacacacagagugagggcuaaggccgaagauggggaagaggccuccugacccacagcagaagagggcggggcucccgugggcacuucaggguuuucucuugcagaagaccaaucugcgcuuggagugauagaaaucuguggagagagaacagaugucaggccagaugccaaggggaaggacaucauuccccagagucuaagggacauguggcucaucguggggaaaagccacagccacagggcacaacaccuccuggucagagggacagggcucuagagaggguagaucccccaacgcccagaguuaguuauaggaaguugucauuuccggugcugggaaucaggcccucagcaagaguaagugcccucaucugcugagccaucucuucagcccggcucccuucuuagagcucuacugccaaucaccacacuauccugggcauuucggucacugcagagaaaaaugccuggaucauaugaacaucaacuguuccucugagccccacgaggucccacgccuauggaauggcuuggugguggggaagggcuggaauguucucuguaaaggccauccucaaaugguggccucuccucuccaggccucuugcaggaucuuucuccuucucugcuccuguccuuaccugucaggcuggucugccuccguuuucggcccugagauguuccgggcccacccggggaaucuucaggccgcucagacaccagagugcaagacagcgacaaggccacgugguccuccggagcuggccccugcagcagggcagaggaaguacugggccucuuguccccucccaggucgucacggcugcgggacccagggcucagguagaccuugggcagcccuaggcuccgaacgcgcucccagacgaaguugcccuccagcggcgucuccgugacgaagucaaaguuccaccguucucgggccuccuggagacagcccgccaugagcgcaucgcaaucacggcgcaacugcucacuguccacgggaccgaagagacaacggcacacuuugcuccugugcggaacaggucggacaucaccaggauuggacauggugccuguggcugaaacacaagaaggacccgggucacuauggaaacuaccccaucacagucuucaggcucccucugguccuugcaggugcuuuuccaccacaccaugagacuaagguggguguugaguucagccagcccugcaccccaaggucacgggugauguccacagaaguaggagucaccguccuguuuaccccaggaauucuauuagccaaaaucaaugugcuaacguguucuucaugggugugaacaucccaaauacgugugaauugcuagguccaguggucucccuacccugcugucuuggugauuaacuccaucaggccaaucaaaaguacccuggacagccgggcgugguggcacacgccuuuaaucccagcacucgggaggcagaggcaggcggauuucugaguucgaggccagccuggucuacaaagugaguuccaggacagccagggcuauacagagacauccugucucaaaaaaaaaaaaaaaaaaaaaaaaaaaaaaaaaaaaaagugcccuggacuuugggauacuacacauaaacuguauagcauuagugcugcuacuuggcaccaguuuuaaaaagugacuccaugucuccagccucuguuucuuagccagugugguuguggcagcauacucgcgaggcuggcaugguggcugggagagaggcgcgagaaugccggagcuagacugcccagaucagaaucaaggcuuugcugggugaccccgaauaaguacccuaacaucucugggcucccuauuugagaaugaacuaaguuaacauaggcaauccugagaaacagaagccaugagcgugccucucugccccuaauucugacagagccuccucccugccccucccucccucccacugucacugacaggugcuccaggcuggaggccuuuccaaaggacgcuggcaggcaguagccugggaggaggcagcagccugggaggaggcaguagccugggaggaggcagcagccuggggggaggcaguagccuggggggaggcagcagccuggggggaggcaguagccugggggagaggagagucugaagggguggagcgggguuaaggcucucucccaggcugagccacauccugccaggcagaucagguaaucuggagucuagacaccucccagccccagacgugccuauagccugugcccaaggaacccguuuuacaggcacugaaaaaaaaaaaaaaguuaaagguguugguuuaccuggcuccucuccaggaaagagggauaccugaguggcccauccugacuccaagacuaggggaugcagcuucuaaggagggccuuugagcuugcaaggugagccccaguggcuuccugaggcaagacccccugggcucuuaccacauacacuaccacacacauacacacgcccagcuccuuaagaccucagggugaguuugcccacagcuggaagagagaaggggguacccagacuaugauucaagguaggaagccagaagagaugaagcgucuggggccccgaugguaaagccugggccuugugcuaagcaaggagcucucuauaaaacuggguguggcggcacacaccuguaaucgcuggaggcagagguagggaaagaaguucagggucuaccuuggcuacuacauagggaacguggccagcauuguggcuuccauaaauaaguaaaacagccaauucccaaaacacagcacucgggaggcagaggcaaaaugucugugaguugaaggccauccuggugugcauagugagagccuggcuaaacaccaaccaaccgaaacacaggucuaacaaggauucccacugcccgcaaaaggauucucaaggugcagaccucagaggccuaaaggaccucagauggccucugccuacagguagagcuuggggccuauucacauccuuuaguacaacucagucauccuccugccucugccucuagugugcugggauugcaguuguaagccaccaaaagcuaucguuaauagauggcaauaucacauucuuuuacggcagagcuaauccagguucagaauguguguccaaaggcacagggcucacaagcgggguuugaauucagacccuuuuggucuaguauugaucauucucucgucuucucaccuugaggggcaugaccagaggacuccauuaaaaucagcuggaaaagcuuuuuuauuaaauauagacugagcuccauguuauggggagagucuuuaaucccagcacuccaccagaggcacgugauccuuaugaguuccaggccacugggccagccugucuauauaguacugguagcuggggccauuuuguaagcuugucucucugucucugucucucuuucacacacacacagagacagagagagagaucuauauagauauagaaauauagauuggcucauuuccccagacaaacugagccgaaaaacaaguuuggugcccuuccccagacgguagcucacaggggccagaggaaggaagggaagacaccaauggacucggcuaaggcuggauaguccccaguuuuucauagcugaagauaagaccaggaacccaagaggggcacgaucuccaccuugucucucaagggccacgccucccuaauaguccgcuagcacacccugcuaaaaucacuuguaucuggccaucaggcauauuuuaauucccuuuaagccgcgguggggguggcagaagcccguggugccacccgcgccuagccggccuugcaguccucacugaugccgguagggggcgcugugcacucaggaaauggcgcucgguaggcggcgcguaggccgagcaaggaguggugagucaguuuccugcccggcgcugcccgcccgccaaaacugcuugggcaccggagcugcgcgucacccugggguggagagaggagaggaaaggagggggaccccgggccacaaaacacgucacgaugagcccaggcuuccuaaauucccgccuauguugggaaaccagacugagcgcgcgcgcgcgcacgcauacacacacacacacacacgcacguacacagacacacacacacacacacauacgcacgcacgcacacacgcacgcacggacacucgagagcaaagaaagugcucuuagcucuggcccccuccaccuugaucuccacgcccaaagcacgcgaugagucagaucccuggaaaauaaaaauagaugagggcgaggacaacaaaaaaccgccugaguguccucucugaaacgcgacguaggggacagaggaagcugccagcgcgcccccaaaugccaaacccaagcccaaaguauuucccgcacgaccagggugcaaguguagcccuuguccccggagguuccgaguggaauggaugugcccuagugggcgcacucagccuggucaccuuccuacacuggguguggacugggucgagggccccagccccggggcgucugauguacggcacccguaagccucacuccgcgaggauaccggccgcucuacagugcgggcuccucucgcgccccacggucacugguccgggucguggugggcgcggugggugggacccuuugcgcuucccgggcuggcaggguggacaggacccgcccagacucccuguccccgagggcgcgccgccgagcggggaccggacaccgcguccuggaccuccccgugucccggguucccugggaacauacugugcccgccaaauaggucacugugccgcgcgggggaggggacggggcaggaacgaggcuguacccgggcagggaaaggggcuucugggcugccacugacccauccccaguuguggcgcgauucuggucucaauccagugcccggggucuccuugucacaaugagucaccuccucgccuguccucuaggacgugcccaggcacgaucccgagggcggaggacacagcucgcgcugaccucagagcccaguggggugguggcuaccgcgaaacagggcacuugguucacaaggaccggggauccggcggcacccaugggaucggagaaccgcucugcgcuaagcucuagauagacucgccgaagcuugucacaaccgccacccaggacccaucucggggcaccgugagcuucauucucacgcuuugggcgagccgcaccuggaaucccuagaaacauuggcaaccagaagcgagcucccgguagccgauccccgccagccaucgcucggacccggucuccaaggacuggaagaguggcugccauccgugguccuggaguucagacucuguaugccgaguccgcgacauagccugacccucgucacacuccaacaaacgaagccuucagccaccacggacgcucagacccacacccgucauccaccugccgcggacacaccugugacucuggcgggcacgcacaaauacacauauacacacacaggugauccacucaucaccacacacacacacacacacacacacacacacuucuggggacacccacugggcucagcgcauugcuacggggaagaacuauuguucccugccacgaagcucucaccucugaaugucuggauaucgcuguggaucugcgccugacuccaauuccccuagacucugacaccgcggcggcucacaccucucggcugcugcaguuggcgucgagcugccuccuuauagcgucggcccaggccccgcccccucagaggcaggaccaacccacuccuucaccgaucccggggacucgcuggcccgcccuccccucugggaaucuaagcccgcgccagacagcuagaaccggcgcgcguuaagagggcgcgcccuccccucccccacaccugggcuauucucuugucacgcagcgcaccagcagagccacauacaucuaugaacaacaguacaguuagagcugagugaguguuuaugggucugucccugaccaacugugggaaggacuaacucuuuuccagaucacugauauuaguaaauaaaauccuggguuucgggaggugggucuguugguacaguguuugccuaacuugcuggaagugaagcccuggguuggagcuccagggccccauaaacugggcaugcggggucacgucuguaauaacagcgcccaguggggggugaggagggggaaauaggcauucaaggucguuuugacagcuaccuauuccgauggagaccaacuugaaauaugugacacuguuucaaauauaaauaaauugaucauuugaguaugauagcaaaagccuggaauccuauacuugggagauugaggcacgaggggcguuacagguucaagaccagccugggcuauccauugagacccucucaaaaacaaaacaagcccauaaauaauaaaaaauaguuuaaaaucccaagaagucccacuaugucuggagauuuuuuucccccuccucccagaagccccucggacaucggguccagaacgcgaucauuuccucccugucucacagacgaggaaagcaguuccacagaaggaaaggaugcugucaaccgccucagaaaucggggagauugaguccaguucucagaccacggacuaccaagaaaaacagccgccaggcuccuuaccuccccucuccccucuucagaagccagcaugugaacauuucucacaccauaauacauccugcaagugagagcaucaagaccugacugggaccacacuaauggcuaccugcugaccucuggcaagcugcccagaguacucugcuugcagauuucuuucucuggguccaaaaugagggaaaugucuaauacucccccucccaagauccagacaguccacuaaaaugacauugauaaaggacaauucuagaaacaucuacggauguuccugacagacauagcaguaagacauucuccguucccaccuuccuccaugucucuagucaguuuuauuuccuucuguuuggggucuuuugagacgaggccucgcuauguagcccaggguggcccucauauucaaggcaaucuuccugccuuaacuuccuugcuuagaguuaagacuacaggucugagccaucacacccagcagaaggggguuuucuucagucuuguuacacgauccagccuggucacaugggcuacauagcaagaccaccaucucagcuaagcauagagguacaugccugaaaucacgguacuugggaggcaggggggauuuggagcucaaggcuagccugagcuaucugagaucaccaugcauccaaaaagggauguagcuccguuaauauagcgcuugccuaacauguaugaagccaggaguuggaucccuaguaaggcaucaucuagaugauagcggcauacaucuguaaucccggcacucaggagacagaaacaggaggaccaauaauucaucaagguuacaugacauccugccucuaaaacaaaaacaaauuccucucucucucaaaacaaacacaaacaaaaauuuuaaauaaagcagagacuggagucuuaguuugaacggauaucuuuaguuaaaagaucaaaauccugcuuuggagaagcugugaguucugacaucugcucuccgaugucuagagaucgcugcccagacaugcccagucuuccuccucggauuuagcugaccuagacaggccuccucuucugugaugggggguggaagucugggaagggcuuggccaccuucccaaccccccucaaaagccucauccuguucagaaacacaguugaaggacccccuucagacccccaaaccaggacagacauaauggccacucccacaaugccccagcuccugaacgguccagucccugcauccaagucguccaucccagggcugggcugucaggggccagcacaggaugucaaaacugcccaaauccccuuggccuccaggcuucucagauagaagugacauugucugucuguuuacuuugggagaaaacagcuugaauaaaggcuuauacugaacugcugagugcugugaccuccugugccuuuacccuacugguguuggagagauuuauuuuaaacaacuucuggcuucccagagcaccacaaaaguacucaacaaauauuuauuaagucugggacuacucagucuuucuaacaaacauucuuggccuugcacuugaauguauagucaggcacaccauugcacgugaauguauacucagaaacaugguuggaggagcccuccagaccccaaaaugacaaagugacaaaaugacuacauacaguaccugacacauacacaccccaggcacacacacacagaugcacaaaagcauccuucaccugauacaugucacaagauacauaccaccuuuuauucugcuggcaaagugggacguccuuaauuaucuggggucucugucuccauucaugcuccuccucaccccacagcugguaguuggguaucaucaggucuccaccaccc

SEQ ID NO: 12562 - RNA, 1200 nt, Mus musculus
cuaaauuaugugccacucgcgcaaccaucuccacaccaugacuggccugagggccccuucuccagcucccuccaccggcccggaacuccggcggggcucuggucccgaaauuuucaccuucgacccucucccggagcgggccgugguguccaccgcgcguuugaacacuucucgcgggcaccgaaaacgcagccgaagggugcucuacccucgaguggugaguaucgcccgagugggcaucaggaggucgcgucgcccuggaacuuguagguaacaacuaggcgcagggaccuucgaucugacguuucccucuuuuaucugcucagguccggcgccagcuaccaaccgaggaacccaacauugccaagaggguccucuuucuccuguucgccaucaucuucugccagauuuugauggcugaagagggugugucgcagccccuggcuccggaggaugcuaccagcgccgugacaccugagcccauuucugcgcccauuacugcgcccccgguccucgagccuuugaaccugaccucggaguccucggacuaugcgcuggaucuuaaagcuuuucuccagcaacauccggcggccuucuaaacgcgaugggucacaguccgaagaaacaaaggcaccauggauggguaccuggugcgagagaacguaucccaaacugggauuucuaaggcaacgcuaacucagaacacuaccgccaagagacaccgcggguccuggcuaggcccacuggggacggacagagacuuucuccgugucuaauuaauauuuauguauuuauguauauccuccuaggugaaggagggguguauguaauauuuauucuaacuuaugcaggggugcgagauaugccucccugcuguaacacagauauuuauuacgauuuauagggucgguaagacagaguugugggagggaggacccgggugguaggacucccagcuuggggauuagucugggggggguguaauaagauuagggguaacacuccgucuuccagcacuucaacucuguagucuguuguaaggcuuuggaagacccuugggaauccggccuuugaugucuucugguugcuucucaggggcagcugcaggagucuuggguccauggauugucagagggcggcugucuggggucgccuaguauguauguucugugaacacgaauaaacuugauuugccuguca

SEQ ID NO: 12563 - RNA, 22937 nt, Mus musculus
gguuauggggcguggucucgaaggcgcuugcgcgaaggcgguuggagggaggcccgauuccccuuuguucagauucgccauuuugcgaggcagcggcaguggcggcggcagcggcggcuggagccucugauuggguuucgggguccgguacuggagccaaucagcgcgggcagcgaaccgggggagcgaggcacggugaguaugaggagccaauauccagcggcccagagccggccccagcgccccgauuggcgggucucgcugaccacucaggagaggcccaggcguccgucgagcccgggagucgagccgaggcugcccgagcuggguagccaguagccccggcucggaguugguggaggccugcaggggccguccagcguugggacggcguccuggagccaggcuuuucgggaucuggaucgucuccgggggccgguggcggaugcgccaccgguccccgauccucggucccgagaggucagguggcugaccgcccagccacggaccguggcgguuuccccacgucguuccagccucauccuacggccuguccuuguguguccccacauuccgggccccgacgaggcccguguguccugagcucugcacaguuggggcuacagauccggagcgaggccagacugagacgcgcggcgcggccucccaagacccaccccggggccguuggcgcgccugccgcgccccuccucucggcccgccaccggggcucccgggccggcgccguuaccaccccuuucuggcucgucauuuccuccccgcucagcccgcggugccggcacaccuccgugcuggagcccaaccaagcacucuuccucuuuuugcucagugucucgguguuugaaacgccgcuguugcagaacugauaacccuugugcauccuuaaugauugggggcacacaucucgcaguuccuauuaucccugucuccucccuugaucuuuucucccuuggaugcucucugguuuuguuuuccuuuaaucucuccacucaauagcucggcccacucgugucucuuuuuucuaauacaccuugaaaucccgcgcgaacguuuucucaacugauguuuuaaaacuuacacgugcuuagauuuucuuucccccuucgggggacaggaagucuuccaaggacugcuagcuauuagucuuuggcggacgucacccaagugcugcaagcgaguagggcuaggagcuaugucugcucgguggagauugacugguguuaguguuucauagggaucugauccaguacccagaagugcacuuuacaugaggaagccuauuuucagcgccacgcuuuugauuggugauggagggugauguccucagagaggaaagacugaaaagaguaacuggaacagauagugcgguuggacgcagaaaggccgggaguacugaguuuaggcgggaaaguccaguugguaaaaaccuuugcaggucuuacaaaggaauuuuuugaaaacgguuuugacuggagguuaaaaguuaaucuagaguggauuucuccccuaaccuugggggugaagguugcugaccugaggauucuaccccauagucuuguauuuggacuggguguucuaacuuugauugguauuuaaaaaaaaaaaauggaugcauauguccaccucaaaacugccaaauguuuuuguggacaaaaggcaguucuccucagucacugugacucagaccuguggagccuccacugguuccucugcaucugcacuuuaagaaaaaguagugcagacucucgauuucucuaaucuaaucacagcccaggcaucucccuuuguuugaaauacuucacccuauacuaccuucaucugggugagaucucagacuuaaaccuaacucacaugacacccuuucccagugcuuuccuugguuuguccccaguggaaaagccucugucccccaaacuccauuuacuguauuucccuuuaggagucuaauacacauuuuuguuccuuuuuagacuuaaaagccucuuugaaguuaacuuguuuuguuauuuaguucaugcuaucuccuuaguggagacaaggagcacacuggagccuucaaaggcccuagcugggugugugugugugaugccaggucagauggacugcggugaucagaugcuuauuguaggagcauuucugggcauuucagcuuuugaagauucuaagugcuggccagcuacuucugugccauguaaaugggcaggaaaugcuauggaagagaaugucucagaggccagaauaaacccauucucauuccuauucauucauauucucacuuucaaaaacacauucacaagucuguagaagagcuagacagacuaaauccagcuggcucaauucugucauaaacuugggcacagaaagcguaaggaaaggaagugugucagguugugucacaguucugcuggcugaguugauggaggaaggagcauauggccgcacuggagccaagaagucggcaccaugggcaaccugaggguugugcuccaagcgccaccacucccuuaucaaugcagaauggcugcuggguuugaagcugccuccaaagcccaguagguuucaauggccuaagaguggagcauuuguaucagcaagauaacugagucaacuccaaauguuccuuacagcuauuccagcccucuugcccacuucaggcuccauucugcauuuaaucugagacgaugcagacuuaggacauuuagccaagaagaaaguuuuauaggaaagcgucuuggggcuaguggaagcgguaaaauacagagguuguuaauaucuuaaaaaaaaaaacuuuaaaaucuaauccuuguauaucuguauuuuggugaguuuuuaaagcucuccacaccuguacagucccacuugaaaaaaagggugagaacuuuggucauccccaaaauggucguagagcuagcucaucuauucagucucucccaccuccuucccucaggcucaaggaacuccaguuugcuuucugucuaggcuucugaugucagaguuucuuaucauggggccaugcuugcuuauauuguagcccuacuuuauuagucuggagacagguacauuguuagacaacaagguaaaauucagaaacauuggauggacuguaguaguacaggcuuuuaaucccagcaaucagaaggcagagucagguggaucucugaguuugaggucagccuggaccaccuguuagcacccucaagcccccucacccccaguaaggaaaacauuggugcccuaguggagccacuuaguuuggcugauuuaccauauuggaccugaggucucaagaaccagcucaggcaacuggcuccaacaggcugguguaaaaucugcaaacuuagccagcuuuucagcugaugggauuaauagucagaauauagaaagagcucagaaauuacaaacaaaauaaccuaagcuauaaauacucaaauugauuagacaguucucaaaauaauacacauggccuauaguuguauuuaaaaauaacauacugagccaucaggaaaaugcagaugaaaacuauacuguaauuuccuucucacaccagucagaauaguugucaucaagaaaauaaagagugccggugagugaggauaggaauagcucuuaaauaccaucgguugggauauaagucagcucugccaccguggaguguaugcacauugguguauuaggguucucuaggaacaggacagagacugacguguguguguguguucagcuggucuucaguauaugacagaaucuagaaguacuaggcuguacagccagugaaggaaugaacuugccagcaagggcaaguaggcgaagggcaaacacuuucuucuuccaguuccuuuauauggacugucaccagguguagccagauuacagguagaccuacccacaucaaaugauugaacuuagaacaauuccucacaggugugcccagcugcuuggguuuucgcuaauaccaaauguaucaaguugacaccaagaaaagccaucacacuguagacauacccccccagccccccccccccacuauaugaucccgcuauacugucuugggaguacacuugaagaagcuagagucaacauguacuaaagacacugcacuucauugcugugccuucaucaccaaguuagggaaucuguaggcgccaaucagugaguaaacugguaaagaaaauguauguauacucaguguaguaugcauuaugguguuuguagggaaauggaugauacugaagcuauauaguaagguaacaaagguauauucagaaagccaaauaccaaauaugcauaaucuaaagacaagaagggaucauuuguaaaauggggucaguaguucagacagguuauguauauuguuaaaacauacagauaaaaaccauuauuauacaaugaacacaugccaguaaaguagcaaucaaguucgaauacauugcuaaugagguagugauuaaauuuaguuauguugccauucauauugucuucccuuugcaagucuuuguaaguucaagucagagccagaaaucuguguguugaguagucaguccauuggaacccacaauaaaggcauagugaucuauuuugguuacagguaaugaaugagccugauuauuuuuauugaauauuucccccuacauuguaauguagcaauuuccagacagugaaguugaaaaaaauguuaugauggauacccauguaccuauuacuuaagacucuauaauuaccaucugccaaauuaaaugcuggcuuaucucuccacaaacucauuuuauuuuuuaucacuauaagaguaaguuacuacuggggggcagggagagacacuuaagacaccuagaaaagaacacucccauccaaguacugaggacugaccaaucaauucccaccuugcuuggcuugugagauaagacaagauggggcuuuuccagggugguguggcagaaaaggauaugaacuuucugaguagggccgcauucuuaagcauuaacagaggggggcuggugagauggcucagcagguaggggcacugacugcucuuccaaagguccugaguucaaaucccagcaaccacaugguggcucacaaccacccauaaugagaucugacacccucuucuggugugucugaagucagcuacaguggauuuauguauaauaauaaaucuuuuaaaaaaaagaauuaacagagggguuuugugaaguuaggauuuagcaaaguaaguagcuacagaaucaaaguuuuugccugcauaccauuaguguguuugucuguugaaggaaaccacucauccucuggguaacugcccuccuuugagacaaggucucucguuguuugagggcucaccaauuaggcugaacuggagacccagaaguugugccgucucugccuccccagcucuggcuuuauaaacaggccagcacacccaguguuaugggcauucuagggucaagcucagguccucuccugaggcagguacuuuaccaacugagccaucuugccagaacugcagauacuagaggacuagaacugccaggcaugagaugggcucugcaguucucagaaggacacaaagggccagcauuuuuaaaagugacugacauacuuauccaccagagccaugcaaauuaaaauuuaccccaccccaccucccuaccugagucaacagcucaucuagaagggcaacaaaugcugcugaggaugugggaaagaggagucuucacuauuuacacuguugguguguacaaaugaauacagagcuuucucaaauagaucuaccaugugacucagcuacauacauacucaaaggauccuaugcuaccucacaaguacuugcacucuccuaugcacaauaacaaggaaguagaaccaacguagauguuaucagcagaauggguaaugcaaauaaaugucaugcauauguaaaauggaauuuuaauacagccguaaaaaugaacuuuacaagaaaacauaaaucuggaaaguuuuagguaauggcugcucuugguugucaacuugaccacuucuagauuuaacuaaaacccaaggagcugaguacaccugugaggaauucuucuuuuuuuuuuuuuuuuuaauuuuuuauuagguauuuagcucauuuacauuuccaaugcuauaccaaaagucccccauacccaccuacccccacuccccuacccacccacccacucccccuuuuuggcccuggcguuccccuguacuggggcauauaaaguuugcguguccaaugggccucucuuuccagugauggccgacuaggccaucuauugauacauaugcagcuagagucaagagcuccgggguacugguuaguucauaauguuguuccaccuauaggguugcagauaccuuuagcuccuuggguacuuucucuagcuccuccauugggagcccugugaaccauccauuagcugacugugagcauccacuucuguguuugcuaggccccggcauagucucacaagagacagcuacaucuggguccuuucagcaaaaucuugcuaguguaugcaauggugucagcguuuggaugcugauuaugggguggaucccuggauauggcagucucuacaugguccauccuuucaucucagcuccaaacuuugucucuguaacuccuuccagaggaauucuucuugauuggaaucauuugaggugggcagacacaucuuuaauccagaucuuuugaggugggaagaucugccuuuauuuugggccacaccuucugcuagugacaacuuauauaauggacaugaaagaaagaaacuuucucacugggucuuggccugcuugcccuugcuccuucacuggcauaaggccuacuucuucagguuccugaccuauacugaaggccaguugagaccuccaaccucauggaugaauaaacaguuacuggauccuuggacuuuguguugguagacagucauuguugaacucgcuggaccacagccuguaagccgucuaaccuucuccacauacacacacacacacacacacgcauauauauauauauggauuuauucuauucuguuccuccagagaacccugacaaaugcuuguuagguuaagcaagauaaauuggacucaaaaaacacauguguuuuucucucgggcauaggcaguccuagcagaggcaauucuaacuuuacuuucgugguagcggguaaguagauguuuguguggauagagauuguauaccuagaaauggggccacaagauggguagaagagguuuugaagaagguauaguagaacauaauaaguuuuauaugucauugucuauuuaggucccacuugaauguuguuagguaccuguacuggcuggguuugugugucaacuugacacaggcggaguuaucacaaagaaaggagccucccuugaggaaaugccuccacaagauccagcuguaaggcauuuucucaauuagugaucaagggugggagggcccauugugagugaugccaucccugggcugguagucuuggguucuauaaaagagcaagcugagcaagccaggggaagcaagccaguaguaucauugcuccauggccuccgccaucagcuccugcuuccugaccugcuuggguuccaguccugacuuccuuuggugaugaacagcagcauggaaguguaagccgaauaaacccuuuccuucccaccaacuugcuucuuggucaugauguuugugcaggaacagaaacccugacuaagcuaguaccuuucaguuucuaagaagcaaccugaaguaaucaaccaagaaaagguucauuugggcucacaguuuaggcuucgcugcaggguaaauaugcaaagaauagucucuaugggauuugguacuaaaccagguuuuagacaccccguguguguauugauccaccacguggaaacaggcugugcucuaucaggcuuuaaauggcugcuaucauugauaccauuucauugcagccacucuccuggacuauagcacaauccccagagcuuugcuaaaguguucuacuuagugcuacuuaauggaguuugaaacagggucucacuguauagcccugguugaccuggaacgaacucccaguagagacuugaacucagaucuaucugcugaguuuaaggccugcaucacugugcaaaggaacuuuggggguuugguuugguuugauuuugucuuuaauagacaugauucuguaaaguggaguucauuuacaggcaaagugucucucauucaagcauagguuguccugaacuuacugugucguccaggcuggccugacacaggugguccucaucuucucuuugccaagugcugugauuauaagcauaagacccccaccccacccccaggcuuauguaaaguggagauuuugauaagcaaaauauuugaacuacuuaguaacaacccuccagccugaggucguuugggacuuauguggcucaagagaguagcacguuugggcccgcuuguauacaaauucucugacguacgucugcugcauugaaaguagaccuugcaacaagagauggucugacagugcuccuaaguguuauucuggcaauguugaaagguggucaguuuuauuagcuuaacuggauuaagaaacaggaaguuaguaaagcacacccgggccugucugugaagauguuguuuauaggaggaguguugcauccugaggguuccaaucuggguggauuuauaugauaccauuauugguuaggaggggccuagcuagaaguggguuacugugagguguguuuguuauuugggacuaaaucuugcccuagccauuuggaguauuuauucucuauguccuggccaccauggugugaaaauguacuuuucaacaccacacacccucacagugcaagugaaaauaaaauacuguggcuugcuugucgguuagucucugaggggaguagguuuaaguagcccaggcuggcucaaacuuucagauucugccucagccucuccaguacugguauuagagauccccacuacuagccugacugugauuuuuuuuuuuuuuacgacugugcuguguaauccucuuuuauuuaaaaaacaaacaaggacgaugagcaucucccaauggugcucauuuauauugaaaauacugcaaauaauuguguguguguauguguguguguguauguauaguagguaucuuaagagggccuuuacugauugacucauuuuagguuuuuuccuucccuuuuuauuaggagucccuaccuggcagcugccugggaucuguagagugaagcuucaggacucuuaacguggccgggccauggagcaguauacgacaaacagcaauaguuccacagagcagaucguggugcaggccggccagauucagcagcagguaugggagcaagugugcuuugacuaucacaauagcacagugauggagaccucuguggaaggacuuagaccuagucagaccuuaggaaguccucggucucaugacuguugcugugcaaugaaucagucuguugccaccugguacuuguucuuggugaaaaucacuuuaaaaguagauugcccucuuuuauuugacucauugaaaugauaccuacccugcuuuucucugcauuaagucugcuuauuucccuuguuuuaugcuaccuugugauaaaguaaggauuuggccacaacagacaauugucaguuuccagccagucuguucagaauuaauucugaacaguuguaguuuaauauuagaacaauauugggcugcuacucuguggauaaguacauacugaaagagagcgucugccacuggugucuuccacaguaguugcucagauguuuggauuaaugcacagauaccauuuuugaugcuuuuaccuagguuuauauuagcaaaucuccucccacuccccucuccugcacuuuggagaaaaagacauuguuucuauuugauuauaggucaagacuguuguccucgguguguuuucuccugaguacagagguucacuaguacagaauagcagggagggugaaaggaguagugacugugagucccaagccacugaugagggagagaggcuacucugcauuaaagggggagaugggcugaguaugguggcucccuagccgccuuccuguccacacucugcuauagcacuggcggcuuccugaagugccuuagcgaauagaccuuggaggggccuucuaacuauggccagagccucguuggugggucucucuucugugaggacuuccccaggauaggaaauaagguugacuuucugaaaacagucagguggauaggaauaaaucuucauuuggggauguaaaagcaguagccuccugaggcuggcgucuggaccaguccccauggcuaguuccuucauccauggugaugcuuuaaagccacagcaagucuucauuguaguuucaaggcuuuaaaacccgguaguuuuguucuugugacccuaaggaaaauaagagauccuuaacauauaugucuagcagaagggaaaaauuauuagggaguauugcauuauaaaucuuuguauuuuaagucauagaaguguguugugagguccacuccaggaacugcugaugcagcaugacagcuugaauauaggaguccacaccuuugaaaguucccguguagggugaggugcuuuagaggcaucccacccucucccucggagugaucugcugucuugggcuguauauuuccauccugauacauuucaagcucuuccucuuccuguucucagcagcaggguggugucacugcuguccagcugcagacugaggcccagguggcauccgccucaggccagcaaguccagacccuccagguaguggugcccucucugauucccugugagcacugcaugaacgcugccugucugcugcuguuuguguuuggaucucaaauugaauggcaaaaucgcaugccuuuugugcugcuaaccugucucugaggccaguaugccagugucccaugccaagacauguagugauugcugugucuauuuucucagaaguaugcacuaaguguguugcuuuagaaagaccaggaagcaacaggaauaaauucuacagguggcuucagaucuuucucaguccucagcucccaauccaagcgcaugucagaguuccaugaauuguguuccaugaacacuggagaagggagagcacacaugggaagacucggcuacgcuguuuuguuuuugcuaaaagugcaaaaugacuacugaacagccauugcacuaagcaaaguuuaucugagaaccauguaccucucguguuucauuacaagcgcuauacaguugauugcauaucucuaaguagcagcauagcacauggugauacaugugucuuguccagcaguugggauauggaggcaggaggaaugagaguuugggacaacacaaaaaguuauuacugguuacacugauauucauuuaaagacaaacacuggaguuaaccaaugcuguucuucaguauuauguaugcuuguuaaauauccuaaauuccugugaaaaaaggguaacagcauuggucuuuucugggucuauuaagaacuaaagguuuggagaaauuggcaagacucagauacccguccucccuuucuuccucuguuaaauuggauggacucaguaggcccuccagaguccucugacaucuccguuuacugccaauguugccaagacccuccugcagguaaccacccuuuccuguaagucaggguuuucugauggucuuaggcagccgcugugagaggaucuuucggccuccaaaggguugcagcccaccaguuaagaaccauugcuguaagcacuugacccucucagccugccccaacccugccacuuuggugauggcgcacauaauuuacauacauaauuuacacauaaaugaaaauaaaagaaguuuguuuugucuuccugcacaguuugaguaucaaggagagcagcagcucucuguuccugcuugcuucaucuuuuuaauacaugaaauggugucugggauugucauuaaccacugugugaaugggauguaccaugcucuuaacuguguggcuuguugucucaugcaugagucccuguggucuuuguuguagacacaugagcuccucagucucaaacccuuuauugcaugcauacguagcauguuagugcaggaggggggguggggugggcagagaugauggauaaccagaaaaguaagugguuuuaaauuugugucgacuuuggggacugaggcaauggcucgguguucccuauuugcuaugcaagugugaagaccuaaguuuggguccauagaagucauuuaaaaauauguagguuuauccuauaaucccagcacuagggggcagaaacaggaagaaccuguggcuagcuggcugucccuguggcuagcuggcugucccuguggcuagcuggcugucccuguggcuagcuggcugucccuguggccgggagcucuaggagacugucucaaaacaagguagcaagcaguagaagauggcauccagugucagcuucuggcuuccacuuugacaccaagaacugcacagccuuccagggcacugcaacaacacaguuguuguugaucuuacuuagaucuagauugcacugaagagaaauagaagugaaggggacuucucaugagccgccucauguuaggagaacucaaacaguucuuucucuuacucugcaguaaggcuccuguuaacauuuccuaacaccgcacaaaaaaccauuggugcagcaaagggaauuuauggagacuugagagagugugaauauaggccauaaaguuuugggacagcccugagguugggcugaugguucugauggagaaugguggagagcucgccaccauacacaucuaggacacaguaacugcacagguaguugaugcuguuggaauugacuucugcugggacuaaggagagugucagucuguucuguuacaaaucguuccuucaagcagagacacgcucuacaagggaguuugggauuuguccuguuacgccucgguccaaagcagcuucugucugggccucugaaggcuuucuugaguuuucacacugggguucaaaguguggcugagcauucguaucggcuuccuuucuagagugucuguugaugcggaagacugaaaauuggacauucuauuuacauacaguagcugucugauuucaggguuucacugcuccugauaauuaaaacaacuaugcaaauauuuauggugcaguucgaagaacucuaccuugaucacaaacuagcuagauaauguuucugaccagucuuggcuuugcuuugaaauggggucucaucaggcucaccuggaacuagcugaagcccacugcuucuauagccuuuaccagaaccgguccugaguaucggcuugagcaggcaagcgguacugguaacuugacugcuuucuagaauucagccuguguuuggugaugagugccuuacaucuuuugggauuuuccagacucuacauagguuccauuauauuugaccuuugacuauccagcuuggcacuuaaucaaaaauaaucagaagugucugaagaacacuagacuuaucuucuuggagcuguagugauggcucgauaguuaagaguacauauugcugcugcagaggcuuugauuucagucagcaccaugucagacagcucuuaaucaccuguaagucaggcuccaggggaucugacaucccacucucuguaguauaugcacauaaccuccacacagagagacagacagagagagaauaugaauauuagaguuuacaaacacugucucaggccaggauuucaucucugcacuugggaggcagagggaggauaucugaguucaaggccagcuagcacuacauagagacccugguggggagguggaagacugaccuuccuaaaucugccuugccuccccucuuccaggcagcaggauaguugcagugauugaucaucuuugugaagcugcuugugucugacacuauuucauuguuauuuuauuucuuucuagguccaggggcagccguuaauggugcaagucaguggaggccagcuuauuacaucaacaggccaacccaucaugguacaggcugugccugguggacaaggccaaaccaucaugcaaguaccugugucuggaacacaagguuuacagcaggugagcaguguuuuuaaaguauuuagguuguaugucagaguagaagucugguaugaguguggaugguguauauaauucauauguguacagguuuguacacacaugcuuucccuuaguuuuugagacaacaucuuuuacuagcuguagucugggagccugcugcugucuccugccuguccucugugccagggcugccaugaauuccuguggaugccaagguuccagucagacccuugugcugugcaccacaugccuuaccucugucugagcugucuuccuagccugcagagcagauguuuugaagaagaaauugcugcaaaaaagacaaaaaacaaaacccagcugcuuuugcuugaguccuaccccuuacuuugugcuuagucuuucugccuuuguuguacuguacugcauaacaggaguacagcaaugugguggaaacggguauuccuugcuaccugaaacccuggagcaaaacaguccagguggaaccagguagauuugcgaccuagucagcugccaacacuuuuaauugaguuaaguaguauuccagucuuuaagaaaauuugggcaguguauagcccaacaaaaagguccacagaugucucuaagacacggggccauccauggucugguuuccuucccuuucccucccaccagcagucaguccagcuggagaguggugggacuugaggcucuagucauguccuucacagacucaccuuuucaagagugaccucccaggcugcuagaucugggaaugcuccagagggucaaaggaacuguaauagaugcuuacaaagccagugagaaggaaggcgggucuaggggugggguugagggguggaggccagacuuuagguagcugggaccauggcuuggauuggggauauucuagaguauaaaguacuagaaauuuugaguugugggccuuccuaaaugcuuucccaucagaucuuuuaagguuuauauaucaguacucaagaaaacaggauuuuguuccuugagcaaaguguuaaggcuuuuuuguuuugucaauuuacaagauuucaaagaaaaacauuuaaaacuucuugucaagauucugauaagugguuaccucacaggaucucuugcuuuccaucuuuguagugugaguuuugcacucuaaaaccugcaggguagggauaggaagagcuagugaacacugccagcagcgacgagugacagugagggauuuggagccuugucuguguuacuccuguggaucaucauauccuagagguuguuggcugaaagcaagaagcauuuugugugaguuacuguucugcugacucacagguuaagggugcugguacagcaugguggggaaaagguggcagcaggaggcagagugacuacugcucugcucacugucuccuucuuaguucaggcugccaccucuguuaauuaaucuagaaacagacaugccuaguguuuguuuucaugaugauuuucugucuaguuaaaugggugguuauacauuucaguuucuguggaucggaagguugacagcugaucugucugucuauccaggaucuaaucaaaguguugccuuugcugccaucagcauaacguuuaacuuggaaagaauguauuuuaaaaguuguuugauucguugauaacagcacuucagaguauguuuaaguaaauauacuuuaaaaaauaaccaugccaccaacgauuauuuuuuuaaagggacacuuuugugucccuaacacuggccuugaauuccuaauaacccuaccucugccucccaaguuguagaauugcaggcauauuccucuggguauuuccuggucucuaguggaauuuguucagcuaauuuucagaaaucaaagacugagacuggagagauagcuuaucaguugagaacacuagccauucuacuagaggacccagauuugauucccagcaccaccuuguggucacagccaucuguaacuuuaguuccagaggaucccucgucuggccucuggacaccaggcacgcauacaccuaaaauaaagaacagaaacaaauaaggagccagaggaguggugucaguguggugccaagcuguuuguguauucucuuccacagauacaguuggugccuccuggacagauccagauucagggugggcaggcugugcaggugcaaggccagcagggucaaacccagcagaucaucauccaacagccacagacugcagucacugcuggccagacucaggugaguccaccugcuccucugucaucaggacagcaagccaccugguucacaugggaugugaaugugaagaacgucaucaaaauggggucuccgugagucucuggcaucuguuaaauaugucauuguuuucuacagacacaacaacagauugcuguccagggacagcaaguggcccagacugcugaaggacagacuauugucuaccaaccaguuaaugcagauggcacaauucuccagcaagguaagcugccgcuauugcaguggcccuuuuuagggcauuaguuucagccuuugaguaccugagagugcuucagagucauuaugaaguccauguccuguuuaaacagcaacaggauucccaccacaucugcagugaccgaccgucagucagcacauagaccagccugaugcugcuuagucacuagaguuccuuccauuucacuuugggccucuacaucuauucacauagguguuuacuuagagucacaagaucgaagauguaaacaccauacagagugcaaaggcuuagagagguacgcccuaggaagaggagguauguaacaggacuagacuuggcuucagggaaaccaugcucaaaguagacuuaaaugcuuuggaagcuaaguuuagaaaggagauggcagccagauucugugauggugggcggaaguagaauuuauuuggaauugggcccuagacuguuagacuuuuagaaaugaacugaacuuagcagaacacagugaagcagcagaaggcacuugcuuucuuccauguguuugccaguuauccaggaggguauacaggagccagguagaagggacuaacucuuuccccuucuuucuguuccguguaccugcuuauuuuauuuuguuuuguuuuguuuuguuuuuguuuuauguuuuguuuucuuaaaguuacagucccuguuucaggcaugaucaccaucccagcagccaguuuggcaggggcacagaucguucagacaggagccaauaccaacacaaccagcaguggacaagggacggucacugugacacugccuguggcagggaauguggucaacucaggaggaauggucaugguaaggaaagugucccuggcacuggagcuucccgugggguucucuugucuuugagcugcaaguuggugucuccugugaagucacuuaugauguuaacuucuggauuugacgcuaacgucauccuuaaggcacuagcaguggucugcauccacaggaagccuaguucauucugaugccuaccaguuagcagacuagucuggauguuggagaugcagcaguaugggugugaaugggcaauuuuauuuaggguuuucaugccaguaauaaggucuggucuccuguucaugcagaugguaccaggagcuggcucugugccugcuauccaaagaaucccuuuaccuggagcagagaugcuggaagaagagccccuguaugugaaugccaaacaguaucaccgcauccuuaagaggagacaagcacgggcuaagcuagaggcagaagggaaaaucccaaaggaacgaaggguaugugugcccuggggagugcuaagcaggaagcagugcaguucugcaucaagcguguguguuuccuugucccaaacacuggaaugcaggaagguuuacuauaagacuggugacaaaaugucuuggaaacaagggacuuuguccuuucuacaguaaaguccagagaaaacguguccucuggacuuccucuugucuuaaggcugcagugcucauguguugauuguacuuugaaguggcaguugggcucuagccaaggagccaagggaauaagaaagcggccuccucauuuuaaaggagucagucugucugucugucccauuagccagcauccacugacccagucuaagcuauagauagcauaaagaugggaucuccuccugaccugccauuugcucaaccaaaccucggucaguucccggagcagaggcccugauugcacugccugaacuuguagugauggacucugcaguaggugacugcuaggucuucucacuaacagugggggcucuuauuucucuucucuagaaauaccuccaugagucucggcaucggcacgccauggcacggaagcguggggaagggggccgcuucuucucuccaaaagaaaaggacaguccucacaugcagguaaggacauugcauccauccuuucacuguugccgcccuucucuccaucaacaaugggcuguccuccguuuaaggaagaaacacacucugugcagcaugugaugccuguugcuuagcuuccuuccuuuagaagcacugaaagcuccaacccacggccuuuuuuacucuugguuucucaguucuuuguuaaggaaaaguuuuacuuucuuguagcguucgauuagagucaguaucauuuaaugcuguguggcaguucuugugucacgcauucuaauaagcuuuuauuuguuguuguucaacugacugagaaccucagguccauagaguacauagcauuuuuuacauuugaauaggaguucuugagaucuuagguaacuugccuaaggccgauccuugcacagcugaaucagcccuggaagugcaguccacaucccaguuacccuggaagcugaggcaggaagauaacaaggugaggccaugccugggcuagagaugaauucaagcccagcuaauuuagugagacccauucucauaaagggcuaguaguguagcuagcucaguaguguagaguauuugacuggcauaugaagccuuggguucaaauccugcuuccuccacaaacagacucaucaacugaauucaaacucagguaguagaaucucacuaauuaucucacaugcuucugaauuuguccaaaauggagugcuuguucauuauucuauuaccuaaacagguggcuugucaccacccaguuauuacaguuuagaugguucugauucugaaguucuuuugguucuguuucugaaacauaauuuuacauguuuacauguuuauuguacccuccugacugaugccagccuggccuaguccucuuucuugguuuagauuaauauauccacugucaugccucuugccucccuuugcauuuuccacaucucaggaugguggucgucaggcaccacaucacaccuucuccuaccuuuguucucucaccccaugguuaguaagcauaugucugggucuagauucauuuguucacuguuuaccuauuuaucuguuucucuugccugguccuugguccuuacacuuucuagucuguaauguucuuuucuccaucauuuccaugacuaucccuucuucucucuguguagccuaggcuguccucagauuugcacuacuccuaccccaguuucccaagcacugggguuacugugggagcaugccaccacagacuuuggucugccuuacuuuuaggccuggcuuaggucugagaggcuuugagccugcucucaucucuccuggagcucucugaccucuuauacuuucccauaauuccauccuuuaccugguaagaaccaacaagagguuuucucuauuugguccccauugcuuccuuuauugcagaguaagugacauuaaaauagaaagcuuuguuguguuguauuuuggggguuaacuuauuuuccaguucuaagugguuggguucaugauucuuuugcuggcucucuucacuagcagcagcauggaauuccucuacacucacagggccccauccgguggccacgugcaguucugaucagauagugaaggcuuuaauagucuacccacggcagucugcagguuccuucuccuuagugaaccacacugcgaacauccugacaacccucuguucuuagugguaucugcgcaugucugugaauaggaacugccagcuguaggccaugguguggaaggcuuuccuuguucuccaugcugacaugggaaguucccucaccucuuuucaucucauauaaaaauaaugacacaaaauuacaguguaucauggugcuugcucuggggcuuuguccuagccacucaagcaccuaaguguugauguaaaggacuguugugcugucucucucuguaggauccaaaccaagcugacgaagaagccaugacacagaucauccgaguuuccuaaccacaggaggguggcagagcugaucagucacgguccucuccacuguucuggaaauggacugacuuccaguggggcacugacagucucacucugcccuuucucaggacagaaacuacuuagcucaguauuacagcugcaaugauggcugacaaacugaaguggcaagcuuuugucgcaccccuucauugaggaucuguuucagacuguuggacacugaccuuuugcaaauuuggaugauuaaaaagagguauuugccagcccagcauuacaaacacagcacuuauguugagugguaaagccauccagucagccauugcaguaggggagagcagccuucucaaccugguccucagucgaggcagccacagccccugccucccuguggguucucaacagcauccaugcccugguggggugccgggcugccugaugcauagacacuuggcacucagguggcucccaagcaaagaagcuuccuguuaggacuuggagcaacagaccaagcugcugucuucugaccugugcugauaagaaucugucugcccacaugcuagguugguguuuacuucagccaagaaaguacaaaaaggauauuuggacucaggauaaaaggauagauggaccuaaaagguacauuucuagcuuugacuguggucugcucauuucuauuaacagccaucugggucauaguucauacuguggccacuuuagagacaguuuagagaguaaagaacaaaacuucaaaacaucugugcugaaguguugaggacauucacagucguucuccaacagaggcgaaccuaggguauucaaucaugggcuuuaugacagcaaguagcaaauggaaggaucugugcauuucaaucuagagagcaagggcccugcuggcccuagugcugcuguagagcgugguucuccaguggauggauagauaccaggcaugacucuuaggcugaagaaaccaagucacauuuacauugacaccuucuggcgugcacuaaaagagaauccuuauauugccugaagaagcacuguugagcuagcugucuuggcugcaggcuggagcacugcuggagcacagaguggaggagagagaugugcuucaucccugccugggugcugacccagagggugaaugcucuucccauggcagcugauucucuggugccaguuuccacuuguuuucuccuuucucuguaggccuugcagcaagguuugcucacugcaucagugcuguagggaccaacuacagccugcaaggauuccugcagggucaggaauugggccucagaaauguguuuucuggacaagcacucuaccacugagccacacacacauacauacacacacacacacacacacacacccuuccccugccccagccccagccccaaccccagccccagccaaugcugaggucuggaagaaaagaccaauguugauacaucaaaagaguuggcugccuucucugcaaucaaagucaaacgcagucaauccaaagacuaaaauacccgucaagucuagagacuggcccuuugacuuuguucuguguuaaagauaggaaagacuuuaaccuuauaaagaaauaucgcagggagaccaguuuaauuggagaaccaugagguaagccaucucuuccugcucccaggaaucuugccauuucuccuggcuuccggaggucagagggggcugauccuuuuuuuuauaaacucacuacaaacuucuggcucuucacaugagcuuccguguguuacugaaagccgggaggaauuucucccuuugagguggacaggauucuaaggggaggcuucagggauuccuccgacuuaacaguagcgcuucagccagcaguuguagaaugcuauuuauucgugucuguaaguuuguacauaacccuaaccucguaggcaaguuugaguuuucuuuccuuugaugcagaugcuuggguuuccacucuggcugcauugcagucggcucccagcccugccggcgugggcacagaggccagaggggcucacuuggauuuauuuuuguuuguuuguuuauuuguuuaacuuaguucuuuuuacuuguucucgugauuguagugauggcuucaaagacacagaguaaguggaggagugggcugcuggucuacugggcacucuacuuccuguugcaggauaacuguaaauguauauauuuuaauugcacuggucuagaccacugcaccaacagccucuccuggcuacagggugccugauaauaaugucuugauuuuccuuugggacucaaccauguacgucucucuucacaccccucaccccucagccccuucccccaguaggggaguacaggugaucacugaugucauugcaauugcuuuucuuuuuuaauaaauuuauaaaaauacuagaaaaagugac

SEQ ID NO: 12564 - RNA, 105407 nt, Mus musculus
ugacagucggggcggcauggccgaggcuggcggggccggguccccagcacugccucccgcgcccccgcacgguuccccccggacccuggccaccgcugccgggagcucugcuuccugcgggccagcgaccgcgguggccgcggcgggcacggccgagggaccgggaggaggcggcucggcccggaucgccgugaagaaggcgcaguugcgcucugcuccgcgggcgaagaagcuggagaaacucggcguguacuccgccugcaagguacccgcugggaugagcacaaucgcggggucacgggcgggcucggacccccccuccccucccccacccacucccagcuucccgccggcaccgcggaagugcugcguucugugcgcgcgcucugccgcugcggcuugcacagcaucucacugggacagggguagggggucuucuagaucugccggugucccucuucugggaaggaugagucuuggcuucggagcgcucggcacuggggcuuuuucugcucuguaggagcucgcgggaguccuuucacagggaguguaacugugcuugguguggcagaucugucgggguugggaagcagcuuuuuugggguugggggcaucuuagcgugugucuccccgcgcucgcccuccccacugagccccgcuaggaggagcuggguuguggagcacccagaaguguccuggaauccuggcgcucuacgggagcgaaggggcggagcgcggggugggaggugggcacugccccaagccccuguccuuuggcgccuggcggccucggccgugcggcgacaacccugucauuauuguuauuauuuauuuagcgaaagcgggauccuggccgcuuaggguguaaacagggucuggcagggugacagcccaggcggcgagcgcgucugcucaguuugaagacagcuuucuugccauucucccucuuuggggacuuuaggcacccagggcauccagcuguagagcacuuguagggggcucagcaucuccaggcugcaggggagagcgacucugcacuguagacugcggcuuuguuuugacugggugacagcagaagugggcggggacuuggccuugucagcccgggcggccugugguugggaccaggcacucacucacucacaccucccguguugcuugcugcuccagcuuacuacuguaaaaggagucgcauccgcagcauccagguucucauuccuacuccccacuguacagccaggauggauaaaccugguagaugacuucccuuccgggacauucugguugucguguuuucuggagcuuuaaggaccuuggggucucaagcaugcccugcccauuccuuguggucaccuccuguuuaucgaugcagucacagcaccugcugugccuuccugagagggcuccagugcggugccuuaugcacacaaauaugcuuuggaaucgcuaaaagcaaaaaucaggaggucugggguggggucugaggaguuacauuuccaacaaagccccccaggagaugugaguggcaacugagaauacuuuccacgaagcaaguauauuacuacuuuugaauucugcagaggagcugggaaauacuaacgucacgugguauagacuaaggcgugcaaaaaaaaaaaauuggaaguauguuucuaagaaaugggaaaggcgaggggcucuacuccaaaagcuauugacuuccuuaguuuuacaguccuaccaguccgaccuaccauccaccuuagacaggaccucugguguagcaugccggggagagaguggccaacagaacccagagcaaguucaaggacuuaauaaauaggcuuggccuuugcagcugcucuagucucauucagaaagccagcuauguaguccugacuuaguuuucaguauuagccugaguccccaucaccaauacccaucuccauacugccuccugucugaaaacuuuccagugguuguacacaugcauucuuuuuaacuuucucuaggucuuccuaugaaguccaggauggucuugaacuccuaucugccuaggauuacaguucuaccaccaugcuccuccccuggccuucccaaauacuuugaauuauucauuauuauucaauuauuugaaacuucaaguguauaacuugagaauuuuuuuuuuuuuggucauauuuucugacaaucuccuaggaaagaaaaaccuguuauucuuucuuccugcuuuugagagacucugaaaugaaguuuagugugugugguguuugucugcgagugucagagaguguucaucucuucugugugcuccuugagucaucucaccagccugaaagugugccgucuuauuugcugauuuauuuagcuaauguuaugaggauuucuaacuggggcuaggcauuaagccagguaccagguuuauggcacuggggucugucuuuguggaguuguuggaguauguguucagauucuaagguaaaggcaguaacgcagugacaguggacuccaguggagccuuuuugggauguagggcacgggacuuggagaacucaguagcuguagauccaguagacggaggaagugucauacugauuuagaacuuuuggcccguuggaguugggugggguaggguuucuugcuguaaagagaaacugaaagcaguuuugaaaacuuggagcugggccaaccagagccugcccuccuuugcuuggggccugcuggagugggggaggggugaguguggccuaguggguguuugggaauacuggacuccaaaccugggagggauguuaucuuagauuaaaaaaaaaaagacauuuuauuaugugcacguguguucgagugcauaugaguggucagauuauuuucuuuaagcccggcugauuggauuugaugagguuucucacauaaucuguggcuuuuuuuuuuuuuuuuucuuuuuucucagcuugucuuuguacuuaaguugagcaagucacaaaagacagcugacacuaccuuugccaaugacucuugagccagugggaggacaucaaggaagauggaaaaagacagaucugggaagucuuaguuuccuggggaccacugaaagaaaacagagaucugacauuuagacuuuaugaaaccgaagaaagagggaagacucugugugugacaaacuugucuuacaggauccagccuagagcucuuugaacuguuggugguaaagguugcaucagagccacuuggcuugugugacacugccagagcgauaagggaagcauagucuugaccuuggugacuucccauccuuuuguuuccccuuuccugagucuauuuuaugugucuucccuggcugacgucugucucagggcuuuguggaacaguucucuuuccaccucaggucucacacguuuuucucugggaucugaaaggucuucccuccugaaaacucauucccuaccccggggagggagcuuaucacaaggcucucucggaguuuaguguugaucucacgugcgcgcacacacacacacacacacacacacacaccccaaacccaaacaaagccaaaccccggggagggagcuuaucacaaggcucucucagaguuuaguauugaucucacgugcacacacacacacacacacacacacauacacacacacacacacacacacacacacacacacacaccccaaacccaaacaaagccaaaagagaugcaaaauuuguucccagauaucuucucuuuauuucccuacccaacauuuucauuaggaauuaauuacccaagugccuccuuccugcaaauuuaaucguuaccacaauaaucaaauuugauuguuaauccuacugguuagagauuaagaccacuaccacaaucuuuuuuuuuuuuuuugcuuuuuuuuuuuuuuuuuuuuuucaagacaggguuucucuguguagcccuggcugaccaacucacuuuguaaaccaggcuggccucgaacucagaaauccgccugccucuggcucccgagugcugggauuaaaggcaugcaccaccacacccgacucacaauccaguuuuuuaacaacuguuuuauuuauuuauuuauuuauuuauuuauuuuaugcgaguacaccguagcuguuuucagacacucccauuaaaaaugguugugagccaccaugugguugcugggaauugaacucaggaccucaggaccucuggaagagcaggcuguacucuuaaccucugagcuaccucuccagcccauuauuuauguacuuuccaaauguugcccuccuucccaguucccccuccaagaguucuucgccccuccccuuuucaagcucucccccccaccccuucccugggccauaaguuucuacagguuuaggugcaucuucuccuacugaggccagacaaggcagucaguccucuguuacauauaugccaggggcacagaccagcccauguaugcucuuugguugguggcuuagucucugggagcucccagggguccgaguuaguugacacuguuguucuuccuaugcgguugccaucccccucagcuccaucaauccucccccuaacucuuccauagggucccugaugucagcccaaugguugguuguaagugucugcaucugucucagucagcugcuaguagagccucucagaggacagccaugcuaggcuaggcuccugccaugcuuguccuuuggggucuggguaaccucgcucaggaugauauuuucuaguuccauccauuugauguccuuguuuuuaauagcugaauaguauuccauuguguaaaugaaccaccuuuucuguacccauucuuugguugagggacaucuggguuguuuccagcuucuggcuauuaugaauaaagcagcuuugaccagaguagagcaaguguccuugucgcuaccacagucuuaagccaaauuugaagcaagcuuuaauuaaauacuggccaagucuguagaaaaauggccauggaucauauuuugcagggacuuuaaaaggcacaacucauaaugcacugaauuucccaucagauccaaucagggccaggcauguuuuaccugccuacauucccucuggcuuaaauccaaucaggccaagcauaccucgugcccacaugugaucuagugcagcuggugcagaugggucaacaaaccaaccaacaaacagcaacccauucuucacugcaaacagaacaccccccccaccccacccccacccccagcugaggaccgaacccagggccuugcauuugcuaggcaagcgcucuaccucugagcuaaauccccaaccccugcaaacagaauucuuaaccugcaaguguauuuuuccuguuuuggucuuacauuccuucccugacuuauaucuugagucaaauccuugacucugugaugaccuguuuauacugggauuuaauaaccaucaguuuagugguacccagacaggacuuaguuaggcauuuaguuaaggcaucaaugaugcaagaguaauuauagcagaagcagaagagccaaaggcccugugauggcugacaucagaguuacuguguuaguggaggcuagaaguggauggggccccagucaggucaugucagcucucuuuuuuggauuuuguuuuuuuuuaaguacagucagauaauaauuauucugagugguuuauauggaaacaacaauuuucuuuuaaagccaugcaauaaccucuuuguuuuacauugggcagguugaauguccuauuacacuguagaacugucucagcuaaugaauuuaccuauugauagauuuggggcuauuugguuuuuaacugguaccuuucuugguaugccaaugaguauuauagguguuugucuccugugccagagagugcccuuuugaucuaacauuccagccuguagggggacaagggucgacauacuuuuuuguguaacuauuuccugcuggaauuaggaagucauuaucagggccuaggaaggcuggagugcuagucaaggucaccaggaaauucaggcaaugggacauuuaucaggagcaucugguuugcugaccccugaagggacagagaacaaucccaucaguucucaucagcucucagcaaguccagggcucaugagcaggcuguagucagcagcugauucauggauggcgucggucaaacagcaaucugcugggacagauagagacugcagacagaagcugaaguuaggaacuuaaaagaaaauuacauuuggagcguucaggcccacagaccuaguaauugugggaggagaaggagucuccugaccaggacagagagcccauucucaguaaugggccggugaggaaacuuaagcuauacuuaacuggaguccuuuugaccugagggagguggauccaagucuuaugaugcccugaagccuacaugauuuuuuuuuucuuuaguuuacaaagagacauaaaauuuucaagauauauuagcauuaaucuguacugaaguccacacuguagaaaaaaauagcguuaccagcuuaucagaacuccauuaaucaauguuaaaacucuggcccuuugaaaucuuaguauaacaauagcauagaaggggaaagaaguccaaaacaucgucuauuuuucauaucccuuaaaucacuugcuaauucgcauuuauauaccugaaaacauuuuuuagacccuuagaacuuauugaagcuuucauaucuccagacuuuuguauaccuuagaacauuuucuuagacccucagaacuugcauagaccuuaaaccuuuuucuuuccaucuauucauuuaccagaguagguauuacugagaaguuauuucaaagcaaguucuguaaaauaaaugaacaguaaagaguuacgucugaagccugcuuuuccuuuaauaugaagccuguuagcaaggcaaacccgucugccuuucuuaacaagagaucugguagcucuagaaaaagguacauuugauuuuuauauaagaaagggacuaaggaggacccuucguggguucuuagggaagaaccuggcugccugcugcuguuacguugacaaaucuacagcuagccuagcuauccaggccauccgagaucugagaaauucaaauuauagcaggaaguauacuccaaauggccuauguagcaauuaaaaugaagaggcuuacccauuaauuaccuagcuaucccaggcuccuguggucuccaggacauggcuggguacagagguccuaggacagcaucugucuggcugacaggcccaggagaguugagaggcuuuuccugaagucugaccauacuuugccaagguacagugaggcaaucaucucuccauuguccugcuuguucacaaugaaggcaaggucccuuggcaggcaaugccuuugggacagucuugcucagugguuaccguuaccauaauccuggggagugguuguugcuggacuucaucaucaucuuuggagaccuugggguaauucuaugagcugggguaaaauaaaugaacaguaaagaguuacgucugaagccugcuuuuccuuuaauaugaagccuguuagcaaggcaaacccgucugccuuucuuaacaagagaucacaguaagcuuuuuccauuaaauauuugaaaugucacagucagcaaaucucugacaaguuugaggacaauuaucuaucugagccaaacaaacguugcuuguuuuuaguuacuugcuuuaggcuuaccauggaaaaccuaauggaggcgaaaucagucuuauucuguaauuaauuacauugguacuucuccugaucacaaacacagccuggaacacauuaaagaauuugauccguuaugaccuuuaacuugcacgucuuaaucaucuuucacaguuuaugauaaguuaguagcuuuuauaagauuaggauuuuaggggccagccgugguggcgcgccuuuaauuccagcacuugggaggcagaggcaggcggauuucugagucuggucuacagacucagccagccuggucuacagacugaguuccaagacagccagggcuacacagagaaacccugucucgaaaacaaaacaauacaaaacaccaaaaaaagauuaggauuuuauagcuuuaugucuguuaaguuuuaguuuuaaaauguaaauauuuuaaaagcuauuuccgugucucuagcugcauauguaucagaagauggccuagucagccaucacuggaaagagaggcccauuggucgugcaaacuuuauaugccucaguacaggagaaugccagggccaagaagugggagugggugggagagcuugggggggggggacuuuugggauagcauuggaaauguaaaugaaauaaauaccuaauuuaaaaaaaaaggaaaaaaagcuauuccuuuaaaauacacaguuuuuaaauuuaaaauuucuguaaaaucucuccaaaaauuccucuuaaaaaaguuaaaaaaaaaucccucgacuguguguuccagcaauguuaaacauauaaagcaucucuuuauuucaagaggaaagauauaggccaugaucauaauccucacaaggcaaauucaauucuaaaugucugggauucauuuauaauccucuggggccuggguuacaucucuggccgcacccuaagaggcaaacccagccugguuucuagauccaagccagcuccuuguccccuucauagcucuaaaaaccaauauuaccugggugacucuuauguuacaaaguuuggcugccagcacaagguacauucuugcauaugaauggagguacagcuuuaauaccuuuuuaaacaaacauuguuuuuaaauccuuucauaaacucuguuuucaggagagacauuaucauguaauacauccuaauccaaaauaucuuggauucugguuguugccuccucgguugggccgugccaccugguuaccuucaaucaagaugucggugaagucacaugacaauagcuuucuucagcccuagcaaacgugcuauauggcugccuaaagagaauggcaagccauguguugcuuauuccuaaauggaauuuugccagaugguucgucuaagauuaccuaugcauaggguuuuaacucucaacccuguguugaguuuuaaauucacuuauuuuucacagacuuuuaaccauacccaauacacuuauaaaucuugagguaucgaguguucauauaaaccagaucucauuauuauuauuauuauuuauuauuauuauuauuauuauuauuauuauuggucuguucaguuuugcuuucuucucccugucacagcaucagguggcucaacugacacaggacauagaggaaacuuuaaaauuuuugggucuagacaagggagacccaacucaagagccagcuuuccaauaagaagaacagcauaaaauaacuuuaauaaagguuagacauaggaaggguaucaucugaauuccugcuaaccugcauccacugaccacagagcucagcgauaaauucugagccaugaaagcaguuacaguagcggugguggcuggcagaggagacgguaaaaacauccauuucugucucagcugcauguuugcaaaaaaccuuacagauccaccagaaaacacagacaaaacuucacaagaagacagauaaaacuuuccaauaacagacagaacuuucggguuagccagaaccagguaggcagauggucuugcuauucgcccuacacgggagguuauugggccuuugaacaaaacccuuccaugucuaggauugcgaucccacagacagugacucgcuaggaggccucuauagaugacuucuaccuuucuuagcacggcaguucauccccauagucuaugaacugaagccucagagccuuggaacaucucuaggcacaugccucccaaaguuaccucagaguucugaagugaaagucuggcuuuagaauuuggauguguggucugaaucucacugggagccuccagaaaguguuaaucgcacuggcccagaauaagaccacuacuauacucuuaggccagauuagaagaagcuuuaauuaaauacuggccauguggauggacucuggccagguccauagccugguucccaggaaaauggucaugagucgugguuuuuuccccaaggccuuaaaaggacaacccccacaauugacauaucccauuagguccacucaggaggaagcauacauccugacauauuuccuaccuucaugccucuauccuacauccaaucagggccaagcaguacauccugauguguuuagcauagccaguguagaugggucaaacauaggauaaauaagaggaacuuauuuuuaacugcaaacagaacucuuaaccugcaagguacuuuuuuuuccuguuuuggucucacacuaugugauuuaauuauuuacugugauagggguucucucuguagcccugacuaaccuggcgcuccauacguagaccagguuguccauaaccuuacaaagauccuccccucuuuaccuccugagcacugggaugaaggguaccacuugccuggccuuauuuacuuauuuauuuuaauucgggcugauuaggaguuuaagaucccacacucucagccugagaagugcugaaauucuaggugcacuucccaguaucauguucuacuauguuuagaauaacagacugaauucuaugacgagguuacugacugacugacugaacuggagaugagaagauggagcgaaugacucacuucagccaccgugggugcucagcuuggcugcaucucaacagcuuuaugaaggagcccuuuuuaauuuuuuuauagggcauuuauagguacacguugaugagauuuuucuuuuuuaugcaaugaaagaauguuugugugagugucuuuguaauuaacagcacucuaggggguuagacauaggaagaguaucguuaaguuugaggucagccugaucuucagagugauuucaaggcgagcuugagccacaugggacccgaccucaagcaaaccaaaugaacaaauuaaagaagaaagcucgaaugaauguauugugaauagccgaagcucuuuuaauuaaauaucauaaccuacuauaagacaaaagcuaccacugugugugcguggugugugugugugugugugugugguguacaugagcucauguguuuguguguacacauauacucauguggaggucagaaaacaacuuuguggaacuagucuucuccuacuuuuaguuugcucagcaaacauuuguaccuauugagucaucuucccggccuuuuauugacccuucuugcagggguaugucauuugcaaaagaggggaggcgugagaauuugauucugggacccaccaaaagggcucacugguuccaagcuccaaaagacgugagaugggcucacaacuggccaguaacucuagcaccacaagaucugacgaugcacucuuuugaccuccaugggcaucugcacacucucacacacacaugaguacaaauuagaaagucauuaaaaaguagcacuaacuguggguuagaaagggaugcguccucagaggaggaaaugugucuuccuguggcugaggccagccagugggccauaccugagcaaaccuuggagcugcagagagagcaguggugugugugugugugugugugugugugugugugugugugugugugcgcucgugcaugugcgugugugugcguucaagugcgagcacgcuuccucguauuggucagucuuuuggcuuuuugagauuggucucauguauuucaauggcucugcacuccugaccuacuuccaccucucugcacugggauucagguccccucccccacaccaggcggcaacuuucuauuuaaaguaccacccuccccucuucugggggccauuuagugccucuuccugggggcauauggcuguguccugaagcagaagcauuuuuuuuuuuuuuuuggucauggccucugagaggaagaaaugccugaacccuuaccagauagaaagcaagggauaguauuacccaguaaagaauuaucuggucaggaggcgagagcugaaaauucugcuuuggagaaacaucauauucaaaagucugauaaacaccuuggcggggugcaaaaacaguuccuuuaguauuaauuugaauuacacuaggaaucugaaaacuuuccuuuguaaaucauaggcaucuuuauguaugaacugcucacuguucucccucucccucucucacucucucucucucucucucucucucucucucucucucucucucucccccucccucucuccuuuccucccucucucccuuuccuucccucccccgccacccuuugguuuucaagacaagguuucucuguguauagccuguccuaaaucucacucuguagaccagguuggccuagaacucagagauucucugucucuggucccuucccuccuugagggcgugugcgccaccacugccuagcuacucacuguucuuucuauacucaguguguguguugcuuguacacauguaagcaccagugacagaggaacguccuuccucuguuucuuucaugccuugccuuaguuccuugagacagggauucucacugaaucuggagcuaagcugucaggcagcaagccuuugagagccuguccuuaccacccacaggccgggcuuucacuuaggaaccuaggauuugaauguaggucuuaaugcuugcccagcaagcaaccuuccaguugaacuaucuuccagcccugcagacaauuuuaaaacagcuuuauucccuguaacucaagcagguaagaggaugugcacagugagucugagucauuacucguuuacaaacuggaaccgaguuaaaaguauacuuuuggaaauucaucaaauuggcaacuauguuacaauaaaauacaaaacagggauggggaagauaaaauguguuuaaaaguuuagucugcuggguuugguggccuuaugccucugaucucugcuuuuaggagguagagguaggaagauaaagaguucuaggucagcuucaguuauauacugaguuugaaguuagccugggcuacuaaagacccuaucuaaaaacaaacacacaaauggaaaaucaagacaagaccuuucucuucuccucuccuggccucggccugugccagcuucagguguccuguaauccuucugccucucucuccugccaacccuauugugaaagauuuguccucagccgugaaguguauaguagccauuuggaagguggcaacaccuccaaacgcugguaaauaucagaaccuggcaggcagacuuagugcuauuuggcagguucagaacaaaaggguggaaagaaaaaaaaaucuacuuuuguauuuucucagacauuuucaagcuuauaaaaauaucagauuguaauuuguaguguuauacuccugagaaaguuuauaggcuuacagagcaaaacagagcaagaucuuucuguggccuguuuggauguaggacagguauaguugcaaacaaugauuggggaugguuaaggugguuuugcuguuguuauuguuguuuucuuuuuguuugauuguuuuucuucugagacagguuucacuguguagcccuggcuguucuggaacucacucuguagaccaggcugaccuacucucacagagaucugucugccucugcuucccaaaugcugggauuaaagcuaugugccaccaugcccacagguuuugauucugagagacauuauguagcccugguuggccuguaacucauagggacuugccuaccuguccuuuuuccagggcugggauuauagacacgugacaucauuuccuuuugauuucauuuugagguagagucucaugucuuggcuucaaaguuaguaagcaguugaggauggcuuugaguucuuggcuuucuugaagcuacuucagaauuguuuggcccaccacaccuggcuuuagguaguguuguugauuaaacccagaauuucaugcauccuaaauuagcgcuccaccaacugcaauacagccaucccacccugugucccaccaugcugugacauaccccgugugaguuagaauagcugggacuuucuuaaaugaaagaucccaggacuaacucuaauuuuuauuuaucuuccaaggaugaggcagcuuuuguuuuguuuuauguuuuuuguuucuuugucugucucuguuuugagacaggauuucucucuacauagccuugucuguccuggaauuuacuauguagagugugauggcuuugaacucacagagauucucugccucugcaucuuugaugcuaggguuaaaggugugugccacaaaauccaaucuguuuuguguuuuccaagacuucuuuuugcuacuuaguccagagugaacucaaacaugcaguucuuuucucuaaauuuauuauuuacauuuauuagcauuaucaucuuuauuacuauauuguauguguuauuuacuuauuuacuuauuuauuuguuuuuuuuuugagacaggguuucucuguauagcccuggcuguccuggaacucacucuguagacuagacuggccuugaacucagaaauccuccugcuucugcagcccaagugcugggauuaaaggugugcaccaccacugcccggcuuuguaugugucuuaugguguguuuguguguguguguguguacacguguacauucugagcucaagagaaaacuuguggaguuaguucucuucuuucacuuuuauauggguucugggguagaauucauccacacuuuauuugcugagucuugugggaaaagaguacucuugguguuuuacaaaggaagaaagugaaaguaauuuuacaaggcaauuucuuuuugcaaaauggugugccagaauccaaacugggcuagugaguagagucagucaagauggcaucugucuuucauccuuguuguaggagugacugcaucuuaucuccguggugggaucuugacuuaacaaucugacuguuagcuaaucugcaaaaagugggggaggagggagguucaggaacuguggggcccuuacagcuaauuacuuuggauagaaaagaaaaguuucucauaguucccguacuuuauuuuuaaagguguuugucagucaaguguaauggcauucaccuguaaucugagaacucaggaaguugagucagagggaacucuucauuuagagccuucuugggccacaguaacacaguuacaggccagucagaguccuuaccucaaacaaacaaaugaacaaacaagcaugcaaccuugcgugaaacaaaacaaaacaaugaacaguguucucugacgugaguguuuggcccaaggugcuaucuuguuucauuugaucacccugggugagaagauggccaagaaaaccacuugcugguagaguggauacccagaacucuucuaaaggcucugggagagauuucaucuuucuagguacucugcucucaccugaccugucugaagagauguggacaaaggcuuuuccauuccguggaucuugcacaggcuguaagaaaucaguauucuuuauuguugggauagggugagcauguguacggcucugagggcguuaaagcuggcaggcaagacaagacuauuagaagaacgcugcagaagcugccagcuugucaggaggguaaggaauggagaguuuaauuuggaggccccagcacccuaagcaguuucuaggacuguagaguuaguacacuguaaacccaaagcccugccccccuuccucucacgucauguugcccagauuggccuugauauguagcugaaagugauccugaacuccuaaucucccucauucugccuccgaagugcugcgauuauaggauuauugaaaagagaaaagggccagacaugguagcauacaccuucagucccaacacugaagaggcagagaccggggauuuucugugaguuuaaggccagccuggucuauacaaagaguuccaggccggucagagcuacauauugagacacagccucuaaacaaacaaacaaacaaacaaaacuuuaaaaauuuauuuugcguacaguauugcguucaaagcuagucagcgauggcacaugccuuuauucuccgcauucuagaggcagaggauuugaggccagccuagucuacggaguaaguuccaggaauggcagggcuacccagagagaaaagaaacaaaccaaacauuauguucaaauuaaaggguugggacaccaucaccuagcuauaacaacacuugcuucuaaguuaaaaaaaacaaaguuaaauuugcuagccauuuaaaaaauggaagucaauggauauggaaaacguuagagaauugauuucauuuuuuuaaaaauuaaguuuuuauuuaguuguuuggucuuuugaggugcaguuuuguuaugaaacccaagacuuaccugggacuuacaauccuggcucagcccauugggugcgggggugacagguuugaguuacuccucacucuuuuuuuuuuuuuuuuuuucugagacaggguuucuuuguauagcccuggcuguccuggaacucacuguauagacccggcuggccucgaacucagaaaucugccugccucugccucccgagugcugggaucaaaggcgugcaccaccacggcccggcacuccucacucuuuaggcuccuaaacuggaauuuacuucggguuuugaaagagcagauggaaauuugacauucaguuguacugagaaggccuugugaggcaggaauauggacaugaaaucaacgugccuaaccacaacaaugugggcaggaauggaaugcugggagauagcugauaggcugucggguaagagaggugaugucacagcugguggaaugccagcuguagacuuccuucuguuuagugccaugguuccuuguucuugguguuggucgugaugaguccugaaaugguaacucucaugugaaauccuguugcuuccaacccgugguucuggaagaugacuagaguuaucaacccauugucuuccagaggguguguagaacuggagagcuugggaggaugguagcuuucuuaaaaggcugccagacuccugcacagaaaucuggggaguggggggaacaacagcaucucugugauguuggccuacugccuguagauucuggaaagagaacacucauuuguacauuccucagcugaugccaaacuccugugugcccccgucuccucaggaauggcagagaaguaggauuacucaacagguucucacagcuuuuccauaaugggaaauuaagaugagcuuccucaguggaaucaugugacuauccauacccaucucuugguagccggcagggcacuguucaccaagagugauugucaguucugagcugacuuacuguguguacaguucuggcuuuuacugcuauuccugguauucauuuaacuauguggaccauuuuuuuuuucucucucccagauagagucuaauuuaacuggcuucuacuucuuuaauuacauauuuuuaauuuauugugugugugcacauguguugugugcccaagccauugcuuacauguggaggucagaggaaaaccggaggcaccacuuuucuucuaccaugugggacccauggaucaaacucaggcccaucagcagacaccuuuguccauugagccguacaugugaucacgaagccccuauguuuuugaguugcauuccucucuccgucagauuuuaccuggguuaccucugucuuugcacacaaagaggcaugcuugcauaacccccuccccuuuuuguuuccugugcuggaaauggaaaaggaugggaauggggucuugugcauccuacacaaguguuuuguuacugagcuauccuucagcucuuuccuguguuuauuucuguaacuuguucucaaacuuccuucucauauggucucagauuccaauaucucagaaauguuuaacuccucuccccugccugucuaaacaggagcaugccauccaucaccuuguaauauuaauuauccuuuucauucauuuguuacacuuaccaagaguuggaaaucauuguguauguauauauguauuacacacacacacacacacacacacacacacacacauacacacauuuccugaacuauaccccuagauaucaaaaguuugaaaaccauuucuugcccauguucugagucccaugaagcagggacuuggacuuauuucucauagcaugaagauguacauccuaggcacucaaaaaauaguugucgaguaagaugauaauuuuauauucaaaggcuuugugagacuagaagaaagaaaacacuuuuugguguguguguucaagacaggguauaauagcccugguguucuggaacuugcuuuguagacuauacuggcuuugaacacagagauccaccugccuuugccucucgaauguuuggauuaaaguuguguaccaccaugccuggcaagaaaacauuuuaaaauuauuuuuuauuuuuauuuauuuuauauguaaguacacugaagcugucuucaggcaccccagaaggagggcauuagaucucauuauggaugguugugagccaccaugugguugcugggauuugaacucaggaccuucggaagagcagucagugcucccaaccgcugagccacuucuccagcccaagaaaacauuuuuuaaauuugggaaagguagccauaugagguggcuuacaccuauaauccugacaacccagaacugaggcaggggauugcacaaaguuugggaccaaccuggguuacguagugaggucuaggccauucuagauugcagagugagacucuuguguugagacaaaaggaagagaaacugaggcucuaagagacuuuguagcuauggauccaaagcaaaagaccuggcagcugggacugaggcaucuccuagugugguucucuucgcucacggcuggcuuuucuuucuguucaaauaggguuucauuauuuagucgaggcuacuucuucaaugcuggcaucacagacuaaugcaaucuuuccagcuuuugucguugguuguugcugagaacagggucauuuuuugcagcuucuguuagccucaaauucacucuuucugcucugucauaaucauauuuuccuaaagacaucauuacuguuuugaaaggcaugaugguacauaccuuuagucucagcacuuagagacaggggcaggauuucucaggaucucuuuugagaguuccagaccagucagaacggcauagagaaagccaguuucagaaagucagccaaccaacagaccaaaauaaaccuauacaauacaaaaauugacuuuccagaaaguuuaaaagucuacuacauuaaugaaauagaaaugacaucaguuauguauagaccuacauugcucuuguuuauauauuuuuguguacacugcucuuuuaaaguggcaguaaguugucuuuacuuuuuuguuuaggagccagcuauucuucuguccccaucccauccccuuuucuuccuuuccucccucugcccucccucucucucuuuuuaaggcaaggucaugugaauccagggacagcucagacuuucuaugaagccaguguugacuuugaguuucugauccuccugccuccugccugugaguuuuggcauuggaggcauagaccaccaugcacagcuuuauaauuucuaaaucaugaauauacugauuuuggaaaaaacugaaugcccuuggaaugacugucccccacucucugaaggagacuuaucucuuugguugccucaggguuggguugggguacuaaguuccauguugaccaugguucccaaucucccuuaguuaaugugccuugcugaagccuuuuggaacccccuccccauugcugugcaggagauuccaagacagggcccagaucaaggaaugccagugacuguuucagugguagaugguggcagcacuaauuugcaucugcuguaacaagcugguguugaaaugggcuggcagaaugccaaggaagccaaggucagcauacuucgaaauaacaaaugagucaugcaacccaggauugcgcgucccuguaggaaugacuacuugacucuucuuccgucggaacaguuccccgggccagcauguguaaagggaggugaaagccgcagcagccucuugcuagagagacaauaauggaggaggagaaaaauuaaaguggaaagucacauuuaaagucacuucagagaaaaccaucgugaguuguagaagacagcuuucugaacugccagaaaacaagccaagaaaucgaggagacccaaaccucagggcgguuagaccacagaccugagcucaaauucucacauggcacuuuccaucugugcccuccgaggcuucucacccuucccagacucgagcuucauggcugugcacuguagauagugacaguuuuuccguucagucaacauuguuacucaggcugccaggcauugauguagacgauguggggguguagugacagauggguccuuauucuuguagagcuugcuuucugguagcagaagcagauggugaaaaagaaaauaacagaacaugguaagugccacacugaaggaaaacagagaaguugcugguagugccuggggaaucccuuccuguccuaccccgcagggacugugcagagaaaaaaaaauuuauuuuuuuguucagugaggagugaguaugcuggggguugaaccuagugcuuuaaacauuuuaagcaaguuucauuucaagccugagacaggaugcuacuuguguagcucaugcuugaacucauggcaauccuucugccucagccuugcaagugccuggauuacauacaggugugccucaccaugcccaagcaagaacauucuggagucuucucuccugcucuuuuccuuucagcccuaccccaccccuagaagcugcuuccgaacugacucugaguuuuguucuuuggugguguaggccucauaacucuaguugcuccauuaagaggcuaagaggaauuuaaggccacagaaggaauuuaaggccagccugggcaugauuuagauuugguuucaaagaaaaccaguaaacagagaggcggagauguagcuuaagagguaagaugauccuggguuccacauuuaguacugccaccaucaccagaaaacgguauuacacaauacacuuuagugcagcaguguuuuugagauucaaacguguggcugcauucaccaguagccacuuucuguuuuucguggagggggcaaauugagacagucuuggaaucucguuggucuuccaacagccuuuguagccacgauaaccuugaacuccugguccugcugcuuucaccugcugagugaugcucgacagguuauaugccaccccacugauuucugugucccugcacuuuaagaaggaggugccacaagguaguuucaggugccagagcugaguucugguauugguuuuggccccuugcucuuugccagcuauguaaacucaggccagugaaacccuucucuaucauugaauuauucaccuggccuuccuguggguuguucggaaaauaagaugauuuagaccagaguugucuugaaaaaaauuaaaugcucuccuugguaguuaagcaagauuaaaagacaaacuauuuucuuucuuucuuccuuuuuuuuuuuuuuuuuuuugguuuuucgagacaggguuucucuguauagcccuggcugaccuggaacucacuuuguagaccaggcugaccuugaacucagaaauccgccugccucugccucccaagugcugggaauaaaggcgugcggcaccaccgccuggcaacaaacuauuuucuuuaugcugguguuuugcuugcauguaugucugcaucauaugcaugcugaguagucauggaggccagaagaguaucaucucuugggacuggaguuauagaugguugugauuuccauuuggguccugugaauugaaccucuguccuguaagaacaaguacucugaaccucccagccauauuuccagcucccaguagcgaguuuuaaaaaauccucuuaguguacugacugggcauguuagcucaugccuuuaaucccccaaauuagaaugcagcagacccaucucugugaguucaaagccagccugguuuauacagccaauuauaggccagccaggguuauauggugagacccucucucacaagaaaaucaccuuuauaaugaacucaaaaaaaccaucacacagcuggaucgugguagcuacucaaacaccuacgaagucucgaacucugugaaucccagggaccgucuauauaguuaggaaggucauucugaagguuuagguguucacuaucaauggcauuuuuagggauuuuaccacaagggaaaaaaguaaaaggaaagucagaaaggaaagaaggaaggaagaaagaagaagaggaggaagaggaagaugaagaaggaagaagaggaggaggagaagacccaacagaguugaaauuagaaaacgugugcuuuuacacccucuuccaccucucugcuacuguuguuuguguuucauccaucuucacugucugauagugccuuuuauuaguuuuucuucuuucaucaaaaaauuacuuuggcagaggcaggcagauuucugaguucgaggccagccuggucuacagagugaguuccaggacagccagggcuacacagagaaacccugucucgaaaaaccaaaaaaaaaaaaaaaaaaaaaauuaguuuggaacuuuugaauuuugaauagaacaagauuuucauuauucuuuuuuauuaaaauuuuauuuuuuguguuuauaagaggaaagguuugagaguaaggaauguguggggagaggggaggaagcauccuuccaaccaugguggcgugaaggagcccuuggcagcaaacuugcagaagguguaaggaugagacucagaggacggugggcgaggcauugagucaaaaugucacugagccuuagaaguuggagaagggccaugggaugcagggcuaggggugguugaacgggggcugaugguguugaagacaaauccugucauagagcuuuaggcagaaagcuggcguaggcaguugggaaugugggcugcaagaucuguuucacagguugggcugguuauguggguuucuugagaaugugagcuuccaaagcaaccacgggggaggcuugacucuacccaucccauugcccuggugccuaaacaucagguggaggauggagguagcccaucagucuaucuguguaaacucugucuaauacagcuuauauaaagauuauauauauauauagcuuagauauguagugacugguagugacugggugcuagccagccaguugggugagguguucacagaguugaacacucagcuggaaucccagcacuugggaggcagaggcaggcggauuucugaguucgaggccagccuggucuacagggugaguuccaggacagccagggcugcacagagaaacccugucucgaaaaaaacaaaacaaacaaaaaagagaaagaaagaaagaaagaaagaaagaaaggaaggaaggaaggaaggaaggaagaaagaaaacucagaucagcuggaugcuaaacaucuucacagauaaaaguguguguauguguguguguuuguggaaacugaaaaauuccauugaaaaccggcacauuuggaguuagucucuauucaggaccccaaggcaggaggauugcuggguuauauagugaguucuaggccagacugggauacaaaaugugacccugugucaaagcccucucccaagcccccaaaagaauuccaguugagaggcugaggcaggaggaucacagguuugagguuagaucugggcuacagagugagaucuuguguauguguugggugggggcauugucucugauucugucuccagcauaccagccacagcuacaagaguacaugauuaugacagccaugucauauccagaguguuucauauccuuaucuccaucuucugacucuuagcauucaucccaccaucucuucuauguuguucucugagccuuggaggaggugagguagaugucugauuuaggacugaacauccaacgguuauauauccagauuacuuuuuuaccaguuauuagauucuguguuaacugucaucuucugcaaaaggaaguuucucugaccccugcuaagaacagcacuaaucuguggguacaaacauaaugaugcuuauagcucauaccuguaauugagcagaugggaggcuaggccaagaggaacagcacaaaugugaagccagcuugggcuacauacccgacccggucuaucaaaaggaaaaagagaaagcgggagaagagaaggaagaggaagagauguuuuucugggcuuaacgauguggcuuacugaccagcaagcuugaggcccaggucugguaccuagggaggaaagaguuggcaugaguaugaucacagugcuccguacauggaugcaauugucaacaaauuuuuaaaaaugcgacuggaacguuucuuugugggagucaguaacacagugaaggucuuaaacucaggguuucaucuauguuagacaagccuucuaccucugggccauagccacacuauagagauuuaaaaaauauuuuuggccgggcgugguggcacacacuuuuaaucccagcacucgggaggcagaggcaggcaggcaaauuucugaguucgaggccaaccugguguacaaagugaauuccaggacagucagggcuauacagagaaacccugucucaaaaaaccaaaaaacccaaaaaaaaaaaaaaaaaaaaauuguguguuugaguguuuugccuucaugaauaugcaugcacuacaugcauacguaaugucuguggaggucagagaggacaucauccugaaguuacagaugguugugagccacccaugugagugcugggaaccaacucucgauggaucugcugcaaggucaagaagugcucauaaccucugaaccaucucuucauaaccagagaacuuuuaaaaauguagaaucuuagcaucguaugauagcuuauuccuggaaucccaacauuuuggagauugaggcuggaagaggaaaggguuuauuuaaucuuaccauuugcaauccaucauccaggaaagucagggcaggaaccuggaggcaggagcugaugcagaggccauggcagaauguugcuuauuagcuugcugcccauuauuugcgcagucuacuuucuacuauaccucaggaccaccugaccaaaguugacccuaccugaaggguucuccccaucaaucauuaauuaagaaacugugcuacaagcuggccuacaagccaguuuuaugcaggcuuuuuccaauugagacucuucuuccuagguaacuauagcugcugucaaguagagaaagagacuaacggggagaggcguugugaguucuuguuuuuuguuuuuuuguuuuuguuuuuguguuuuaaagauuuauuuauuuauuauguguaaguacacuguggcugucuucagacgcuccagaagagggcgucggaucuuguuacagaugguugugagccaccaugugguugugggauuugaacucaggaccuucggagagcagucagugcucuuaaccgucgaaucaucucaccagccccaggguugugaguucuaaucgagccugaacuacagaaugauacucagaacacugccaucaugaccauuuuaaggcuauaguucaguaacauuaagaaauauugggagcuggagagauagcucaguaagaaaacuggcugcucuugcagaggaccuaaguucaguuuccagcacaugucaggcuacucacaaccaccuggaacuccaguucaucugauuucuucuucuauugaguucugugguaccuguauguccauaguacacauaauacacuuaggcacacacauauacauaaaaugaauagaauagguaaauagauagagagauggauacauagauagauggguggauagguagguagguagauagauagauagauagguagacagacagacagacagacagacauaaauaaaucuuccagaagucaccacuggcaaccaccaaacaaaacuuagcuuguaaaaugaaugaacagauuaaagucugagaauuaagcaccaauucuuuuuccuaacaccugauaacugcuaucuacuuuuaaagguuuugauauucuuauuuauuuuugguauuucaaggccagguuuuucugugugccucuggcuaucuuuauuuuguaggucaggcuggcuuaguacucagagauccaucagccucugccucccaagugcuggauuaaaguugugugcuccccacccccuuauuucuuauauuauuagggagugucugcauaugacauagauagauggauggguagauagaugaauagauagugaguuugggcacauggugcaggucagaggauaaauuuauaccauuaacugucacaccaugagagauucugggauugauucaggccauccuccuuguacaggaaugacuuugccugcuuaaccaucuugcugguccugcucuccuuuuuaugaauacuuuucacauuucauacauguauauaauggguauuaaucauauucacucaccacuucauuuguaucuuuauaaacuuggcucuucauagaagugacgucauacagaguuugucccuugugacugguuuauuuuacuuagcagaauauccucaaguuucacauuguagcuaaaucauguuuucuuuuccuuuccaggucaaaucauacaagcacucauguacacauacacauacaaaugcaugcuugaacacacuguaucuauauaacauauauauauauauauauauauauauaugcacaguuuuucaaauagcaugcauuugcuugcauauaccagguuauauuuacuuauucaccacuuaucgcuucugacuuuuggcuauugugcuaaauaaagaaggcagcuggaauguggguggacaaauauguguuuugauuuccuguuauaguuuucuugauugcugaggcuagaaccgaaggucccauacaucucagcaaggacauuccugcuucaauuucuuaaaauauaugcucauaaguagaauuuucagaauuuuggcagugccuucuugaugcucgagguccuguccuacuguucuccaccucagcugcuccugcuggucuccaccucaagugguuucuagauccuauccagccaugcuccaauuucucccuuuuagcuugcuaaugaggcugcaggacaccccaguagggcuugcauuuccucaucauuaaugauucugagcauuuuuauuucaguuuuuuuuauuaagauuuaauuuuuaauuuuacgucugugugucugugugaauaugugcguuggugcccagaaaggccagacgagagcaucagauccccuggagcuagaguuagacagcugguguguugccuucugugagguacugaaccuagguccucugcuugagcagcaagggcccuuaacuguugagccauuucuccagucucuuauggugauucucuagcucaguuuucugagugcuggcgugagucaccuccuuucuuccucuuucucuuucucuuccuuuuccucuucuucuccuccucccucucccccucccucucuccucuccccuucucccccucccucuccuuagucauccucauugucuguagccuuuuucuuucuccucuucuuccuccuccucuucuuuuuucuccuccuucuccuccuuuuucuucaacuucuugaaauucucuucuucuuccuccuccuccuccccuuccccuuccccuccccuuccucuuccuccuccucuuguucuuguucuucuuuggcagcucugggcugauccuuaggccuuucaugugcugcaauuacucugucauugaaguguauccuaacuucuuuuaguuuuuuuuuuuuuuuuuuuuuuugguuuuuugagacaggguuucucuguguagcccuggcugucuuggaacucauucuguagaccaggcuggccucgaacucagaaauccgccugccucugccucccaagugcuggucuuuuaauuuuuuaaaaaaaguuuuagcuuuuuuauguauaugggaguuuugcugucaugucugugcacugugugaguucagugcccguggaguccagagcaggguauuucacucccaugaaguggaguuacagacauuugucagcuucuguauuggggcugggaauagaaccuggguccucugaaagcgcgccagugcucuuaacuuggaguugucucuccauccuccgacagaauugucuuaucaacuuccgacuuuuauuuuuuuuuuuaauguuuguuuauuuccuccuuguguguuuauguguagauguaaauguaccacagugugcuacgcugagaacaaguuuuuggggucaguucucuccuccugucaugugaguuccaggaaucaaucuauaagaucuugaggccuggugccaagcgcccacacccgcugagccacgagucauuaucucuggccuuuugacuuuuaaauaguauaccuuugucaaauuucagagcuaggauguagacaauacaauucccauugccuccucaccccugcccccaaucucaugcucagguaccugccaggacaggaucuaugguucugcauuguagaaagagcccugcucaguuuggcucucagcucaucccuuccucguacaucguacaaggugaagaagggaagauagagaugcaggaguuucucuagcauggcggcguggcacagaaaugcuaccacgaaugagucuagagucaucauuuccuaccaccguguuccuaugcuuggucugagucugagggcugagaagucacuuuuaucggugugcucuuccugaguuuucuaccuacuugaauuagucuaguaguuucagugugacagaauucuguuagacagcauggcugucuucucuuucccuggguggccuccaaauaucacacaaaugcuuacacguuaacacuaagcaaacugcaaucccuugucccucuuguuugucugucaucuggaugugaccacaugucuauccagcucagcuccuuagagucucuccagugucugucuucuguucacaguaagaaaaucacugcauguccaggagccucucaugugaacaaagccacuuuuugucucaggcuucuagagagcauuuucuuccuccuuggaugugucuccucugcauagauuugcuguuugggagaugacgucaccuggacagcuggcucuuccuuggugccaagguugcuggcugcugugguaauuggcuuggcagagggcuccuuaaaagguuguccuccagcuguuauugaguuaaagcugcuaggcuaacccugcuaggaguucucuuagcagcugucacgccuaauuaccaagagcuauagaagagguguuuccaaggggaccucuuaucucuaagagcagggaccaggcucuaacauuuggaagaagaaaugaaggcccaaguggagggcuugauagcugcagaucaaagcacgagacagaaauguguucuuggcagccaaggacaaugaaauucacugguuuguuuuuuuuuuuuuaaauauuuucaauuuuuauuuuuacuuuucuuucuguugcugggguuacaacucagggccuugacauucuaggcaaacacuguauuacagagauacaccccagcuuccaccgacuguuucuuaaaagacuauuucccccuuuucaggguagacaauuugucaaacaguaucaauacuggacacucugguugacauuuuccugggcaugcacaggggccggaagugcucuucacaccugaaacuccauuugcucacguaugcucccuacccuacacuugcacacuaaccugagggaaaccccgugcaucaugggguguccuuagccacugaggaauacugaugcuuucuacccuaaacuacaguguccacagugaagauucagguguuuucccauucuacaccacuucaguaauuacuuaaaguuauaaugugagccaucgaugcagucuaauuaguuuugaagcccaggguggucuagggcucacuguguaguccagacuggccucaaagucaugcugguucuccugccucagauuccuaaguguugacaucauaagcaugaaugacugggccuuaaccuacaguuucuaguuaccucacguaucuuagaacguucucacacaugagcacaaaauugcuugcuuaaaauaacagcuucuggguggccuagucggccaucauugggaggagaagcccuuggucuugcaaagauuauaugccccaguagaggggaacgccagggccaggaagcuggaguggguggguuggugagcagggaagggggaggguacagggaacuuucgggauagcauuugaaauguaaaugaagaaaauaucgaauaaaaauuguuuaaaaaaaaaagaaauaaaccuguguaguaaaauauaguaugccucaaaaacaaacaaacaaacaaccccccccccccccagcuucuguguuggcucugggaagcugaagacaugagaagaguuuuucuaaaggcccuccugcccccgcugcugcugcugcugcugcugcugcugcuucuucuucuucuucuucuucuuucucuucuucuuucucuucuucuuucucuucuucuuucuucucuucuucuucuucuucuucuucuucuucuucuucuucuucuccucccccucccccucccccucccccucccucucccccucccccucccccucccucucccucucccucuccuucucccucuucuccuccuccuccuccuccuccuccuucuucuuuuuauuuuuuauuuuuuuugcaguccugguacuuuauuucuuuguguacauuaggccaugaauucguauggaaugggcuccaacagcucagacuuuuuuccguuaguccucacaaacugugcuucucuggguggcacaggcuggcacuucagcugcacccaggugccuuucuccuuggcuuccuucuucuucugaucguucuccuucacccguuccaggaagcugucccugcucuuugagugcuugaugugcucaauccgcacguugauccucuuggccagaauuuugcccuuaacuugcuuguuuacaaugaugcccacagcaugcugggugacauuguagacucuucugguuuugcugugguagcaauuacggggcauuccuuuuugaacagugcccauucccuugaugucuacaauaucacccuucuuguagauucgcauguauguggccaaaggaauaacaccauguuucccaaaaggccuagagaacauauacugggugccucuccucuuucccuuuguguucgucauuuuggcgaguuacuagaagauggcugccccugcccccacuucuaaagcccuucccccucuuuuuaagggccuucccuucuucuaaagccccuuaccuccuccuaaagacccacuuucuucccucuuuuuucuccccaaccuucccuccuuuuccuuucuucucucagcaggugacaucucuuggcgauccauccuugagaaucuuucgcuugucuggcuuaccaugccagucuuugccuuugucuucaguggcuucucuugccagcuuguguauuuggauucaaaucucugagcucuaggagccacaauaucacauuaacaaaugagaggacuggggugugguucaguuguacagggcuuaucuaucauauuaauaacuuggguugaucucuagcaagaggacagggagaugugugugugugcacauauuuacguagaacaugauauauaucuauauuuaugccucuauauagagagacauauauaaguuuaaguuacagugaaagaacuagaacuuaaauuuuauuaagugauuuucuuuuuagucuaguacucuggaaguuauuaucacaauaccuggugaauauaaaauaauuaaaauaauuuuuagaaauaauguuauuuaauccauguaaugugggaguguguguaagccacaguggauguguauagaugaccuuugagaaucucgcucuccaacauguggauacuacagauugcacucaaguugucagacuugguggcagauaccuuuaccacugagccaucuugcuggcccaaugauauuuuuugguguguuuucgacagagcuuugcuguguagucuagacuguccuugaacucacaaucauucuuccucagucuccugagugcugccaggauuauauguaugaacuaccauauucaauuuaauaagauuaaggcauuaaaauuauauuuguuuuucaauuaguguguguguguaugcgcgcgcgagugcacacaugcacuacaaugucucuagagucuagauaucaaucuguucgaguuaccucuuuucuacaguaugggcucugggguucaggcucaggccauaagguuugguggcaagccuuuucaaccagugagccaucuugcuggccccauauauuuuaauguuguuuguaguaacguaucucaacuuggauugccauuuuccccucucucccucuuugcuuccauuuuccuucucucuauuaaguuuguuugcuuuugcacugcuggagaauuaaacccaggaugguagcuggugcugugacaccaaacugagcuauuaccccucuuccuuuuucuuuuucuuuuucuuugagacagcaucccuuuacauagugcuggcuguccugaaacuugcuauguagacaaggcugucuuugaacucacagagacccaccuacuuuuacuuccauaguucuagaauuaaagguggccaccaccauaaccaaucuuguucgcuugcuucuucucuugggacacggucgcaauauguggccuaggcuggcuuugaacucaugccucucuucucacgugcccagauuauaauugagcacuacuaugcaugcuuuuuucuuuuuuguucuagggaauaaaccuagggcugcacacuugcaagguaaggcuaacacugagccacagcccuaggaggcuuucucuuuauugucacccucucauuguggggacucuuucauccugccuugcacuguggagugccauggugccacaaaacuguuggacugucauuguucuguuucaugccuuuuaccucuugucuuuuuuuuuuuaauuugguuuuuuuguuuguuuauuuuaggaaaaauauucacucauucugaacaauagaaaccaacauugaguuuguaaaaacuccuggaguaauuaaauuaaucaguuuugcaaggagagccauauacaauaugugugugacuauaucauauguauauauucagugcuggauuugcauccaagaauucuuggucauguuuaagugccaguauucacugugugcuagaaugggcucagcacucuauuacaguggcuuaaauaugugcagcuaauauuuggauuaaaaggagaaguguaagacuugguuacuauaaaugccccugcugugagauuugugacuugagguuuaugagcccuggugaacagggcuauuguuuuaugucaugucgggcacguagagguauaagauuuucauucucugcugacuguacucuaagcccauugccaucuugaaguuucagucucuggcucugaaaaucuucagggucuucuuauccaacauuaaaaaaaucauuauuugcucacuugaauuuuaauaaggaagccaagaugguuuuauuuugauuugauuuuuauuguuuacucauuuauuuuuauauguaugaguguuuugccugcaugcauaccuggugcccgaggaggccaaaauagaaucucagauuuucugagacuggaguuacagaagacucuaagcuaccauaugggugcugggaauugaacccagguccucuagaagagcagccagugcucuuaaccacuuagccauccguucagcccuuuaaaguuauuggguuuauguuaauuuuaugcacagggguguuuugucugcacauauggauguacaagaagucaucaggcuuuuauaaguaaccccacauggaugaaagguuuggauucuugaauucucuuuccuccccuaguacuggggauugagucuagagucucucauauacuaggcaagugcucuaccacugagcugcaucuccccuuguaaaaugucuuaucuugagggaaccuuacuacuaaacuacccaggauggccuugaauuuccucugcagcucuguugagcuugaauugacaacccucuugcucugucugcuuccugagaagcugacgacucaggcaugugcaaccaagcccaaccuggugcuucagcucccuuuuuuguuguugucaaauaaaucuuguguguguguguuugugcucuguguaugcauaugcacacuuauguaagaaagccagaggguuuuaucacuuucagccuuuauucucuugagacagccuaucacugacccuggaguaggcuggugacucgaaagaucuaacuguccuuuauuuccacuccaccucaacaucugacuuugacaugggugcugagaauuugaauucaggucccauguuuacacaacaaagggucuuacuugcuaaaucaucccccaguuccuggauccuugaauucuguuuggggugugugugugugugugugugugugugugugugugugcuuguuugagacagugucucucuuuguagcccugagacaugcuguauagaccaggcuggcuucggaguuagaaaucuacccacuccucugccuuuuaaaugcugggauuaaacagagacauaugccaucacgcccagcuuugaauccugaaauuuggugcuugacagugauacagccucuuauucugcacugucagcaggaugacagcugcuaguaaagguuggcuuuguucucuuccauccagaauuuccaccaguuugcucucugcccugagcagccauccaaggaagaggaucuaggcuauguauggcugcuauuguagaaaguuaugggguuggggacuccacguagugggaaaacacugccuaauaugggugagaucuuaagguuacccuccguacuuggaagaauuuuuagaaaacagggguguggcuaucauggugagggaaacuucaaugacaugacuccuuaggguuuagacuucucguucguacucaguugaacgcuaacucuaaaguaaaccuuagaucuaaugagaaacgcuuugacuugaacacuugaggauuccuugguaucuauuaguuaguuuguuuauugauuuuuguuuuguuuuguuuuuuuuuuuuaagauuuauuuauuuauuuauuauauauaaguacauuguagcugucuucagacgcaccagaagagggcaucagaucucauuacgggugguugugagccaccaugugguugcugggauuugaacuucggaccuucggaagagcagucggugcucuuacccacugagccaucucaccagccccugauuuuuguuuuuuuaagacaagguuuuucuauguagcccugucugccuuggaucuuguucuauagaccagaccgucacugaacucagagaucugccagcuuuugccucuugaguguugugauuagaagauuaacagugugugccuccucacccagcugcaguucucucuauuuuuaaguuuaucucauucacacucuuuuggggccuuggucuaaacaucgaugcuucuuccaucugucagaggguuuuaacucucuguuguauuaaugggagugugcugucuuugucccagaauggcugguugauucugaacuggaaaccuaaagaaaaaaaggaaauaagaugauucuucauggaaauuaguaacaggaaaggucuagauaggguucuuacuagccucccugacuguuaucaaaggagaagaagugaagauucugggcugggagaccacaggagaaaggaggagagaaagaagggaggucacagggcaccugccauuaacaccuuggaguucucuuugagagaggauuuaagguagaggauguaguugcuccugcggccucacauaguuccuuccuuucuccaccuucccgcagcucuguugguucaccuucuuagcugcacugcagcccuccagcccuccagccucagauggacauggacgucaccccuuccucuuugcagcccuccucacagggcaccuucucuucugcuuucaaucucucagcuaggucuuugucuuuuucuuucuuccuguacugcguugaggcuuugaaauguaauuugcucauuuuguguugccugguggcuugccgcacccagacaaggcucuucguuuccuuucacguauaacaaaaaugcugcaguuuuccaccucuaucucaguuuuccuucuuggaaaaguggcaaccaugguaccugauugagcagaagcaagaagcuuguucuuagcuaaggaaagaaguguaagaucaacuugagaguuacccucucuguucuucucuuacaggguaagagaaggggauacaggcuuauaaaggggaaaaauauucauauggucuucuuggaaugggcagaaguuuucuggggaauuuaaauucugccucuagcccagcgauaguggcauacaccuuuagucacagaaacugagagccggaggcaggugaaucuuugagaccagcuugguuuacaggacaaacuccaggauggccaggacuucacagagaaacaauguuucaaaaaaccaaaaccaaaaccaaccaaccaacaccuaagaaacaacaaaaccucugcuuuuuuucucuuuuuggggccuuuccaguuguuacuuggcaauugucaacugucauggugcuagggcguguagguuuucaguuguguuauaauggaguuagagacugucuugcagccaucccagcaaccuucuuacauuccuuaguuuugauuguccugcggagggagggguucugacuuuuaggcauccuguccucagagacaaacaagauuagggcucaguagaaaugcagcuggggugcuggguggaggccaggguucaagguuugaguggcuuuuccgcaaucccaggccaauuuacuauuauuuuaagaauuaugugguguguacgcaugcguguuugcgugcuugcgcgugugcguagguucuggcagucuuagaugaggguguuggaucuuuuggaguuguccaucuuauauuuugagauagucuuucacugcagccagagcccacuguuuuagcagacauauccgcagcaccaaugaacgauauugggggaugaaacggggcuuuccaaagguaccagggaucuuucaguuaaggacacuacuugaaagccucccugucacacaguaugaccagccagguagagcaaauaauauguccuucauguuuggucuccauuucguagccaagaucacugcacagcagcuaaauaagucagcuuuauucuuuuguacagagcuaaggaggugugagucuuuagggaaacacgauuuauaucaaguauuguaaacucacucuuguucuauugcuguuuggggguguugcuuguuucaugaagcuaguguuguggacugucuuugaucugaccauucccuggggaaugcaaaagcaaaauguuugaguuguaguuacaaccagcagaagcaaaucugaagucccacccccuauuauuauuauuauuaauuauuaauuaguuuuaauuaaggauauguccuuuacuccccccugcuaguaaagguuggcuuuguucucuuccauccagaauuuccaccaguuugcucucugcccugagcagccauccaaggaagaggaucuaggcuauguauggcugcuauuguagaaaguuaugggguuggggacuccacguagugggaaaacacugccuaauaugggugagaucuuaagguuacccuccguacuuggaagaauuuuuagaaaacagggguguggcuaucauggugagggaaacuucaaugacaugacuccuuaggguuuagacuucucguucguacucaguugaacgcuaacucuaaaguaaaccuuagaucuaaugagaaacgcuuugacuugaacacuugaggauuccuugguaucuauuaguuaguuuguuuauugauuuuuguuuuguuuuuuuuuuuuuuuuuaagauuuauuuauuuauuuauuauauauaaguacauuguagcugucuucagacgcaccagaagagggcaucagaucucauuacgggugguugugagccaccaugugguugcugggauuugaacuucggaccuucggaagagcagucggugcucuuacccacugagccaucucaccagccccugauuuuuguuuuuuuaagacaagguuuuucuauguagcccugucugccuuggaucuuguucuauagaccagaccgucacugaacucagagaucugccagcuuuugccucuugaguguugugauuagaagauuaacagugugugccuccucacccagcugcaguucucucuauuuuuaaguuuaucucauucacacucuuuuggggccuuggucuaaacaucgaugcuucuuccaucugucagaggguuuuaacucucuguuguauuaaugggagugugcugucuuugucccagaauggcugguugauucugaacuggaaaccuaaagaaaaaaaggaaauaagaugauucuucauggaaauuaguaacaggaaaggucuagauaggguucuuacuagccucccugacuguuaucaaaggagaagaagugaagauucugggcugggagaccacaggagaaaggaggagagaaagaagggaggucacagggcaccugccauuaacaccuuggaguucucuuugagagaggauuuaagguagaggauguaguugcuccugcggccucacauaguuccuuccuuucuccaccuucccgcagcucuguugguucaccuucuuagcugcacugcagcccuccagcccuccagccucagauggacauggacgucaccccuuccucuuugcagcccuccucacagggcaccuucucuucugcuuucaaucucucagcuaggucuuugucuuuuucuuucuuccuguacugcguugaggcuuugaaauguaauuugcucauuuuguguugccugguggcuugccgcacccagacaaggcucuucguuuccuuucacguauaacaaaaaugcugcaguuuuccaccucuaucucaguuuuccuucuuggaaaaguggcaaccaugguaccugauugagcagaagcaagaagcuuguucuuagcuaaggaaagaaguguaagaucaacuugagaguuacccucucuguucuucucuuacaggguaagagaaggggauacaggcuuauaaaggggaaaaauauucauauggucuucuuggaaugggcagaaguuuucuggggaauuuaaauucugccucuagcccagcgauaguggcauacaccuuuagucacagaaacugagagccggaggcaggugaaucuuugagaccagcuugguuuacaggacaaacuccaggauggccaggacuucacagagaaacaauguuucaaaaaaccaaaaccaaaaccaaccaaccaacaccuaagaaacaacaaaaccucugcuuuuuuucucuuuuuggggccuuuccaguuguuacuuggcaauugucaacugucauggugcuagggcguguagguuuucaguuguguuauaauggaguuagagacugucuugcagccaucccagcaaccuucuuacauuccuuaguuuugauuguccugcggagggagggguucugacuuuuaggcauccuguccucagagacaaacaagauuagggcucaguagaaaugcagcuggggugcuggguggaggccaggguucaagguuugaguggcuuuuccgcaaucccaggccaauuuacuauuauuuuaagaauuaugugguguguacgcaugcguguuugcgugcuugcgcgugugcguagguucuggcagucuuagaugaggguguuggaucuuuuggaguuguccaucuuauauuuugagauagucuuucacugcagccagagcccacuguuuuagcagacauauccgcagcaccaaugaacgauauugggggaugaaacggggcuuuccaaagguaccagggaucuuucaguuaaggacacuacuugaaagccucccugucacacaguaugaccagccagguagagcaaauaauauguccuucauguuuggucuccauuucguagccaagaucacugcacagcagcuaaauaagucagcuuuauucuuuuguacagagcuaaggaggugugagucuuuagggaaacacgauuuauaucaaguauuguaaacucacucuuguucuauugcuguuuggggguguugcuuguuucaugaagcuaguguuguggacugucuuugaucugaccauucccuggggaaugcaaaagcaaaauguuugaguuguaguuacaaccagcagaagcaaaucugaagucccacccccuauuauuauuauuauuauuaauuauuaauuaguuuuaauuaaggauauguccuuuacuccccccugcuaguaaagguuggcuuuguucucuuccauccagaauuuccaccaguuugcucucugcccugagcagccauccaaggaagaggaucuaggcuauguauggcugcuauuguagaaaguuaugggguuggggacuccacguagugggaaaacacugccuaauaugggugagaucuuaagguuacccuccguacuuggaagaauuuuuagaaaacagggguguggcuaucauggugagggaaacuucaaugacaugacuccuuaggguuuagacuucucguucguacucaguugaacgcuaacucuaaaguaaaccuuagaucuaaugagaaacgcuuugacuugaacacuugaggauuccuugguaucuauuaguuaguuuguuuauugauuuuuguuuuguuuuguuuuuuuuuuuuaagauuuauuuauuuauuuauuauauauaaguacauuguagcugucuucagacgcaccagaagagggcaucagaucucauuacgggugguugugagccaccaugugguugcugggauuugaacuucggaccuucggaagagcagucggugcucuuacccacugagccaucucaccagccccugauuuuuguuuuuuuaagacaagguuuuucuauguagcccugucugccuuggaucuuguucuauagaccagaccgucacugaacucagagaucugccagcuuuugccucuugaguguugugauuagaagauuaacagugugugccuccucacccagcugcaguucucucuauuuuuaaguuuaucucauucacacucuuuuggggccuuggucuaaacaucgaugcuucuuccaucugucagaggguuuuaacucucuguuguauuaaugggagugugcugucuuugucccagaauggcugguugauucugaacuggaaaccuaaagaaaaaaaggaaauaagaugauucuucauggaaauuaguaacaggaaaggucuagauaggguucuuacuagccucccugacuguuaucaaaggagaagaagugaagauucugggcugggagaccacaggagaaaggaggagagaaagaagggaggucacagggcaccugccauuaacaccuuggaguucucuuugagagaggauuuaagguagaggauguaguugcuccugcggccucacauaguuccuuccuuucuccaccuucccgcagcucuguugguucaccuucuuagcugcacugcagcccuccagcccuccagccucagauggacauggacgucaccccuuccucuuugcagcccuccucacagggcaccuucucuucugcuuucaaucucucagcuaggucuuugucuuuuucuuucuuccuguacugcguugaggcuuugaaauguaauuugcucauuuuguguugccugguggcuugccgcacccagacaaggcucuucguuuccuuucacguauaacaaaaaugcugcaguuuuccaccucuaucucaguuuuccuucuuggaaaaguggcaaccaugguaccugauugagcagaagcaagaagcuuguucuuagcuaaggaaagaaguguaagaucaacuugagaguuacccucucuguucuucucuuacaggguaagagaaggggauacaggcuuauaaaggggaaaaauauucauauggucuucuuggaaugggcagaaguuuucuggggaauuuaaauucugccucuagcccagcgauaguggcauacaccuuuagucacagaaacugagagccggaggcaggugaaucuuugagaccagcuugguuuacaggacaaacuccaggauggccaggacuucacagagaaacaauguuucaaaaaaccaaaaccaaaaccaaccaaccaacaccuaagaaacaacaaaaccucugcuuuuuuucucuuuuuggggccuuuccaguuguuacuuggcaauugucaacugucauggugcuagggcguguagguuuucaguuguguuauaauggaguuagagacugucuugcagccaucccagcaaccuucuuacauuccuuaguuuugauuguccugcggagggagggguucugacuuuuaggcauccuguccucagagacaaacaagauuagggcucaguagaaaugcagcuggggugcuggguggaggccaggguucaagguuugaguggcuuuuccgcaaucccaggccaauuuacuauuauuuuaagaauuaugugguguguacgcaugcguguuugcgugcuugcgcgugugcguagguucuggcagucuuagaugaggguguuggaucuuuuggaguuguccaucuuauauuuugagauagucuuucacugcagccagagcccacuguuuuagcagacauauccgcagcaccaaugaacgauauugggggaugaaacggggcuuuccaaagguaccagggaucuuucaguuaaggacacuacuugaaagccucccugucacacaguaugaccagccagguagagcaaauaauauguccuucauguuuggucuccauuucguagccaagaucacugcacagcagcuaaauaagucagcuuuauucuuuuguacagagcuaaggaggugugagucuuuagggaaacacgauuuauaucaaguauuguaaacucacucuuguucuauugcuguuuggggguguugcuuguuucaugaagcuaguguuguggacugucuuugaucugaccauucccuggggaaugcaaaagcaaaauguuugaguuguaguuacaaccagcagaagcaaaucugaagucccacccccuauuauuauuauuauuaauuauuaauuaguuuuaauuaaggauauguccuuuacuccccccacccccuauuuuguuacgcuuacauauauagaaauuacuuagcucacgugugagucacugucagauaauuagugugcauuggucucuuguaaaacuguccaugggugccuguuaaaagaguuguguuucucucuuucuuuucacuucuaggcagaggaguccuguaaaugcaauggcuggaagaacccuaaccccucuccuacuccaccaagaggagaccuccagcagauaauugucaguuugacagaauccugucgaagcuguagccaugcccuugguaaguucccgaaucagcugguagccauuccccaguggccugacaaucacacugcuggacucugggcaaaccacauuugccacuuuguugacaaggguccagagucugcugggaagugcuucaugggugagacagaccccaucugcuugcacugccuucuccuuugucuuuucaccauguuauaagagcugggggcacagaaggcuaaaguugaaauaggcaugauggcucuggugucuaagagguacaggccugauuuguccugguggagggggcgcccuagggcuuugguguuagguuugaaaccucaacuaaguggauaguuauguauaauaauaaucacaaugacaguaauuauuaauuaguuuuaauuaauuaauggagacaauguuucucuguguaguaccagcuauccuggaacuccaucuguagaccaggcuggacucaaacucaggagaucugccugccgcugcuuuccaaguguuggaaguaaaggcgcgugcuaccaugccucgcaauauguucguguggaaacuugugagggacagacgaggcuguuagaucccuugggacuggagcuacagaugguuguaagcauccauguggugcugggaauugaacccauguccuccgcaagagagucaguguucuuaacccagcugaaccucacuccaguucuccuaacacuacuuuuuuuuuuuuucgagacaggguuucucuguguagcccugacuguccuggaacucacuuuguagaccaggcuggccuugaacucagaauuccaccugccucugccacacacacacacacacacacacacacacacagaggucugaaccucauaauguugugccuuuuuuccuaagugcuggguaugugcaaacucuguuucaggucaaguucaguggggaacugguugcucuuggauaccagcauuucaguuggaaaggcugcucuuuuuacacuuuucugcccaugccaaauaaaucuggcuuacuguugaguauggcaaggaccugucuuuaggcaaaaugggaucaccaaguccugucuuacuacuccacccacgaccuguaaaagaguggcauuuugucauugucuuugccgguuugcuguugguccaaaugacauagcuccaccucugaagccaguccacuguuaagcugagucugguguguuucagugcauuuauugcacuguauugcauuuaaugcaaguauaggcauuucaauacuuagcaggcaaaaggacagacagcgguguggucuuccccggaagcugcugcacuggaaagcucuccacuaggaaacagaauugagaucucgcaggagaaaucaacacacuaauaagcgcaucauuguguugacugaacuggugucaaaaauaacccaagcugugacuaaaagacaaacgcucucguuacaaaaacaucuuguuucaggcuaaaggcugucauaguuuuaagcagugcaaagggaagauuccaaagcuuccagagaugucuuagcuuauaguaugccaagauuaucgcccaucugugaguugauagaccgggugcccuucacauugaaucaccugggaaauaugaugcaguuaacagagcuuaaggaaucuaccuacgacugggcugagcugugcccauauugauuugggaaauccuauuauccccaaucaauuaccauuaaaaaacaaagcucuuguuucuucucaagcugauaauuguaugguucuauacguguaagaaaucaucugccagaaguggcgcaagugacaaaagcuagcugacuuggcuugcuuuccuuuccuuuccuuuucuuuccuuuccuauccuuuccuuuucuuuccuuucugaacgaguguuggcagcagcgcccucauuuuccaauacacagugaagaauggaaaaacaagucugcaguuaucuuauuuuauuuuguuuuauuuuauuuuuugguccuuagugcuaggaaucuagcuaaggacauuguaucaauuagguaagugcuauacuacugaguuacaguccagcagaguguauacguacgugugugcauguaugugugugucuguguguauauagccccauguucuuuauacuuguaaauucacaccugaaauuaaccucuuuguaaguuaagaaguacccugagauuaaguuaaaagaauuuuacacucacuuaaguguauuuuauuuacucucugacgcuguaauacauaacucaaucucagcucucccuccgacuucucccaacccccagaugcauguccuacuuccauguccuguccugugaaccuacugaguucaauugguguugcuuguuggaauguugacaaagugauccuucccaaaggcagcaacagcuauucaauuuucaguguaccauggccuuccuuaggacaugcccauuugauuaguuagaacauagagcacaaggauccccaauggaggagcuagagaaaggacccaaggagcugaagcgguuugcagccccauaggaggaccaacaaugucaaccaaccaguaccccuagagcucccagggacuaaaccaccaaucaaagaguacacauggauggauccaugguggcagaggauggccuugucggacaucaaugggagagaggcccuugguccugugaaggcuugaugccccaguguaggggaaugccaggacagggaagcaggagaggguggguuagugagcagggggaaagggggugggauaggagguuuucacaggggaaacgaggaaaggggacaacauuugaaaucuaaauaaagagcauaucuaauaaaaaaaagaacauagaacacuguaaaggggugguucucaacuuuucuaaagcugcaacacuuuaauacagucccugggguaucugauauggacccuugugaaaaggucauuugaccccaaaggaucaugacccacagguugaaaaccaccucuguaaaggacaaccuaaccuuuuuugauuuauuccuuuuugucagagauaggauaccucagaggccagagauaugauccucuugcuucacuugcugaaugcuuuugaacugggaauccaccauuacuccauugcuuucucaauggaacugucuguacguuuucaagaacucaugggaauuuuugcugaaaugcaaaaauuuauuaauuugccaggguucuagaaaaccauuuugugagauuacaccaucuuccuccuucaacccugcuuaagaaaaaguaaucguaugaacuuguggauacacaucagauaguuuaacaaacugucuuggacccaucacccacuuaaugauuguuaacacccuaccacucuuuuuuucccuucaccccuaccuucaggggauuuugagcaaguucuuuaggcauuuaaucuuuguguguguguggugcuggaaguugaaucuggguucucauucauacugggcaaguauucugccacugagccauucccccaacuaucuaucuaucuaucuaucuaucuaucuaucuaucuaucuaucuaucuaacuuguuuauccaggcaaggucucaccuugugccuugccauggaaauacaucagcauguguuguaguguugcuaaucaaguugugaaugagggacuucuguaagaaccauguaaccccgacugccaugauggagacucuucuacaucuuuggaagcaggauaaucuguucagauacgaagaacauucaaucaaguguuaggaaauaauuauucacaagacugaggagacggcucaguggauaagugccuuuccucugaaaagaagagggccugaguucaaacucccacauaaaagccugucauggccaccugugauggcuuguauaugguuugcccagugaauggcaccauugggagguguggcccuguuggaguagguguggccuuguuggaguagacgugucguugugggcguggacuuuaagaccuucauccuagcucccaggaagucaguuuucuccuagcagccuuuaggugaagauguagaacucucagcucuaccuguaucauaccugccuggacauuuccauguugccucuuugauccuaauggacagaaucucugaaccuguaaggcagccccuauuaaauguuguccuugccaggcgugguggcgcacaccuuuaaucccagcauucgggaggcagaggcaggcggauuucugaguucgaggccagccuggucuacagagugacagccagggcuauacagagaaacccugucucgaaaaaccaaaaaaaaaaaaaaaaagaaaaaaaagaaaaaaaauguuguccuuuauaagaguugaccuaacuaagacaccaccuaugcccauaaccccaaugauaguaggcagauauaggcagaucccagggacucacuggcuagccagccagccuagcugaaacagugccgcuucagguucacugagagauacuaucucuggaaaaagauggaauguaugccuuuaaaaacaacaacaacaacaacaacaaaggaaaauggucugggggaugggugcacaucuuggugccagcaucacacggccuagacaaguggaucuuuuguuaguuugagaccagcccagucuaacauagugaauuccagguucucagagcuacaugaugagacucugcccugacuaaacaaaacauuuauuacugaaggcugugcauuuguucagaagccaguuuuuaagaccagaaagcaagagauacacgaggcgagcaagugcagcuguaaguuuuguuguuuuggaguucugaacacugucagcugcggaggaucagacuccaccagugagugaugagcugucaggauuguuuuuaaaaauaaauuuauuuuuauuuuauguguaugaguguuuuaccuucauguaugcauuuguguguauggugcugccagaggccagaaaaggacauuggcucuccuggaacuggaguuacaguccguugugagcugcuauguggaugcugggagcugaucuuaacuucugagccaucucuccagccuucaguuuucagcuuuguaaggaaguuguguguguguaugcacauggauauggaaguuggaucaaucucugugcucuucuucaggaaccccauuguucacuuugcuucuuuuuauuuguuuuuuuguuuuuuuguuuuugagacacagucacauuuuguaguccuggcuggccuggaauuuacagaguucugccugccccugccuccagaguacugggauugcaggugugugucccccccaccccagaacuaucuugauuucuuuuugagaccaggucucugggauacccaggaauccgaggucuuuaccucccuauucugagauuccaagcaugagauuccaccacaugcuuggaugauguugaugaugacgaucaccauuauuuauuuauuuauuuauuuauuuauuuaacuucuuuuucacugucuucuuccagcaccagugucaucagcuucaauugacguuuucagugcaaaugauaguccuuuguuauuuaauauuauguucauuauuucagucuuucuaaggaaaguagagguuacuucugaagucuguuuuuuuuuuuuguaaucacgauucucuugcuucagcuccuacgacugaaaagacagacaccacggggccggggggcuuuuagucuuugaaaaauacgacauaauaaaguauuuuguuuguuugaacuagugucucauguaauuuuggauggucuugaacuucuuucugguuuuccugccuucucccaaauucagggauugaaagucuacgauaucguaaccagccaacuuuaaguuucagcugcauuaaaagugaguccagccaugugcagguuucaaggucucaggguuacaggcuagagcaggaaacuugcuuuauuguccuucugcacagcacuuuuuuccugaaggcugccuccccagcuucagaucugguugcccauauauauaccucaugccuuuccuuuuuaguuucuucucucucuuccuuccuuccuuccuuccuuccuuccuuccuuucuuuuucuuuggggccagggaauucuuaaccucccaagccuaacaaugucagaacguauagagaaaauaaagguguucacagagauuggcuggaugcuucccuguguaugauugcaaauauuaccuguuuuucugaacugugauuaaagguugcauugcuugcaguuuacacuauauucaguuccuuggguagacuuggguuuauuccuuuacugguaaauaauuuuaaguuaaauaauauuugaggaggggagaggggaucugguggggggagggagaaagaggaggguuagcugcauugaguugcauuaauuuacagaugugguuucauaucuucggcucugugaguacagugcuuaaaacugaacugggccccgugagacuaacaacacuuuaaauggggcuuacugauagagucucagguauaaaaugaauacuuauuuugaagauggacuuccucaagugaauguaaacuagauguaauugucuucuuuaucuuucuauugcucugauaaaacaccaugacuaagccaacuuaaaagaacaguuuuagggggcuggagagauggcuuagugguuaagagcaccaacugcucuuccagaaguccugaguucaauucccagcaaccacaugguggcucacaaccaucuguaaagggaucugaugcccucuucuggugugucugaagagaucaauggugucuucauguuauauuucagguuauacuuccuguucuguuuagaggguuagacuccaugauaaaggagcaaaggcaggguacaggaacagcugagagcucacaacuggcuuugcaaggagaagguggagagucuuuugagacuucaagcccaccacccagugacauucuuccucuaacagcguggcacuaccuaauucuucccaagccauucuaccaacuauucaagcguaugaaccuacggguuccguucuuuuucuagcauggaguaugugacaauguuuuuggaguuugagcuauuuuaagccaaauguaugguuaaaguagccuuugucuauuucuuuuaccuuuucauaugcuuugggggcguggcaucagaaguaggacuggagcaaacccuacucacgcccacacuaaauuacagccaugaugggucuucuuuuuauuucaaauauuuauuuauuguguauguguguguguguuugcguguguaagaagggaagaggagaaugcucugaguagacccagacccucaaccuucccuuuacugagaugaaggcucucucauuucuguuaauugcuguaguggccuaaaagccucugguccagguuuaugugaauccuuuaaccauaggcgccaccuccucaggacuccucagcucuuccugugccuugauguuuauuguuguuuuguuguuuugccuuaguuuaaaacaggguuuucuauagcuuagguuggccugggcugccuggaccuucccugccucacaaguguuggagcuaugggccuacucaucacaacauuucuuucgcuuuaccauucucggugcuguuauggggacacugacaacugaaagcugguuccucugaguucccauugaccacugucaucgaccacauccucucaugggcgcgcugacucuuaggucuacuuuucccauuucaaauuugugauuaggaaagagaagcaguguuuacaugauccgccuuuugcccguuaauguguuaacaguuuucuuugcaggugcuaguuuucuaaccuuaggacauugugggcauuaauuuuaccucuucuagcuaagagaaaaauggauuucucggcagugugguggcacaugacuuuaaucccagugcucaggagguaugggcagauagguuucugugaguucacauccaucuaggccuacuuauuaaggucuaagccagcuaggguuacaugaugaggccucuuucaaaaaggaaacauaacaaacuaaagaccccaaacugacuacaacaaacugaucugugcugcuuccaaauugcuuagacacuuggugcuugcuucuggugcaaaggaucagggacacacuuguuuccaguucagcaggucucaaaagaauuggcaagcuagccuugagaaguccaggugaguguacuuaguggaacuuagcgaaggucacagcauacagagcuaugggucugcuguacuauggguccccuguaagguaacagcuacacugauucucaguagcagguacacagcugguaccucauggcuugcugguguuuguaacgugacagagaagcgccaaggaacacucucccagagagauaucaagaauuuuccuuuccuuucccuucccuuucccuuccuuucccuuccuuucccuuccuuucccuucccuccucuccccugcccuucccuuucccuuucccuuccuuuccuuucccuccccuccccuuccccuuccauuuccccuucuccuuccccuucccucuccucccccucccucucccccuuccccuuccuuccuuguuccuuuguuguuuuuguauuuuugaaacaguguuuuccugguagcccugguugucuuggaacucauuauguagaccagguggccuugaacucacacuaauucccugccucugccucccauggcaugcagcaccacacccugcuuuaaauuucuucuuagugcuuccccccacccccaagacaggguuucucuguguaguccuggcugucuuagaacucacuuuguagaccagacugacuuugaacucagaaauccaccugccucugccucccaagugcugggauuaaaggcgugcgccaccacugcccggcuuuuaaauuucuuuuuuuuuuuuuuuuaagauuuauuuauuauuauauguaaguacacuguagcugucuucagacacaccagaagagggagucagaucuuguuacggaugguugugagccaccaugugguugcugggauuugaacucuggaccuucagaagagcagucgggugcucuuacccacugagccaucucaccagccccuuaaauuucuuuuuaaauaaaugacuauuuuuucccuuuuguuuuuuauuuuuuguggguuacaggucccaaaagucuggaaaugaaccugggagaacugggaagugauugugauugggggaauguauggugugaaauucccaaauaaucaaaauaaaaaauauuaaguaaaaaauuauucauuuauuuaaucacaugauuuuuuuuuuaaauuuuuuuuacuugaauguauguaugugcacugcaugccuggagugcccacagagaccagaagaaggugucagaacacaacuccacugacccagacuagaauaaccaacaguugugagcuuccauguuggugcuaggaacugaacccagaugcucuggaagagcagccaggaccaaauccacucguuuaacacagguccucacaaacuccguaagccucugcacagcauaugacagaccauuaguaccugauuucuuuuaaggcaguaggaaaagacgggcauccucacaacguaggcagaggaguuggcagugcuagagaggacaguaucuguggaacguaauggccgacaccuaaggcauccagucagugcaauagagcaccggcagucauuacuguuuuacagcacagucuggaugagaauccacccauuaaggcagugguggaaggccagaagacccuuccacauuacugcuucacugugcugaugagacuucucgagggguaggaagaacucaccacagggaguagcacaccccagacaggcuuggcaggagcugggacuuggcacgauuauaaaguugaaaccagccaggacaaugaaguacacagugagacuuugucaaggggaaaacaaggcaaaagccaaaaccaaaaccugggcuucaaagugcaagcuuguaauuccugcaguugggagacagaggcaggaggauugccacaaguuugaggcucacaggccagccucgucuacaaagcaaguucuaggacaguugggacuacauuguaagacuugagaaaaucaauucaacaacacuucaggaaaggaacuaauuacauuuucauuuauuucuaaggcuauauauaguuugcauccaugugagauuacaaguguuuauaaacaggaaaguuacuguucaaaggugguuguggugguacacacuuuuaauuucagcccuugggagucagaggcaggcagauuucugugaguuugacaccagccuugucuucauaucaagcucaaggccagccuggauuacauacugagacagugucucaacaauuaaugaaugaaugaaugaauaaauaauuuggggcauggugauacagaccuuuaguuccagcauuuacgaggcagaggcagguggaucucugucaguucaagucaagcuugguacagagagcuaguuccaguacagucaaguaaagcuauacagguaaagccugucuccaaggggaaaaaaccaaauaaguuaaauuaaaaaaaaaaaaagaccuauguacauuuuauuuuuuauuugacuacaguauguggccaucucacuuaugacaucaugcucagaauuagacuucguauaaguagaacaauauuagggcacauuuuucuuaggucgucugugcagggucuuccuugagguccgucggaagccuuccagggacagaccucauuuuggagauaaauaggcuaaaauuuuaaugucgucaguuaauugcagaaauccuuauuuccugguguugccacucaaggcuggccuugugccgaucauucuccuguguaagccucuuguguguauaggugugugccucuuggucuuuugcucucccuaacuccugucaccagcuagcuucuucaaauggcagucuaucgggagccucuagcaucccuaucucaaaaucauaagggugccaccagcaaggucaaucggacuccuaaaacaaugugucaaucgguccugaaaugauagcucuccuggcucuguccucaucuuccuccccaucagccacaggauucagucauucuuugucaccuuccagagccgcuguauuuucuuaaacucuagacugccugcucuguucccaggguagucugaacauggcuugacucaaacaacccacaucucucugagauccuaagaucacucgucuaaguuucucucuccuugcuccuuuauguaaguuguucagacacaucagaagcuuggagggggguagggcucacauuuaugccacacuucucauucauuggggcugugugcuagaauugaacgugauuaacuuaucucuggacucuaagcauuuaguuauccucuacugauagaggauccucuacugaaggaggcacccaggggugccucuuucuaaccacaaggcaaauuucgucacugauaagcaacucauuaaguccuaaagaaccacuaacuacaaaauuaagaaaaaaauuaguuuuauuuauuuauuuuucauauguauggcuauuuugccuuuuuauauugucuaugcaccacaugugugccugguccuuguggaagccagaagacaucaaauacccuagaacuagaguuacaguugguuauggaccuuuaugugggugcuggcaauugaaccuggguccuggaaaagcaaacaguccucuuagcgucugagcaguauauucagccuccuuaagucuuucuaaagcagauuuuugauguaagcagucaugcuuuguuuuguuguuguuguuuuuuuuaagucuauuuuugucuauuguuugcauaucugcugaggaaugaacucaggaacccaugcaugcuaggaaagugcuuugugaaacuacaccagugguuuuuaagacaugggucuuggggcuagagaaauugcucagccauuaagaggacuuucugcuuuaauagaggacccggauccaauuuucagcucagaaauguuugcuaaugcuagugccacggugucccacccucucuucuggacuccuuggguaacaggcagauguaucauauauaugcauauguguaggcaaacauacacacaaaagaauaaauaaaaguccaagagaugaucuuuaugcuugaaaacugccaagagaguggauuuuaaauauguucucgcuacuaaaacuuggcagaugucucucucucucucucucucucucucucucucucucucucucucucucucacacacacacacacacacacacagcaggcaaagauggaagcagaagcagguagaucucugaguuuagagccaacaaggucuacauagugaauucuaggcuauccaaggcuacuuagugggccgaugucucagacaaauuaaauaacaucccuccccccaagaaagauaaaaauuaguaaauuucaacauggaaauccuuaguaguuaacccggcacaggggaguucagcgggaugacauacaaagccauaugauauguggugacaugugagcuagccuggggaacauagagccugguucaucuguagcagcagcaaaccucagacgcuggaguaccaaugaggcuuuucuuauuauaacuauuuuuuuacguagcaugcaaauaaugggauucaugguggcauuuugauacuauguaccauugaccccucugagucuuauucuguaauccagguucuuccuaaagucucaguucuccugcaugcugggauggcagacauccacuaugcccagcucaucaguuccuuuucaacucgauaacgccaagguguaguuuggaugcuugugaauucaaauguguucucuggauuuauucaauuaagaagauuacagaggcugcuuuggccucuguaguuuuuguuuagugugugugagugugugugugugagugugugugugugugcuacaguauuuuauggagucagacuguuuggagcugguucacuucuaccgugucagacaaggagauugaccugagggugucagucuuggauauaaauauccucacccgcugagccagcucacugucagcccccguacacacgcauaggugugaacaugcuaugacacgugggaggagguccgaggacagcguuuacgagucuguuccuugcacuguggguucuggguauugaaccugggucaucaggcuuguguggccaggguguuaacuugccgacccaucuuacuggcuccacuguuuuguuuuuguauuugggaccuugcuuuguaguuccuguuugccugggauuugcauccccucggucucagccugccaaggguugggauuucagguuagugccaugaugcuaggugauaaccugguuuacugugcaugaucuuuacgguugucucuuacaccucucgcuuccuuuggucuuacccuaagcugcucacguuucucacuuggagaaugugucagaggaagagauggacagacuccugggaauuguguuggauguggaguaccucuucaccugcguccacaaagaagaagaugcagauaccaaacaaguguacuucuaccuauucaaggugagagcuuacccuuuuauuuauuuaauuaauuacauuuaguugcauacucgugugugugcaggcaugcacauaucguggcucagauauggagauuagagaacagcuuauggaagucauuuuucucuuucccacauuggguucucagggauuaaaucagguuaucagcuuugguagcaagcaucuuucccugcuaaaccaucauguuggguucuuauuacuguuaaaaugacuuauuuuaauuaauuaauuaauuaauuaauuaauuuuuguuuuucaagacaggguuucucuguguagcccuggcuauccuggaacucacgcuguagaccaggcuggcuuugaacucagaaaugcaccugccucuacuucccaagugcugggauucaaggcgugugccaccagugccugacuuacuuaauuuuuaauuauguguacauguguuugucuguguaggaauaugugcacaugaguaugggugcccacaaaggcuagagaggcuguuggaucccuucaagcuggaguuguagguaguugggaacuauccaacauagauguugggaauugaauucaaguucuccagaagacaugcaagugaucuuaaucacguaaccaucucuccagcccccuuauuuuuauuuuaugacacauuguuuugcuggccucaaacucucuguguugcugaggcuuacuuuaaacugaccuuccugccucucuaccuuccaggaccuagaaucuaggugucacgagugugaggugagauuuuugccuuuccaaagccuuuuauuuuccugucgucaugauggugaucacaugaugaucccagugccucgugcagugugugggaagaaggcacugagcccugugcuugcagaucugcuucuucaggagucucuaaaaugccuuccuucacacgggugugcagaacuggacagcuugauucacguacacucauagauuucuuuccgcccaccaaacgggugcuuagcacagccuguaucagagauggcacugagguaucuugagggacagagcuguagcaagacaaaguucuuccagcauggaguugcaugucagucaaggauauggucagugaauaaucaggaauggguugacaauguuaaagccugugaaggggggaaggggcggcuggagagauggcucagugguuaagagcacugacugcucuuucagagggccugaguucaauucccagcaaccacaugguggcucacaaccaucuguaaugggaucugauguccucuucuggugugucugaagacagguacaguggauuucauauacaaaaaauaaaucuuuaaaaaaaaaagccugugagggacaaagagccauuccugccagggagguuugcaggcagagucuguggcauggagucacagcagugaagccaucaagguagagccuggagacaggugucaauggaaggaagggcaacuucuggggaagucugacuguccccaagcugcgccuccuucauucacauggcuguucacaggugaugauggaggacaccuugucacaaccucauaggagguggcagaaggacaaguaaaacaagaaaccugagcuggagagauggcucagugguuaagaguaccuacuacucuuucuggggcucuggguucaguucccagcauccaugcagggugcauuaacaacugccuggaacuccagcauccaauaugcacccuuccggccucugcagacaccuguacacaugugugcauauacacacaugcagccaaaacauuuauacacauaaaaaaagaagucuuguaaggaaacacacagagagaccuguuuuuuagaucuuugccaacauuuauuguguaauccuuguaaagauguuaagaaacacaucaaaacagaaggcauggccagaaacaugugcccgagucuguauuuucuuuuccucuuuuuuuuuuuuuguuguuguuguuguugguuuuucuuuuucuuuuuuucuucuuuguuuuucgagacaggguuucucuguauugcccuggcuggccuggaacucacuuuguagaccaggcuggccuggaacucagaaauccgccugccucugccucccgagugcuggaauuaaaggcaugcgccaccaugcccggcaccuccucuuuuuuuuuuuuuuuuucuuuuggagacaugguuucucuguguagcccugacugugcaggaacuuacucuguagaccagguuggccuagaacucacagaacccugcuugcuucugccuccugagugcugggagcaaaggugugcaccaccaauacccaacuagccuccccucucuggucacacucucuuuuucucuguagugauguguguguguguguguguguguauuuugcuuguauguaugucuauauacuacaugauugcaagguacauaccagaaauuuagcuauguucauagcucacaaaagcuuucuucuuuuccugagagcuagugcauuuaaauuauuuuuaguuuuuacuuuuugugauaguggggauugagaucagggccuuauauauuacuuuguauuccaauauggacacgugcuauuuuugaacugcauuccagccucugcuuauguuuuguauggcagagagagcuaagucauucacugagauccugucuuugccauagcugcugggaaucucaguggauucucuacaggauucuugucuuuaucuaaacauuugcucuguaguuuccccuucucuuuguucauuuguuucuuccuucuuucguucauuacuuaccucccuucuucccucccuccuucucuucuuuacuuauaguuucugcuguauuaacugaaggagggggaaggaggauccauuuuuuuuucguuuuuggguacuauuggaaaaucacagaugggaugaguugggugggugagugagucacacagcauccgcaggauaggccccuuagguggcagcuuguggacauagcuguggggcuggagucauuugacucaaucaacccuggcaguuuguagcugguagugcuucuuuggagaaagaucuuuguugagggaaaacaagggcugcauaacuuuagcugguguuugucucggagcaagugaccccgcaguuuucguugccuugcaagucaagaugcugucaggcuuuccauccuguuggcccuguggcuugcagccaguagaacaagccagugagcauuggcccaggcuguaggucucuggccuuugcccucccucauuuccaaacgacaggaaagauauauuugcuucucaagucagaaucuaagauagccaguguucucuucucucucaaccauccccuuuucuuucuuuuccugagaccuggucuuucuauguaauucaggccaaucuuuuuguuguuguuugaaagaggaucuuucuguguagcuguggcuagucugaaacucacuagguagcuggggcuagcugugaacuuguagcaauucuuauugccucagccuccugaguacugggaugggagcaugagccauggugcccaauuuccagcucuaucccuuuauauuugagaaaauagguucacugucucccaguucauaucgauuuaccaaaaaacuaaccauucaguggauccaguucccaaggggcugagauaggaaagaagaucuuaucuaacucugaaaauaaacacagggacugggauuucuugcuuuuaaaauucaugacaaaucccguuuaguuuuguuuuaagauggagucucguguagcuuuaaacucagcauguagcugaggauggccuaagcacucugauccuucugccuccacuuccgaggucugggauucuagccagagcuacaauugauucaugcuuaaucuuuaacacugcaaacacacagugcuuaccuuuauuacagcacaucgaaaggaucaguaacuccuccacauccauaacguauaugggcccccuagaagguguugugcucugagggaaauauuccucuuucuguccccuuuuuuuuucuuuggagccuuugauucucaggcuggaauuagaagcgguauauuugguuugugggcccagagaacaugcaccuggccucuacagacagagaaggaguggaaaaagacagagguagagaaagcuccuuccaagcuucugagccugcgcuccuggccuuggccuuaugugugcagaguggagccugcuuuuucuaguguuuaagacucugagagcuucagcuaccugugguggccucaaugagucucacugggccucugggucccuagcaagcaaaaaugggaaagaaggggaaacugaaggaggaguagagugguguguguguguguguguguguguguguguguguguguguguguguguauguguguguauucagugcaggauaguccagacugcucagaauugagagguuguuuggcucuguuuaaacgcaagaaggcaaguuuuugguaucuaggaguuugaguaucugacuuaaagauuaguucuuauauauguagcuaaguuggugauuucucuuaaagcuuagguauaugugggguaaggugggggggaggaaagaaauagauguaguaugggauguauuuguaugugugacuauguguguacgcaugcgugcuuuaaaugcuagauacggugguacauaccuguaauuccaguacuuggaaaauugaggcugagaaagaagggccacgaguucaaggucagccuggacuacauagggagacccuguuucaaaaaaccaaaaccuggaccacauaacuacaaacacaccauaaaaaagccuuucaaacuaaaguuuguuuuaaaaaaaugauuucuuugcagcucuugagaaagucaauuuuacaaagaggaaaaccugugguugaaggcuccuuggagaagaagccgccauuugagaagcccaguauugaacagguaagcauauuuagaggagcucuuuuuucaugcauuuaaggcugaaggcccugccagguuuuguuugcuggguucaaaccuggaaccaguuagccaucauauaccauuaagauauauucuagccugaagauuuuaugcuuccuucaacauuucuauauaguucuugcauccauccccacccagcuacaagauguuccuacaaauaggggcuggugagauggcucaguggguaagagcacugacuguucuuuccaaaguccugaguucaaaucucagccaccacaugguggcucacaaccaucuguaaugggaucugaugcccucuucugugucccauguacgugccuagugucaugaauauucuggcuuuugucuuuugggaguguuguucacuuagacuccacucuguauguaggagaauugaguagaacauguaguuaguaagaacucauaaaacgugccuuuucaugcuuuugagaucuaaaaaugaaggcuuuguguuuauuuauuuauuuauuauuuauuuauuuuuuccauuuuuuauuagguauuuagcucauuuacauuuccaacgcuauaccaaaagucccccauacccacccacccccacuccccuacccacccacucccccuuuuuggcccuggcguuccccuguacuggggcauauaaaguuugcguguccaaugggccucucuuuccagugauggccgacuaggccaucuuuugauacauaugcaauacauauggagucaagagcuccaggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggcuccggcauagucucacaggagacagcuacaucuggguccuuucaauaaaaucuugcuaguguaugcaauggugucagcauuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagguuuggggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauauaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaguuuucuaaggaacugccagauugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucuaccauucgguauuccucaggugagaauucuuuguucaguucugagccccauuuuuuaaugggguuauuuggcuuuguuuuuuuauuuggcacugucugaaaaagccuauugaggagagggaguucauuaaagaugugguaaacauuguaacuugguggggguggaggugggaguuaauucuaauucuagugauguuucuguugcugugaaguaccugauuucaguuguugugauaaaauaccugauuucuguuguugugauaaaaauaccucauuaaaaaaaaaaaaaagaaagaacaguuucugagaaagauguuucuucaguuuacaauccagauugcaguucuucauaacaggaagucacaguggcaggaacuccaggaagcuuaucauaucacauucacagucaagagcagaaagcagugaauucauuuaggcuugcuguguucaguuuuguuuacuuaugcuuaagcagaucagaaccucagucauagggaauggugcuacccacagugggcuggcucaucccacaucaauaaacuggauuaagaccauucucugaagccaugcccaacucucuaagacuguuuucccaggugaugacuguaggucaaguugacagcgcuaaccaucacaauaugauaccagcguuguuacaaauacaugacuuuuuguaagaauaauuuuuuuccuccuccuccucuucaucuuugguuuauugagacaggguuucucuguauagcucuggcuaucuuggaacucacugugcagaccaggcuggccucaaauucagagauccaucugucucugccuuccaagugcugacauuaaagcugugcgccaccacugccuggcugagaauauguuuccuauugauucuaaacuaggaagacuucuugaucuuuuaugugaugagaugggaauauuuuauagaaaauuuaaaucaaccuauaacucucucggaaaaguacauauuuuggcgguuaguucaagaugagguagugaacuuuuaaaaaauucacagacagaaacaauuaucccagaaccucauuuauuuaaggguuuuuuuaccccuucccauguuuguccgggauuugcucuuugaugcuucagauugaagugggggcaaaaugauaauucugauuuuuuuuauuuuguaacuucuuccacugugaccagaagggagauuucccaugguaguagugguucuuuuuaagcaaagggaaaacuuuuuuuucucuauugagaaauuaucuuuuuuuuuuuuucuaauaaccacugagguaacuggcuguauucugaguuaauaugguuaucuagcuucauuaacaugcugcauuuccaucuuuucagggugugaacaacuucgugcaguacaaguuuagucacuugccaucgaaagagaggcagacaacgaucgagcuggccaagauguuucugaaccgcaucaacuacuggcaucuggaggcuccaucucagcggagacuacggucucccaaugaugacaucucuggauacaaggaaaacuacacaagguaacugaguucgaauccugcagccuggcuccaaagagaaccuuucaaggcaugaaauuacuauucacuucugcucugcucagugacuccauucacucagacagcaugccuaugcaguuuaguuucaaguucuaguuuuaauuaauuaauuaauuaauuaauaauguauuuauauuuauuugucucucugcccugccauguauguggggguuguagaaacaggcuuguagggaucggcucucucuaccaugugauacagagaaauguuacccaguccucagguuugguggcaagaaccauuauccacugagccaucuuacuagcccugaugauauuuuagauaaauuaaauuaaauaggguuaauuuaacuucuaguuuuuauuucuucaauguggcuacuaugugauuuacaacaucuacaggagccaagacacaugccuuuaaauccaacauuugagaggcagaagcaagcagaucucugaaaagaccagcuuagucuacuuuagugaguuccauauuauaugcucaaccaaugcuauauaauaagacacugucacaaagaaaaaaauguuagaacauggcuuauauuuuuucauuuaacuuuuugguuuuaauuuuaaugauuacaauaucauauaguauauugacaugaaggauaaauuagaaaacaauucugcauguucauuuuccaaaauauaaaggcuuacauucaucuucaguuaaguagcugugggaagaaauuuuaucucuuuccaugauauucauaccauguauggacuuguuugagagagggugcauguagcccggguauccuugaacucacuauauagcccaggugaauucugagauuacagguguguaccaccaauccugugcuuguagcucuuacuggagaaaauuauuguuucaucaagaaaaaaagggacaaaagagaaagaaagaaagaaagaaagaaagaaaggaaggaaggaaggaaggaaggaaggaagaaagaaggaaagaaggaaagaaggaaagaaggaaagaaggaaagaaggaaagaaggaaagaaggaaagaaggaaagaaggaaagaaaggaaggugaauaauuaaaaaaagaggugugugcauaccugugcucugaagaugcuaaaaguggaggcaggaugauugugaguuucaggccacagucuuuaagaggggguuuggagguuugagguagaauggaaggagaagaaagagaauuaaauguuaaagaaacacgagcgauauugccaaauuuuagaaaacaaagugaagcuggguguggugguguaugccuuuaaucaaagcacuugagaggcagaucucugaguuggggggcagccugaaugaguuuccggacagccagaacuauacagagaaacacugucugcaaaaaaaaaaccaaaaaccaaaaaacaaaaaacaaaaaacaaaaaacaaacaaacaaacaaaaaacccaacccaaaccaaccaaccaaccaaaccaaaccaaacccaaauaauuaguagagggaggcacuucggaacuaucaagaaaugguuggcacauaauagauacuuagagaguggcaaaaccagaaauugggcucucagugggcucagggcuugucucuggucccaccuuccucuaucugugugagcuguagagcagccuucucuuuccuuacucucagcuucuugcucuguggaguuguauccucugagaaguuugcacugcugucuggcauaaaccaguuacagggaagauuuuggguuuuguuuucaccugccucccccaccagugcuaucuagaacacagucugccaauguaggguugucaagacuaauggacaguugaacgagaguguugguauuugagugagacuuuugaagcugucauaguauaugauagaaacaggagaagaguccuuuggugcucagcuuccccccuggaccaaaaagguggagcuaaccaugagaagagaaaccugcccagagacaguggauaugucccuguauguccugggaccuguucauuucuagaccaagagacucuguuuauaauaggagggaaugaagguagaugcauucaccucagcguccuccaucaugcccuuugaugaaaggaaacagggagaagaacccagcaaaguugaggacaauuggggaaaaaaaaauaaaacaacaaacagaccauacuuacagaacacuauuaacguaaaaaugaggcaagugggauucucuguggugaauaaaggucugaagcuuuauuuauugaaaaaaguaaaaagcaaccugagauggcacaugucuauaaucuuagucccagggaugugaucccaggagggucaggacugcaaggccagacagcuacaggagaccccaccucaaaauacaaaauaaaugaaacggauuuaacagaauugcuuggcacucuuaugaguaaaagaaaagguguuuuaaguuuuacauuauuguuuagucaguugugguaguucauggaucuugguguuugaggcuagccugcucuacacagcuaguuccaggccagccagggcuacgaaaagagacccuaucucaaaaccaaccaaccaaccagccaaccaaccagauaauuaaaucuuuuauuaugauauucauaaaccauaauuuuuauagcagaaaugccaguuucuugauugucagauaccuauaaugcauuuuagacacaagcuagcacugcuuagauacagaugugaagcccagauaggggccacaugugcaaaauaguaccuacacuguaugaauauguauauauguauguauauauccauauaugucugucugucugucugucugucugucugucugucugucugucuaucuaucuaucuaucuaucuaucuaccuaccuaccuaccuaccuaccuaccuaccuaccuaccuaucuaucuaucuaucuaucuaucuaucuaucuaucuaucauccaucuauagagaggagugagcugagagaggaaaacagaaguaguguaguguuuuaagacuaugaaucugggaagauugcucagugauuuacugcacacacugcucuugcaggggacugguguuugguucccagcacucauauuagguggcucauaaccaccuguguguaacuccaguuccaagggauccaacacuguguuccuccucaggcacuaggcacacauggugcauauacauaaauacagacaaaacgcuauaacauacauagacuaaaauuuaaaaagaagaaaagguuguggaucaaggcagacauaauaacaccaacucgcuucuccccaaggagugacucaugcuuguaaccccggugcuuaggggucugagguagcaguuuugccaugaguucaaagccaggcuacacuacagaguaaagcugucucaaaauauggggguagggugggacgcaagcaaaaagcuuuuuccuucucgucuacccaucuucuuucuuucccucccucucuuccccuucccuggauaguucagauugguguugaaccuaccauucuccugccuuggccuaccauguaaggagaauuauggguguguaugaucaugaaagucuuccugcuaagagacacagcacagcuccauugcccccuacauaggaucguuuggggucagauacagacugaggcccccuagguguacagcagcacgccauucauuccugcccuugcuucaccuuaccuguuagcguccucauuggauggaggaagguuuuuauuuuuuauuuuuauuguuuuggauagcagcccuggccuggaagagggggguuugugcaaugacacauucccauggcgucucccauacuuacugcuacacucugggaaucccaugaucucugcuuacugcugucucuggaaguaguagaguccaccacaucuguagacuggaaauccaagggacgguuucugaaucuuuucauuuucaagcacuagcguugaaggaaguuuucuaaauuagauggccccgauggucagcucgcugcagaccucuggucaggucaagcaaacuggguuucucuucuaucccacagugcugaaagcagccuugacuuugaggcugcagaguauaccuaggugacagauggucaaagcuucuuacuuccugcgccugacugggguuugaacagucuuaaagcucuuuaucuuccccccacagcuucggcaguaagagagugucaucuaggcaguucauucauucauuuguucauucuauguaucauaaaaaagaagaaaaguguguguguguguguguguguguguguaugugugugugugugugugugcacgugcaugcgugugugcuugcauguauuugagaggaacacaguauuaauauguagcuagcccagaccggccacaaacuuacaugauccuucucucuuggccaccugaauacugcaaucacagggauaugccaucaugccuauagguauuuuauuagguuuuauuacauuuuauuuauggugugugcgugaaauguuggcagcaagugauuuuuccccuuaagugacgccacauaaggaaaugccucuguugccuuuccuuuuuguuucucacuuauauagcuugcuuauuuauuuauuuauuuauuuauuuauuuauuuauuuauuuauuuucaguucugggcucaaaucuaggaccuugcucaugcuaagugagcuuucugccucugagcuacaucccaaacccacuuuauauacauacuuuaaauuuuuuuuuuuuuuuuuuuuuuaguuuuaaguacuucagacuaucuaaauaucuacaccuaccaaauaacuuaaagaaagaaauuuuuccaagucucugauuagacaagguccuuuaggccagugagaugugguauacacauuuuucagcugcuuacuaucagucuuuaaaaauaggcuguuucagauuaguaggucuucuaauugaggugcucuauuugaaucugaccuuacauggacagugacaggauuauaccuuacaguacaucugauuaugccacauuuuggcuucccacgauucagcaacccaugcaggcagccauauuuccuugguguucaauguguuaaguauaaauucuccuccuugguccucaggaacuucugugcuggcaugcagggauguugggcucaguccucaguacucuuccacuuuagcgucuacagugcugggauuauuggacauugcuccugccuauacuuucagcauaagcucaaauuauacucuguaccuuacucgugcuaucucauucucuagaguccagugaaguaguugugacuugucucuguuuuauaggcaagaaggugggcacugaacaguguaguauauccauguaguuagucaaguggcauagcaguauuggauuccaggcucccugcacaacagaauaggaagaggccaacaggucuaccagcugcucuuauccugcacucacuucuugcuaguaaucuugcugguugaucuugcuggcugguauugaaggucucguuucuuccacugagcuucauugucuagaaggucuuugugauaggauguuuggauggcugggacuugauggcuucuuugugauuggauguuuuggguggcugggacuuguuggcuuacugauggaacuugucuccuucuugcaggugguugugcuacugcaauguaccgcaguucugugacagcuuaccucgguacgaaaccacaaagguguuugggagaacauugcuucgcucggucuucaccaucaugagacgacagcucuuggaacaagccagacaggaaaaagacaaacugccucuugagaaacgcacgcuuauccucacacauuucccaaaguaagggguggugcuuaugggauuuugcuucaucccagggccugaggauguggagaauaggccaaagccugcuuaaguaccaaaaucaugaacauccgaguauaucagugcuuucacggacuccugugguuaaauaagacacagaaacuucuaauaauuuaaagcuguuggccuuuggugggacagucucucagcuaggucgucuaaauuuauccuaacuucucugccauccagucucuucccaugcuucucacuuccuacuuacaguucuuucaauuccuucaugcccugccucuaccuucucuuugaguguccuucuuccauccugcuucucugaggggaagccaucagcucuuuauuauacaaaagccauacucuaaucugaaccaagcagcaucaagacaauacccauucaucucuuaggguugccuuuaggcuaugagagcugccugaccuucaucuuuugggcaugugagaaaggacaagcauuuacauauagaaaaccuggugauggaccauagaaaugagaauaucaaaauccugaguguugugaucaaauguguguacccagccauuauuaauuuuugugguacugacacuggaauugaauuuagagcuuuuuuuuuuuuuuuuuuaaagacagggucucucaauguaacagcccugacuguccuggaacucacucgguaggcuagacuggccucaaacucacagagaucugccucccaagugcugggauuaaaggccuguauguuuuguauguuuguuuuccuuuuuuguuuuuguuuuuuuuuuuuuuuuuuguagucccuuucugaauugcccagacugaucuugaaguggugaucuuucugccucagccuccugaguaccugggauuccagacuggugccaguaggucugguuucuuguacugguucuaacaagugccuuuccacuacucucugaauuguuacaagauuccuuccuuguuuuucuuucucucuuuuuccaaccccauugguuaauuucucacccacccucuuuucuuuguuucugcacuuuccauauuucucuuucuucucucaguauugaaguggggaaaaagguacucugugguggcaucgggcuauuuccuguugcuggccuccaguugcuguugagaugcgguugguugccuuaguguguugugaaguccauacagcagauccccacuggucucaguucagacccugcucuuuaguagucaugggaauauggaaugcuuguuccaucccucugcacuuugcauguuuccauggugcaguggauucuauuucacaguggccuuaggaggcucaacuaagggcaucaaucccucaccacacugucaaguaaugagagcuguguaauaggggauaccuaaucacagcaguagugaggcgagucaguguggaguuccagaagcuccaggagcaggacaggcauggguguaagggccuagucaguacacagugacauugguggugguuucuacgccaaugacuuccacauagacagcuggaaucugcugugcaucucaccaaguauacaucaucugcuuaguacucuagccagugcccuaccaagcuacucagggguaaaggagauguuuauagagacacaaucuguacuugaauacacaggaauguccaucugaauccaucucuggcaucauaauucuaaugcauuuucuaacugaagugggaacccuguugcuuggugaagguugcuacaggugacugaugcucugguaguaaaguaaugguauauuuuauuuauuuauguagaaaguuuuuauuuuauuugugugggugauuugccugaguguguaucugugcaccacgugcaugugugguguccauagaagccugaagaggacacaucacugcaacugaaguuucagauguuugugagcuaccaugugggggcugggaauugaaccugguuccuguggaaaugcugccaauguuguucuagaucacucagccauuuuuuccugccccuauuuuuaauuaaaaauacuguuauuaacucuuuguuaauuucauauauuuugaucauuuucaucuccacacacuccucccagauccacccuuugucuccucuuuucuuuuuuuccuuuuuugguuuuucgagacaggguuucgcuguguagcccuggcuguccuggaacucacucuguagaccaggcuggccucgaacucagaaauccgccugccucugccucccaagugcugggauuaaaggcgugcaccaccacugccuggcuucucuuuuauuuuuaaaugacccaucaaguccaauuuguacugccccuauacuucuuauuguggggauauccaauggaacaugguugaccuaccagaauccagacccuuaaaacugacuuuccuacccagaagccaucuuuugagccuacucccacuccaacuuggauuguugaccugccugaucuugcauaugucuuguacaggcauccgcagaugcugugaguuacugcguguagugguucuuauguccugaggacauuguauugcagucuuuccugacaucuuauagucuuuuuguucccucuuccaagaugguuuuugagccuugaggaauauuuauaaauuuuagaagcucauucuuguuauuuucugugccuagguuucuguccauguuggaagaagaaguguauagucaaaauucuccuaucugggaucaggauuuucucucagccucuuccagaaccagcccgcuaggaauccaaacagguacaucccuuuuauauaaauuggaaagcaaccaggaagcucaagccaggguguuaguuguaguguugcguuuauuuguuugucauaaggaaauagaugucuagagccuguaagucugguaucugcaucacuguuaaugaagaacaaguaaauacuaacucaaauucuucaacuguguuuuguugaugagcagugcaagcacaaaccaaacaguugaaaccacguuaaacacaggaagucuuaguuuucauagucggauuaauggaggaucaaaugucaggcagcucagcucugucaggagauagugaccuuuugaagaugcuaaugcaauuguauuuauuuucuuuucuguugcuauaauaaaauucucugauaaaaaagcaaucuagggcuggugagauggcucaguggguaagagcacccgacugcucuuccgaagguccggaguucaaaucccagcaaccacaugguggcucacaaccaucuguaacaagaucugacgcccuuuucuggagugucuaaagacagcuacaguguacuuacauauaauaaauaaauaaaucuuuaaaaaaaaaaagcaaucuaggugauaaagggcuuuguggagguguauuuuggcuuguaauucuagaggaacagucugucaugacugggaaaucaugacagcaggcagaggaagcugucuaucacauuucauccuuacacagaaaauugagagacagaaaacuggggugagggcauaaaaccucaaagccaucccucagugaguguacugccuucagcaagcguucacuugguaaugaauuuauaaccaccaaaaauugcacuaccagccaggaaccgauuguuuaauucuaugagccuaugggggacauuucauacucaaacugcaguaacaguuguuggcaagauauguccaggaaucaagccucagucuggcuucuucaccugggacaucuauuuucuaaaagauggugggguugugagcgagagaaggcgauucugcuuucaguaugcaaaguacuucucaacggggccagauuguuuuugcuaucaucuuuagcaguguuaaguccaucuuuauaaugcacuaggaguuuugacauacaugcgcuguuugaggugacauuguugcuuaguucuuugaugaaaggucucuggaaaaucucuuccugcguguaaaaacucauugugaccuuugccugaucagacuccuccuuuuuugccuaccuucggguuaggucacugccauggcacaggcuggcuauggcagagguugucucuguggcuaagcuuguacccuuaagucaggccauucauucugguauuacucgaugccagucaggagugagcugucaucuccuguucuacuguaauuacaauguguucuuugcugggaaaguagaauguaaucaccuaaauugcccugucugcacacccgugccacagugauaaauggcugucauaauaaugacuuugaaguucugucagcuauucccgugucuucuggaucuccagagcugcuucuguucacauacuucgagauucagaacccuguaugcucggagccugugugccagcuuugcuuuuuagcacauucugagccuucuuuuagaggugcagagggcaaaauuacucgaugucgcucagacuagccuucaagucuugggcugaagcaauuuccugucaaguaccuggagcugcaggugccacuguacccauuuuucuugugauucaguugccuacaguuagaagcaucagggguugcuggcuuauugucaccuggguugcauauugaaucccgugacuuggcugcugggaacaucugcagagugaaccacuauucagugagaaaugucagugaaugaccucguuggcuacccauguggaaguguuccugagagugcucacuacuuaccaucucucaccucuucagcuacaaaucagugccacacccaacaaaagcaacauccuacagugaaaaacaccaaugcaauuuauuuggaaauaaaaacucagacaaacaaagcaguuauaagcuuaacagagcauuggagucuuaggaaaugacacacuugauauuaaauaagaauugcucccuuccuauccaccccuucccauucacuguguguguguguugaggcagcggacacacacacucauacacacacaaacacacacacacuccuccucauacugcuauuucaacaucauuuuuguugcugugaugaaacaccauguccaagaacaacucagaggaaagguuuauuuuggcuugcucuucugagggcaauaguccaugguugcaggaaaaguaugggagcugguggcaggagcaggaagguugcuaaucacguuuccuucucaugggaagcagagaaggcaggaagggaguagggugaggcuguaaaccuucaagccugccuuuagugacguaccuucuuccgcaaagcugcaggucaguguuaaauaaccuuugcagacaacaccuccagccuuggaccaaauauaaaagagcccacagagaaagaacauuugucacucaaaguaccacaccuagccuauuauguauuuucucagaaaucaguucacaauuauaaauauucccacuuaucaacuccucucagagcaaaggacauucucuuacaugagaaugguguucuuguuaaagucaguaaguguaucugggugcaauauuaucuaauggauagacugccuaucauuuuuuuuuuuggccucuuuucuugguaagacagcauuuuaauaaucucuagacuauuaagcaccccuagaggcuguggauaaggcuagucuacuaauauugguaggaggccugcuuacuuguuaauguggaguccuuugacuuucuucgcuucagggaaaauucauccugggaagaacuuuuaggcuuuguccaaaccccacccuuggcaauucugcucaugaaguucagccuccacguccagucuuccuuuaccugguuucaucaggauggcuaccaugauggcuuuuuuuuaaaagcgcaaacaucuuuccuuauugacuucguggcauaugucuucaugaaaaaaaucuucacugucuuguuuguucacuauuuuaucaguuugaacuuggcuacaccauuccucuguucagugaguuauacuccaugacugucuagcaucuuggugcucugcaguuuuuuuuuuagcaugguguuuaugguguuaggcagucauaggauggcuuuauggucucacauguccuugagucuuguugucaaagaaaagagccaccuaacauucucuccuuuuuuuuuucucuuggggcaguaaucaguccuccuguuacugggacagcauuguucaguucaaauuccacuucccaugagcagaucaauggagggagaacaaguccuggaugcagaggcucuucugggcuugaagcaaacccggguaagcuaccaagggaguaagagagcacugcagcgcacacugggagcucagucaguggcagagccccucagcuagauuuaaacccacuaccaguuguguuuccccacaacauuaauguucggaugucucuuugcauuagacuuugggaguguacugcuguguaacaaacaagccagcagcacggaacuauaacuauaaaaaacuuuuuuuuuaagacuuauuuauucuaugugaguacaccguugcucucuucaggcacaccagaagagggcaucggaucucauuauaagugguuuugagccaucaugugguugcugggacuugaacucagaaccuccagaaaagcaauuggugcucuuaaccacugagccaucuccccagcccauaacuauaaaaacuuacagcacccaugagauauauccuuuggugguggucaaauuucugcuagucucauucacuuuugccugggcuuacucaaaacucuguggcuuggcuaaagcauuuaaaggggaagcagcuuucuuucauguguaucuccuucucuggggauguuguccuguacacauguucuugagacaguagcaucaccauaggucauucugagauaugcaguguugucuauaggaaacuguuucuagccagaaacccuugcagugcacuaaguaaauccauuuucuuucucaaaacaaaagaaauaaucagugucuugaggugaagacugccuuuuucugguaccccaaaucacaugguuccacuuggagucgcaucgcagcaggggagaaaugaagggaugcugcuggcaaguccugugggaaagauuucaaaguuacaugcaaaucauggaacaugaugacuucuuggccaaaaaaaaucuuaagauaaucuaugcuuaucuucaaaaccaaccuucauagaauugguacaauuggaaggaaagccaucuaugaagccuuucuuauagaugauguacuuuguaguauucuguuuuuuuuuuuuuaaaguuagugaguacagugugaaaguguguuaaugagcuucauauuugaggaacaaauugcauuuggacauugaaaaguuacuauuuucuucuuuuuuuaagugaacaaccccucagguauuucuguguagugcugcuguccuagaaauugcuauacagaccaggcugcccucaaacucacagagaucuaccuacuuugucaguguuaggauuaaaggcaugcgguaccaugccugcuuucaaauuacuauucguauuuuuauucaguuauuggauuggggauguagcucaaugguggagugcuugccuggaacguauaaagcucuggguucuagccucaacaauacaugugugcacacacauauacacacacaaacacacagaugugugcacacaugagugaacacacaaugcuugcaccagauuaaaaaaauagaugcagguaauaauaguaaaaggaaaagaaagccagaaaaaucaaaugugaguauggaaaggagaaaaggucauaacaaggugggugugguaaugcuaacuauaaucccagcaguuaggaggcugagcucagaggauuucaggacugacuuuguuuuuauaguaugucaaaugccagacgugguuacaucagacauggacauaagaaggcaauagaaaaagcuaccauguucuacaauuuucaggaggaacauaggagaauguucucugugccuuugcauacuuuucucagccagggccuugcuggccuugugaagugucauuuuuaagggagaggaauccaaaccccacccucccaaauuacgacaugugaguguuaaaguggaccauuuuguaaugagaaaagaaaauuuacuguuuaaaauuuauuuauuuaacuuuauaauuuuccauugugcauguaugguauacaugugagugugugugguacacauguguguggagcucuaagacugauguuaggaaucuuccucucccggugucgguggcagugcaugccuuuaaauccaacccuugggaggcagaggcaggcacaucucugaguucaaagccugccuuguuuacagagcaugcuucaggacagccagggcaacacagagaaauccuguuucaaacaacagacagacaaacaaacaagaaacucaaacaaaacaaaaagaaucuuccuugaucacuuuccacauuauucccugaggccaaauauuucaauugaacccaaagcuuacagagaaaggcuggucuagcuagccagcuuucuguagagauauuggccuccuccuccuccuccuuccaagggcuggaauuagaagucggucagcaugacugccuggcuuuugugggugcuaaggaucugacuuuugagucacacauuuggaaggcaagucauuuuaccauagccaucuccucaguguuuuuauuaaagcaaaacauuuuacugguauuuuucaaauauauaaaaagguaccuaaauauaauauacgagcaugcauaugaacaccuguuguauaauguguagauggagguaaauaauuagaucaaccagcauugaagguuugaaaaacaaacuuggccgggcgugguggugcacaucuuuaaucccagcacuugggaggcagaagcaggcggauuucugaguucgaggucagccuggucuacagagugaguuccaggacagccagggcuacacagagaaacccugucucgaaaaaccaaaaaaaaaaaaaaaaaaaaaaaaggaaaaagaaaaacaaaccuucuuaauuuauauaucaagcagacaaaauguccuccaggccuggguugcuggaugcucagggauuauucuacccccagcauugggaaacacagauucuugcuaggaagaaauuagagauuuaauaacaacaaccaacacauucuauuugaggcgauuaaaacagucuuugacaucuaugaucauagaaauguauuacaguuuugaauucacuguguagucaaggaagaccuugagcucccaauccuccaauaaauaacagaaaccaagcucuaugucaaaaaacaaacaacaaacaacaaacgaacaaacaaauaaacaaacauaaaaaccaaacccauauguuuaggcuuggaaagauggcccaguguuucaaagcccuggcuguucuugcagaggacccgugcuugguuccuaguacccaugucagacagcucccaguuaccuggaacuccaguuccagacaggaucugacauccucauacagacaugcaugcaggcaaaauagcaauguauacaacauaaaaguaaauaaaaaauuaagacaaagaaacaugcuuuaauaacucauaugucagguugaaagucaucuuagaaaauaagcaaucuuuaagauggaucuggaauuggcagugguggugaucucccuucucuuccaccaccacuuuuuucccuccugagacagccauuagugcuauuagaaaauuaguagggagaccagugugaaaauguacaucuauuaucccagcuuucggaagauagaagcaggaguauuaccaccaguuugaagcuaacccgagccauacacauacacauacacauacacauacacauacacauacacauacacauacacauacacauacacauacacacacacacacacacacacacacauauacacauacauauacacauacacauacacacacacacacauacacauacacacacacacacacauauauaugugugugugugugucuaauacuaauagucuaauacuauauauauauguauauguguauauauguauauuauauaugugugugucuguguaauauugauggucuaauacuauauauauguauacacacacacacacccacacacacccauauauauaguauuagaccauccagggauacauggcaagacauuuucucacuccacaucuccuccccaaguacauuagauccaucaguauguauuuccauuucaaaccauccauuuuuuuucuuuugccuuuuauuuugaacaucacaggagaaaagaggaaaaugaacaacucucaugcucccgaggaggccaagagaucucgagugaugggggauauucccguggaauugaucaaugaggucaugucuaccaucacagacccugcagggaugcuuggaccagaggucagcagggugaacaaggcaccuucuggucucccugccacacuagcugucacagaugaggguggggugcugagaacacacugcuggucaccuguaaccuagaggccacuauagggaggucaggaguggcuaaccaagaugugguucccuuugauaaauaucaauuacaggggcacaaacuacaguuucaaguaguugggaacguuuccauagugaagaauuucaagcuuccaccagcaaugcaaaagacaaaacaaaagaaaacaaaagaaaacgaaacacccauggacuguguugugcugagaagcgucagugauuaccuccuuuuuuccuuucuugaccuccuuuuccucuccugugaaccuuuuagaaucauugcagaguccgaaacagauauaauaauacaucacaccuagugcaucugccugugucucauaggaaagcaauucucuuauauaaucacgugaguuagcacucaggaaauuuaacuucauuauaagguucucugguuuaggguuggcagacuguagccuaccagucaugucugcugcucagcuugugggcuaaggaauugggugucagcuucuuacucgcuaggagugaagguguccagcgucguaggcuggaaaucgcuuuucugggcuguguuaauugcuaaccauugcgcauagcaggaaaauggaaucacugaggcuuggaaugugugucuugcaaaaaaaaaaaaaaaaguucaucucuugacuuuucaguggaaaguuugcugacuuauggccuaauuuucaaccucuagguccagugaccaucugaccaauuuaugcuauucauaauaugcguuauuguuggaggcucaguuaagaaccaagcauagaauucaguauucauuucuucaucuuuuuaucuuccuucucucugucucugucucucuccuuccucccucccugccugccucccugccuccuuccuuccuuccuuccuuccuuccuuccuuccuuccuuccuuccuuuccuucucucucucucucucucucucuuucuuucuuucuuuuuuuuuuccuggacuggucucauguagucuaggcugaucuuggacuaucuauauagccaggauuaaugaccuugaaccaccuugcuagguucauguggugguggggaucaagucaagggcuuguuauaugccauauuccauaccuccgagccauauccccggcuccuuagucuccuuuaaagccauucuccaggccuuuucucuucucuuacaaugcugucuuuguugaggaacuuuguuagcaaauuaugcauaauaucucaguguggaucuguguaauaguuuaggucaaugcagguaaaacauuuugguugaaagucugcucucaucuuauuguaagacauccaggaacagggaggcucaagacguuuccaggaaaugaacacaugacuuggguaguaguguauaaacaacuucuaucuuuuugguguggcuuugcuagauuaaaucaguaaguuucauacugcucuguuuuugugacucuuuuauuaaugucaaagaucauuuggaggauugaguguugcaacagaaccaucucauaaaauucauuccuucuggacugacuauccagucuguggggaccuaaagcugaccuucuguguauuggcuuuagggguuucguaacuucauacaugagccagagcuuggccugcucagaugaaaaguggggaggcagucucccauuucacaaucuguugcuguaguuaauaguguaucagcaugcccaagaaagcugcuacaguuuuagacauuuuuguaagcuaguuuuuaaauaucuuggucacuugaaauaucuaccacagugauacccagucaccuagacaacuagccagagaccucaaagcuagugcuauaguuaggauuuuucuucccagcagagcuguuugucaaagauuuccuugcccagcaugagguggauuaaagcauggggugcuggcucuaggccauguagccugcugugaguuuuaagucuggaucaauagauacuucuagaaagaaaagugucuucccaaaagaggcacuaagaauauaaauaugacugcugcucuauuucaagaauuuggaaccuguuaucuuaauggucuuuaauuuauuauuauuauuauuauuauuuucauugcuucuauguuauuaauauguugugugagugacucacucaugcaucgaggcuaggggacaacuuucacaagucaguucucuccuuuaguuguggauucugggccucaaaccgaagucaucaguuuugugcagugaacacucuuaccugauaaugcaucuuauugguucucucuuaaaaaugaacacugauuuauuuaaugugcuuguguguguauguguucaugcaccaguggagacacccaggccaugguguaaauauggagguuagaggccagugugaggggauucauuuucaccuuccgucagaugggucuuuguccagguauugaacuuagguucucggguuuuguaucaagcacccuaccugcugugccaccugacugcucccccaauucaaaaauuuuuauauuuauuuuuauuuauuuauggcauauaucugaguacaugccauguauguguggcugcccauagaagccagaaaggggcacuggguccccuggagcuggaguugcaggcgguugugagccucccaauaugggggcuugaaaccaagccugcguucccuguagaccagcaggcacugugaacugcugaucuuuuccucaagcuccgcuacccuccuuagaguuggaagaucaugcuccguauucuauacuagugugucugugucugcuuauaggcuacaguagcaacugaauaggagagaggggguacacaugauuaaaaauaucuuauuuuauuguuuaaauuaccuguacauguauaucuguguggaauuauguacaugugcccaaggaggccagaggagggugucagacucucaggacuggaguuacaggcaguugugagccaccaaguguguguauuuuguaggacccacacuuggguccucucaaagagcagugcaugcucuuaaccaaggagccagcuuucuaacaccgcccuaaaauauugucuuaaagauaacuuuugcguugauacauauguucacaugagcauggcaggacaucggugcccaugcauggcagauucucucucaaaacaaaaacaaacaaacaaacaaaccaaaaccccacauaacuuguuuguugauuagucucaguagucagcuugcacuacugcuggccaccagauccacuugaaauccuaggcucuggggaucugcacucugguccucaaguuaugcagcaagugcuuuaguuggugugcuaucuccucagcucuucuaaaauauuuucuacagguucucuuacaaaacgauuuuccuaaucagaagugauauauauauuuccugucccugggcaagcugagguaggaagauuuuaguucaaggccagcuuauacuacagagcaagacccugucucagaacaacaaccaaaaguuuucugaugccuaacccauauaaaauauaaugcacaugcacuuauuaacuuuucauaaugcuaauuuaucuacuuaauucauccacuuacuuuugugugcgugguuucccaugccugugugugcaucagggccagaagaggguauucaguaucuuccccuacaacuuuccuucaagccuuuugagacggggccucaaccuagggcuucagcuuauuuucuugguuagguuggaagccagcaagcccuagugacccuucugucuaugccuucauuggagcugggguuacaagugugcaaaaggaugcucguggcuuguucuauggauacugggauuccaaacuccagucugucugauuauauaguaaacuuuuuuaacugcugauucaccuaucuaaccuacuuaauucacauuucuauuuugucuucauaacuugugggauguggaugcacaggggcucuugugcauauguguuuaagacccagaaauucacaucagagucuuaucagaacauggaaagaguucauauuauccaguccaccacuuucaaagaaaagcccuuuguaaucuauucuugucuucuggaucccagaccaauuuucugucagcccauucggccagagaugaggcggcacggcuggaagaacgcaggggugucauugaauuccacguggugggcaacucccugaaccagaaaccaaacaagaagauccugauguggcucgugggccuccagaauguguuuucccaccagcugcccagaaugcccaaagaguacaucacacggcucgucuuugacccguaaguucaacucauucuuccuuaguuccucuccaguccaaggacgaacuguuuauuuagacagugacauucagcccuuggaauauagcugccuucuguccuacuguugauagagagccauacugauauaacuuucgggucaaaaucacuaagauuaaucuaucaacacuuuuuacauucuuauuaauagacugaaauuuuauagccacgagagcauagaaauccuagggugucuuacuucauagcccauacauucuuggcuuuguuauauuaacuagguaccacuguagaccaaguacccauagguaagguugcaccaaaguuguguuggaucuucaggagaaguacagaggacagcaccauaucugcuaugccauauacucuguaaaccuugggaaaaccauugggauuuuggauauguuaaccuacaaaaucuauggguuuaaggaaaaacaaaacaaaacaaccaaggaugaggauguaguucaucgguagagggcucaccuagcauaaacaaagcccuagguucaaugcacaauucuaucaaucaaucaaucaaucaaucaaucaaucaaucagucagucugcaaaaagcauguauccugacaguagcagauggcagacagagguuugaaaguaaaucuguguuuauuguuaauuuauauauaacagacccaacaaacccaacaacaaguaagcagaugucuccaauuggcuguauuuugaccuaguuagcgagacagccuaugugaaaugugcucugugcacguggcaagucagagugagucagucaggugagauuccacacaugggggcuugacaguuccuacauguggauguuauguucuuugauguaacgucacugucuguguaagugugaacucuucagaaaugcaggccauccuuguguacagcuuugagcucucccuccaaccccuauagcccgcuggacauugggcaugccaguuucagaacccuucuaagcacacacuuaugggcucaggcucuucucagggaauacuuucuuugcuuuggugggagcuuugaugaaguaggcuugcccuguagaguccagggaaauggcugccuagcaucuagaugaaagaacuuacaacccauccccuuccaagcaggaagcaucuccacaaguguuuuacguaaccaaacaagauaaaacucugauugaacauuauuuuauuuauuuuuaggaaacacaaaacccuugcuuuaauuaaagauggccgugucauuggugguaucuguuuccggauguuuccaucccagggauucacagagauuguuuucugugcaguaaccucaaaugaacaagucaagguaagagcugcccaggaccuuggcagggaagcagggguagggcuucuugcugcugcagaggagcaugggaguucccucuaggcucggcucagagaaggcucaggaugugaaguucaggccuuccuucgaaguucucucccuguguguaugugggcauaguucaucagacugaauauuuuuaguaggguugcacagaggcuuugucuaagcagagcuuguauccugacaguagcagauggcaggcaaaucuguguuuauuguuaauuuauauguaacagacacagacaaucagaugggacacacacacacacacacacacacacauacacacacacgcacagaguauuuaguuaucucacacacuucaacaagauucucaugaccuugucuauaaagagaaacgaauauuaaggaaaucccaaaaggaguugggugugauggcccacacacauuuaaucccagugcauaggaaggagagguagguagaucucugugaguuugaggccagccugguuuaccuauuaaguccaggauagcccagaaggcccugucuaaaauagaaacagacggaaagaagaagaguauuuacguggacuuggcucugugcaugcuaaguuagcacuuugccacacauagcuguaacccuguuguuccugcauuagguuuugauuuugcugaaguccuccucugucccucccauguugucucuggcacggguccucuguuccuuuggcgcuaaggcugugcuuucuuaggguugccuggaauaaccuagaugugcuggguacaaagagcacuucucuacacucugucguauucuacucuguuuuucugaggacacuguuuccgucuuagaagguuuugcuuuuggcauucaacagaccuuccuaaagcugccccuuaauaccauucucaugcuguuggugacccccacacagaaaauuauuuuugcuacuacuucauaguuguaauuuugcuagcuauaaauuguaauauaaauguaggauauuugauaucugaccccaaagggguuaagacccacagguugcagacagauacaaaagaguaugaagaaacugugugugagaaggggccgugaacagcuuaggagucaggagcacuacaaacaaaguuguuguaaggucugaggcaaguuguucaacaguagcguguggaagcugcacacacaauccaucacugcacuuagucuacgcuuucuagaaaaucuauuucaaaacagcaagugcaggcaggagaggccauuuuuuucaaauauguuucauuuaagguaaaauucaguaucaugaggaaucgucaacagcaucugcauucucuguacuaagccuuugaaaccgcugugugguuuagacucccagccugucccacccaguuuggacuggccacauucauguacucagugagcacaagaggcugguggcuucuguccugggcagugcagggcgaaggagucuauuaguucuuucagagucaaagaaggacugccauuuacaaagacuaaaaauaagucacuggaagacgcauuuucuguuccaagugugguuagguuugcaugucccucccauguucacugcccaacaccccuuccccugcuucccuccccuuuaaagacaaaaagucuccuggaauugaugguggucucauauuugcuauauaguggcccugagcuccugauccuauugccuauuuucucucucccucuccucuccuccaccuccucucuuuauugcaguguggaaggaagaaggaggccaaacauuacagacucaguaggaauaacaagggggaaaauauuuguuuuuguuuguuuguuuggcuuuuggccuuuuuuuuuuuuuuuaacuagugaaggaaugugggugaaggguuacuuagacgagcagaaaugacucaaagacagcuuaucagccaaggcccaccccagugugagugagagcccccccaaagcugggcaccuggagcacacugcacagccugcaggcagcuggagcagcuggagagugucuuuccagaugcuuacagugggcugagggaucucucaggagacuugauugcuuauauacacgugugaggaguggacacgcccugauggugggagguccugagcaagugguugcuguugcuacaaccggccaugucaaggacccuagccucgacucauggggaaaagucagaagcuacacuccucucccacagagcgaggcuuauaaagauggcugguucucuugcagaguuuaauagugugggcagaagauguccaccauaguuuuccucccuucacccagugcuucugaaacccuuuuggggaacagaagucacaccacccuuucauagggccuccuaaguccaucagaaaacaguuauuuauauucugauuuaucacaauagcgaaguuacaguuauggaguagcaaugaaaauuauucuacaguugugggucaucccaacauuaggaacuguauuaaagggucccaccauuaggaagguugagaaccauugccaugauauuuacagccugaaaacugcucucuugcagagucgguuccuaggagacuaguaaacugucuccuuguucaguuguaugaaacaguucagccuccuccuucccccgugaucaacucugcauaauaaacaugcugaaauuuuguguguuuuggggcgcggucaugcugugguuucuguuucucuguuggaucacgcagauccugaucuguguguacgcccauccauugcucauucuuggucuuccugaagcaauucucuagguauucuggaaauuaaacacagguacgguggaagaacaaccagugcuuuuaacugcugagccaucucucucgccccagcaacuugacacacucuuuuuaaaugccuaacuuaaucauuucuaucucuuuuccuuuuacacaugacaaauaauacacuguucucaauacaugcuguauaacagaaauccgaguuucacauaaaauucuuuuucuaagucaagugugguggcauacaccuuugaucccagcagagggaggcagagaggcagagaggcagaggcagagaggcagagauaggcagagauaggcagagaggcagagaggcagagaggcagagaggcagagaggcaaagagagaggcagagagagaggcagagaggcagagaggcagaggcagagaggcagagaggcagagagagaggcagagaggcagagaggcagaggcagguggaucucuguaaguuccaggcuagccuguuucaaaacauccaguaaauaagugaacaaaugagauaaaaaauucuaggagucauauugcaaaguaaaauaaaaacagguaaaaauguuuauacuuuuuauuuaacccaaucuguccaaaauauugccaugugaacacgaaguauaaaauguauauucacacauaucuugcugauggacauuuuguguuccuagcaccguccagcuagcacuaguaagcugccauacugaaguuccguuuauaauuguguuuucucucuucccugugucaccaggaauucuuccaugagauacauuucacuuguuuuuucuauucacauuauauccgaacucacagugucuugguauugugguauguguauaaggaaaaauguccuuggcugacacgacuggaagaacacucuccaaaaaagggaggugucgcugcugacuuuuaugggacagagcaccccaccugauaguagccaggcauaguggagaaggagugcugugauugcuaaaggguccccacucaugauacugguugauuugaggcuugggcaguggaaguaaacaggagugaggguuagcucuuguauugugugcugugauucugugugguuuugucugucuuuugugguggucacugaucucuggauacacggccgucgccacuauaguuuucacuuuucaaauuaauauuuuaaucuuaaaaauacuucauuaauucuuugagaauuucauacauuuguacaaccccuugccccaacucucauuuuuaaaaauuugagacaggguuuuuaucuauagccuuauuuaccaaaucuagacccucccagcccagcauuuucagucccagcuccuuaggugcacaccggaacacugggccuguuuucauacauuaacccagucauuuauucaacauuguucaccgucuuuuuguuuccacuguuuuuuugcugacucagauucuggguuucuuagguuuuucuuggucugauaaaccaagcuggaaguccugugucugugaugcaguugcuagaaggguuguuggugccuggaacagguaaaugcuuagcucagcauacacaguacccagugaagaucugcauggcucauuuacauaccucagauaugcuaaugagaucagcaccauucaucugccucccuccuuucaucucagcuucucaaauacuuucaagauuaaacucaccaucagcauucacucugcaaacauuuggcagcaagaaggauuuuaggacugaguuuggagucuuacuguguuauuuucaaaggacccggagcuaguguuugccugugauaauuuuguuuugaaccgcagauuuugaaugucuuaguuugugauuccuuuucaaaauucagacaugcaagaaauaguuccucgaggaaagacccugguugguaaaauauuuaaaacugcaaacuccuguaagcuaccauucucugucacguuguuaggaauuucuuuucuugagcaucuuuacuuccaccagggcuauggaacccaccugaugaaccaucucaaagaauaccacauaaagcacgagauccucaacuuccucacauaugcagaugaguaugccaucggcuauuucaagaagcaggucgguucccaacgaagccgugugcucucagacuguguaugcauauacguguguguguguguguguguguguguguguguguuugucuaggugcuugcaccuguuucugcacuucugauggccaaagccagacaucuuucucugccguauugcuuugaaacugggucuuucacuaaaucugaaucucuuuuaaaaauuaaaaaaaaaaagggaaauugacuuaguuucuggaaaauguucguuucugauaaggucugcauaggcuucaggcuuggcggugugugugugugugugugugugugugugucauuauuucgaucuugaauuuacauuccuccugcugggauuccugaugugcacgcugccacccccagacacuuuuacuuuuaaauuugcuuccuguuggcacuguuugauuuuugaugguuuuguucaucagggggcucucuguguggcugcuguucagagcagggcaacggugcugggaagagaguuccucugaauccuuggcaccaggcuuggcccagagccagcccuuagcagccaguugugcaggcguuaugcacagcacccuaaugagugaucugauuugccuuguaggguuucuccaaagaaaucaaaauaccuaaaaccaaauauguuggcuacaucaaggauuaugaaggggccacuuugaugggaugugagcugaacccucagaucccauacacagaguucucugucaucauuaaaaagcagaaggaggugagcugcugauugcuguucugcccaggccagccuugggguggacugcauuucaccauuacacuggguccacccuaaccccauccucucccccgccuugugugugugugugcgcgcgcgcgcgcgcgugcgcgcacuugcuaaauuguguaaaauauagcauguguauaguacaucuuuuuuuuuuuuuuuccuugagacaggguuucucuguauauccuuggcuguccuggaacucacuuuguagaccaggcuggccuugaacucagaaauccuccugccucugccucccaagugcugggauuaaaggcgugcgccaccacgccagguucguauaguacgagcccauugcaaucuaaucucuucacuuucaucgccaaaaggaucuucaagggccauugcugaugcuuuggccucuggcucacaauacccugucacucagguaaacggcauucuuucagguucuguuccaacguuucuguaaacuuguacagcaucagccugacucaccuacucggauuuaauuauuuauccugcagagacaucucuucuagugucuauuucucuccuuuacacuucaugaucugaaguccuauaagaacuaguuugugccaggcagugguggcgcacaccuuuaaucccagcacuugggaggcagaggcaggcggauuucucaguuugaggccagccuggucuacagagugaguucuaggacagccagggcuacacagagaaacuugucuugaaaaaaacaaaacaaaacaacaaaacaaacaaacaaacaacaacaacaaaaagaacuaguuuguuaucuguguugauauguccuucuuuaggcuugcaaacaagaaaugguaaugcuggagaaggcuccaggugugaguuuacagugacuagcaccuuuuagaaggcagaauggcauacuagagaguccacaagacuguucaugaagugaaugaacucuggaauagccaggaccauuaucugggagcugggaugugggugacaucugcuucauccaguacuccuuuuacuuaaccuucuguguucuucccugacaaguuaccaaagaggaacaucugccuuaaacccaucugcucucuauuaagauccuuaaucccaauucuuuugcuugcuagaugugacacauauaacagcccagaagcuuacguaaugucuagugacagcagucauucacugaguguuuuauuuaaagugggucaggcaggugcugcuauuagaagagcaaaacgaauuuuguuuuguuagagaaucaaaguacuuuugcugcauggucaaagaugucugccuaguagggaguuccaaacaggguagugggagaauucuuaauguagcaggcaccucuggccugccuucuuuaaagagucaccuucccucacugcucuucagucuuaacaagcaggucuagacuuggcagcucuuuggugcaucgguggcugcugaucgcuugacacuagcauugugcugacagcugcucguucuguaaucuuccacuagcuacaaggauucauccccuaguagaaugagaguccccugggagucugcagauucccucagagaaugaucuguucacucuuacuguauaggagaaagcuggaagcacagagauauuucagauggcuaacguuuuuucacuuuuuaaaagacaagucuuucuccucuuuucuguuuccucuuuuacuucuccuuuuuuugucucuagucuuuuuucacgcauaccauugaauggaccaguguuuggaguauuacccuaguuuucuuuuuucccacacacauauacaauguaucuugcucauauccacccucugcuccucucuccagcaucacaccaauauaucauucauaugacucccaccuucauaccuuaaaaaauaacccccaaaucacuaacucuaguuagugcugcucaugcaugcacaugcaugggguuauccacugaggcacugacagccuaucaguggccacacucacaaagaaaagugacucuccccccgaagcuaucaguuuuauuggcuucucauuuaaggguauggcaucuggaauuuuuacccucuucaugauacaguuuuuaacucuugggcagguaagcacaacuugggugaguucacguguguacgcagauguaccaucuggugcguauccggaggcuuuccuuuuacaacguuacaacguuccucccgaucugcuggcucuugcauucuuucugcccucucuuccaggauguucucugagccuuugggguugcacaaucauauccuuauucucaguguuuugaacuagauuuuuuaaaagagagcugcaaccguaccauaaugaaauaauuauuuucuuguagagacaggcuaaguaucucugaugcaaaaugcucgugacccgaguauuuuagagucuguuuuuuuuuuucuuauucuucauucuuuccauugacuuacugauggagcaucuuuaaugagaaacuccaacauccaaacacucucaaaugucagacuccacuuguggaaagccccuugagaaacaacagcagggaauaagcuauggauacggagaacuuuucuaguccaggagugauuagaaucaucugaagguggagagagaccucuccacaggugagauagauuuauagauagaaucucugugugcacuggggauaaugaacaaagauuaggucagugucuagcacagaagaugguggacacaguagauaggaccacguagaaagagugggagaaaaggugcugggcagggagguguauggcugcuuauguguaugccuaugaguagguugccguggagugugauucuuacaucuuaguccauaugugagacuacaagaggcugggucuggaggggccccugccaaccuccagccagccucccuucuuccuucucucugauggucauuucccuaguggcaaaggguugggugaauguugcuacaugaguaugguauaaaagaauacuucuuuuaaaagauauguuuuaacuuuuuguauuuauguaugugguguguguguguguguguuuauaccccccccccccacuccaugacacaugugaaggccagauaacaauuugcuggggauagcguucuccuuuuacuacguagaaucccagggauugaacucaaguguuugggcuuguuagcaggccucuuuaccccuugugccacgucacuggccccagaauucuucuguuucuuaccugcuaauguguauucagccuuuuugucuuauuaaaaacuuguacagccucaggagcaccaucucuuugguuuaccugacuuguccuggucugugguguggcuucuuuguucuaaccacauguuucccuaugcuuuucagaucauuaaaaagcugauagaaagaaaacaagcccagauucgaaaagucuacccuggacuuucguguuucaaagauggaguucggcagauuccuauagaaagcauuccuggaaucaguauguauaagauacuuucuaaaaaaaaaaaaaaaaaaaaaagcaaacuuuucuguugcuccugugagauauguuugaaacgauuuccagagugcaguccuuugaaaagcucucaccugucuccuuuuccaugcgugguguuuguggucuuugaagugggcagcaagcugguuguggaggagcucucgugcaaucccagcauugggagucuaaggcaggaggauguaguguuugaggcuaaccaagacaagcgugagacauuaucuggggccggggagggcaauaauaaagaguuucugaugucuuuuucuucuuaacucaacccagacaguguaccuuuaaaaagaaguuauuaauauccauaauuuauucagccuggcacuugcacacaaugcuuggcaacaggaauguguacuaaguaguguggaaacucuagauuuucauauuuacgaauggaggaacuggucuucaaacgguuguauaaauuaucaggcagaaggucagaauggagcaacucguucuguucgcccaaucgccugcuguggacaaccugccuuggugccacugugauggacccauagccugacuuuccuucuuccucccucuccaagugauggaggucacaucaguuguuucaaguuuuuauuuuacaguagcuuucuuaagaauucuuuuuuuuuauucucuaaaagugaacuguauuggguugaaccguacaaaaugacugggguuuguagauuagaagcuagcaauuaucauuuggcaaucuuauuugguuggaaccuaaguucuuaugaugacucaaccccucccugccuucggcagacagacacaaaacuaaacuuuuccaggaaagagacaggaugccugucucacugcaucugcccugccucagaacucuuuuugcugaaacccaggucucaugucuccauguagucacuguuaaugaccgaguaauugccccauuguugaaugcccaguggugcuagguauuuuucuguguuuauuuuauuuguucacgauuuauuauuuuccuucuuggucaaauguuuagauauuugggcuucuuuuuuuaaaaauaauuauuauuaguaucaacuaaugucacaagggcuaaccacaccuaauuuccauaguucugcuuuguagguagguaaaucaaggaagggguaaaggauaagagaagaagucaaauccagaugcccuagacaccaggucucuguaaaccagaugugcauugcaagcagcaggaacuuggccaaacaaaacaaggagcagaauauuguccugagcuaaaauaauagcagcacuuugguguaggguaauugaagacauuagacuugcaguuuaaauguguaguacuguuuucuucucugccuuucuucuuucuuuugaagaguuggaauuagaagaguuaguugccuuaguacacacuaacuagcugagacaaaagcucagggacacagcacuugccucagugguggugugugguauuagcuucaauacucagcccuacagaagcaauuaaugaaucaagagaacaaaagacguuaauauagcugccagucugugaaaaccuuuuauguuguaagcugugugagaaagaaaauauaugccacuaauugcagugugucuccccuaauagacauuuauugagacguggcugucauguaugaugcuuuugauaaguaguaaguauguuauucucuugacccaaagcaguucucauuuaguguuuaauuuuguugacauauaggagagacaggcuggaaaccaaguggaaaagagaaaagguaagcaagcuggguuagaggauguuaauggaaguguucuucccccuuccagcguguuagaggaaaagggccaagugauguuaauugguacacagcaguuggugggcuucaguuccuaggcugggaccuaccugugaggcuaagcugaguggugaagaggcugggagcaagaacacuaauccuuccuccuuugcucucuguucuuucaaguaaagagcccaaagacccugagcagcuuuacagcacccucaagaacauccugcagcaggugaagguggguguauuugucuuuuaucucaugcucuuauuuugaagugauuucccacuugacauucccauaugagauaccuuauuaucuuuauuauuuucuuuuauucaagaaccauccaaaugcuuggccuuucauggaaccagugaagagaacagaagcuccgggauauuaugaaguuauaagguuccccauggguaaugcuauugcaauuuucucauuauagauauagaacuggguggugcugugggagaccagugcuggcuaagguggacguguugacuucugugacaaugagugugucucgagugggauuugugagagggaaguggguuucauucagggacguucugugcguuuuuaguacacuagcuguggaguggagguagggaucuuacuguggacaguucuggauuacacacuggcucuuuggauguagcugacuacuguguuacugaugaaaagaaagcaggcguuuaucuuuuuuauuuggcucgagucugccaaaagucacucuuauucgaaggguuguucaagauagagggucagagccauggcuccguaguuaaguggcacuggcugcucuugcaggggguuggcuuuaauuccccgaacccgcaugguggcucacaacuguuucuaacuccaggcccagggaauuuggcuuccuuaagcacugcaugcauguagucacuguucuguuucugugaaaggacaccgugaucaaagaaauucuuaugaaagugagcauuuaagggcuuguuuacaguuuccgagguuuaguccauuaucaucauguugaagcauggugacaugcagguaggcauuagagcaguugcugagagauauaccuugauucacaggcagagggagagagacugggccugauaagcauuuuuggaaccccaaagcccaugcccagugacacacuucuuccaacaagggcaccccuucuaaugcuucuaaucuuuucaaauagcaccuuuccuagugacuaagcauucaaauauaugagccugugaaagccauucuuagucaaaccaccauacuauacacauaaaggguuuuugucucuuccucccuccccccaagucaagaccucucuauuagcccuggcugaccuggagaucaccgggcagacuaggcuggccucgaacuuauagcaguccaccugucucaacuuccgacugcuggaauuaugggugucugucaauuugcuuggccacauaaaucuuuuuuaaaaagaaguuuugaagcuaacagagugaggguagguuaaguucccuuauggcuagacuuucagagagaaaaacuaguaaaugauuguucuuagacuauagauuccauauguauauuucccuuuaaaaauucuuuguaaaacuauauuggugugugugcgaauggugugugcaugugaagucaagugucauagcacacaagugaaggagagaugacagcuuuguggagucaaacuggggucaucugguuuguauuauaagaaccucuaccuguugaaccauuuuaccagcuucuguauauuucuaaucauuuuccaaauccuacagcuacaauauauguuucuggaauauagacuuauagaauuugggcuucaccuaugcuggggguaacaggaacaaucaguucagaauccucaaguuaaauuagcuugucagugugcugugacaaguagcugaaggaaaagccagagggugugacgguccucuuuuuccuugggaccuguucccagugucagagugagggaggaagaaucagggacucacggccuccugggugauaagugucuuacaugucucuucauggcauucauuuccauguagauguuauguguggcuauuggaggauuucaauggagugugaaagcucugcaucuauaucauuuugcccuauccugcuccaauacauuguaauguaagaaaaccaaagagaggugugaccuaguguagaauucugauaggaaacaucaucugggaagcaguuauuuuuuugcuucaaaccuguuaucaccauguguaugugugcaugugugugguaugcgugcaugugugugcguguguguguaugugugugggggggaaugcacgugggcgcacguguauccauguugguaaccaggccagaagaggacacuagauccccuggagacggcauuucugagaguuuugaaccucuugcuguagguguuggauuggaacugugguuagugugcaagaauaaucagagcucuuaacuucugagccgucucucuagucucucaaccuccuuuuuguccucacugagcccuguugaauuuagggagaguaauuaauuccuuucucagcacccacucccgauugcaaugcuagagcuaucagaucuccucaaucaaaugaaaucacuaccugcauauggacgggucuugcuuguuucuacuggagagggcuaugagcuucuccagucagguacuaacuugugugcauggcagaggagaaaacuaauuccacugcuuaacaccgaugaugccugagaaaugugccgagacaaaauuaacuaaaacauucaacuaugaucuguaagaguggagcaauauuauuuccuugggaugaagcaggacuguuaugccacgucaacacuuacucugcccuguugccuuugaagguuuuugaacgaaccccuucucuuucugucauauucuaaaacuucuucucccauacacacauggaggaccuaggcugaguacuuuuccccacuaugaccuuaccuagcauguuucucuacuuacauagaguugaggaaaggaaaauagaauaauuuaauauggcucuguguuucuuuguauuuaacauugugugcacacguguguguguguguguguguguguguguacacaugcuuguauguguguaugugaaugcgauggcacuuguguggaggacagaggacaacuuguaguugguucucuccuucugucaugugguuuccaucaagacugacacccggacuaggcuuggugacgcaggccuuuaaucccagcacuagggaggcagaggcaggcggauuucugaguucgaggccagccuggucuacagagugaguuccaggacagccaggguuauauagagaaacccugucuugaaaaacaaaaaacaaaaaacaaacaaacaaaaaagacugacacccaucucacuagccauccauauuuauuuuacaugcucccuccccuuuuuggucaguucauagaaucuaagaugacuagaagaagaaagacguuauccuuuuauaagagcaaguguggaaggagggaugaacccauuguacuucuuugggaaggcugaagccuucugugaguugagcuuguuucugcuagcaacccuuuggauuuguaaccagucccauucaaagaaagaguuugaagagcuuugaaccaacuucugggcuuuucauuuuuuuuaauaaaaaauguuuuuuauaucugucuguauauguauuuauauauguauuuacuuauuuuucaagauaggguuucucuguauaguccugguuguccuagaacucacucuguggaccaagcuggccuugaacucagaggucuaucugauugcuggcaauagucugccaccacacccaguucuaauuuucuuuugaaaacuuuguguguaaaaguguuugccagcauguauauacguauaccaugcaugggaagugccugcagaaguuacagacggguccuuggaucuccuggaacuggacugagagaugggaguuaggguugucagccacuuguggauguugggaacuaaacccguguccuuagcaagcuagugcucuuauuccccagccaccucuccagcucccaaccuuguaucaggucauacuucugcgcucguuucauccuguguugacugguuauuuugaggcggaguaucacugaguaggccucacacucaguccuuuugcuucagcuuucugagugcuggcuuuccucaugauucauucuuuuuggacuucacuuuugaguauccccuagugguuuaguuuucuguucagucacuucacccagaggcccagcuuccuuccuuuccuuaaugagaacugucccacagagguauuaggaaucgaacucagguccccugcaggaacaauaugcacuaucaauuuuagugagggaaaauagauuauuuucggcuggagcgacgguucagcacuuaagagcacuggcugcucuuccagaggaucuggguuggacucucagcacccacgcagucacuuacaaccaacccucuuuaauucuaguucuaggggguucuauguccuuuucugaccucagagagcacuagacauggauguggcacacagacauacacagaaacaaaguaucuauauaauugaaauagcaauaaguaaguagauuauuugguaaaguuggucauuuugacuucuucgauggacccucaaccgaaaguuaguuguuuuccuuuagguacuauaugugaaaaccacuguauuugcaaauaugauauuaauuucuuucuuuguaucccacaagaacaacuguaaauuuaguaagcugagcucagccucaucauuuuuagugaucaaagauucugugccaaugcucugccugccccacucagcauccaugaguccuccacugucucuuagccuccuggugcacaagggauggaagcagaugacugcucauguuccuucuaaugucagugucugugcagugcuauacaagaaauccuuuucagcagaguacucaggaaucgguuuugcuuacucccaagaauuuuucuuuaauauggcauuaauauggcauucuuuaaagaauuuuucuuuaauauggcaucagagugacaaagauguaagagcaaaucaagaguguagcuuucuucccacaucccccuugucagcugcugagagggaggagucaacagucgcuaauguuguuguuuccugugcagaucugaaaaccaugagugaacgccucaggaacagguacuaugugucuaagaaguuauucauggcggacuugcaacgaguguucaccaacugcaaggaguacaacccucccgagagcgaguacuacaaaugcgccagcauccuggagaaguucuucuucaguaaaauuaaggaagcaggguugauugacaagugauuucuuucccuuagacacacaucagcagugugccuaaaacaggucauuuagguuuuugguugcuuuuguuuuuuuguuuuuguuuuuaaauuguacaucauguguugaagagacuuguaauaauuagcacuuuugaaaaacaaacaaaaccuccuuuuagcuuuucagagacguauuuaaauggaaaucauagauuuuuuuuuuauuuugagcaauagauuuuaaucuauuuacuacuaucauguaauuuuucucuggcauguccaguagcugacuauugcaugguagaugaucaggggcuuccucaaaaccuguaugugaggaaauugcacacaguaccaagauuugggguaaucuagagaaaaguuugaccaugaaugucuccauuuuuuuucuaauggaacaugagaguuuauuuuauucugaaggacuuuaaaggguccgugacacaccugugcugugaaugaacugugugauguuugaagucuccuuguagacuuuuuauaaguauauauuuuuaaaacacucaucuagaugaggugcuuugagcaguucugaaaaaaaaaaaugcagcuuccacaauagcggcugcuaugacuccuaaggaagggacuuuuuauaagcuccuggggcuuugaucauucugucuaccuauuacagacuugagagugcacaaccacuauuuaauaauaucuuggcagauauguguccaucucauauuugacuuugcuugugcagggcccaacuucuaaaagauccguucccaggccacaaagguguuagcuugaaaauauuugagguugaguuaauguuaagacauguggccuaaacaugaacccaggggagccuugcuucacuauguaaggauucuuuguauuuucugguacauuuaaccccaucaccagugucuaugugaacauuucccauuugcacuuccagaguuuuguuugucugaggugaacugaauucucaccaaaguuuaggccaguauuuuaacaccuccauuguuuuauugguccaggguuauaucccacuaacauucgcuguacaaucuuauuaaccauuuuugucuugggacuccagcuuagugcuuggauuuauuuccuaauuacacuacauagaaaagugggacaccugccagcccaacucugggaaaaaccaacuaauauacaaccauauuaaaugaaggccaccuuaauggucucgacacuaauuuuuaugaugcaaauuuauaaacugauuuuuuuguaaaggcugagguuuuaaaaauguauuuaauguauguuuucuauccgcauaaauuauauugggucacuaauagucauuaaaaauagcuugcagagguagugugcuugaaggaaaauauccuggcauugcucccgagugcugcuucugacauggaaggcaugcuguauguucauaguguucacugaagaucacacugaagaugccucaacauugggaaauguaaggaacacuuugagugguaucuagacuauuaaugaagagugauaauagaggcugcauuaagugucucagacugguuuuaaaacagcuuuguaccgauuucgcugaagcgucuguccaguuugguauccugugaaaguuuguuauuuccuggguagacauccuuaaagaguauugucuuuaaaaucagauggucucuucuauauugaaagcauuuuuauguuuucuaauuuaaaauuaauauuuucuuauagauauugugcaauaaagcagaaguagaaugugguuuuugcaaaugcuuuaacggccgacaaaaacuuuacauuuguaaaauuaauauauuguacugguacaaaauaguuuuaaauuauauuuugaaaagcuc

SEQ ID NO: 12565 - RNA, 20151 nt, Mus musculus
caauugggguggaagucucccgcagcagccugugcacacuaauaaaaacgcccugaguuuucgcgggaaaaaaaguccuagcagcuggaaggaacccgcgcucuagugcucacuugggucuucagccacucacgcggcucccuucugggucacccagccgcagagcccuagccuagaaccaggcguuccaagggagaggagagugcggaucgccgccgugagagaggugaguggaagagcgcguucuaugcacacaguggcacgcggggcaccacgcaaaacugaaaggaacccuucucacacaaggcugcgggggcuugcuucaggggauccgaugggugucuucuacgcuuagcccucuuacuggucaggcgcacuacguugacggcccgggucgugggggggagcuuugcaaaacuuucccgcgcguggggugagaucugcagagggccauugcccacgcguggguuccacaccucuuguaagaggaauccgaguuguguccuccacgcugagccucccucuccggcccugugcacacgguuagacccgaaaacuuggcauaaguuucccgcgcguggcucggggcauugcacagccacugcgcaugcgugcuucugcauccguugaggggcaacuugagaggaauccuccacgcugcaccugguuuuucacucuccugggugccgcuaaaguucgcgggaaacgcgugggguccggcggggaagugcacgcggcuccacgccuaagagcggacacuccccgagauucaauugucgcgcccgagucggguuucgcgcgcccaggcgucuccgaggucaucuaggccaaucgcaugcgaggagggcggggcacguagcccgggaggagccaaucagcagcgagcucuccgggaagggcggaacuuaaacggcggggcuccaggggucuggccugggcggcggcggcggaugugggcgugggcucugugccucccgggucuuuaaagcgccuuuccgggaggccagggucugugucccgaggggaaguuagggcagccagcugugggugggguucaggugaguuuguggccacaagcgcgcgcuaacggguggcccggcccggacugccgguugccauggccacggcgggggggugucuugcucuaaguacgcgcgcgggaggcacgggucuggaacuuugggggaguccugaguggugugugugugugugugugugugugugcgugcgcgggggccccugccuucugugaccgaguucucccuccugggacuugagagguuccaguccgcuucggaguuggcgaguuccaguuacugggacuuaagacuacguggaaugaaugaaugaaugaaugaaugaaugaaugaaugaguagcugcuggcacuuuucagcccgaccagggucuuuaucccgccauggacauuuuuucccucuucccucauuggaagcgugguggauggauguucuuggaucacccagaguguuuuggcaauucacauucaaguguccccacucgccgguuauuaaaacuuuuaagugccuaauuuaugccaccugguccucccaggguggggucuugcccuauguaggaggccaggacuacaggagauugaucgugggaguugcuuccuuugcucaauccgauguaacggggcgaggguacucuacuuccccuccuccuuccuggcaggccccacugacuggaggggggggucucccucugucucccucucucucucucuccaguacaucggcaucauguggauccagguucgaacuauggaugggaaggagacccacaccgugaacucucuguccagguugaccaaggugcaggagcugaggaaaaagauugaggaaguguuucacguggaaccccaacuacagagacucuuuuauaggggcaaacagguaagggggccacuggcgccuuuccauucauccacccucugagcuuuguuccaagcacccugcuucucaaagccaccaagcaauaggcccgcgcccccccucaagucgccagucaguucccgccccccuccuggaaggagaugccucagcugcuggggaggaggagggggcgaacaaaggcaggccuccucagcagcuggccagcuggccucgugcuuugaagccugguacucuuuauuaucuuuuaaacucucuccuaaacguuaucuuucuugagauaguuugaaguggccauagagggccccaagguaguuucugcuuggaauguguuuaacagucuucacgugucggcaguaagaggggaccagguuuuacuuuugagauccacccugauugccugcagcuuguuuccauaagacagcaacacacacaccccucccccgaggauccauuugauuagucuaggcuuguggggaaaauggggccaguggcccuucuuggugccuaaacccguguuacaccucuccagucaucuuugcagcccaguugcccgcacuuggggcaucuuauccuuguccucuagcugggcuaucuuuuauuggugucuagagguacugagaguugccugugcuagcauuggggucucggguggggcaagcgccugugaggcccauuuggcgcugagugcacugcugccagcagagaaggggccaaagucgauuugccagguuuuuguggccuguacucaccuuuaugguugggcagggcacugcugcccucugguguccagguccaaggguuugguuuuggacccccucccuggccccaggaggggcuggcugugacugcccgcucuccuggaugggaguggggguauuguuuagcugggugguguguugacgccguguucaauugcccgcuguggagacucauuuccuuucauacccaguguguuuccugggaacuguguguagugggucaaguucacagaacauggaagagguauaagugaccauacccacugcagagacucagucuuuaacuccugguuuuuaacuggcugccuaugucuucuaucaggucacuggacucacuuucuucugggaccaucaaaggugggaaugcuuguccagguucucccuaaacaguggugguguuuuauugagagacaggguuucagguagccuaggcuggccuugaacuuagaucugccugccucucugccuaaaggaaugagcagugugcccagccucacuguuaacaguuuaaccuguagcaaaccugcagcacauguuacuaccuggucccuuucccuaccucucuccauacuguagcacuguuggcuuugucaaggguuggggccuggcuucuggucucuuccccagcugcuggggcuacuaggacacagcaggucggucauggggagggagcaaggggcuggaagguaggggacaagcagagagcuaggggaagccugcuucuguggugguugauaggaacagaaacccaugcaaguaguccauucuucagaaaguuuuagaugguucaugacucguuggcuuucuccuuugcucuuguggcccagaugccuccauccacugagaacugaaaggagcuagcuggugucuggauuugaugugcuggccccuccuugccugugagcagggugucgggugugugggagggggcucugagcagcaucccugcuagggcagaugugagaugugucugguagacccauguuaucuugagacugccugugaaaagagcuguagucuugagugugcucaguauguucaggcuuuaauguuguuaaguuccuugccucccuggucaugggcagcuuaaccuuucgugucccaaaugacaagcauggcugacugguggcugcugcacauggugauguguuaugaguugagcaggaccuggcuugauggcgucaccagauuaucaacccaggguccccccagggagauguacacucaggguguucuguuucuaugucaggauuccccguuguuaagacagucucuagaaaucacccaggagccccuuggaauacuucccuuucaacuuuuccuuagcuggucucauugaugauugcaugagccaugcugacaguguugguuaaaugcuugaguacccuggaaauacccuggaaaaaccauaccuuuaguuccagcacugggucugucuccucuaccuguagaguucaggguuagcugggcuacagguaacuugguugcucuccucccucccuaccccaaugugucaggaacaaagugguuggaccaaggccugccuaucaggcuguucuggaggcugagacuggguuucagguucaaggccagucuugucugaaaauguuaguuguugauuuuuuuuuuuuuuuaaacuuccuuguuacugugugugcgugcaccuccguguguaugggggucagaggacaguguugaaaguuggugcuuccuuccacuguggacucacagggcaagagcucuuaccggcugagccaucucaccagcuuuuacuuaucuagauaaaggucccguguagcccaaguuguagucauucucuguguagccaaggauaacccugagcuuguuucuccuugagauggaaugacagguuuguguagugcuggggauggagcccagggucuucugcacauuagugugugcacagccccugcccugggguuuuuagucucagucuuagaaguuagccaggaguugagacugaguccuggauuuaccuguugcuggacucaguuauuguugaggucauugagugggaguugagcauuuaggcucuuagacugucuguccucuugugauagauggucccaggggugaccagagccugggcucacaugguuuccugaauuuccuaaccagccauuugguaagugggauguaggugggggguacuacacccaccccuaguccuagucacaugccauugcaggcuuccaccugccuucccgggggcccuuccggggguaguuccagaagcagcagccagaagccguccaaccggccuugugaguuaggagcucuaguuagaacugcuggcugagucugcccagagccuguuccagccacauccugcucugcguguugagugggggcugcccuuagcaucccaggccguggccaugguugggacagcuuggugggcuccuuggggacagggaggcuuuugugguuugauugccuacccuucuggcccuaccuccuaguggugccagcacugaccaccaguccuugggcucaguaacuaccacaauuugcuuuguauuugagaacuuugggcauaugugugugucugucauaugcauaggcauuguauguuuauggcugucagauguccuuuguugcuuucuuagcugugcuccuguuuaugacugagugauguuucacuguguggauggcacacaacaguguuuguucaucugcagaaagacuugguuuuacuguggucacugccucauguuguuuucucucugcccccuuccaucuugggauccccaagucuggccuauggugcagagucucuguguugggugacagauguuguggaguguuguggguccugaccuccaauguaagcgugcaucagagcugucacggacugcugacaucuuugucucccaagcuguucccacaugcagaguuccugaagaaagacccagucucauuccugaagagucuuguucccuuagacggguugccauuccccccuucccccaguccuauuuccaccccaggacucuucuuccugaagucccagucucccacauugguccucaggcuuggucaggucuguucuugguuaccauagguuauaugggccugcaagccuuucuuucauaugcccucccaauuaguuuccaggggugggggcaucauucacuguaacccuaaaaccucuguggguacugauagugcucgacgcauggcuucucaagagcagcugugagugcccaggccuggaacagagcuuugucuggccucuguauucccaucuaccccuuccccaugcuaggccuuugaggaagacggucuguuauggauuuucccacagauggaggauggccacacacucuucgauuaugaugugcgccucaaugacacaauccagcugcucgugcgccagagucuggcacugccucucaguacaaaagaacgggacucggagcucucagacucugacucuggcuauggugugggucacagugaaucagacaagucguccacgcauggugaaggggcagcugaagcggaugacaagacugugugggaggacacggaccuggggcuguacaaggugagggucccuguggcugugugcaggugugacgguggcauucuggguuugcucccaacccagauuuauccuuugccagccuuggcagugccugcccaucucuguacugacaacugcacagggucucuugggacugacuccuuggugacggcacuaccugcagguguucccucuacaguugaaacuucuguauuuuugucaaacuggagguugagccucccugagaauccuagcagaugugguugaagcugaagagugagugccccaugagagagagccaugucugcccucugugaccacaucacuuauuuuuuuuuaaagauuuauuuauuguuauacauaaguacacuguagcugucuucaaacacuccagaagagggcgucagaucccauuauaguugguugugagccaccaugugguugggaauugaacucaggaccucuggaagagcagccaguguucuuaaccuccaagccaucucucuagccccccuuuuuuguuuuuuguuuauuuuuuugagacaggguuucucuguguaguccuggcuacucuggaacucacucuguagaccaggcuggccucgaacucggaaaucugccugccucugccucugugccagcacugcucagcugaccacaucacucuugaucugugcccugcaucugcuuuguggcaguauagauucucacccaaggaucuaggguuacgugggagguuccacucuggaguguauggaggccugggauguggcucagcaacuggaccuagugucacauguggucacuacuuauuugcugucaguaaaccucuauggagauagucacagccaucagagcagaggucucuugcagaugguguuuguugagcuguuuguacagaauaguccagucucauccaguguccauagugcugagcuuugcugccagguaggacaugguggcucacaccuaacauccccuuaccucuggaggcugaggcagcaugcuugaguguguaaggccaaccugggcuacagaguaaaacuuggaggcauagcugggcacaggcccugggucugcucugcugcugggucuccugagccgccucuucccguaggucaaugaguauguggacgugcgugacaauaucuucggugcaugguuugaggcccaggugguccagguacagaagagagcccuaucugaggacgagcccuguagcuccagugccguuaagaccucggaggaugacaucauguaccaugucaaguaugaugagugagugccaucaguccugcccuguccuccccaagugacugcugcuggggauaugggaggcugcccuugucccauccucauugcccuguuuagacaaagggcccuuccuucuucccugggcuuccuagugcuaggagcccagccaugugcugcccugccuugaucugauccuguucagucugugugugugaagcucgcucucucucucucucucucucucucucucucuuuuuuuuuuuuuuuugguuuuuuucgagacaggguuucucugucuagcccuggcuggccucgaacucagaaauccgccugccucugccucccaagugcugggauuaaaggugugcgccaccaccgcccggcuaugugugugaagcucucuugaguguccucggucccaaccuucacagaguucccauaggugcagaaggccccugcccuuauggcuuugcuggacucugcuucccucuucuggucauaugcugggguuuuggccucagcucuuuacuguccauggccuagauggccuggauggcucaccugccugccuaugaugguucccuccauauaguaggugguacagaucccaguagcauaaauugacaucuaguuagagauuuccauguuccagcucugggaucacauguggcccccugcuuauuguugucaauaaagcuuuauauagagucauuuuguguggaagugcuuggcagagggugcuugcugagcagaguucugugauggaccugaagugagugaguacucuggaguagucaacucugcucucugccuccacacauggauguggagaaacaguucacuuugaacaauuuccuaaagucugguuccccaggccaacuguucuaggcugcccugacuuuguguuugugggcauauggccaccucaccauaguguuugcuauugucugugcuacuuugucacuucucucaugugaaaaaaaaaaaaaaaagcuuuccuuacucccauugggugcacugagcugccaaagccuuccuuucaaguugcugucucccuugugcugggauggggagagggucacuuugggaagcuacauuugucuacguuccacauaccuggaccaugagcauagacacuguggucccccagaacauggcuccccaugcuaucacauuucugucccuaugaagggacugcauguguuagccugguaggucugagguuggaccuuugcuugcagcuauccagagcauggaguggacauugucaaagccaagaauguccgugcucgugcucgcacugugauaccaugggagaaccuggaggugggucagguggucauggccaacuauaacguggacuaccccaggaaacgcggcuucugguaugauguugagaucuguaggaagcgccaaaccaggacggcacgugagcuauacggcaacaucaggcucuugugagugaccugcuuggacaggaacccugauagccucucucauccucccacugagcccucuuuggccuagucucgcuucaaggccuccagauuuggcuuucuggaugcuucuguuuguucauguuguccccaugcugugggaaggugugggcuugagugguucuggaggccugccagccuacacuuagcagcaggccaagggcaauugccuccuuuggaggguaccauuccuugcugucuuacccagggugucuucaaacaccugccucagugggugguaaggguacuugcugugcaaauacuaggaccagaguucaaauccccaauacccacauaaaagccacuugcagaagcuugcacugcuagggacaugggaggcaggggcagaauuccuggauguccaggggcagcuagcuugccagauguaggcagaaauugaggcuagacagcugaagggugcccuaaccugucuguagcacaggccugcccagaugauuuaauccacacauguagaaaccaaaggggagaaucaaccugggugaagaagcccaggcucagccccauagugugcuaagguuuugggauguucuguaggaaugacucucagcucaacaacugucggaucauguuuguggaugaagucuugaugauugagcucccuaaagagaggaggccuuugaucgcuagccccucgcaacgugagucuuggucgggcccugagugugccuggguggggguggcaaucccagguggcaugguggccuguugcagccccuccugcccuccggaacacagggaagagcggcccauccugccgguucugcaaggaugaugaaaacaaaccaugucgaaagugugccugccauguguguggugggcgcgaggcuccugagaaacagcuguugugugaugagugugacauggccuuccaccuguacugccugaagccaccgcucaccucuguccccccugagccggaguggugaguggcauaccucugggguuaccuagcaggucuagaagggaauggaagacaggcugggagguagcucagccuugaugcacaauucugcuguccugaguucaaaucccagagcugggcuguuaacaugccccugugagcccagugcugggggagcaaugauaggaguuuggcuaggaccuucugacugccagcuuggcuguaggcucagugagaggaagcuguaucagaguuaagggaguuuggcucgugucccucaggucugccacugugugccccacuccacugugcagcugugcacuuggggagcuuugugguucccuucugcacaagggggcugcuuuugagcugucugacccuaugcagacgggaaaccugagacucugccagagaaggaaggguauugucacaugacgcaugcucuuucuuucccuuacagaacauugggauuugcucuuuuuuuuuuuuugagacaggguuugucuguccuggaacucacuuuguagaccaggcuggccucgaacucagaaauccaccugccucugccucccgagugcugggauuaaaggugugcgccaccacgcccggcucggauuugcucucuuuuuuaaagacaggauuucucuguguagccccggcuguccuggaacucacuggccuugaacucacgagaccugucagccuccccagugcugagacuaaaggcguaugccaccacugcccaaccuuuuuaguuugacuuuuaaaauuuuuguuuaauuuuuauuucacgugcauugguauuuugccuguacgagggggucagauccucuggaacuuuugagcugccauaugggugcugggaauugagucccaguccucuggaauaacagccagugcucuuaacugcuaagccaucucuccagccuuaaaauuuguuuuuauuuuuaaauuauacuuaacaugugugcaagcgaaguagcaggguacucacggaggucagagaugucacaucaccuggagcuagaguaacaggugacugugaugccaaugaugcaugugcugggaccgaaccccaggccucugcagaagcagcugauguuggcgagcacugcuccagcucuguucuugucuuuguguggggguuucuuuuugggacagggucugauuuuauauuccaggacuucugagcuggaacaccucuaccucugacuugcuggaaauagaggcaugagcgacucuacuuggcuuugaaguuuuuauuucuuaugaaguaaagggagguguaggagguggggcuuuagcuccuuccaucccacucaggacaggguuucucuacguagcccuugcuguccuggaacucacucuguagaccaggcugaccuugaauuuagagaucuaccugccucugccagcugagugcuggcauaaaagacauacaccaccaugggucucugggguucuuaaaaaaccuuuuuuuuuuguuuuugguuuuuuuguuuaucuuuguuuuguuuuguguuuggguguguggacagcuuugauaguuacuucuguaccauguagguccuggggauugaacuccaauccucaagcuugguggcaaccugcugagcccucucacuacuagccuacuagccuucugcagacagggcuuuuaguggaaagcuaagaaaacucauguccuauagacauucuauaacgguagggacaguccagguuggaguuuaaccaugugccucugagugcacguggcugcacauggcuagagcacaucauagcugcgcaggaacccacacuugggauuggacuaaguaagcucucgugaccuugguucugaacggccgugugggcuguguggcuucucucuuuggccuguguguagugucugcgggaaggacauuauccaccuugcacuuugggcuccaggccacaugcaguugacauucuugucuuccuagguacugccccagcugccgcacugacucaagugaggugguacaagcaggggagaagcugaaggagagcaagaagaaggcaaagauggcaucagccacuuccuccucccggcgggacuggggcaaggugagacacacaucccuucuugucccugucccuguuccuguuccccacuucccauuucucacauagcccuuuccacauggcagggcauggcaugugugggccgcaccacagaguguaccauugugcccgccaaccacuucgggcccaucccuggugucccugugggcaccauguggcgcuucagaguccagguaugcugauccucagggcuccagacauuucucuauugagugugugucuuagguguggcuggggcaggaaacgauugcugagugggguucagggaguucagguggguaccugcuuaggugcaugacccuagacccuugucacagcuagcuccuuuaugguggcuauacucagccauugugccagugugcucuuguuagggacucauccuggggugugucgaggguuacaguccccaggaaauggaguggguaucuuguugauguucacaggucagugaguccggugugcaucggccucauguggcaggcauccauggccggagcaacgacggugccuacucauugguccuggcugguggcuaugaggaugauguggugagcacugcgccucucauguuacccaccaugacugauggauggaucaggaguccaggcuggcuuuggguagccugucaggauucuuuucuguaucauucuacccagucuccacacugguacccacccucagcgcuggccagaggugcaaggucacucucucaaucuguuucagucacucuugucagaucuaauaguguccccagacaacaagaacagagacacuugugguucauuucugccagagaaagagaugccacgagguauaaccuaaagcacaaaaauaagucuugauuuuauaaggaaaauugcucugaggaugccacagcuaaguaugguagggugggauggcaggagcuggccuggcgucauggucagggccgccgugugggggugugauggcugcuuaauuagaagggaagaugggaagucacaggguggagcaggcauucugcgcccaugguuggggugguucaacccucccugcucagcaaaggaggcaucccaaguucaguagcaagacaugucaggugccacugucucuacauccaccucuagaaccucguguuuucccuaugcugaggcucugucucaucaggcacuccugacacacacuguccucgcucuuugugggucugacaacugggaacuccagggcauggggccccgugcuguguuucugagucuggcucaugucacugagcauaugccuuccaguccccuccaaguuagaacaguacucugccuuuucgaagaguggcacuuguuaaggggacacaggguagcugcauggcuccucugggcguccauauuccacugcucccucagucucacugccuccuuagggcucacacucucuuuuuuuguuuuguuuuuuuuuuuuuuguuuuuuuguuuuucgagacaggguuucucuguguagcccuggcuguccuggaacucacucuguagaccaggcuggccucgaacucagaaauccgccuaccucugcuucccgagugcugggauuaaaggcgugcaccaccacgcccggcgggguucacacucuuguccucaccuaaugugucaaggcuuacucacccuuaugcugcgagcucauacagccauucuucuccauugcaggacaauggcaauuacuucacauacacagggagugguggccgagaccucucuggcaacaagcguacagcaggccaguccucugaccagaagcucacuaauaacaauaggucuguggaaagcauggucccugugccaugggugugacugcucuuguguggcagagggugaggggacauagguuccuauuaacucuugcccagagaucuaaguuugaguuuugagacagucucacugugccuaucaggcuggcuuggacuucagagauccuguauggguguuuugucaagaugucugaauaccacuugugucuaguaucaggccccaagagggcaucaggucccguagagcuguaguuacagauaguugugaguucccauguuggugcuggaaauagaaccuggguccucugcaaggacagcuggugcucuaacugcugagccaucuguccagccccaggaauuuucuccaaauccuauuuccauagacaguggugucuaacacugggaagaggcuacccugccuagccuugugccugcucucucccuggggagggcauugccaggaaaucccuuccugguuggauaccauuuuuauaucucuuuuucccucauggguaacacuuccauuccgccugggggagagguucuggacaggguucccuguguucuggucugcagcagccagggugcagcucuacacgugguuauuguaacgcaucuucuaggguagguccaaagaggccagacaguugugagcuaccauguagguccugggaauugaacuggguccuuugagagcgaccagugcucuaaccacugagcaaccccuucagccccuuugggaggcauuuaaaucagacaguagccucuggcaggcccuggccuaugcuagggaucuuguuuugguguccaguugauaucuccaugaaucuaugugccuuucuuguggaggcauguaacuucucaugcguguccugucuccccaaagggcucuggcacucaauugccacuccccaaucaaugagaaaggugcggaggcugaagacuggcgccaagggaagccagugcgugugguccggaacaugaagggcgggaaacacagcaaguacgcuccugcagagggcaaccgcuaugauggcaucuacaaggugagcgcacugagcaccugcccuugucucauguccuccugccggugcccugagaccccacaccacacugcaccagccacacuguccuuuccacagguggugaaguacuggccagagagagggaaaucuggcuuccucguguggcguuaucuccuucgacgagaugacacagagccugagcccuggacccgggagggcaaggaccgcacucgacagcuggggcucacuaugcaggugugugucuuugaaggccaugagucaagggauuuccaaccaccuccucuuuggagcuugcuguccaucauggugggagcugggauugaaggugcuugcucugcuuccaggucccaggcucuccaagguuucuguugccuccagaaggcugaggcagaaggguugugaguucaaggccagccugggcuacguagcaagacccucucggcaaaaacgaaacugggcuuaguuaggccuguggcuuugagcagagauuuccccuucuugaaacccauguuuucucugcagcacccccuaugucaggcagggucagggguucaaggccagccuccacagugaaguuagaggccagacuagacuauacaagaucccaucuuaaagaaacugauuauguauggagagagugauggcuuaguaguuaagagcauuggcugcuccuacagaggaccuuaguuugauucccagcacccccauggacccacguggcagcucacaaugucaugagaccugacagccuuuucaggcacugcacacacauaguguagcauguaguuaacacaccaauacaccgaaaauauaaauccaaaaauguugaggucacaggugaaucuggauauugagguaauauaucugaucagccaccccuguggccaguguugcuucugcuccucugaccucugacuuuuuuuuuuuuugagaccggguuucucgguauagcccuggcuguccuggaacucacuuuguagaccaugcuggccucgaacucagaaauccaccugccucugcuucccaagugcuggcguuaaaggcgugcaccaccacgcccggccugaccucugacucuugaugaaagcuaaugaaagcaucagcagguagaagcuaccagaacugauagaacacagguggugugugggcagcuaaggguagcaaguccccaagaccagagccaccucaccucucugcugccagaacauuagucacacuuucaucuuguuggggacauuuaagggcaugcuggcauggccucagaguuuguggucugcacugaauguauagcgggauguacagaaacgugugggugcacacaugugugcgaggaggcaggguugggggcuaggagagggucagugguaagacugcugagacuagccgggcgugguggcgcacgcccuuaaucccagcacucgggaggcagaggcaggcggauuucugaguucgaggccagccuggucuauagagugaguuccaggacagccgggcuacacagagaaucccugucucaaaaacaaaaacaaaaacaaaaacaaaccaaaagaaaacaacaaagacugcugagacuagguuuucuuuuugugguucuuaaaggucucauucugucacucgggcuguaucucauauagguccucuugcuacagucucccaggucacagguggggcaucuggcuucguggaccggcagcuagccuugagguugcuauguagcucaggaugaccuuugaacuccuaacccucucuuuaccucuagugaacggugacaggaaugugcugcuaguucuggcuuuacuuaguuuuggguaagacucuucccacauaguucaggcuggccuuaagggacuucugacccucaggugcuaggguaggaccucuuugcugccacacuuggccuccaugcuugggcaguaaauccccucaggugcccaagagcuuguugggugauggcacugugacuucaggaugggccgagucuugauucugccucccacuccuccccguucaguacccugaaggcuacuuggaggccuuggcuaacaaggagaagagcaggaagcgcccggccaaggccuuggagcagggacccucaucuuccaagacaggcaaaagcaagcagaaguccacagguaggugcccccauugggacuugcuacugcccuguacauccccaugucugacgugcuccccagcacugcuguacuccucacugccuuguucuaccuccuccugacuccccacagggccaacccucuccagcccccgugccucuaagaagagcaagcuggagccguacacacucucagagcagcaggcuaaccucaucaaagaggacaagggcaacgccaagcugugggaugaugugcuaacuucacuucaggaugggccggugagccacuggggucccauugcucccaugggcaagcugggucaggucgcagucugucugucuguccuacugcagcacuccaaugucucuguacaugacccaacaccaaagcuguugguuuuuaacaugaacuaacuucugucacccaccauuccucuuccucaguggcucugacuccaaggaccccuugggagugggacccuguagcuuuguauuucugugcuggcucacagcgccgaggcucaccuaugcuggagcggauaugagaauaccccccuuuuuuguugguuuuugucuuuauguauguauguauguauguauguauguauguauguauguauuuauuuacuuauuuauuuaauguaaguacacuguagcuguccucagauacuccagaagagggcaucagauuucuuuacagauaguugugagccaccaugugguugcugggauuugaacuccggaccuucagaagagcagucggcacucuuaaccacugagccauuucgucaucuccuggguguuuuuuuuuuuuuuuuuuuuccaagacaggguuucucuguauagcccuggcuguccuggaacucacuuuguagaccaggcuggccucgaacucagaaauccgccugccucugccuccugagcacugggauuaaaggcgugcgccaccaugcccuuccagaauaucccuuuucaugcuugaggaauauuccucuauacacugccuucuccaguggugguccauccauccauugggcucauauggugucuuagaguuuuacugcugugaacagagaauucuacaucuucagaaggcagcuaggagaguguuuggcuucuaggcagcuaggaugagggucuucaagcccaugccuacacacugacacaccuacuccaaaaaggcuauacuuccuaauagugccacucccagggccaagcauauucaaaccaccacccaagggcugcugcaccuauuucccgcugugccuuuguggcucuggaagugucccuuugcccuugcugugcuugacuuaaaguuugugugcuugacuuaguguguccccagagugagaguccuguaucuuguaacugcuauguauguguguuaaugaagaccuguaccugccuuuagcgaggcugugacaugagacccugccaugacggcugcuguccuggggaugccaguuucuggggcucauucagggucaaacugaauaaagccucuacuuguuacagacugagucuggaugaucaguucagacucuguaugugucucagugcugaaaucagaggucuggacuuagagggacuugaagaggcucagccccuuccugccauuuucagugucugaagccuugucucugugucuuacacugcaguguccucagucuuugcugagggucagaugggugugggagacccuugucuuguggcuggggcgagagugauggaagugggcccucucacuugccuugcaguaccagaucuuccugagcaaggugaaagaggcuuuccagugcaucugcugccaggagcugguguuccggccagucaccaccgugugucagcacaacgucuguaaggugaggaggcagggguuacugcgaugggagcauggcuuggaaccacccucugcacuuucgggguuucuugacaauugccucagcugugucuuuuauagagaucccagaccccaacagccuuugggauguugccaggagcuaccaagagggagcucuguguguacgugagaggacggaguccuguggggcuacuuugagcuguccccucacccugccuauuucucacgcaggacugucuggacagguccuuccgggcccagguguucagcugcccagccugucgcuuugagcuggaccacagcuccccaacccgggugaaccagcccuugcagaccauucucaaccagcucuucccuggcuauggcagcggccggugaugcugagacccaggcagagggcucaugguuccaacuucauaguguguuuagcuugaagguguuguccuucacgucugccuguggcaacucuucugaucuggucaccaguuaaccaggcaucuauaggaaucccauguucuggcuaccaguuggacuucuguuuuucaucccuccacccccuuucuauaacaaagccugcgauuuauuguccaagagaaggaaaaaaauguuuuuguuuuuguuuuuuuuuuuuugagauggguuuagaaaccguugaguuucauaccaggccucaugucaugcugguaggaguucuccccacaccagcugccuagaaaccaucugcacccaucuuugaaaagcccagacaugucuuccuggcagcuaucugugugcuucauuccagggguggccccugcagcugccccucagaccuucauagaugcccuggcccgcgccauucacugacaugauugcagaggggaguuggcuguggccucaggccaggggaccagcugggcugaagcugcaugugccuugggcuggccacuucuucacuccccucaccacugagcauuggaugucuaccuugaaagccugguuuucagagagugcacugacugggugucauggaaggcagagauguguuaucaguuccaucucauuuuuaacucagcaacagaauucugaggguuucuguauuauggguuuuuuuauuuuuauuuuuuaaagcgagauaaauggguuuccucgaugaauuucuuuuguaguuacagccuguacugaggaagauguuuuccuugguagguuuuguuucuuuuguaacuuuaccaaagugugcaggugugucucauggaaacuaaaccauuuacuacaggcagacuggacagcacaguucuaaggguuguguuuuguuuugugugggguauuuuuuccuuguuagauuguuaacauauugcaauaaaauaaaauucuggccgggca

SEQ ID NO: 12566 - RNA, 79548 nt, Mus musculus
uaggaucagaauacuuuaauaagauaucagugucaaaauacauuuccuuauaaaguuaagcucccguacaguuauaaugucgucaguaggaauuugacaaugcaguaauggucaugaaguuguuacauggacaggaaagguuaauacgaaacucggaauauuucucagagugucuuuaguagaacugcaaacggaaaugcccuuaacgcugaggcaacaacacaggaaaucaaacaccagcauuugcaugucaauaacccuucaaguuccgucgcccgccugcgugugugccaggccacacugugcaccgaugcgcagcuuggacaacaccaugccuagguaaugucagguagacugaccuucagaguuaauuuuugguuugagcagcaaguccccuuaggcuuacuguacucuugccugaugggcuuuguguguguugagaguuuuauuguacccgagucaacaacaccuuauguugauugguaucgcaaacccaaaaggugcuuccccucccccucagugaguuacaaagugcucuuggaacacgauuuucagugcuuucuaccuguucagugucacacuucaugugacugagaccucagcuagaggcuguccuuggaggucugcccgcugcucgccagcagggggcgcugcaccguggcuucgcagggucauuugcccggcaagcugugaucuguggcaggguguagggcuggucagaccugcuacccuccaccuggcacccacucccaguuuagcuccaaggacuaggucacuacauuugugaauccuaacuugcuuuaugaauucccauuaaaaacauuucaugguagcugugccaacccaaacgugccgcaggagagagauuggcagucucguagcucagugugcuagaagggcuagcaacauugccugaaaaaaagugagagcgcuuccuuccagcucgccugcgacaugcccucagagccugcaagccccgagcccucauagcggcaacagcacacacguacauaauacacugagaacacgaaaagauagcuugcaauguucccccuuaaugacuucucuccugggacugucacaccgcugccauaucacaaaagcaaaaagucaccagagagaaagaaagagagaucuguggcgguuagucaggccugugggaguacugcacaggucuacaguguccagaacacugagaaaaauaaaauuaacagcccuaaaagaucuuaaaagugauucuugugagcaagaucccauuucuaagcuuuuagauauuacagaguacccauauauaugauaaacacuaaacccggauauaaauucuucuuaaaaaaccaaacaaaacaaaacucaguuuugcuuuugaauaauaguuaaaaaaauccacuggacccggggagagaugggggcauuaccagacagcuucgaacaccaccgcguggcuucacagguaacccuagaguugauucuucacauugcuuuuuugccccauacuaagucguaugaaaaaaccggagcaaagaguuggcuuuaaaaacacaaaauuuuacaauauggugauuagaugugugugugugugugugugugugcacgcauacgugcauguguguauauguguguaggggugugugugugugugugugugugugugcacgcauacgugcauguguguauauguguguagggguguguguguguguguguguguguguguauauguguguguguguguguguguguaggggugugugugugugugugugugugugugugugugugugcacgcauacgugcauguguguauauguguguagggguguguguguguguguguguaugugggggugggggagagggagaauccacaguggaggaaaauccuuuucucuuuggcaacaagaacaagaacacuugaguugaaugacgccaaagcuuuccuagggagaggcaccagccaccaugcuuguuaguauggauaugaaugagagagagaaaaaccuuuggggaauauaaauuagaaguaauucaagggagggagggagggggaaaucuuauaaaauuucagaacacuuucaucaacgguaaaacauagcagguacaacaacuauguauuuuuaaaacauggauaauaaagugagcaugucagauaaaggccacugcuuggugaccuggccaguaggccagguugaguacaucucguaagaagugugcugguguuagagauaccuaauagcaacacagauggaagugaagcuggcaggucaagacggcggggcaggcaggggcaugcccggccagaggcccuggcucagguggccugguccagagcucugagaaggucucuccccugcaggaguguggagcuuccaggcacgggcacguucaccucacagucauaucuggucaguuccggcaacagguaaggcucgaacgauggccccagcagucgacuggccacgccugagaggagggagaggaggguguuuuagaggacuggcacacaccugcuccgcuggcuguagaugaccagaggaaagggcaugcaugcaaacaacugugucuccagcuuccagcaacuuccgaugcagcagcacucuggcccuggggcuccauccccuguucagaggacggagccagaagaggacaugccacagcaguggugagauccaaagauggcuggagcgagagcagagcucucucaguuuagagacagagcugggucccagugugcucucccuucugggguccacacuucccguugccugcacuccuaccaacagaugcccugcccuucuuaaauucaccuccuuucggucuaugggcagaaacgaucuauguugaaauuaguuuugcuucgcauucaacagcuggggaaaccugucauuugcugacuacagcugcccagauguguauaccgggggugagugaugugugguccucucuuuaaacuuuaaacuuucucuuuuaagacuucuggcuugcaagcccaccugcugguaaacaacagaacugaaauaucagcccagggcuuuuggguucuucagauggaauucuaagaacacaacuauaaauuuuccccaacucugcuacuguagacaaggcucuggaauuuucuuucucaaaccacagauuguuugugccgagcaaaggcgucuaugggaacacuuguguguuucaguggcaauagcugaacuuacuggaucaccaggcuacccucccaucagugaguccccugugcaaccuuucagagaaagcuuguuacgguauguguauacacuucaggcaaugagcagcugaggaaagauguagacucuuggucuugcggggccaagagcccggaugugaucugacugauuacuggacgaucccuuccagagccgugcacaaucuuccagccugccuuuccagggcagcgagcuugucuugcucagaaguccaccacagcccuggggcccuugccauaccagccgcuuccuucuaccaaagcuuccccagccugagacccaccuucuggggagccugcuuggccagaaguaaccguggcucugcccuuucucagggacaacagccaaagaggccuuucuuacuuucucacacaaucucagcucaucaaugaggagccugcacccuccugggccuuccuuguacuuugaacaagucauugucaaauccuuucugggccugguaccaugcaggcucuggaauaaagaggagacuugguccugccuaaaccaucucaugcagcuuggcugaugaagagcccuauggacuguaagcagucgcaucagaccugagcaggggcucugaaggcagucuuguccaaacgcagaguugcuuccugcaaguggcugccucucagcucucuggccagccaggccaccuguuugcaucagacccuggcuauggugggaguuccaaagcacucaccugacaccuuuugagcuccuggaggaccguaguccuggaacugggaggcauagcacuguggcgggaacccagucuuggcguucuccccugagcuccugguagaugguggcuggggagguggcaggugucucaguggcuggcccaggccucucauagauuuuugggugaauucaucuggaggauccaagccagagagugaacuguggugcugucauuagggcagacaauagcgcucucagccugcuuucuuuuucagaagucauguagagaccucugaaccgggauccugcucauggcauggauauaacccauucuaacaaggcucagggaaugugcucugagccuucaacccuccaccagaccccugggccaggccugcuuaccgggggccauguucgcacugauggucuugucaggcaucaaaggacaggucccgcccaugaggcucuucauacguuuccacaucaagugugaacugcuggugccuggagggucccccugcagaggugauguguaguuggaggaagugggccaggguggaguaggguggguagcacacagacccagcaggggcaggugcucacuaccagaucuagcugucugcaucucuacccuagccucaucuccuuccuguccaguaggcuguucguucacagacauggcuuaccccgcuugugucuuggaaggcuugcuccucauacuccagcugccgcuuuagcuucagcuuguuggacagggcgaucauggcugggcucaucauguauggaccucgggccccgaaguccuuugcagaccugccaaugccaagagaagacaguggugggugugaggcaucuacagccucccgcugccuggugucuucaucagaaucuaacacuuaugacucaggcgaucuauggagggcagaaugcuaaagggcuugagcggcggcagcucagcucuuccuucuguaagaugcucaagaguucugucaccugcgccucucuccgcacaccuguccaccucaguccugcccucagggguccugcccagcuagaugacaacagucucuagaaggauuucugcugaaugccuuccuuccagaggaccaucuggggugcucuauaaaggguacguacuauagacaagacacaucagcuuaugggacugcagccuacugggaagacaggaaaaugcuggugccugugugcaccccacagaggcuccaggcagauggaaaguacaggacuauggaggaaauaccauaauaccuaucuguguccaaagguagacagacaucacuuaaaaaagccccuucuucuaucugcuggggucuggcucucacauaucagaggaggacuaggaaaagugccagcugccuacacauacagugaggggauauggucagcgggaagcugaugugacccucuagagccuucauaagcagguguguacauguacucgcccugcccaguauguccccuccagccagacaucugucacuaaccucaucuugaacauggagacaugaggcggggcgcucggagguuccaacugcgaugaccccaccggcagggcucccagggauucagcacucugaucacccacaggccacuuaguagggccgaaauguaaugguggauccgggggccacugcguguuggaucugccucccauagaagagagaggggugcuggccuggccacagcauggagacagggacccuuugcucccagcaucaaagaagauggaagacaugggccagugcucagacucugucuuccugcuuuccaacugcugcggguacuuaucgaggaagaaggggccguggguggcccccggggugagcggcuggaagaugcuggucaugguacugaagcagugcuggggggugggcugggggcucucuggcaugagcggcuccucugggcagauggggcucagcuggaaguccucgccguccauagggauguagggugccaaggucuccaaauccaguucacugaaguccgucugaggagacacagagcaaaggguacauaguggcuggcccagcccugcccugccuaggccuuuugaaacugucaguccuccauucaaauaccucugcuggaacugcucagauuugccauugaggguacaaggauugcuguugggauauaaccugcaucugucccuucauccuguacagguucagugagcuuucuccacuuuugaccugcagccuucucuuucucuuuuagccaggccaacuucuggccucuguugcacugcuccuuuauccuauuuguaccagcuaaucuucaucucccccacagggacugcuguucucacucaccaguagauacucagggacacccauggucacaacagaauacucauaagcaaagacacaagcuucagccgcggucggucagccaaugaccccucacuacagauagaucuuuguacccaagacugguacugaaggaagugugccugcuugugcuaagaagugucacaggcacacgcgcgcgcguacacacacacacacacagaggaaaaagacaugcacagaaacaacaagagguucugcaggauaggauaaggccacacacuaaagaacaauguggaagcugggguggagaacucaggcugagacaaucaaagggaggugugaggaucgccccuggagauucucaucaccacccucgcccaccuccaccaccaccacuuacaccauuugugcaagacagagauggggucaacaguuagacaggaguguggggcugagcagggacacaguaggaagggagcgcgccacucacaagcuuccugaccccgaagcuuugcgcagcacaccgggggucucugcaaaggagcccucugucacccacgcgcggggcccaccuggguacugcccgggucccucggcuccguguccauggcgaaaagcuucucaaucacuucgaucuucaagggauucuccaaggaugaauaguaguccucagggcugcugggcuggagaccaggaaggacgagaccaaguaagaacacggggccugucucgccaggaguccauugagaacagacaagcaugguucugcacucugccccguucuaccaagcaucugugaaggggacuacuauuuacaagcugugugaagcagcucagcucaucaaccucucugaaccuucgucucccucuaaggagaggcuuggaucacuuccuagaucagugguccuuaacuuuccugaugcugcagcccuccaguuccucaugcugugcugacccccaaccucaaaacaguaauuuggcuacaguuaugaauuauaaagugaauuucuguguuuucugaugaucuaggugacccugugaaaggcuuguucgauuucucccgucaaauagagggauuuguguaccacggguugugagcuacuuguccugugugucuugaugugcaaacuggauagaggcuguggccagcagggcucugugguugaagccuuugguuugcagagaccugccuagguucuugcugugauuucaagagucacgacguggauaaggguggaagacagaugcuaagagccgguagucagcucuagugucucucggaguaucugagccauccuuaggggcacuguaacacccaagggaggcaguacuucucagggggucuguccagucaucuggcagcagagcuugaggggcccaugagcccugugugcucuccuggagggugggggcucaccguggagcagcuacugcugcuugaagcacuggguguaguguucccuggggugucugccuggggcacagugaaggcuggcaggcucccggacucgcucugggcacuguggcuccucagccccgagacccauggcuggcccgggggaaggauggccuugccauaggcugaggguucaucgaaguucuggcuuccuguaaagacaaggcuugcuugaggagcauucgugagaucugggcucaccccaggguggauaagcccagaaaguucacaaaagguccuaaaagagggccugaaguugacacccucaguacuguggagccuagauaggaccagaacuaugauucaaucuggggacuuccuauaaagagagcaaucuccagcagcauuuggcauucagagaccgagcuuacuagauagaagcaguuguuuccugcagagccuuccagaacagagcugaggaaguuaucagaggagaauugggccauuugccucaguaccaacauggagcugggggguuacaagguuaucucgugcaagagggcucauugcccuuucugguucucugagguguccauuuuccuguggccucucagaugcacauuaucaaagggggauuugauugcaaaggggagcagucagagcugggcuggagagggugcagaccggaagaggccucucccuggacaguuccgggugucagaggagagcucaggaccaaaaggacuucucuuccaggaagaugggcagacauucuaacgcaggcagccaccgagggcuucauccucgcccucagucuccucucggcuacugguucuggcgcuguucugacucagccuuucgcuuaaguuagaggacacucccugagacacacgccucaacucagacucucaagccagguagaggaugggccccucgagagggagcccucuccuugccuaccucuuuacccuucaugaggacuuauaacucaguggccaugagucugugcuucuucucuaccuagcagaaccugaccacgcacagugaucagcaaggcccgagugcaucugugguuuagggaagcuguggccagggaggcuugucauaacaagaacuguccgccaguccaugaggguucuguggguucaaccagggcuaggaaguacgcaccgaaaucgagagaaauaauggcaucuccuggggugggggccaacugggccaguuccucgggcuccuccuucaguuuggugaacagguaguugcucuucucaguuacagccacaucgucacugcugucaaagaugcuguucauggccaucagguguggcuugaacagggauucggucugguccauggagaacaccacgucguucuucucgaucucacugaugggaagagagagcggcucagaguaucugcaucuuuuagcaaaagccuuuggcucucccgccccagacaugucagaagccugguagauaaaccucucagagaaguguuaggcagaaacacaaacaauccaauucugugagccacagaagcagagacggugagguuagccucaaccugugggcuguucgcucgcucccugugcucaagcuguaggcacacaaaaguccuggauuccuauguuaguuuccuucauauuaucaauggcagccgcucauagucuuuccagggguggaggggagaggguauaacauccacaucuucccaaaacagcuuacccaggagagcacugucucccauucacacaacaucaagcauuacucuaugccaucuucuccccccucagcacaagucagagacaugauaccauagcugacaaaugaaaaagaaacacgcuagagcucuguuccuaagaccucaauauagagcccucccaguuagaaggauccacaccacagccagcauguggagguacugcccagggucccgagaggcuggcugcucccuccucgacucaccucagcacauaguugacacacaugauacacugaggcugcagguugcggggguuguagaugaccguccccugggucuccagccacacauauccuccguguuuggcuagcauccgguacuggccagauaccaccugccccuuggugcacacuagugaagaaaggagccagagguaagagaggugcaggaguggugugcagcacacacucuaaccccacaggaagugucaccugcccggggagggggauggacagagcugccagauggaugccaaggccaggaacagugagaggguugggggagggggagaucauuucagccaacucuucguuucaaaaaaugggaauaggaguucugaaggaaagcagauguuugccugcccagugcaggagugacucccagucaaccagggagcagcacccuacugacuucaccuccugaagguagcagaccacaucuggaagguggaccgcagggcugcagccccgucccauucccugacuguggaggacagaacagggcugggcaagugcucguccacggagcuccagccccaguccuuucuguuauuuugaugcauuagucagguuguccuugaacucccucugaagucuaggcgggccuuaaaccauucuucugccuuagcccccugaauaacugggacucaacucaagagcugugucacaagacccagcugaaguuuguuuuuuaaacuuugugucccuugaacuuucugcuaccuuaggagccagauacaauuugagagaaacuacugcucuauuuaucuggaguagggaaaggccuguacuguuaauucagggccucagccacuggaaggucuuuaaacuugccaacugccccgugagacugccagcuuagaguuucuuuccucuccuaggccauucuaaguagucaauuucacagucuaaaaacaccaaggggugucccacacacuaguuugucuucuuccccauuuccaaaugcauuuuuauuuuugugaaagagcucucaagggcuccuuuucagucaugucugcugauuuuagaaaugucuguuagcuucuuaaacuguccacugacuuucaccccccccccccuccaaaugauuguucagagcuccagcccagaagugcccaggucacagagaacugaagaggaaugaugggaggcucaggaagucuugcuggcuuggggacuuuggguaaguaacaauccuggugugguuuccucucauguccaucacugucauuucuaacuguccagaaggcuacugcuguuugcagaucaaauggacuugccugccucaucggcuacacaaacacuguuuaggaauuuccucuuccacaagcuaucaaugccuagugcuuagguacugugccaguuauguuacuaggaauuguuuacggcaauuguccugggguucuaggagagaacagcuauguucccuguaggcagucuccuuggaucuaccagucagcucgugggccaccucaucaguccugcauggucugaugagggauggccuuguucauagucacaccagucacaguccuucugccuuggcacaucuuacccucuuggauaucuuaacacacagcagcgaggagcaggaaugauggagaauuacaugugcgcauugcucagcagagccaccgcugccuugagagguaaauucaagucccugugacagucauuacauagugcaccuguggaguucagugucauggcugccuugcuugguguggguuaccagugugugaaacuccugcuucccaucgacagcgacugcagcccuugaaagaguccuuuggcuaaacaugauugccagcuugcacagucucaggcuugagagucuagauuagacacauuuuccucucuacaacaagcuuuauuguauuuuaauuaauuuuaauuuuaauuaauuaauuuuaauuaaucccauggagagguaacuauuucacgcauauaguacagugaguuuugacaaacguaaacaccuaaguagccaucaccacagcagagggaccaaaaacuucaucugaaccugccccauggcccacgugccuaacuccuccuccuaguucugacuucugauuccagacgaucaccgaucuuuccccggcaccgucuccuguccuuucuagacgucuaugggaguagacuuucuugaguuuggcuucauuauccuugagcaucguguuccugagguuguggguguuucugugauucgugggagagaagugucucccuggguguaccauggccaguuuauuccuuugaccuggauguuugaguuucccguugugaauaaaagugcaauagacaucuguauccaaauccacauccaaaagaacguggcuuucuuuuucauggggguguaacaagguaagaaacuucuagauuaucugcugaagaccauguuuuuauuaucagaaguagucagauuguuuugccacuuugauugucuuaucuucaucuaaucuuuuaaauggacuccugugcaggagggaggagagacagcacccucuaacacaaggaaacgcagccuaggaaggcuguguuugcuucacuuugcacagaauaacagucauaguguuuagaucaucggucuuuugauuccaggggccauggauccucucugacuacauuauguugagccagaaagaagugagaagaaaaaaaaaaaaaaaaacgggcuaaggccauguuguuaaccaucauggacuccuuggccagagaaggaaccuuuaucuuuucugcugucgcuuucugggugacauggaggccaccuggcugcagugacgcaauucuugcaugacaucaagccuggaauuagcucauuuacauaguucuuauugcuugccacauucaguguucuuagucuuuuucacgaagaaguucgcugagcggagguuugagcugcacuucuguuaagugcaggcgcgggccugcuguaucagucaccucuaagucacaccacucccauuccucucauuaaugccagccuuggugaagggccugccacuccaggagagagagggaggcuuuuuauggccuuuaaucuuguuuuccuaagagcacaacaaagagaaaccagcccaacucuuccccucugagagugacaguguauagauuauuagcccauuuggaaaugaugacuuucaauuaucuaaaucuggcugaggacggagcuucuccaggcguuuggaugggaaacacacacaagcugugacacacauggugaaucagagaccccacacacuggcaggggaucuagaauggaacuguacuuguagggggauagggcggaaagacuuugcuugaugcaggccucuugguuaaauacaggccucugugcucagggcagcuuuuccuaacuccacugggggaaaaaaauaaacaaaacccagaaaaucaagagucuguacuuucuauuuggacugugaguuauccuuaggugugcugggggguuaaauauauggauuaaguaaaaacaauauccaaccaaaacguuuuuccaacguauuucccccaggagucagcugcaaaccgguaggaccagcuuccuugcuaucccucuuuauagaugagggagcucuaaacagggagccgucuucuuuccacauggccacugagcucucuaacggcccuccccaggagacaaaguauaacacuacccuccaagaauucccagguacuuaaaaugaagauauuuucccggcuguguugacagaccccauuggcuuagaaggccaagaaaaaaaaggaagccagacccagagacacuagcuggugagcuaggccagagcugagcagaauacaguugugugucucuaccaaucggccuuggggguggggaaccccuagggagcacaaaagcauugggggcccuccaagagaaggcugacaccauaccuuggagucucuggcugggucaucucccugagagcaucagggaguguccugccaccccugggguagucuauuuggauauuuuuguuuuuaugccagagagacaguaagagacuugucugagaugccauaauggccccugcuguauuauuagaucagaugaaacccaaagcucccagggaggaaacagaggggugaguuugaauucucauauucccucccucccucccucccucccucccucccucucucucucucucucucucucccucccccccccccaugcugugcacagcuuguggaguugcugcacaguuagugaagcugagcucgagcucucccgacuguaaacagaggagugucgggcagaaucagacuuggaacagaaagcuacacuucuguuuccuacauugccaguauggcugcuagguggcuucucaggguuuccuauuugaagacuccuagccuauccccucggcagcccugucuguaccaguguccugcuuggaugaucucuuuccuaaauauagucuguuuaugagauuaucauucaccugcuguuuguauuaccacgaugcuaugagagaugcuaagguuaaaggucacccaguuucugggagccaggcucccuuuucuuccaaaacaaagacuccuuaggguagagaucaagucuaccaaucccuaguccucagaggaccaaguccaguuucuuacauguugauggguuuuacguauucaaaauuacccuggagcauccauaaauggaaagaccgaauuggaaacguggccaagggaacaccacagaaccacucaguccaauaagguagccaagugccaagaaaagcuacuuaaaucauuuaaaacuuaaguuuaaagacauuucucaaugcaccagacacacugcaaguacuaccuaggucuuguguggccuaugaaggcacaggauguuucugugauagaggcucuacuacuggacagcucuguuccugaacuccuucgcugugcaggcucucccgcaugcacacagugugcugcugcacaggcagcccccucucuuaccucuuccucugguuagccccauccucucuaccauggaaacugauucagugcaagccaacucucguuggaaccuucccaggcccucuucuaugccgaggugcuugccgaucuagugcagccccaagcugguuacacacccacuuuuagcugcucuucaagacugccccugaggguugcauagaauguuaaccaucugcgaggacucaagagucuuuuucuuaauuugcauaaacgccauuuaggggcugguggcaucggugagucucugaccaucuugaagguaucuaccuuaucugccacccaagaugguaacucugggaggaaguaaccaaggccgugucuugucaaucauacccucaagggcagacgucgaggacacaggguaucuaggaacucacaguucuggugacuuuuggucauguucuccgaauccagggcaugguagaacucauaggcagagcguccaaguagcuccucggggugguaaccaaucaguuccaagauucugaauuaaaaaggaagcagcaggugaggacaaaagaccaaacagccuuggcacagcaugcgaucagagacuucaggaucuaaggugaauguaucaaguaucgucacaccucaucacaccauuucuuuacucaagcaaaaccccaucaggagggcaucauccugagugagguaacccaaucacaaacgaacucacacaauauguacucacugauaaguggauauuagcccaggaacuuagaauacccaagauauaagauacaauuugcuaaacacaugaaacucaagaagaauaaagaccaaaguguggacacuuugccccuucuuagaauugggaacaaaacacccaaggaaggaguuacagagacaaaguuuggagcugagacgaaaggaugggccaucuagagacugccauagccagggauccaucccauaauaagcuuccaaacgcugacaccauugcauacacuagcaagauuuugcugaaaggacccagauauagcugucucuugugagacuaugcuggggccuaacaaacacagaaguggaugcucacagucagcuauuggauggaucacagggcccccccaauggaggagcuagagaaaguacccaaggagcuaaagggaucugcaacccuauagguggaacaacaauaugaacuaaccaguaaccccggagcucaugucucuagcugcauaugaaucagaagauggccuagucggccaucacuggaaagagaggcccauugauugugcaaacuuuauaugccucaguacaggggaaugccagggccaagaagugggagcgugugggggacuuuugggauaacauuggaaauguaaaugaaauaaauaccuaauuuaaaaaaaacccaucagacucagcugcaacuguggaucugcccccgucccccacucuccugcccuuccugaaguucuaucucagaggacucuacugccuaguaucuaagagguccuggggucaggaggggucacauggcuccaccucccaguucaucuguguaaguggagaucugagagaggacagaauuggcuugauggccacacaagugcccaguucagacaggaacaagcgcugaggccuccuagcuagcaucucaagcucauucuaguugaagcugaggaauguuuagauggaaauccugugucccagaagggaaggcgaggaagagccagggaggaaguuuucucuccggugucaccccuggaugcugcucagcugccaucuaugacccuagaugugucuccagcagcuugucucuucccaucuccaugagggagaaggacagaggcugcuaaggggaagcaacauaaaaaucaguccuggcagguaaacaagcagcgaagccagaaaauggcaugagugcgccgcguguagauguguucccucuggauggucuaguuuugguugagaacuggacaggaaaaagccaauauggagagagccacgaagacgcauggaagcuuucuguguggagacauuuaagugaacaaaagccugcccuagaaucacugcaccggccaccuugugagucgcaugucauucugcugugagucccacgaguccucuaucguagaugccucacacuuugcucaucacaagccagagcugacgggagcagcucgguaugaccauccuccuuggagcacacugccuuggggcacagcuguguucugugcccucuggacagaggcuaaggacaaggaaaauaaaaagcucugcuugcucgagugacugucucuguauucauuccauccaaucguaauggcauguggcuguuagacccaguccuucucaagccagcuacucgucuuaggccagcuacucucuuggcuggggcaaacugcccugguucuagaucuccccagaauccagucuuugcuuguaagaaaucugauuuucagcuaacuugcagggugucauguacucuccccaccagccaucugcaaccaguuucucucccagagucaccgcaggccucuccuucuccaccgaacccccuccaauuccuucuucucuugcagaggccuaaaggccaugugcccgggcccuaggaaggauguacuggacucuuacaccgugggccuucuccuccugccuccccacagugagggaagucaugcugacaauccagccccacuuaggaacccgggucacgaucuacuuuccuuaagcaugauuaaccaucucagugcacacguguucacauguguuuacacguacgugcacauguguguacccacaggagcaccucuagcagcucaucacagucuucagucugcccuuccauucuguauacuaccugcucuuauguuagcagagaaaaggcaaguuuucugaccagacgcgaugcuggaggcccaagucuuugcagagcaaagguuaggcccacugacauaaccucuaaguauggcuaauucaguccugugaggcuggcagagcacuagugccagcuggccauccuuaccacaagaggauuuguccccacuugauuucggacccuggagcugguacccacagacacucccgcugauauaaagcuggggggaaugaggaguggagcaaugccuguaccuagccauacagcauucccgagaagccaacugcaccucaaacucccugggaaucagaaccagaaccagggacagcagagccacucacaggguugcucacuugccagccggacugagccgaugcaaaauuuucuacaaacuuuuaccacuggccuucuaggaaggaugugaucaucuuuccugaagaaaucccauuuccuuucacgauuaggaucuugccaucaaaaggcuucgaguaaauauuauaaucaaccucauaauaagauguuuuugccuaaugaccguaucauccuuucaaagacacacaaugggcauguucuagaagacaaacaaacccagauuucagacuugccaguuaucuucccgcuagcagcuuucaguuaucuugucagccaaaauaaauauuuaauguuucccucuucauuccuuuaaacagacuacaguaaaaaacugggaaaugcgcacggcccgaacacaaucgcagaccaugcggguucucaagacuucacaaagccaggaagccccaaguuacagcuaaugaccguuugcccccauccgcaggcacaccgacgccauagggagguuaaggaaccgaacuuguuuauagacucgcuguuauggcccccggggccuucccugcucauuucccuggcugcggcagauaagagugccauccgugcucuccaucaggggagagggaccacuuugcucuucauaauuagagauccuugacucgcuggaagaagaaucauuuggggucacccguaaacuuaaaagucaacucgagacugcacgagaggagggggaaacguaaaaagaucugucggauuucaaagcuggggaccgagugcaugcuuuaauaacaagcagauaaagaagugagacuccaaagaggacggagcaagccuaugaggaggcaggagaggaagaaagagaggaaacagacaaugaauggaagaaggguaucuuuguucugaagucagaccagacucuggcuuuggccuucagagugaggcgugaagguaaaaucugaggugauuuauucacuguccacaacugcucuuuguucuggagauagucuacaagcacgagugaggaaauggcucaaagugcucacuauccaagcauaaagaucugaguucagauccccagccucagccugcugcauggcagaagaugucugcaagcccagugcugggccaguggguggggcaaaugcugggggccaguggguggggccaguggguggagccaguggguggggccaguggauggcaguggcauagcaggcagaucccaagagcuugcugaucaguuacuuuagccaaaacaguaaguucugagcucauugcaagagccugucucaaaaaaacaaaguagagaauggaagaggaagacacccagugcugauaucugaccuucagaagcaugcaggcagaccaagggagcccauauacgcauguauauacaaacacacacagaaugaaguguggcauguuaaagacacguguagguguguuauauggaauggucaggaaggaaauggucuucugcaugcuguccccucuagagacagcagaaucagccacaugccaucccucccaggcugcagcccccuagugccaauucuaucgcugcucccucccuucagaggcccaggguuugcugaguuaaucauguaaacacagugucuagggaguaucugaacucugcgugaagaugaaaguacugagcacuuuuuagccacguacuugccuucccaagaacgcuaucauuaaucaauguguauucucacuggcucuuuccuugugugcuuuaacgacccccagacacuugguuuuuauuuucuguauauuuauaagcacuggcagugcauuucuuuaaugauaucuagauuauucacuacucagauuucaagaccuaaucauuuuaauauauuuuuaucugggccagacuugcuucaagcaacagcccuuaagucuugcacacacaccccgaauacugcccaguuauaugaagucuauaccccagcucuaugguuaacaguucucuaugggaucuauggucucugugagauguguuguugguagggugaaguuauacaccagaagguagccuggaccagugcuauccugcaugccaccagcuccgucgacaaaacccccaacagugagaaggaaugugagaagugacuaauccgugguaggaaccccaucaugcaauaaacucugauauaaacuacagggagucugcagagcauuuccaacagaccagguguuucaggacaacaugugaguaguuguuauuacacauucaaacauggcuagggcugauuccagaauacugucagcugagcggacauaaggacacgcagagcacguuagagucuaacuucaggaucuaaagaagcauuggauaaccccuaacugagaugucuggagaaaggcaauguacaggccugcuaaagcacuuggaaucaauuauauaugagaccaaaauacauucacggugcuugcaaaagaucacccugaaauuaaggcgauaccacccauuacaaaaagcagcaaaguuuauuaaucaucuccaaugugcaaaagggaacauauuauuuuacaacgaauuugcuuaaaccagucugcuuuacucuuggacuugacacaccuucuagcugucuucacacacgccuggccucacacuuuaugguucuuuauaauuuccucuuuaaaaaugcauuuauuugugugaguguacaugccauaguguguguguguguguguguguguguguggucagaggacuacuugugaagucagcaaaucagcucuguccauacugguucugggggucaaacucgguuucccaggcuuggcggcaaguuccucuauuugcugagccaucucagcagcccaggacuucacggacauucuuuccauggcccucaagccuucucucacucaagcugucuuacuguuccuaaguucuuugaaugaauccaccauacaucuuuuuccccaaagauuuaaguacgugugcgugauaacacgugugugcauguaugcauauaggcgcacguguuugugcccguguacgugugcccucagaggccagaggcccaagucccuguaaguagagcuacagguagcuguaauuauguguaugggguggggucucugcaggagcauuauacacaagucuuccuaacuuacaaaccuaacucuuggcuauguccuguauuguuuugauggaacauggugcucucaaauucuuuuugugugguuuauucuuuaaaugguuuuacuuaugaguuuuaaaugcuuacuauaauuuucauacaucuuucaaaguuacagaagacucacaaaaucacacugagauuacaugugauuuuucuaagaaaaccucaucuugaugaguuggcuuccuucacaguuauucuauuuggccacuagauggcaucucacgugaauuuaaaaacccaacccuuuuaaaggauuucagaauggcuugggucuuccuccaggaugaauggcacguucuguucuguccuacaaauucccugugguuucacuaagcugcucggaucucaagcccaaacccucaggcaccaggacuuguuucuuucccccgugacacaacaguuuauggcagcuguuccccagugacagcucauggauuagucccuaagaauguuaggaaacagacagacugcaacuuuuauguuugagugcacagcagaggaggacauuaauuacucggacaauaaagacauccucagcacucaggaugcuggggcaggaggauugcugcaaaucaugggccagccuugagagggugggggcuagaggaagacgagauuuuucuuuugccuggccaagcaagugaagacuccuguugccagagccacagcaguccacaggcgggcacucuucaucugaaaaucugaugcccaaagugugccuacauuacacuuaaaaacuucagauucuagagcaguuuggauguugaauuucuagauucacuugaggacaguuuacgcaaaauuucccccaaacucgaaaaugagaaacgaguuuaguuccaagauuuucagauaagcaauacugucuaagccauaacugugcccuauacauauaugaaaaugacagacacuauuggaggguuuaaaguauucacugacucauaauuaauaaucaaauacauauacauauauacauauauucauauauagaaacauaucacacacauacaagcauaaucagaggaaaguaucaaacucgcucaaaucugauuguggacucaaaauuccucucuucagauucuuucccugcuucuguuaggggacacaauccccuuugugucagaugucaccaaaccaaauaauucacugaguaaaaugggggagcccugcucuacacuggcucucacauguaggcucuggauuuagagcacaucucucagaaggucauguuaguguauguauucucucucucucucucucucucucucucucucucucucccuuccccucuuacacacacacacacacacacacacacacacacacacugcuccacaucucaacacaugcaaacagaacaagccucucccccaacccaaagcaaucgagaaauaacaccaagggauuaaacacuuaaaauagccccuucacuaacuguccuaucuguacccugguuaacuaaucugcuaaucgguuaaacgcuccguggggcacucuguguuugcaucccucugcagucggcucccuagcagaacagaauucacguugggccggccaugcaaucagcuuccuuggaaggcaagaguaugcugaaaauacuguguguccuaagccacccuaagcggcaucucccugugcacgacgagccacaucucuaaaucccaggauccuuccugugaguaugaaccccaccccacccgccguacugagccaaccuaaggacgucaccaugguaccucugugugcgugcacauggcaucuuugucccuuuaggcugcccauuucuugugacuguccccuucugcccuuaacccaaggcuagcccuuuuaccugaaacccacucaaaccacaauaaugaauggaaauuaacagcaaaugaaccuuucugggagauaguucccucaccugccagcuccuuuuuacagucucuuuucugcuuucaggagauggcaggugaggguuugguuuuccugcuucagagcaacucccuccugucacccacaucccugaccacuccuggguuucugcacaagcaucccaagugccacugcaccucaaagccggugucauggaucuggcaccgggacuuucggggucucucugaaaacugcagagggcguaccuccgaucuaucuucugcucagagagacacggcagagcugagcuuacgaugggugaaguagucaggcacagugagugaugccuuucacucaggcuaggcaugcacgcccagugcagccucucaccuggcuucccucacccuggugcaagccacugcacaucacaacucguucucaccguuguccuccacaucuccaucccaacagcagcagcacaaguggauaggaacugugguguagucuauacaaaccuugcauguacugacaaccacacagcaugccuuccugugcacccucuguggucuccccuuuaaugaagguaagaacagcagccuacacugaccacagaugacucugcuagguucucuaguccaaguccacagucuuuauuguuucugugccccccacucccaagagaacguccaguugcuuuggaacugaggguuagagucuaaccuagcucucuucauuuuaaagucuucacauggaaggaggcuaccuucuacaaacuugcagccagcagucccacaccauguccuagucccgucccugcgcugucacacucucacagaugcacacugguaagacccacccugucccaacaccccaccugucgucacaguaggugaacuucauguccaugcuguggcggcucaggaaagucuugcuguccagggggauguccaugugggaugggugcuggauuggcucacacaugaugauaaggcaggacagcaggggcuccuuggagccacagaggcuacugugaggggggcaguuguuguagacucucacuugcccggugcagugcaggaccuggggucaaagcacagaaguaagacaaggccgagacggccgagaagagggagaggccucaggcaccuccugcuccuggcucuuucuugagacuccacgaauccuaccuuccagguggccgacuugagguugacaguccggccucuguuggugaccgugcacuucauccucaugaagaagucacgcucgguggacacgucuuugcucuucuucccaaaaccagagccugaguggggaagggcgugggagccaguuaaauuaauccaaauuacaauguuucugggcaacuuguauuugugucuccugugguuuguaguagagugcguguagccugccaugggcagagaggcccucauggcuuaaauacuaauggugucccuuuguugcugugccuugaguccuggcucaauuguggucagaacuagaggacagaaauaugucaaggaagguuuuuuacaaaacuucuagugauggccagucccacccagggacuaugagcuaacaccagguugguggagacucacaguggagggacuccugggagaaagcugcuccccugcagaaguuagauuucuuggaggauggcugaguagaagcuccugugugacugcauucccaggagcaggaaggccuggaaggcaggagcugugccauguuugcuacacacuguaccuguuugucaccugagagcugugaggcuacaccacaguuuuagaugucucuccccagucaggccuugggucucuagcaggaaaccugagagugaccaugguugcuccaaggacauaagucugucuaguuagaauuauccuuggacacuccucucugcucucgcuagccugucucucaggaaugugagcaaccaauauccuaccugaauccucgaaugacuaugcuuuggauaauguaccauucaucaguuuccuccuaaggugacacaugucaaggaggggaggggaggggaaugaacacacacacacacucacacacucacacauacacacucacacacacacacacacacacacacacacacacaccccuuguuuuuaacuggaacuggguagacaagucuaucuuaacgauguucuugauaaagaucaauuagaugaccuuucauuuaggauuaaauaaaucaccgagacaaggaacauacggcuucuuuccuuuaguacaaaucuccaaagccuguccagguuuucugcuucuuguuaugcagaacagaaaacaugaguccaacggugucuaaacuguggcuacaccgccaucuucauccuuggccuccacaggcccagcaucacagagcaauucagaacuuuccaacaaguagucacacugcucuaagagaagcugccaaccucugcacccacaccucuaaggaacauugauuugaccgacacagucuaaaacagcuguguaucaaaagaacuggcauccuugaacuggauuuaaacaucuucugcagaacccauuaagugacagcuugaauguuguucuuauaaacugucucucccauaauuaggcuucuuauaauuuuaguuauuagguggaguuuguauaugaugaguuauaacuguacugagagagccccccccaggauuuaggaaugagggagcucaauauucauuugugauuaauagucuggguuguaauugugggcuccuaacuugcuaaucacuggagucuccccauucugacaucugauaguaucaccucagcuuaaacaucuucaacagccuuugacuguuugcaggacccaguuugaggcuuuccacucaccaucaaagcauuccacagcccgucucccaaccuuuucuucuuccaggaauccacacggaccccuugcuuuuagaccaugagucuaugcagccugaaaccuucagcaaggacuugcugauuggcugagucugcuugaucucaaauccccauucaugaaucuaaagaccugaguuuuccucagauaaguggaggacacucagcuaugagucagagaaaccuaaaagcaaaaagauccuagauuuggccucaucuuuugccaucgauuugaaaagaaagacuuugaacagcacaggagugagauucuuaguucagcucacagaugcucaaacaaagguuuuggucagcaguugaguugagacaaagaacccagggagcaguguucucuagaagagaagcaacgagagacaccgauuuaggaagugcuucugaaagccaaguaugguggcgcaggucugugaucaauagccccuucaccaucaagaaccaaucauucuauguguuggguggcuuagccuaggguuucuuggcaccacaggcaagacaaauaaacucauggugguccccagccuauguacucuggaagccaguugaccaaggucuuuggauaggaagcagcaaugcagaugagaggcuggggcagcauuggaaagggaggugguuauaauuuuacaaagcuuuguaagucugaguguggauuacaguacucuguaccaacaggagaggugagccaacaaagccuccccuuuugcagcacacaaggcaacgagaacacgccucgcaggcguggcaucacugccuuugcuauucagguuggaugagcacacaccccauaguagugacaggugacagauuuacaagauguugaugugggcagucuguccagacuggugauagauucucaaguucaagaggaucucaccagucauuggaagccacugcugccuacagcgauggcuccuuucgugugguuuggaaagauuugcugaaguuuguaccuuuguguuuaugggcauauuugugcagauaccugcagagguuaggggaggacccuggaucucccugaagcuggaguugugaccuaccaccagucaaagaaccugggaggucaacuuagguccucagaagaauagccaguauucuuaaccacagagccagcucuccagcaccaaaguuuuaguucuucugaaaaucuccacauucccgucauagcugcucuucagugguaauccuaagggccaugccucuugacacggaccugagacacagggcaagccugaaccuuucccucgccagccgaauaggguuagaaguggugacaugccuauuucagggcuagggccuaggauggucuguaggcuucugcagcugcacuuuacaggggagaaggaagaugcauggccugagcugucauacaagaugguugcucuggagucuucauaugaagaaggcuaccgggaggcuccauagacugagagcuguggucacugucccagcagcacaccaggugagccaucuuaaucacuucaaccuaguuuagccccugauggcugcaauccagcugaugucacauugagcuagagaccugcccacagaauccccagaaaugugggagauugcuuaagccuguguguuggguggcuugauacacgacaaaaggcaccuguagcucccauaaauaaucaggcauagaugaagcuauugguuuggguggugucgcuuggcggagaugauugaucucaggugaugaugaaauguccuagagauggcacccugaccucguagugugacaucaggcaucauggaugggccauuaggagcuauucuaugugcugggccucaucucaacagcugcauacucacccagaagcuaguccaacuguaucuauggaacauaauccauuugggcuauuugugcaggcuuugggggucaugagaagaaugcaaacaaagaagaacacuuuaccguuuuugagagucagguucucacggaucuccucauggucgcaaggaugagugaagucaaagaugcuguguccuguuaguucuaccuguuucaaaagcaaggccagaugcuguuacuccuagugaugaagucauucggacuccaagaggaagcuaggauaaugucugcauucagagacaggcagggggaugaacugagugguuaucaauagucuccagucaauauugggucuauggacuuacagacguaucagagcaauguugauggcaacaagggcuugauuuauacuuuugccaaguuaaucuagcuagaagagaccugucagggcagccacaaggaaugucaagccccaugacauugggaaguccuaaggacugucaucaucauaugggaaugcauaaggaaaagucaaguaagacuaugccuaggaccccccguuagugucuauccccaaauaaagacauguuuuuccuacugaacgaggcagagggugucaccugaguaagucccaugaacuugcugauguuuuccgacagaaagaucaugucaccgucuugggucaccacagcaaugaaacccuccaaggcuuucagguacaaguuauccauuugcuggucggccucagcuucagauucauuuucagagcagacuggagagagaggggaaugaacaacaggggcacgaguguuaaaacagacaugaccgaggggacaggcauggcuccagggcacagggaaaggcacacuaccaaccaucuaacauuugccacaugccugguggaacacccaggccacauugacaaugacugugggacagcgugguuucugugguagcagaauuugcuguaccaauaggaaggcuggggguagaggcuacagauagaaugcuagaccucgcagcagcagcagcaguuauuuuagcugcuaacguaaguggaacaucaaccacagacagacccagcauuaaacacucuacauuggcuuuucaauaacgcacaaggcauguaccauuugcagucucauuuuauagugcaagacuucugagucaagccauuuuuccaaaggcuaugaugucuagaauguuaggaagccccaggagcuaagugcagggccacguucaaccaccucacaagcuucggagucaaauguuguaucuauuccuacaucugcuucccacuugcuuaugacuuuggguaacgauugaacgcuggaguccuccaccagcaaaccaggauagcgauucccaucuucaugaauuguaagguuaaguaaauuaacugcuuaaagugauaucaacgacuacaagcucuaccucaucugcucccuccucuaagacaccauuacuaucucaaaucagagccaagguggcgaguucguggcucacaaccucacaaagcuaaauaagcccucacgcacauuaccaugggguaccaaagaagggguacagagagcacaagcuccagcagucagaggagagaugacucuaaaaaagaagacauaggauggagaggaaacaugaaauaucucccacacucauggauuggcaggauuaagauagugagaauggccaucuugccgaaagcauucuacagauucaacacaauccccagcaaaauuccagcuccauucuucauagaguuagaaagagcaauuugcuaauucaccuggaaugugaguucacaugaguauggaaagagaggucugucaggcaacuggacaggauugggccaccacugcaggacacacagacagccuuccucccaggacagacaagaggccagcuagaggcagaagauccauggcccaauaucagagacugggacaauaagggagcccagugucccaaagcuucucuuccagucaaggggcagagagguggcuucucagagcaccacuuuggggacauaaguccggggauagauagcacauagaauagucgaaagagaauggaacuuagaggcacaaagccgugagggacaagaggcagacacuagggggcguugugggggaacucuacccccaaccaugcacucuguguguccuggacuaccaaguccaccucugcaaucuaagcucagcucuuguuccggcuccuggcuguuauccucagaccacaggcuaugcccucuucuuguucauuauuuaaugucaaauaugugugugcuuuagaaaucuggauuuaaccagguguguuagagcaggucuuuaaucccagcuaucaggaggcagaggcagguagaucucugugaauuccaggccaucuuggucuacauagugaguucaagucuagccaaggcugagugggugggccaggaccucuggcgggcccaggacugcuaugcaacuugcgggauuugugcaaaguaaaauaaaaacguggaacccucugcugaaaauuuaagcugagcucagagcccaagaccuggcuaguacgaggaggccgcaccccacccaggguggugcuggaagguucuaccuccucccaggcuuccuuccuaauucagggaagcugaaaaagugccuuuucuuccuuuaacaacaacaacaacaucaacaaaaaguguucagagggugucaaagcugucgcuccagagaccacgugcugaagacuaucccccacgucaggaaaaccagccagucugggcaaagggugccugaccccggaaacaugcccggagaagguuucagcugcauuuggguuauagggcgagguggcuacuuucuccagacagacagaggcuagugcugaggccuacugagaauuuauuuucacuucagcuucuuugaucucaguggcaacacugacuucaaaaucuggaguaaucccaagacaaccuaucgggguuaacuagacccagagaaaauaguucugcuuaaaguuuccuguuuuuaacaggcccggcacagccaagcggccuuuccgaacuguccagcacgcuuacuuccaggagguggcgaaauuggcuacaguggcagguggacugcccuuuagagaggagggagaagggugucuggggccacagacauggaacaucuugagacugaagucacaauggccaauagcacccucccccaccccuucccugcgacccuagagcagcccagcuuggguguggccccuuccuucaguggaacuauuugcucuuuuagcaccugcuuguccuccugggagucucugaaggaacuuggcuaggucacucccagccaagagggaggcagacaucccccugcugcacccagagcccugagccuccugucacaauucugcuaaaaacugcuaugccuggcggcugcgcacaccagaccucccucccucccugcaguuacuaaggcuuuuccuccauggcuucccuggcucacagcacucauuacacacucaguccugucucagggagagcuggggauacugcaaggaagggugcaauucaggaaccaacaaacugccaggaagacaucugucgaagagccuaagccccuccuggggaugcugauaacaacggagagcaaaccauugguacaaaauaaaguaggugcuugcuaaggaacugggcuggguggucuaaauagcucagguucuacauccuggccauuugcuucccagaaucugucaggguucgaaucucaaagaacugguauagacgaacugucuccuuugagaaggaccacgaaauucuuuaaugcuaaaaauagccccaguaaacaggcuuugauggcucccaccgccaggauaugugccgcugagaaggcuguggagggccuuuuccggagcacugcucauuuccuuuaggcagcaccgcccauguuggguggcacaccaguaugguagagccacuugccuugugugaacuagcagguggcagagcagguggcuucuaacugggucuuugaggccuggcugugccagccguaaggcugcugcuuucuuacuucacccggaugauccuucuagauguuuccaucuucaagaaacuccuuguuccuaacaagcuccgauacagguuuccuacuucccuggugcuugcuacuuaguuaucuccgcagggucuuuccuuucaaaggcugugcacgcgucuuccgggcauacugacggcaaacauaaagagugugggccacuuacugugccuuaugccgcacugugagcaggcuggggcuaucucacacuuucugcagagugauagaucucagcuggccuugcugcugcucuccuggugugccccacaaguccagcauuggagauuuuuauuuuguucuuuucacaccugcucccccacccuugcuugcugcgcuagccuucauaaaaugcuauggggcgcuacagucagugacugucgcugacuggccagacucuuugcuuuaagagaaugcuauaagcaagguuagacuuucuugaagggaccgcuggcugcucucagccaguaacauccuggcaugaaucaucuuacuggccuccuuccaaacaggacagaaaaggccuugauuuugaguauagguggggccgggggaggugggacaguaaaacaauugggcugaaaaccagggaaaacaggucuuaccacaaggcauaggagggcacagaaaucacaucugcugcuguaauucuguccccuuugucccacuuuuccugagaagucauggugaaagcuuuaaaaccauguccuggauuuuaaugucucagggaucggagaaucauauccugagcagacugugugacuucacuaggcaaaugccaggaauaaaacauaaacaaauucaaaucaaaauaaucaaaaauaaacuugacauuuaugucuagaaaccuggcuuugugcugaucuccaacucugcaguaaugagaauuugauuuuuuuacauaugagucugggaagccucaaaucagaauuggggcgaaugcacauucuauacauuuacugcggucuaaagcucuugggacgcagaagcgacuccacuucagccccagagcgcaggguucaucuggauuuaagacaaucaagugauauuuccacccauguucccgccacaguguguucuguccuccugggccaguguggaagcaaguaucguaaagcuauuguuucgguuuguuuccugugauaugaaucucaacuguggcccgacucagccuggaguucucagcgcggaggcuuccuccccaacauucccacacacugcagccuacugugaaaaucaaaggaagugugcugcuaaguaaagaagaaacuggcccuaacgcuaagccugguauuuuuuaggcguuugaacucugagguauacaaaacuccacuugccuaaguaaugagucuguaguuuguuuugaguugggaaaguauauguuguaacacuguaacacguaacugcuaaaagguggguccaaagacauuagaguucgcucugauuuuucucuuacaucguuucuuuuguuagacuuacuucaaagcuauaacuuguacaacaggcuagacuuucauaucauccaacaauguuucauggacucugcgguccaaugagauagagcuguguacaauguuucugagagagauggcagcaacaccaauaagcaaagugcaggaggauaucugcucaaagauccucuaaacuuuuugucacauaaaacaaacaaacaaacaaacaaacaaaaaacccacagcacuugcgaggcagagacaggcagauuucugaguucgaggccagccuggucuacagagugaguuccaggacagccagggcuauacagagaaacccugucucaaaaaacaaacaacaaacaaacaaacaaacaaacacaacccccaaaccaacuaaccaacaaaaacaaaacauaaagaccuaugguucaggguugaaacgauggcuuagcagguaaaaaggccuucuauucagaccugacaacuugguuggaacccuauccaugguggggagggagaaucaacucccaaaaguuguccuuuccuccccuccacaaacacaugcauauaauaggugaaaauuuaaaacaaugagccacuuggguggcuaagugcauaagagcacuggcugcccaggcaugaagaugugaguucgaguccucggcauugacagguuggcugugugugcccggaaccccaauguugaccugcacagucaggauccugugaguuugccagccagccaaccuagcuaaaaucgugagcuucgagucgagcgagagguccugucuaaaagaagggagguugaagucuuuaagcaagacuucgacgcucuucccuaaccucuccagagcacgcaugcacacacuaaaacaaaggguggguggggaggaaaaggcucauuuuacauuccauuucuggaaauaaccagucccgagagugccugguaggagccuggagaaauggcagagaaggagaacuaagccacaucuccuuccguggcuggacucaggagcacuucuuuaaggucaccaggaccagaugaccaaaacuuguuuaucaaucucuaacuuuucuuucuucaggccugggagccccauagcugacgcgccaaggguucuggucuguccgugcuuaugcugucuagagaguaggcaguccuuguucucaaggcucagagcuccugagaugucugcuccguguggugucugcucuuguaucuguggcuuuguguaguacguggagugcgggagggguugcaccaggacacaugagggcagauaagcucggaagauccaacccuagccaagcccucugcaaaucaaccucgacccaucgaggaagacacacaggcuucugugugggcgagcacagacaaugugucccugcuacggcagcaagacacagcucucagaaccuccuggccacccacugcuccuggcuaguccuggucaggcucuagcugcuucacuuggacauuggcucccugccccuuaucuacauuucuuuuuuuuuuuuuuuuuuuuuuuuuuuuuuuuugccugacaggcuuugcaaaauccuacaaaucaccgaacugucguccucauuucuccaagaggacaauccucuguaaaaugaaggcaugcauggggcaugggugagacaccuccgagucugccuuuuuauuuagcaguccaggcuuuacaaguccuuagccugagcuucccucaaccauuuucaccgucuaaaucugaguaauugcuguugcccugcugugugugcagcggcuccgcccuugcuuucuccacucucugcucauuucuguaacagcacggucaccucagccuugcagcccaggcuuagccuccagccuggggguuagaggaggacgaugggaugagcagccauucuaaccuccgaaggucuuucccauauauccuuccugugcacaggggcccagaauagcacaggcuagucuggcuuccccgccucauucuggaccccucugugcagggggcucuuucccagaauagccauguaaggagucaucuccagagugacacacucacucaggaaaacucaaaaugagccacgggaucucuuucccccuugccugccugccucccuugcucaugccucggacacugcccugcuguagugccagccuggcagcuauaugcugcccaguuuccuuacagaacugauaagucugacaagacugcacauaggaugugaaaguggaaaccccaggcugccucuuccuggugaggccuaacaggaaaugauuuuugagggauguaacucugacaaaggaaagaaagcauucguuaugaacuguuuguuggugaagagauaugcgggaaagaagaacgcaucggcugagcagggagaggugcccgaggcuguccucuauggcgggggcuagcccagcaagaacgaauacagcugagccgcugucuccacucauuccuauagugcccuaauaaucccccccccccauuuccuaccccuauccucccaggcaguaugccuggcuaauuccaguuuguaggcaaggaaaccaagguucugagagauagaucacaagggacaucaccauuucugauguccuagagauguagcuggaagacaaggauaaaaggcuuccugcagagucaacacaguguggagcgggacucucgccagagguccagagguacuggaugggcuuccaggagaagcugcucucggcucuccaaccccuuggagcaccucacacucucugggagcaccucacacucucugggagcaccucacacucucacuugagucuguccuuggucucuucccugggugaacucaugagaagaucauugccagaggggagaugcuaaaaugaaggaacagggccagcaagaagguccaguggcuagaggcauuugcugcuaagccugaggacccaaguucaagucccagaucccagaugauggaagaagagaacagaauggacucccaaaggcuguccucugacccacaugcauacccucacacgcaacuaaauaaauguaacacuaaaggccaugugccagcuucugugaguggauauuuguagaugugucuuggagcgaggccuagguagaugccagcuuggggcaggaccugucaagccuuaccugaggacaggagcuuauguguccgaaggaagcugauggccaggcgcaugauggaggcuuuguccaggugggagcucacacugugaggcaggggcaacucaugagccaacucauagaagaccuccgucuccuugcugcgccggcaccucgcggcaucacgggauuucuccuuccucagcucugagcugcuccuacaugaagaaacgagggguuaguccuggaauguggacgucauccauucacacucucgguagugacccacucacccccacagugagucaauucucccacugaacccaucuggcucagcccaggggagcuaugagcaagccaccuuuugguauugacucugcuuuugcgcauuggugucuucucaaauugcuuucuucuguauucuugcaggagccagaacugggcuucacguggguagcguuagcaaagauuuaauuaaacuaaugaacaaaguuugaggacagggucaaagggcaccaauggaaagagaagggcgaagaagcuacggucagaccagcccuggcuuaccuaagacccuguuucugaucugagagacgacagguuagagucuggagacaucaguaaaggccaagagaacaugaggcggacaacacgccuccauuugcaauccagaagcaaagaccuccaagggugguagcugcagugggugccauccuugccagccugaggugccagacugacucuucuuuguugcagaaugggaaggaaaggacaaacugacacccaaaccugccucuuuccagagauccuaaagaaacacggucuucguacaaaguccauaucacguacuaacacggguaaguuuaaaagucagaguaucugccugcuaacucgucagauucuaccaugaagcugccuaagugucgcaucaguaaccaguaacugugaggacauacugugaccauuuauuuaugugaaacuuuuaguccugggcacauuccacuauaaagaaacauuagcaacaaucuguccaugaaaagacaaccuauccgcaacagagggcaaucauguccucaaaacacugugcaggucccacacagcacuuccugugugcuacacagggagugcaguuaaguagcaaacauuuuuacgauggucacagcgucauggugacagguuuuuugauacaguucagcuacucuuucagacaguacaguguuagcaucuuuaaauuucacaaauuguugugagaguagcugcuguuagcaucuccaauauacagauaagaaaacaggcccacggaggcuaaguaauucacccgugacugccagcugguaggugaacucugccccuggcagggcaaccccagagucuaggcacuuagccauuaguaagaguugcagaguaaugggguuaguuagggagcucgcccucccuggccuaccaagugguuaucgauauuuuccuguguuuucuauaaauaacauauauugcuuguuuaauaaagaaacuaacuugguauuugcuucuguagauguccagugugcuuuguggcuuucaaggccuucuuccaauuagcuccaggcuggcucaugccaccuuacccucugagguugccaguccuagggguugcucuccuuucugccugucuuugagcaugucguuaucuggacagaacaucacuacuuggggauuccuggaaugcuggcaugccucucauccccgugcggauuugaggcagaggcccuguuucgacguuuucgacgucagagcucacuucauuugcaggccaucuaggcccccagauggauuagccauuggauaccagacugcaggaagagccacauaacauggauggucaggcagaaccuugugagaaguugugaaagagggaaauggguuuucuuguccccucuccccuuggcuuuccuugucucccuuucucccccuucccugccuuucagcucucagaaaccccacaccucucuauuucuaucccacccuucucaccccucagaaccugaccccugggagaauuugcaucuucuaccagacuuuaagggccauuauuggucccuggauuuuauaucucaauccugagcuccuuagggugggauaccuuaagggcucacaggaggaauggcugcacuggaguaccacagcucuggcuccugagguccaaguaggagauccugaauuccccuccucagcaccagcccucacgcuuccggacagcagcagggucagcgccugaucccgucguuguuaacauccagagcagcuaugccgugaagcagucaccacaggccguguaucagcaacgauaccaagaacaagcucucccguccgcgcccccuacccccguggcugaguuguggggaacaggcuagcuaaagucuggguucucuuuggcauaagagcucuggguuuggcuaagcuccuucagcuacauaaacacuuacugauacagacacguucagucacugcgccgacaacuacauaucaccccguuauacucuucuuacugacacggcucgguagacauugugcaauuuacagauaggaacacugaggcccagaacauaccaugccguuuucccaaggucuuacaaccaggagcuacauaggcccuuccagucagggagcagacaggcugacuaauuuuauccuugcaaccauugucuccauuucagagacuuggaaacugagacccaauuugguuaaguucugugcuuagagcaauuaccuaauuaguggcagagcuagugauaaaacauuaccuccucccacucgcauaagaggcaguaccuuuccuuagcuggaaagaggcaacuucaacauuuuaacauuuagauggccgagacccugaggcaggucccugguuuaaaauguuguacacucccuuuagcuaccuuuuuuuuccaguuccacuguagaacuagcuugauuuuaauuagauugccuaguuaaucuugacauaguccagagaugucuaauguugacucuuggaaaaauagacaaaaaucuguaacacugaaaucauuuaauuagcaacccugaagaaaaagaauaauuaucaugaaggcacagauaacagaagcccgagcuuguacgaagccacagugcuaucuacccaucucaaucuggggaagaaaacacguucucugggcucugguuccugcaucuguaaaguaggaagaaaacuccaugucuuaucaggauaaaaugggugcagaaucccuagaagguucucuggcaaucaaaacuauuggggcagauugaagauccauugucuggcuacccugggcaucgaugcccugagaaucagcugcaucuggacucuggcauggcaccuguccguccucgcuaagcaggcugucugaggggaccaggcuauggcacacgggcugaucuugacuggcucugcauauuauaucugggcaucuuccuaagccgacaaugugcuucauuuccuggaacacuuuucuuccaagauggguccuacaaugaccacauuuugcuuauccuuauugaaugugucccacaauuuacauauuagaauccauuggcuucucuuaaaaagauauccuacccuaaauacuugauucggagagacuugguacuuccuuacuccacguugguuuucuuuccuaaguuccuuucccauccuugguucccaucccucuccuguucccacgagauggccuguaucauaugugguguuccaaacacaccaccuaaaugugguucuggcugccuguccuuacacacaccaaaguuggccugcggggaccaugcuggccccuguggucacagcacaagccuccuucucuagaaguaagcagucaguuagggggucaccuacaccugcaguccuuagcuagaggaucagagacaaaccugcuaauagcaaaggcagugaggcaggauucugcuaacugcgagugauaacaauguugcccuuauaacggcuuagguacauauuuuacauauuuuacugcaguugaguuucauaauaacucuuuaagacaggagcuacagagacuaaaucacuugucucaauccuagcuucucugggucccaacaccccaauuucuccccaugcagcaaggaaacucuuggaucguucugacauguccaguguuguuacagaccuuccuacaacucagauccccauccacaccaugggaaagggaggaggcuugagacuuagaaagacacagugcaaagcaguccuuggggcuuggacagcucugucuuuggaaaagcacccaauaaccuuagggacauccuaggacccaaggaguaaggccaguauuggaguucagacugggaggagcaggaaggcaggacgcacacagcccccguugcuguagagcugacuuacagugagguguuguuugaucaaguccaacaucaaguagccuugcacgcucccuaccacacugcacaguccucccuaccacacugcacaguccucccuaccacacugcacaguccuuccuaccaaacugcacaguccucccuaccacacugcacaguccuuccuaccacacugcagcuaggggugggagcauuuucuuuuccacauucauuuacaguagcucucccugaggggaaacaaacaugauucugaaagauuuaaucccagguaaaggagguaagcucuucuaagcagcaugcuaaagguaaaacagaacugacuguccagaagcaucaauccagggguaaccguuccucgcucagcuacgacuggcuaccccucaaagacaaagucaaagaugcuccaguccuuaagggguaguguuuguguggaaccugcacacaucugcaucuauacuuuaaaccacuugauuacuuacaaugcguccuagaaugugagcacuauaaguagcuauuaugcuguauuauuuaggggccgauaauaagaaaaaaagacuguauauauucaccacauucauaauuucuuuccaaauauuuuagaucuaauuaguagaaucaaaggauccagaagccuagacuaugagguaaaacucacccaggcaaagcuuggccagagcacgugauacuguaaguguggcagugggucccgaugcucucauucacagugaccuacucucggcccaauccuuguuucucaucugcgaguguccaagccuagcugucuccagcagacucaacuuuuacugugacugcagucaucagguaucuaagucagaugucugcuaccguauaagguuaaguggcugagaggucaagcgaggcucacuaaaccagcuugggccaaccuguugguuggaucuaaacguacgcuaaaucacagggcacugugaaggcaagcaggaaggaggugggcucuucagugagcuuguggagcugccagacaacagcugccuggugaaagaaauagcagcuucaggcuagaaauggcucagugguuaagagcacacacuguucuuccauaccugggguucaauucccagcacccacaugguggcucacaacugucuguaacuccaguccuaaggauucugauaucuucuuccuuugugggugcugcguggacaugguacauggucacagaggccagcgaaacagccaacacaaaauccaacauaaaaauacauaaauauuuuaaaaagaaaaauuacucagggucccggagaaaaucaagagucccuggaccccaagcuuagcaguuguuugcgcaacugaugaaaucacagcagaacccaugccucugcagaguucuugaucuugauugcucacuggaaaagccuuaaaaguagauccuggggccgggcagugguggcacaugccuuuaaucccagcacuugggacgcagaggcagguggauuucugaguucaaggccagccagccuggucuagagagugaguuccaggacagccagggcuacacagagaaacccugucucgacccccccaaaaaauggauccuggggucccagcucggacugaccuuagauuugauuuaucugaggacaccaugacuccugcccaauucuguucuuaugugcccagggcuaaccauuguuacacagcugucaauuuuuuuuucuuucugagacagaguuucucuguaauauaguccuggccauccuggaacuugcuucguagaccaggcuagccucaaaaucagagauccaccuggcuuugccuccgagcuggaauuaaaggucugugugccaccacaccuggacaaagcugucugauuuuaaagggcccuuuuguugauuuuggggguguacuauguauguaaucuggaauuaaggauguguuggaaauacaauuaccccuuuucucaaacacucaggaauaaagaaaaccugcguuuauggagcuuggggcgcagggcuuuuccucagugaguguuuuugguuuuuggcccauguuuacauuggaauuauuguuacugaugucauuuuagcaaaacagccauuuucaauguuggcucauaucaaaaucacuugcguucuuauugauacagacaucaggacccauuauuauacaucacaaaaagcaggaaguccucggauaccucugagaucugaccaugcacucccccucucccucacacggugucauggccaucaugucaagcagauuuaaagucacuaucauaggcugaacagauacuguuagggcugguggggccauugcucuacagaugcuauagcuacaggaagggacccaaacaauggcauagagauuuauaccgaguaucacaaaaaggugauggccauuacaagagucacuucaggagaaggcugaggcuuauccugcugaggcggcugcuacucuaacauuuugguaggugauuuaggaauuaauguuggaaccacaaaagaauaccaguuacaacauuuaauggcaaugacaucauuccaacugacuauguauguuccccaacuuacccacccuuuuagucacuaggccaggcuauggacagcucauaguucuuggaaagaauaaaaugugcucucaacugauauauuuuuuuuuuuugccacaacuggaggcacucaaaagaacaagacaacucacaagaauuucucagaggguaauuucuaaaggcuagcgagaacguggucuauggagacaauguucugaugagccacuuucuggaagcauucugacccaaggcaguaguggucagucagggcaugcaaaacaaagggaaggaaaagcugucagucaaaauggaagacccggaguuaagaacucaggaagaacugagaccuggacgaggcagagaggcagcagugcacucagacaaacagacaguuuaugaagaguguggucucuguccuggaaggggaggccagcaacagaguagcagagggaggaguggcugaaaugagggcuaggcucucaugccccgucucaaugagaaguccuuauaauggccuuucagcccagccguccuucauggggaguuuagcccccagcugcugacccucucugagggucaguauccccagagcagcaggccuggacuacguucagagcugacaguaaguaaugucuggggcucacuccacuugccccuuuaauggucaauucugcacaggggccgacuggagaugcuuaucggacgagccuccugccccaggcagccucccagaagacaguaacagauuuaauuaccaagcaguccaucugggaacccagacccuucuaucaccuuaggacauguggaguccccagccugcuaggaaagcuggccacgcacaggaguagcugugacaaacuguccuuggccuagccuuauucuagcaagggcccaggucugaguuuuaugucuccaaaguuaauguugaaauccuugccuccaaagugaggguggagcccucucucuggguaagauaaggcccaguuggaucccuggcaccuuccaccagccccacugugugaagcagaauguggauccucaauaaacaaaacagaucaggcucaaaccuugaucuuugcugcccagacuucaaacacacaagcaaugacucccugcuguuugaaaguuucccggccuauggcuuuugcuucagcauucugaauggcccguggcaauagguaaacacuagcauauuagugaauacuacuuuacauuugagucacacacaacaccuuauaaggcacuuuaagaguaaguaaaucucacuucacagcacgaaggaacagcugcugccaguuguccauuuuagagaugaggaaaacugaggcuuagaaaauagggauagguggaaguagauggaacuccucggauguauuuucaaggacucgugaggagugugcuggcaagcagcucuaggcuuggaaggaggccuuucaucaugcaaccgagaaucagcccaaauccuacucggcaaggguaaccugggaaauacacagaugcuuacagaaaggacucucacggaacguacggcuuuuccccuugacuuucuuacuuaacauuacguauaaugcucagauuucuuucuuaauauuccuaaaagccagucacagcguauugugugaacagagaccccaaugcauuuggcgauccccauauguugcucaguugggguccccaacgcuuagcuguugugaacagugccaugauguaggccucugcacugcauacugcuuuguaacauguaucuaacucccugccaucuuacauccccucaccugaguggcaacauccguagccucacuccugaggcaggggagucugcagaaggaaggaaaaccaaccacucauguucugccugguccugggcucuacaugccccgcccccaggcuuccuuccucucagccuuccucuuuuccuuagaucuuuuugaagcaucugaagaggcugccuuuggcucuaagccagugccgggaugauggccaucuugcaggucaacaauuccucuucccucacucuaagcuagcucucucuccguugucccucuccucacacauggaggucuagagaagacuuguagacguuuacguguaaugaagggccaacaagcagcaguggccauuugucugucuaaguguuguucuuugcuggccuccgauguucuuuacugccugaccucugccaaugugcagacucuagcuaagggguuaauuaguaucagcaaauugaaaugcugcugcugccgcugcugaaacuagcaaauaaccacgggcagugcuuugcacuuaacaaggaucacuuauccauuccuacugccugacuuaauccucaaaucucauggaaagaguauggcgacaggucacgugcccugaggaagcagcccccagagauggaggaaguuggcaugcuuagcucucacaucugugucaacgcagcccacaugccacauuggguuguaauugggcaauuuucuccaaaugccaauaaacaggccccucuugcagcucagaaggcuucgcugaacugggcacacggaggguauagcccucuaagaauacugaauuugaagccauugaaaacacucucuugaucaaggaaguggcaagagaggggacagcaggaucaccuucuacucuaggccauugcuucaaggggcaaacuugccagagggaagggggagaucaucuuuguuuggagaucuaaagacaagaaguuaaagggagaaaaaaagaaaggagggagggagggauggagaaagggcugguggagagaaucacagggguugagcagagauagagugacuuggggacagcaugcuuacuguggugggcagguguaauggaugucuccggugagcgcgucuuucucccugguccguuucuuucgggccuuuccccugggucugggcguaagccccaugccuaagcuguugccugaaggccucugggguuucuccuuagggcuccuguguccucucagacaccuucuuuuggaccccacaagcacccaacaacacaaaucugugauuuggcucaagccacagcacaugugcaagccgucccuacagcacuucuuuuucagcagagagagcuagcaaaaucgcacagcagaaaaaaggaagaagaggcugaucggugugugacaugaacucccuagcaugaagcaaggcuccgagguguggagaacagcugaccagucccacguagccuggaagauuuagcucuaggcacugacacuccccacggccuuccagaauguuccucuugaccaucuuagucuaucucuguuccacagcuccucuguucaccuccagagguguccauuuuccccgggaaggcccugccuguucugaccucuucacauugcuccagagauuccacgcugcagagucagccucaugcuguucucccuuucauuucaccccaugcagacauguucuucugggaaggcccccacccuugguucccucagaguccuuccucugaggcacaagcaguaccagaggaaggcauuaaaaaccaccucagugacuucuggggcguaaauuccucaaugcugcucacuguuugaaucuucccuaagaauucuaacccagcacgugauuagaccaagaaguuucuacccgggaacaguucuuaauacagugacacucauagguaaaaguguguguguguguuugcucccacgugcacacaagcaugugauccaucccucugaauaaacacugggcuaucaucuagucuaugacaucaccuacacuguuccgagugcacagagcauuagggaacuugauccacuguacuuuuaaguucggggcugggccggggcaugagggucuacauuucuagcaccauccuagaugcugaugcugaugcugcuggucuaugaccucacacuuucaacagaaagaauuccaggaccuuuaagaucuugaagccaaagacagugugcaguguguccacuacccaacgccauguuuggucaaggguacuuacuacguaacggaucagaccacuuccucugucaggaagaaucagcuucacuuguauauuucuugccaugccuggucccggcucccucuggcacuucugcccacauuacuaacgccauucauuauuagagaauguccccaucuuaccggcuuuccugugugauguuccuacugcuuuaaggacuguggcagcagagacacugcauucucuacuuuugcauguucuucucagggccucagcucuggacaaacugaaaaauaucugcuaauugauguagggcaauucaaaugcgcccuccacuuucuuccuucccaccuccccaggaaggaaagugaucccagcugugcuggcuccagccucagcccccagccacacugcuccccaccccgccccugucccccucucccagggaacugcagcugugccucuuggguuuucuuuugcucucucucuguagcuccucuucccugcagggaagaguuaaggcauugggaaggcugcuucccacuuggaaaucuccauuuccuccugcagcuugaacaagagaacucuauggacagaagcugagugggccaacugcgcagggagugaacucggucugaaugaggcuguucuaagcccgccaagucaagucauuaagaugccagcccugaggugcagcccccgaaggacgucaccucuggagagcgguacccucaaccccaggcccagcaguggaugaauggcuaacacagagccagggaagcaagcaagcucuuuuaugaguaggcauggggaaacgcaucccuuuuggggugggcauaggaugcugcaguggggcgaaaggagaaggcaucccccucucuccuugccucgucuucaccacugaacuaaaauuaacccucugauuuuguguggaauugccaaaaacugagugcuccucagaaggcacccagaaggguggaggaggcaauaauaacauuagagaaaauaugcgcagugccaaaaauaaucacugcaucaugagaaaacagagcugggcugccucugcggccagcacuggguauacgcaggaagaagggggcagaaaguccccuacaaggguuacacauuaggauguagaaaaggaagaggaggaagaggacaaggaggaaagguguggggagccauccuaagcagauggguguugggcgagggaaacuucucauaauuauaagggcugagccucucucuacuucagacacuuuaauuuuaagaagaacagaaaguguuuuggucuuuucgucaggacuggcgcuuggucacaaguuaagaugaagaaccucaggaugugcucuucuaauccaauucagggucagagcuguggcacggguuugggaacacguacagacaagggggaaacccugcaggaucucugggaggaguuagcucgccuugguagagugcucgccuaauguucaagcccgagaugaguguccugcagcagccaugcauggggacgcaggacaguaaucucugcacccagaaggaugaccaggagcccaaggccacccgccguuauauagcaaauccaagucuagccugggcagcaugagacccuguuuuuagaaaaggaaccaacugagagaaucuugcugguucuacugcaagaacaccgauaugugccccguuuacauggucacaugucuggcuuucugggucugauucacggccacagggcaggcucuuguuuucucccaaauuugucccuucuucgucccugugagaauugaguaucugugcauauuuaggaagcuuuacuccauuccuuugcaaagaagucauccgaagccacgggaaaugccaaaggcuuccucucagaugguaacccugagcaaccuaggacaucaggcugucuuccccagcaggggcuuacucgcugcacucauugcacagacaugauucccuucuuccauguguggucuuccagcaagagugacaaguggagauggcuccccugaccucagggagccugcagagaaguucuguucuggaggacugguuuacuccccagucaacaccagagugugagaggagaaagucagaaagacuuggagagguaauuggaagggagaguggguggagggaaggaagccaggaagccaggacacaaauaccucugagggaaggacaggggccagugaucaggagacagcaaagcgcaggagaaagguggcaaggcagaguggggugacuaagugugcacacugccccacaagugaucggaggcagcacagcagccaguuagauucggcccauucuguuggccaagcuuuggccacacuggacaguacauaugagaaucucucuuuugacaccauaggcaagagaaaugaaugucuuuguuaaaagcuccaaguacagccgugucggcugggcugcugugggccguauuccggcuggguccucagagaccuugucaaggucuucuugcugaagcacaggucacacguuacccacaggaugaaaacaauuccuuaaccaggcuauaccccuuggcagacugcauggguauuucauuuauuuccagauguuugccccugucuuccagcugugucccuuugcgccccccccccauacauguagauccacaugccacauccugccggccauccagcgagguccuaguaguugugccuuaguagagggucuucuuccuucugaccuuccaagcuuuaagguccagcauaaccugccacccugcagaggcucccucagccacucuccgcaguccauguggaugccuccuccccggcccaggccugagcacugagacuugauugauccucagcugugagguucuggccuuucaguuauuccuuaucuugggggggucuccucugagggacagguggaaggcaagcuuaugaauuacacacacacacacacacacacacgcacacacacacgcacagaggcaacaacagcaucagguagcucuuucagaugugacguggccagcugcugagaagguuagacaagccacacuccuccagccucaggagcaggaagccagaguccuaaugcuuuagugcuuucuggcaaagaaaaaaaaaugguaaagagaaauaacggugacuguauccagguuauuuaacacccaaggguucaacuaacuuacccacauauccugaagcuauucucacacagacauggguaccugugccugcuaccuacauucagguguuuuagggagccagcugccagucagcccucacuaggggaacagguccagacagaagccacucucuccccaccugcggaaguuccugucuugaucccaacuccuugacauaaucgagcaaucuaccacucgcugcaggcccauagacuguaugccacagauguggcugcccucuuuagucacuuggcagggacggugcuagggccugaccagggcucccaccuccuuuggugagguaauauggaggugagaaacuaggacaagccacacaccccauaagcacgcccccaucccuuaagaaaaaaaaauaccaccaaaacaaacauguauacaacugaaaccacaaccuaaaaaucgagaaguagauuuaugggauggccaaccuuaagacaaacucucuccaucacccgauucgccuuuaaaacuccacacuccacccccaaccuucaguucauaccagaccuagacacacgugccacgccaggagcuggugaagccggcuguuucucuuaucuguuuaccugcuaaugcaagucucugcuacugggguugucaacgaucucugcaaaucacguuuauuagggauaaugucguuuuuacaucauuacccagcccagcaguugaaaagaaaacaaguugguacuuuuuuucugugcaacacucuuugugccuauuaauggugacaggugacaggugacaggugacaggugacaggacacuggcuuuccaugagauccuggugaaaggcucaaugcuccaucuguccccuggccaagcaguuggagcacccaggaccuccucccagagcuaccgaagcagggcuagauuucuaggccuguaaaaaucccugccuuggccaucaggaagagauauuagcaacucagcucugccucagacacagcuguguagccuucaggccggaucucucguucuacuguguggagagccacagagaaaggcugccaaaggcccacucagacccuacagccccagaggcuugcaugcuacauucuaccagcauggggagaccugaguggaggggcuguguugugugacccuggaggcuugccugaguugucacuuagucucggauaucccagcccugcugauggcuggagagcagacacacaaccucuuuggaaccgcccgggacagacuucgguugcucucuuuccuuaauuauuuuuaaaaugucaguugcaacuucagcuucauggaaaucgcuucuaaaggccgccaguauucugacaaacacacuguccuuuccccuguggcagucugccaaaucucacagcucugacuaugcuaccuagaaaaaaaccguuccaaagcaacuggagucauagagcaucccugggcaggugaaggcaccugcugccaaucugaagccgugaggcguuugaucccagggacccagaggauggaaggagaaaacuggcucccuuggcuuaucuucuggcucccaugcgugcacugugguguacucucucuccaucucucuccacagaguuaaaaaaaaaucaacaacaacagauaagcaucacccuuacuuugcuaaaauaaaaagucagugguccugugcauuuauguaacuuuguaagcugcacagcucuuuggaauuuaaaucccaucagguauuugugagccauaagccuucacuuacugaauagguacuuacuacaagugcagaccuacuaggugggaacacugccucugugaggaagccagugugggagccagacaagcaggcagccugggccugagggccugggcacuugcaugcucugaucuaggacaaccuacuuuaguuuucauuacaggucucuguuccauggagcacuuggaaggaagaaacgcuuguaacgugcucagaacugugucugaugccuaccgagcacucaaguguuggagccaaaugcugcuacugcagaagucagugguaauagggacaaaaggggguaccuaucucagaguagaaagggaggagguugcuggaggguuuugucuuuugaguuucaaacaauaaacaggagguguuagccagaacacagggcagugccaggccuggggaggcucaggcuguggguguaggcuccuccauaagcccacaccuuaugaaucagcugaccuucaggguggcgguugggauugaacuugaggugucccaaggugcccucagccaggagcagagaggcucacugagccacgggcaagcucuguugugggauuccuucuguuuuugcguuccuauugcuucaacaauaaaaugauugugcacccauuacaagaggagauuaucuccaugggcacugagccacguuagugcaaagaccuagccuugccagcaccgagauuccugaggucacagcuaagcugccaagucuagagaacucuccgucaaaccuuaaagccaccagagaaaauguccuuugugggaugacuguauuuacaggcuaaguguacugagcaggugcugggcuggagguaggcuggguaugcaugggggccuauccauccaguaaagaaaucugugcaggccuaggaaggaaaauugaggaaaaacagcucaugccgugaagugguaccuccagcucagcuaagguccucuguguuucuagaucucuggucccuaggaggagcccacuggugaugcucagcccucgagagugguagggaugagacacagagcucauuugacuuaggcaugaggaaaaacacuacaaugaaagcaagauggacgaguuuaaagaaaggggaaugguuaguuacugcuacagggcauagaaguuuggagaccuuaucaggauuuucgagagcuguccuuagucagguucaagucacccuagggaugauuugugccaauggcuggaaguaaacuucuuaucugggggaggaggguggggaaauucagaugugaagaguccauacaagcagccagaggcgacccagacugaaagccugucuuucagaaaaugauuucuguuauuugaagcagcaaugucucggggaagugggggggguaagcuugucucagcaggacaguuccugaguguuacuccccuuuagcagucggccuccuauaaacauccucuuguuucuuccuaggucucagacuccccacagggaccaucaaaaaaaaaaaaagguucugaguccuuggaaagaaagaacauucuagaaacagggccuccuacccaauuguugccuagcacccagauaauaaucccuaauccaguaaccaauccugggucucuacuaucagacauggcccaauuauccagggcagaguucuggaaccguccuuauuaaggcaaagaaaugcaauacauaacccagcuuaaaaacccaggaagcucuaacgcucuaucaaguuccuacgacuuuuucuuuuccccauaauccuuggccgaguucaaaggugagcacuuucccagaggcucauuagaacuaacguuuauuucauauauuuuggaauugcuuauuuggaagaaaauaacuuuuuuaugaacgaaaaggggaggggaccgggaugagaggaggguuuggaaaagaagcgcuuacugccgccuccuggaaggcagagagacaucuguccccaacacggggcuucagcauuaugucacaguccuucucugaacccugugacuccaucuggccugccuacugcuuuggugccugugugaacggguguucucauggcaagcgugacauguccuugugccuuuacacaagguaaaaugggccgcaugucaccaggauuucuguggucuguaacaggaaggagucucagcaacaagcugcaaucugcugaucugaagcuagggugucaugaaccgcccuaucgagccaggccaucacugacugcucaagagaugaugggaaauuaucagugucugggugaggccagagaguucaugcaccucaucugucauuuacaucucacuuccugucuggaaauaaagaaccacauccaaaugcacugacuaccugcaauguggugugugugugugugugugugugugugugugucugugugucugugugugugucugugugugugugugaaagaauguguguguaaaagagagugugugugugaaagaaugugugugcaaaagagugugugugagaaagugugugugugaaagaauguguguguaaaagagugugugugugaaagaauauguguguaaaagaguguguuugagaaagagagugugugugugaaagaauguguguaaaagagugugugagaaagagugugugugugaaagaauguguguguaaaagagagugugagaaagaguguguguguaugugaaagaauguguguguaagagugugugugugaaagaauguauguguaaaagagugugugagaaagagugcgugugugugugugugugugugugugugugugugugcgcgcgcaugugugcauugggagagguggccuggaaacugguagguagcugaggccuuacccaucuuaucucccaaaauggccucuucuuacuuuucaagaccugcguaagccucuucccagcucuaucacugagaugaccugaacuccacuacuuuggccauuaggaauauucccuuguugccuggaucagccaauuugcaugaggaacuaugguuugguuauuaugaaacaccuuugaagggguugcuaaguuuccuccaaauguagaugcagagacuucagggguguguaucgauauuccccucccacaaugucgucaaaguuuaggcacuggaagaauuuaucuuagaagaaucuggcucaggaagcauaaggccacucaaagcucuucuccaagcuauagguaagauggguauugugugauggguauugccugugcgcuacccucuagaggcagggcugagaacacuacgugcugcugaagcuaacaaugcagagcccuagaucuucccagccuuuggaaagugaauucucacgugugccagauacguuguucugauaggaugaacauccaagaauauaugagaaaccaguuuggaccacaucauacuuucagucuauacucuucuuauaaaauuuggucuaagccucaaauaggaggcuguuuucuccagcuucaguauuaaugcuaguguuccugggaugugacaaggugcauagcugcugucaagucucccuacucugguccacagugaaauuucuuauuccaauguucuucagauccauuacucggcauuuggguuuuuaauuuauuuacuuuugacuucuguauagaucuuuugucugcauauauaugcaucacaugccuaacuggugcucauggaggccauaaaagggcaccagauuccuugaaauuggaguuacaggcaacugugaccagccaugugggugcugggaauuaaaugccuguccuccgaaagagcagccaagugccuuugacagaugaaccaucuauccagccaaaaugcuccaaguuuucaauuucuaauuuuuuuguuuuguuuuuuuuuuguuuugcuuuguuuuuguuuuuguuuuuccagacaggguuucucuguguagcccuagcuguccuggaacucacucuguagaccacgcuggccucaaacucagaaauccaccugccucugccucccaagugcugggauuaaaggcgugcgucaccaugucuggcuucuaauguuuuuuaauuugugaguugauuugugaauuaaauguucuccuguguauuagugaacauuccccaguaagacaagaucuuaaggacaaagagaucccuauucacgcaugccccguacagugcuggaacauacagcagacacuuaauaguuauucaaccauggaaucauaucauuuagaauacacaaaaccuuagcauuaaucugcucuagucucuuuacuguacagaugaagaaauugagaccugaagagugguaagucaaaaacccaaguuuaguucagcccuuccacuugugucuagugucuuggaacuaggaccaaccuucaugaugacuaagcccuacccucugauucaauacuacaaugauuuccaucuuguacuuuaaacacauagguacagaggguuuaaaguacuuuaucaagauaccucagcuaagagguagauccacaacuugaaccugcaagccuaccacucugcucugcgacuacucugcagacgcucuaaaaccauuucuccccguccugccauugauggccucccaccuugucuuccuuuuacccacccuccccuucuccagagcugccacaggaaggaaagggaugccuaucuuccuuaaucuucugaggucuucaauccaugaguucuuagcaaauaaaaggccacagacagcugaagaagcgaucaacguccuccaaugcuguacagauggaucuccugauaguuguuuuucccccauggaggagauaggaaucuguuaggagugaaacugccuuugccaagaccucuccacccuggccaaacguugcccaauucuugcacaaccaugaagucacgugggugcucaucccccaggcaggugaugcagccacuccuuccugaacccauucaucacccggcagacucaucucagcccucacacucaagggaagccguuccaggaagccgggacccacuugagaauacacgccgggacaauggaaaggcguuaugcuuacgucuccagcugcucuccguaguaagaaguugauucccuacugguggaccacaaagauuucagaaggucccaaauccaccccgggcaggagacugcucucuguagggggguugccuggaggaccuagcccaguguaggaccauuuccuucucauccuggucaucccucaggucucagacaucucgaauagcacccaccuuaagccaaccugucccuagcaaaaaauaaucaguuucucuucauuggaaauuaucuuuuuaggauuuaaaugaugcgcaggagguagcuuucaagaaccuaauacacugguggguucuaucuccaucgagcaugaguucugaaaguccauggcaauagaauuucagucucuuuccacugaaaugcucaugugugacggccauggguggacauaacacucauuugaagugagauugcacagcccaguggcugggguuuuguaagccuuggagguacagaggaacuggcuuguggaccucauccuccagcaugggccccagcacgggccuggcaucaucagugcccagagcacaguuuugcugcugaccaauggaaagccugaccaggccagauaggucaccucuacccaucugacuugcugggcucugcugaaccaagaggaaggcagcacaaaaugauucaugcccuccugcaccuaccuacaggaccgucuuaaacagaggcuaguagggcuuuuacaaacauaaaggaagcacacccuuggugccccucccaguaccuuggccccaagcaaacacccacaucagcagaaauuuuugcuuuauguuccuccucccaucuccaaugaauagcaaaauagcuucccuuccuaagguaaugaccuaaaaacuuccaaaggauauuaguauugugauguaacucaggaauugguuuccacaacccuuaucucuaagauccugacuuaagcauauagaacagagagcccuaagcagugaacccugaguccauagggugucaggacaucuuccauggugugugugugugggggggggguuaauuguaaguaagaaggaggcucuuacaaagaucugacuagagaaaaucuuccugcuccuucaggaaaguucagcccaccccaaaccccauuuccuuuauuuaacauaccuauuuccugaacauaccuauuagggacccucucugcuuaauccaacacuaugcccaaggccuguagccaagcuacaugaggcagaguaagaccggggaaggccaugagccuggcucuaaccuaacccauuugcaucgaaagcagaaauauuaaccaguucuauguuucuguauucuugacauuuaacaaaacaacuccgaaucacggacucugccccucuugugaagucuguuacaagcugugcgcagauacccacuuauguaguaguuuuuagaauaugacuuuaaaagcuagugucgccaguugugguggcgcacaccuuuaaucccagcacucaggaggcagaggcaggcggauuucugaguucgaggccaggcuggucuacaaaguguguuccaggacagccagggcuacacagagaaacccugucuugaaaaacaaaacaaaacaaacaaacaaaaaaagcgagugucauggauguggucaguggaagaagccuugcuuacuauaugugaggccuugcacuggauccccagcauuaaagacaauuuuaccuauaagaucaaaugugauguggaaaacccauggcaucugggaguugcccaaggauguccauuuuucauucucaccccagucuucucugccacagggugugucacagccaaaguagagcaucugugcuccugacggugucuguuuugucugcaacagccuauuuagagccaccucuccucuucaauggaccuggaagcuuuaucucuucacaaauuaaauuugcauuuacagauagcuuuuaauauggugaauauuuacauguaauauuuacuauacacaugccauauuauacacaugauggagagagagaaacacacacacacaguaacacacaguaacacacacuaccaccaccaccaccuccaccaccacaaacaucuugcuugcccuugccccuuucacucugauccuaugcuaaggaucaaacucagggccuuggguaugcuaaagaacacuuuaccaucgagcuauauauaccuccuaaucccacccuugcuuuuaaguugcuuauaaauaguuauugagacgagaucacccuguauacacaacagucacagacuaaauauucguuauuggggguaaugagaaauagguaucauguggguuggcaaagccacuggagagauggcauuggguuauuucuaaagccagaagaaucacagcuauuggucaggaggcuccggacgcacacaaaacccugcuuuggcuuccauucccucuuuguggaagacauccuggggacagaacaguagcaguagccacuauaauuuuugcauuuuuaaauuuuuucuuuuaagacuuauuuuaauugugucugugucugugcauuuuguuuuuuaaggacauugaaaaugugacuuuaagagccaauguguugugugaaucccagguguuaccuguccuucugucuugaucaucccucccgcucuugggcugagcgguucagcauauuuggacacagaugccuuuggccuacuuuucuuagcaaguauucacuggccaccaucuuaauauccgucacuacaccuagcgccauguaauggaauguuuggaguaugaguuaaggagaaaaaguaugaaaauguaaaaagcaagccaaccaaacaaaccucucuaguaaugcuaucugucuuaaacuucucaaguacccuggguugccugagaucugaacaaagacuccagcugugaugaucuguucuggccuagaacaacuggagaugccacgucccuuacaaaucuaagccacaaaccacuucucuccuaggcggccuagacuaaugcccggauaaagucuuguuuuguuucagcugcauugguggguuuguugguacugucuccauuguagguuagcccaggggaaaaccaacuccaaugcgcacgcagagaaggcugugagcagcaggcuuccgaggccaccucugaacuugacugugacagauuaauacaccguguacccuugggauggcagaagguacccuugggaugcuccagccacugcacuucugccauugcugauaagacagagacagcaggugccuuagaggcccuagccacguucaaguucaagcuccaucauccuuagccauuaaggugcaagucauuuggccucuuuaugucuuguucccaauuuucuccgcauuaguguaaagcaccaaguucucagcauguggacugagaaccgguaauguccgcgucuccugggaacuugccagaaaggcaaaaaaccccagguuuugcuuuggcaacacagugaggagauccaucccccagagguguuugucgagcgcuauauaaggaacgcagagcuucaguguggguugcagagaggcuccuugagugggccagcaguguggugugauuauguauucucacacaaugaaagauggccgaaaccaggaggagaugccguuaauugauagagugucaucuagcaggcagaagcucuguguucaauccccgauaccacauuagcuaggcaaggugguucacgccuaugaccccagcacccuggagcuggcaguagaaggaucagagguccagggucauccucagagauauauauauguagggcaucugaggccagccuggguuacgagacccuaugucaacaaacaaaccagagacaaaaauaaacaaccccucugagaacccaaauaaccacaauacaaccaaccaaacggcuaaauaugccagaccugucggccaccauaaccccugccccauuaccacuaaggaaaaagaaaacacaauguagacuucuuacaguggcccuaagcuaagccccugcacaaagcaacuguauugaauaaggacccugaagccucuucacucguaagccggagcccagggccgaugccuacucucaaggcaggcucccuacuguacuuugguuugccacacuucaggcacaugaaaagagacacugagcugaaaauggagacuuggcugggacucuccgacuucacccaguggcuucaaaaucuccauccucccuuccauuaacgaggguucgcuucaaucuuuccauuagcccacaaacuacuauuaaaaaagccauuuaucaaauuaacacggagcgcugcuaaagucaucugcgggcuccaugcacucugccacguaggaguuaccaugccaacagcugcugugcguccacuguacagaccuaucaauuguaacaaaguccuguuucauaacucugacugccaauucagguuucucgcccuaucuauccugcuucccaaacgcacauguguggccagaaacccagcaaaaucagguacugacccaguaaggagagcaaucgcaaaagccccuggcuaaaucaguauguucugaagaauucugaaaagcagacaaaggucgcugauuccucucuguaacucuuaguuccaucaguccucaggaauacagcaucaaggaauuugauguaauaacagucuggccaguaaaucuagacuagggagugcaggcugaauaaacugaaggggagacugcaauuaugcagauuauucuaauagaucguuugcaggcagcuaucaucaaaauaagguaaauccuugcaguccccuggugccaaguucuguagcaaguuuuuguuuuaaaaaagacucuugagcuuuaaaaauaaagguauucaagccgagagguauucucuugcuuuuugacuuaaguaaaaaguuuaagccagagaguuuaggaaacaaacaacuuuucuuuacuaaaaaguaaaaccuuauaagcaauucccaacgggaaguauuaaguccagucucaaacagagaacuuugggauggagauauauaauauauacacauauauuauauaaguauauuguauguuacauauauuuauuuaaccaaguuucugauauuuacacacacacacacacacacacacacacacacacacacacacacacucauugagcagaggacguugcucauugguagagcacuuuucuagcaaucugugaggcccugggugcuaucuauccccaguaccaauauggaggaugguuaacccaguuuaaaggagaagcaaagaaaacagacagaugcaggagacacucagauccaacacagaagcaugcuguguguguugucuacugcagacucucagguugucaacuuuuagcagguggccugcaaacucucauggccacccuguagaaaguacaguuuccagagguaagucagaaaccccggaucuaugcaugguuuuguuuuguuuucaauaaucaaacuggaagcaggucaccauggacgcuuccaaguucucaugucaugcuaacaaggacaaggacggggaaaggucacuuccuuaaagauacggauagugcuacaaauuuucagaagggugacagccaaguaaaauuuaaauagagccucccugaaaucuugagcacuggaaagccaaaguuaaacuugcucugccagccagugggcuccuggcuuaacucacacacggcccuguggauagauggaguuuuuuuuccccaaagugagaccaggcccagcccucagagcugucaucgaagcagccuucuccuguguaaucaugggaauuacucuaagccuacagaaaggcucacacaggcaccagccuuugauuuugcaguuauuucugggacuccagagcauacuggucagaacuucaggggagacauugcuuuucagguuuggaaauaauuguugggccaguuaccacuugcuuuuugagccuggacggguagugaaugggagucucaugaagaugcaucaguaagcagaacuuaauacagcuaauauugcugguaucccauagccauggggaucagccuuucugacguaggagaaacuauauucacuguuaauggaacuuaucuuucaauaauacauuuuuuuguuuuuuauuuauauauauauauauauuuauuuuacuuuuaggcuucuuauacagugacuauaugggaauaauucauauuuuuaugaccagaagaaaacaauugaacuacuucaacaauuuucccagggagaugauucaugaauauaagaagccagggagcaugugcacgagcgaguguguguauacagucugcaaugcucucucacucccuucuggcugaaagcuuccaucaaaaaguuugaggggcucugccaccaggacgcggagcacccacggauuagauccaaauaucacccauccucccuccacauccuacucucaauccagcagagccagugagcugcccccgcacuggggccagccauucaagaggcaaggaaauauuaugcaagaacacaggaagucagaggagacaggauucugggcaggccuggcaaggagucugugugaacuccagcgaacaagcggacuuugcucagcggggcaagagccagcagagagccuucccagggcgguagagcagagccguccacaucaugucgcuggccaguggguggccauccagaacuugauguaccugauagaaggcugauaaacgagucccaauauuucugcuuuuuuggcucagauucaaggugacuccccaacagucuugcacugugacucaccucuauccugcagcacggucacccccaccccccacccugugcagcaugacuucauucaacaacuuaaggccucacgggcuuccuagcugacuucucccuuggugccucagguugcaggaccguauuugcaggcugcaagugucaaucaguucaugucacuaccaggugugagcacgccagaaacauucguacacaggaaucauagcagcaaugugcccuuccucuguggcaguuuacaucugugcagccuuguucaauugaagggcacagaacagucaccugccagacaugaaaacgaaggccuagacagaggcacuuggugucugaccccuguccguuaauggcaucagaacaccccagaagccugcaucagggagauggaggcauggccuccuuuugggagcuuucuaccauaucacauaucagaccucagcugacuuuugggggcgguuguucauccugcugcacugaaccaggcccaacagcaacuccugaugggauggaauaucuuuuuggagaggaagaguuacaaagagauggaaagagguccgccagccccugccaacaaccuccaacuuccccugcucuuuccagagucagcaucugcaaacaggaggccagaccccuggaaauucccuucagagcggagcuagaaccuggagaguuuugggguuaccuggucugguucccaucuacugguucauuuuggagaggguagaauaauugaauaauugaggccagagguggucaucuagccagcuaaugccuaccucuucucaggaaauucacuaagcauagcacaucgcccugcaggagaagguccacacuucgaugugagugggagagccaggacaaggagacacacggggcugcggagcuaggacccucaccccagccccauggagaggcagaaccagcaguguauggcagcacccacccugcuucugcuccuggcuugacaauuucuaauugugguaagaacagcaguggccauuccccugggacuuggcugugcauucccagacgcuaccagcacacaauggcccuacuucucugggguaaacauugccaaauaugacaaacaauaacaucgccacaacagaaaacuauggggccaagagaggcagcguggaucuuugcaaauagucuggggcugggaacguguucagguagguacugccagacccuggcauggucauuauacucuagugucucaacugccucauccauaugcuaaaaagugacaauuccuugguguuagcaccaagagcuuuggaaagaacaaguaugggggcauucauguaaauccuagccccugggacccuaccucagaaaacaaaaacaaaaucagcuuuaggaaaacacuggacaauuguaaaccgugguaauguagagcccagcaauaucggagcaacgaguucgcugaacgcaucuguaaaaagcagcagugcaugcaggcuccauucuaaaggcugagcccucagugguaaacaaggcacguguggaguccauaccuucaguuucacccuggcaggggaggggcaugguagacauaaguaaacauguaaauuacacguggaaaauguuuagaagacaaauggaacaggauuagaggucaauggaaggacgucgagaaaggcuucccugaggaggugauauuuaagcugagaaggaccgcuugaagucagcuggccagucucccggguggggcugagggaagagagagcucagagguaagaaguccagauguguuacaguugaugauaggucugaggccagagcugagugaccggucaagucuccugguuaggguauaagcacagccaggccucugcauucaaggagaccaaggucucuuuagaguagcaccuguuucuagguugucaaugccucucuuuggcauaaaauaguggaacgaggaagaggcgagcagcuauggccugggcagcccugguuccugugcgacacggaaggaugugucguccuugacgugagugcugggcugugcccucuccugcuucacaggugaggggaaacaaagcaagcagaaggguguugggaucuggugcuugucaggacuuucuucagauuuccucagucuugggguauccacuaaaugccacgauuggcaagaauccacaggacccaaaagcccaggcggagggacccaccgguaggagccuggagaccagagucuccuguuagccucucucaaggcuuccuccugucugcaggcgguucacuuuuaagagguaauaacacaccuaaugaguauauugcucugcuccuuaaugacaaugccuagaagguuugcacuuuauacuuuucaaaguucuuuccauuaagauaauacucacaaagugugcuuuuaaaauauacauuuaaagcacgugguauuacuagaacauucccugguucguauucagagagcagcagacagaggugacaucuccaaccuagguccgcacaaagcagagagcaagcgaaagcagucucccagacucccaagaugccugaaagcggcuuugaacuucaugggaaggccagcuuugccagggacauaaaacaagagccaguggcccugacggcauuuagaaucuggcaaaacccgagaaagcgaagaaacacaggaggcuuguggucauucugacgcuauuuggaggcgaaggaauucaagugggugaaagcuugucacuccccgaaauaaacaagggcuccggggacccaaggccaggaaaauuaaggugaugucaccacccuuguccccacacaagcaacuacagguggccagaacuaaaaugcacccacugauuuagagaaaagaaucuaaugugcuugagagauggcucaggauggagagugcacucacuaggagcgcgcuaguccucuggaucuccccauagccuggaaugagcuagagaacaugagaaccacacuggcuugagcuaugcccgggccuagccccucacugaccaaggccaggaagaaccugcuaugaguucaggagaagcaaaggcuugcuuguuuguuuguuuguuugcucguuuguuguuuuuuuaaggaccuuuuacuuuggaaaagaacaugaacacagacgcuggugggguagauagcuuagcagcuaagagcacagagggcccaggcccaguuccaaguacccaugauccauggcucacaaccacuuguaauuccagcuucaggagauccagcgcccucuucuggucucugcagguaccugagacauguguuacacauacaaacacccgggcauacacaugcaucuuuuuaaaccuuaagaaacacacuuaggaaagaaaacacagauacauagacauggagcuagcuaucugguguuuagucacaggcaaacuuggcuaagacaucuuccuuuucccuuccugaccccuguaagaagcuaucggaauguagaugcuacacucgcauuuauaauguggagagaucugaguauguguggucaggucuggucuugguuucuggcuuuucuuagagcuucccugaggcuuccagaagggauggcccgaggucucaguuagcuccuggauaagggccagucuguacugugcugcaaagcuccacuguccccugucccuaugugguucuggcaggcgauuacggcuccuuggcuccagaagacucuucucugggcucaggcuuuaaccugagcaaaccacuggccuaaccagccugccagaacugagcagugguuccuccguccuacaaccacaggggacagaacuaacaguugagacaugacaguugucauugugagguuaaaguuuaacacaaaaccaucuaggagccguucccucccuugaaguaccacugggcaggguaaacucauguaacuaggaucaguugcuggccucugcugucccugaugugggcucuuguccagggauuugggaucuuugaccaacuccuggcccacuuugaccaacugugaccuuagugcuucuaaauuccuccagggaaaaggucacaccugcuuguggagaggaaagggcucugacuguccuacccaggugacuccgaaagaggauucuuuuuuucccccacucuucuggcauggucagacucagaacaucaaccagaucugggucuuaaagagaaggucacagaacggcuuggccggagugcucugggcuggguuuggaugaagagcuaccaguagagacuaaagauuugacucagccuuggcuguguaacucccuccacgugcuaggugccgaaagaagccuuauccuucucuaaggagaaauggcaagaaaggauaugacaaaugaccuuaccaaguccccaaggggacaaaggcuuuggccuccuagugagaacaugggaaugaagggcaaggcaauuuuaggguaacagcaagccgucccccuucagguucccauucugauagaacucuaguauuuaucacucccaagcagcuaugcaagccacaaagaaauacauaccugacggaaugacaguggguuuccuaagaucuauggguucagcgcuuugaggucauuguuuuggaggccaucauggcuucugccaaucacuccuaggugugcacacucuagcuaaguuugugggagaaggacaauaaaauugcucuaaauagcuucuaaugucuccaaaaaaggcaggcugagaauuccaucaaacaugcucgaagagggccugucccuagauucuccaguccaggcccaggcuccaucucugcuaauauaagaucuacugauuccgaguugaaagaaaggagcaccccccaagcccuguccugcgcacucugcuucuuuccgucucgcggucugcacugccucgcccauccccagcguagccugcaguugcugccugugcaaacccaaauucuaaucuucaagaccgaagucuuauuuaaugcucuucucucaaagcucuggucuucuccagcccaguccuuuuuaacuuuauacaacucagagcucucgauuccuauccauuuucugcuccuggcucugugcuguaucuggccuaguuuuuacuccacaccaagauggcaacauccuaaagaugcagccaggugccuuggugccacacacugccacauacugguuuaaacgagucauuugaagagaccagagucaucaaaugccuuggugugaucucucugugcagcacaguccccaaaucagcaaauaaccuguaagcauguauacucgaggccagcaguaccacaaaccucuucugaccugcguggugauuaucaaauaaggauggguaagcugaucugaggcaguguuucugccugugguuuccaucccuuugaacuaagguccccauauuccugaauuccaccuacagacaacuacagaacaccuaaaauggaaauagaaagcaagcuuuaaacuuauuaugcaaauuuaaaaauucagacagaagaucagauggauacagggcuacacaaugcccugcugacugaaggaggucugcuuuccagggagacccuuugggacagcugauacggaugcauuugcauaauuucccaccuggaaagcuguuaacuccggaguuaagcuggggaguuuaccuagacuaccaugcauucuugaugcacaacagcauuggcauacuaccugccugauccuugcaucugauggcaaauaaugcucaccuggcccgugccuugccccucccccaaccccaauuauuuucuuguucacagaaacaggugaagggaagucguguggauggagacagcugagcccgagaaagugggacaucaacaaagucauucgaagccgggcagugguggcacacgccuuuaaucccagcacucgggaggcagaggcaggcagauuucugaguucgaggccagccuggucuacagagugaguuccaggacagccaggggcuauacagagaaacccugucucgaaaaaacaaaacaaaacaaaaaaccaaagucauucuguauuuauuuuucuaauggccaugauuucagagaaaaaugaaaaggaucagcauuuauuggccacaucagaaaaucagacaucccugcucuugugccaugugcaagaacgaacguggaaaggcaagaacaaauaaaaugucuuuagacaacaaagaaguauaaaacagcaaauggagggaaaggcagggugggaaugcuauggguuucuguuaaaggcagagagcuuaggcucauucaugauaagacaaagugugagauauuugggcagaaagagggaaaaagcauucaagcauggacuaagaaccagagacgaacgaguacugugacaauaccuguguggcagaggaauaggcuuguggggagcucaggaggugccguaagugacugaguggggcagaugagagagcuggaguguggggacccucauuuccagcagucaccugcuucguagcuucccuaugggaaggcccuugagugagguucuuagaucuucagacugaguauuuagcuaauccuugggggaucuucaaagaaacccccaaguccucauggaacccucuugccacaaggaaaauuugcugugcuuccaagacaacgugaaggccugaaacaaggucguauugguaccauguaaacguuuucugagagccuaggaaaagagugauggugccagggucugcuaacugguuuccauagaacagcggaugacuccagaguggggccacagagugcuuuagaauucccucugaauccuugaccaccacaaaggccuucaccaaauggguggggcaaaacauuggcugagccaagaaaacauaguagcagcaauaaagccagaaacagaaacugagaagggccuuggcuuguacaccacacccaccauuaauucccuuaagaccuggcuauagaguaaaagggacuccugcuugcuacacggugauacaguuacaauuauagacgcucccuugucaccagugaaaugggaccuucauauuuccuuuaucuuaauaucuagguaaacauuuguugugcaaguacacaaacaaagguucuaaaggugaaauguagugugucugguaacaccacgcugcucucagcccgggacaagaaagccuuuuugacuccugcacaggcuuucucgcucccuuuacccuagacaccaaaauuagcuccaucaaccucagccagcgcuggagcgaaggcugccauucuaaaauagcaccugggaacugcuggacacaccagagagaaacacagggcacaguggcucacaggagcagacugagaaagccacucacuggaccgauuuuaaaaaacaaacaaacaaacaaacaaacaacaacaacaacaacaaacccuaaauacauuaccagggcuucuggaacucagagaauugcccacauggcuuguuuuauagaccuugauuuauucuacuagguuuuucuguuuucacucagaaggcacugugaggggucacaguuucauaaaacauuguagugcuuuaaaaaguauuuaggcaaugccuaugauuuaaccucaaguuuuacuuuaugaacaugaauagccuuauuggugcuuuaaaaccagcaguugagaauugauuuuuaaaccuuguuuugaaaaguaaaauucucagcuucuagaagguguaauuuuguuauucccacauggaauucauaaacaaaaccaagcgugugugugugugugugugugugugugugugcgcuuagaggcacucuuuuccuacaaccauguaugacguauguuccagaacaaucuuucucaacacuccaaagugcuucagcaacaggaagucauaaagguaggaaggagaccuguaaauauuugcuguaauuacucauuaguaaugagcgggguuagugcugcagcuaaguugcuccuuuagguuccuggcuauggccccuuccuacaacacaacacaagaccaggagcccaagaugguguucugggcccagccucuccacgccuagguuuggcuucagaugaagagguuugguucuuuagccccuccaguucccgccccuccaggaggcaggcaggucaggacaaaccuuacauggugacaagaggcugagcgcuuucaauuaugaguaacauguguguuuguuaacagugauaugccauccaaagacacagaacccuucauggcuagacacacaacauagugcuuuaaauuauugccaguuccaaaccauauacuguagcugguguauuuuaaaugauuuauaaagcauucguaacuuucuuagauggagccuauguauccucuuauucuuagcaaacuacugacuuuccaguuaagaggccaacuaacugugcacuucaaaccaagggcagaccaaaagaggccacuaacacuacucauuaacaucuaaaauugccaguggcuguagccugccauuuaggggggggggguagccaauauaacagcaugggucagucucuagacuaucauggucaauagggcagcacaguagauccguguguguguguguguguguguguguguguguguguauguguauacauguuuggguacauagucuaaccagaugaaaaacaugaaucaucugauucuuaccuaugacaucggaaguugccacuagaauggugaauguagugagccacugggggggauauaggaaaauucuaaaggucuauuuccaugauguuguggaauuaaaacaugucagauguauacacggauauacauacauacauguguguguguguguguguguguguguguguuauuuuuaagugugugacaugugacugcguggcugugggaacugggugucagaucccuaggaacuauacugagggguaguuaugagcacaugggugcuggagucaaacucagggcuucuauaagaucagcaaaugcucuuacgugcagagccaucacacacacacacacacacacacacacacacacacacacacguuuucauguguuuguuuuacuuaccaacaagccauucaucaugaaaucucauucuguaugagaaaguaucugcuuccuagggucuggcauacagaccacuccuaacuuuaaagaauccugugcuucucggcaggcaacacucuuuaucccaggagccuggaggauguacugguggccucuggaaacagcccaaggccauaagcaaaccaguauuucuugagcuauuagggaaagaaaggccacucagacgcacauaacacucuggucucggccacgcuuaucucugauucuggggaucucaaauaaccuccacauuucucucagucucggacguucagauugguucugugucuuugaguaacaggaccagaaaaaugucagugaauugcacauagacucuacuugaaaaacuguguguugcuagcugcauauauucauacaugccccaccccaccccaccccaccccacccuaccccaccccaucccaccccgccccaccccaaacccauaccacaacccacaacuguuccaaagcaaucaugguuugaggcgaggaaacucaagaagaucucaaggcucuugguauauggccuggggugcucaccagagaaaggacucuauaaaaauaugaucacgacaaucauaaacuacuauuuauccccuccccccauccaucuuuuccuuccuaugcuugcaauuucaaaagaucaaaggagccacagaggaagagcuccuaacaggucccuccgcacaauggagucugaagacugaacgguucuugaagucuugccaccagcaaagggugggaagaaagcuuugaacuuccaggggcaguggagaacuguccccugcuuuagcugaggaaauaucuauauauauauuaaaaaaaauaaguaauuccaggaauucaggaauagccuuugggucuucaguuccugccugugugugugagguuugauacaagggaugagucacgagaaaagucauuauaauaauuauaaacacagcaacaaaagaaguuaucauuuauagagugcuuaccacauucagacaugguauuaaaugcuuuauaggccuuuuagguaaggccaggaggcaaggaacggugggugagaguguggacucuggagagucucagcuccaagauauacugccugugacaacgggcagcaaccuugcugcaccugaguucccaucagugaacuggagauaauaacagggcuuaucucacaggguuguuacaaggauuaacaaaguuaauccggaaaguucugaggacagcgcuggcacgggaagauugagcgcucagcuuuccaucuuguccuucugccuauguagcucauuucucccaagagcacauccauuucuaagguucaaaagaaucuccagauagcaggggauaguggaaaacaugucuuauagacacucccuaggacaagacaagacgcuggcauugaaauguaggaacaggcagccuguagccuagaacucagggaggggagcucuugggugcuagacagacaagcaggaagaagguauuuucucuucacaccaccuuugaaaggcgacuaggagcugaacaaaggguggcgauccagcucagugguagagaaugcuaucccagcccgugcaaagcucuggguucacucuucaugaagaggggagauugagauuaacauuaaaaaaaaaaaaacccagagaacaaaacauacacucuauagaauuuuagagaucuauuacuaccccggaagcucauuuacaaggcucccggaaaaguacuccccucccuucucggccuucacggagucagucaaggccaccguuguccucaguggaaacagaaaccuuugguugucacuguggaggccaguaaguguccucccugcaaauucuccacccaaaacaaguguguacaucaagcaguuaaacucgguagccgggcuggugagauggcugggcagguaaagggcacugacugcucuuccgaagguccugaguucaaaucccagcaaccacaugguggcucacaaccacccauaaugagaucugacacccucuucuggugugucugaagucagcuacagugaacuuagguauaauaauaaauaaaucuuuaaaaaaaaaaaaaaaccaaccaacugguagucauuuuguccaugugucaaaguucauggugcagaacgccuguggagcauccguauuuuuauguucaucaucuccaaguucuaacgucuaccaccacacucucucugagauccaguuuaugcugguguccagcaucuaccguuuauuaucucagggacacagagccagcuuccucaaugacgaaugcauuucaauaaugguguacgguuaccaacugaaauaccauucagaauuucuuuucuuuagcuucaaauauuugaacccuaccaaagaaaacacccaugaguggcugauaccccaacgguuucuugggugguccuguccccccacccugacccccaucagaccaagcaauugggaguaaugaacagaugccccauuucuuaguuuucagcacuguuuuuccagacccacugguuaguaucuugguauagaugucauugugagacucaccagcauguuucuggagugugcaaagcugaauaauaaggcccugggagaaaacagaacuuacucaguaacuugguaaaaagcucgguaguuuguguaccacaaaacuuuccuuaggacuaaggaaagauucaucaagauaaaacgaaggaggacccuauuaucuugagauaggacaggaccguuuuugcuuuguuguugcaguuuuuaaagcaaguaaaugcugcacagaaaagauuuccucaaagauggaaaaggcucagccuugaaggaggcacuuucaaacccagggggcugaagcccuacagcacuaggaauuaacuacuugguuccuucucucucuaaacaacauagauuccuagaacccugggcagggccauguaaacacacacaugcacagaggcagagaaacagcagcagagaggcuuuguugacaacguaaacaaaguagccuguuuucaguucaggcuuucaucccugcaaaauugccuaaucacaccaggcaacaaucuaguagcuguggaauguccucuacuucacaaagcaacuugcuacauccaggaaccaggagggugcuugcauugguuuuauuuuauaccucgaguaguaggguuuguuggggucuuuuguuguuguuguuguuuguuugguuuuuguuuuuuguuuuccccuaacugaaauaaaggaaagguacucaaccaauggauuccgauuccccaaaguuuuuaacuaccaagagcagcgccacugacugguugacaucucuccugccucagcucagaacaaggcucuugcaauuaucuaggaaaguaaaccucugucuugaagguucaggggucugguggugguggugguggagguauggugauggugagcugcacuaauccuuuggaaauccucaguggcaagaggcaugccauggcggggguggggggggugggggggugggggggauggggugggaggcucugcuguucacaugcuaacugauuguaaugaaccaacuuucugauucuuaucagcacuaauuuuccuuguaccgagagggauuauuuuaccuuccuugagccuuauccagaaagagaaaauauguuuauggcuuucauacuugcuuauaaaauaaucuucaagccucacaauaaaacugaaaaaaacaacaacaacaaaaaaccaaaacaacaacaaaaaaccaaaaaaaaaaaaaaaaacccaaaaaacaaaacaaaacaaaaaaaccaaaacucuaagaaagucaucuuuaguacaguuuaaaugccaggcugauagugucguacagcacugcucuaccagguuagacuguugucaaauguugaaggaacacuaguuaggagauaagcuucacucaagaagcccagccagcauugucuccucggcugggaaaacugauggaccuuggguuuauuuuaacagaggaacaauuaaaucugcugccaucagaagccagccacaguuagaaaacuugaagguccagcuaucuccaauuccuugcccaucuuugcccuggcaccaaauaccagaagcacuccugaaagguacuuggacccagagucuagcuuugugccuggacuuggauuccuggccacccaaagaccucacuuccauuuaucuuaauuguucuacaaauccccacuugagagcauccacacuuggcucuuccuagaaucaggaauccugcuggguugaugagaacuccaagagagcuugcuguggcucccccagucugcuaaccagccaacaaauaaaagacuggcuccugacuaucaugaaggaauauauccacccacacaaggauguuugggacuaaaacaagccuucuggccucuggaagggcuguuuccagaaggaaccauacaaaugcucaguuaugcccuggagaagaaccggcccuugaaccacuagugggugguaucaccaauccgggaacccuugcugcucacauugauuuccugaagcgcucuggaaagcucugggcagccauuuaagggacauuaacuuuugaugcccugcuucacaauuuucaacuacauauugaugcccccaagaagucagucaauuuaaccagaaucucaaaaccacuauccuaacaggcuuuggaagucugaaccuacacugaaccuacacugcuugcccuguuuuuuggacacacacacacacacacacccugcgggccuggcuaccacuggggcacugcacuacaggccgaagauuccuaggagguucacagucugugucacacugguucuuaaaguggccgcuguuguggauaauuuguagugucauuaugcaacguucuucuaggcucugacuauacucccugccagcccucggcaaagagucucugcaagcuggguauggaaauagcuuuccccacugaucccugacucucccaaggauugauagaccuaagagcaagaugacacuugacacugauuacugucaggucucaucucggacaaacgcgacagucacccauagacaaggcaguaauaaaguguucaauaagugcuccuggcuacucugcuguccaacuucgcgguuuugaugguuugugauuacccucuggcugguuuuacaguuugagcuagaaucuuagucuuuuuuuuucucucucucucucuugcuucuccuucucuacccucaaaguacacagaaccucagaguuguuuggugggcgauaauggggaaucuagaaccggacucaauaccuucccccucuagagauccgccagcgcagggcgcgggcgccgggccaggacgggugcgauucgcuggaguuuaucaacuccuuaucggugcccugaggugggagcugcagcuuucgaccagaggauacacaguuccuggcucaugucccuaaguggaagcccaaacaaaaagcccguuugcucggggcuggguccucaccgccagucuuuuccagucuggccacggaucucuggcagcucgcgccauucugcggucacgcguaccauuccggacaccccagcuaagucgccacggagcgcagugcuggaagcucuaacccacggcacgcaccgaucgaaacaggagcaaagugccaggcggccagcuauaaacuuuugcaggcgacgagaauguacccaggucugcggcggggucacaguguguucccaccucagcuccuagagcugggugucaagucaccagaugcggggcggauugaaggaggcucgagggcagcgcgaguugccccgaguugccucucacccagugccgaaagguucgcgaggacaaaccuucguggcugcccuucgucuuaagaaucagacacucggagccgccgggugucacggucuucucucugcacacuagagcaccugcccccgcagggcaauccaggucacucacuccccacucucugccggagucuagguguaggguaagguuaaggggguugaacaaacuugggugccgucuggagcaggacccuugacaguguuccggcuucucggucagggcgcaccccagaguugcgcuuugcccucuguuccaugcuaguuuggggcgcaaagcccgcauaggaacgcucucggaaagaccuagagggucuuaggaaaagaaaggcgugucuacugcuccagcauggaaacccuaagagucgagggcaucagcccagaaacauuucaaaacacucgcuagggaagcuuggugcuccagggacgacagacuuuggaaggcgccgcggaagcaccccugaccuccagggccaucucuccgugucucaaggucucggaacuauccgcuuugcaacucuacugcgacaccgcagcuccuugucccuaaaggcaucaccgacucgcuuacucaaagccccucaacagcgguccuccagccuccgagaacucucgcaccccucucccgacugccccgggucgcgcccgccacgcgcaguuccgccaaugccugggaccaagucggucgccagcuuugacucccgcuuaccuuuuuuucuccuugucagcugucauugucgccguggcccuccgagacccggagcaccuggguuccuuaaccccguaggggcugcagccgcucucuuugcuguggcccuccgcagcucucugucgcccgggcaggugugaaaggucuuuagugcucgcagguccgagagucccgcucaaucagguggaaguuugcagagggcuggcuaggugcggaggaggaggagggaggaggggggugacggggaggaaccugcaggaggaggcggggccggggaaaggagugggaggagguuguaagacgccaaaagagagagagagcagcgacaagggaccuggaguuccguuuagccccgaacaggagucacuuuucugggaucugacaaaucaaaaccaaccaaccaaaaaagaaaaagaaaaaaagaaaaagaaaaaaagaaaaaaaaa

SEQ ID NO: 12567 - RNA, 51158 nt, Mus musculus
gcucugugcucuagugguguugguguggagcggcucggaaauggcggugcagccuaaggagacgcugcaguuggaaggcgcggccgaggcgggcuucgugcgcuucuuugagggcaugccggagaagccgagcaccacggugcgccucuucgaccgcggcgacuuuuacacggcgcacggagaggacgcgcugcuggcggcccgcgagguguucaagacccagggcgugaucaaguacauggggccggcaggugagggcagccgcggcggcggggcccgggccggcucggggccgcguugccggaaaccugggcgcaugcagcgguggggcugcggcggagcgccccgcccgagagcugccuccccgggccacgcguuuagcaucuuguuuugguucgcuuccgcacagugcgcugggcggcugcacaccgccgaguccaggcuguccucggacgccucgaguuccagccucccaaguugauaggauuagagucuugugucaccguggguaccuccaaaucaauaacagcccgcagccuaggagcgaggaguggagggcguuuugagagcuuccuuuaagacacccucauuugccaauaggcuguguuuuguuuuguuuuuuuuaaaccgucucgcuugagaaccugggauggaccauugcugaagggcaguaucgccaaguggucaggaccuaggauaugcccuggagcugaacugcccggauuucaguuguggauccccuacuguuugcugagugcgguugagcuaguuggaaagcugugcuuagcuagcuagcuagcuagcuuucuuucuuucuuucuuucuuucuuuuuuuuuucugccaccuuggcucucaccacucagcaucaucucucccuaaaaggcuucagaacucauuuguggccuaggaagauuaauuugaucaccauaauaaccucucccccacccacccccguugcuuuuucuuucaauuacauugaauguccauuauaucauacuuuggaguugugaguucuaauuuuuuuuuuuuuuuugguuuuucgagacagggcuucucuguuauagcucuggcuauccuagaacucacucuguagaccaggcuggccucgaacucagaaauccaccugccuuccaagugcugggauuaaagacgugcgcuaccaccgcccagcaugaguucuaauucuuuaugcuguuauaugcaaauggauguuacagacaucguauuucugccuggucugugcuagguaauagucugcugccuucacaaccaguugaauuuguuuuuguuagacagcuauucuuuaucuugaguuaaagagugacacacacacacacacaagaaauguuguguccauuaauaauguucucucacaaucuucccaguccugaccucuaguuuuccuucucuggauauucugggauguagcauguaaaugaagagcuucaaggcuuaucucugucaucagcacuucguuccuuuugguugcuaaauaauuguguggauuucccacauuucauuuagcuccuugucccuggaguuuguuuuggcuugguuuuuggagacacggucucacucuuuagccuugguugaccuggaacucaguagguuuaccagguugucacuuacacugccacugccuccugggacuacaggcuuucaccaccuugcccagcugagcuguuacuggaaucuacauuuccucgaaucuguaccgguuccucccaacagugcagugaagaguaagcucuuggcagcuuucuggaucccagccgaugggcguggguaggguucuguugguuuuucauaguuuucugcagcucgcaucuggcgguaucccuuuacugacauuuuaccugcaugauuggggucauguaaagauguguuauucuaaagcccugaucagggagagccuccugccugagccucccagguucagaugcugcaauuccaugcaugcaucuucauauuuauuacaggauccaacccuucucuccuaugucccacuuccuggcccaguuggaugcacauagggguuccaugucauccucaagagacucuugugugcacgugaaucugucccuucugugggguguggguaagauucaagucugaucguucgugucacagcagaaaaguccuguuucacagacaaggcccucagaugcuugucagcaggugugcacggccucucagugggucacacaugugcugccuucuagagaaauggccccuuccuucagaggauaaccaaacuuuuuuugagaugggucuacauggugaagcacacgauggccucuggcuucagaccuuagccucccugguggguaccaccucaccuaucugggaagucucuguauuucuguagugcuagggauagaagagggcacucgucucauuuaccucuccgcuccugggucuuagacaguaacacauuuaauaaugaguuccgguuaguaaaaagaccaagaaacaguucucuggguucuagcuagugccagauagauaccacugcuguguacuguaguuaugcacaagaacagagaagccagaugugguggcgaauaccuuuaaucccagcacacggguagguggaucucugagaucaaggccagccugguccaccuagaagaguuuaggacagccaagggcuauauagagaaacccugucucaacaccguccccacccuccacccccaacgcuguacucccacaccauccccccccccccaaauccuucaaacugaaaaacacuaacuacaaaaaggaacagaggggcuuguacaucugagagggcuucgugaagugaggagccuuuaaugcagugagugcuucagcagcccuguccuguccggaugguucuugcacgugcuguggguugguucagccgcucucccagaauucauccagaccaucuucccucagcgugauauuuuuuuaccaaauaagauugcauuuuaguuucuaaauugagagcugauauauuuuuauuuuauuuuauuuuuugcuuuucacacagcgucuuaguguguagccuuggcuagcugggaacuuaccaugacucacagaccccccugccucucugucuucccaguguuagggcauucucccucagacugaccucuuagacguuuauguacuggguuuuauauuuuauauguguuuugucugagugucuguacauguauguaugccuggugcccagggaggucagaagaaagccuaaaaauagauuaaguggccauguaggugcugggacaauugaguuuuuguuuuguuuuguuguuucuuuuuaaagauuuauuuauuuauuauacauaaguacacuguagcugucuucagacacuccagaagagggagucagaucucauuacagaugguugugagccaccagcugguugcugggauuugaacucaggaccuuuggaagagcagccagugcucuuaaccacugaacuaucucgccagcccgaaaauggaguuuuuauuccaguggaugguguggugauuuuaucuguguguggaaagguugacuuuauguguauggauggcuucucugaugcuucucugcaccaugugcaugaaucuagaagagggcagaguuccuuggaacugaaauacuuccugcuaaaucagggucucauccuugguacuauuugcauuuugaagaauaaaucauucauuucuugugagccauucuguccuaaucauguuaacagcuucuugcgccuguccucuagauuccaaagugcuauuguucccucaugacagcucacaugucucccagaauuauuauacgccccccccccccaagaggagcaggaucacgcccaguugagauauagaugagaaaguuuggaaauuuuuaaaaaaaauguaugugugagucgugucugcauguaugcguaucgugugugucugguccccacaaaggccagaagagggcaucugauccccuaaaaccagagcuacagaugguugugagccaccaugugggugcugggaauugagcucagacccucugcaagagcagcaaguguccuuaaccacuaggccaucucuccggccccuggaaacucuugcuuuauuauauucuuguucuuuuucuuuuuuuucuuuuuguuuuuguuuuuguuuuuuuuuuuuuugaaucagagucucgcuguguacugccuggccuggaccuggaucuagccuaagccagcuuggcuuuucacuuauagaggucuugucugucgaugcuuugacugcaaagacacccagcuuccugaggacucuguugacuguaggaaaguagauaaccauagagggaggcagucugguuguuuauuaaaucacacccaugagagaauuugguuuuagaaucuucucaacacacugggaacccugagcauuuacagguuucuucgugaagccuagcaaugcugaggaaauugguuagaucacuagacauaacucccaguacacagaagccaguucugugugguuggagcaagcucccuggugauagggaacuguguguguauccauggugauaagggaacaggguguguauccauggugauaggggacaguguguguauccauggugauaggggaacaggguguguauccauggugauaggggacaguguguguauccauggugauaggggaacaggguguguauccauggugauaggggaacaggguguguauccauggugauuggggaacaggguguguauccauggugauaggggacaguguguguauugugugaguguauaaaagggaaaguaaugauuuacauaugcuauugaauauagacugaaacucccagccuguuacugguaagcagcuggcuagggacagugcuaaaagggagacuugacuuguuugaaccuugaguucuguuuacaaguggaguaugacuaggugucguuuuguguuguguuacugagaagccaacccaggcugucacacaugcugggaaggugcuuuaaugcugagcaaaacccagcucugagcaguuucagaguccuuuguaaauguacuuuguuuuguuuuguuguuuugcuuugauuuuuuuuuuuuuuuucuuuuucugagacaggguuucucuguguagcccuggcuguccuggaacucacgcuauagaccaggcuggccucaaacucagaaaucuuccugccucugccucccgagugcugggauuaaaggcuugcgccaccacgccccggccugguaaauucuuuuuauucaucucuuguguguuauguauauggcugaacacaaugcaguagggaugcaggagucaggccuauucuucuaccugagaggucugaguguuugaacuccauuaggaagcuuuuauucauagcaguuaccuugauaacguaucuucucuguaguccaggcugcccucaaacuccuccugaucugaaguuauaccccugccucagacuuccaaguggcuagacugcugauaugccccguuguacauacaugccccguuguacauacguaguguuuguucauucagcaguuuguuggaagguuggcuugcugaggaaaugcaaguuuaggcuaauuugugaaguucucaaacauguauuaccucacagccucaucuuuaacauuuaaauuuguuuauuuguuguuuauuucagggaguaagacccugcagaguguugugcuuagcaagaugaacuuugagucuuucgugaaagaucuucuucugguucgccaguaucgaguugaaguuuauaagaauaaagcuggaaauaaggcgucuaaggagaaugagugguaucuggcauuuaagguuguuauuuuccuuuuggauguuugucuuagaaaauuaaauucagugcauguuuuacuauauuaacuagguugugauagcaaaaugccuugagaaauuuugauaguguuggguuucuaaaaguuacaguuuaaucacaguuuagaaauucaguagucuaucuauauaaaauguuuugaacacgccaaaccuugucucacuguuccugaaauacaacauuagaugauaaccuggacauaaauguuauaauuuuaaaaagauuaguuuuauuuauuuuuuuaauuaaaaaauuacuuauguguacugggucugcaugucuguccguguaccacuugcaugccuguugcuagagcgaggagaccagaggagagggccuuggaucccuugggguugguguuagacuugugagccagauucuagaagagcacccaguguucuuaaucucugccugucuuucugccuccaguuuuuuguuuuuaguuuuuuucuuuuucuuuggaggcacagucucccuguguccucaggguggccuaggauucuuggcaauccuuggaaaauggcugucuugaugugcagguggcucacgccuuugaucccagcacuugagaggcaaaggcaggcugaucuagaccagccuggccucuagauggggagaaacccuguuuugaaagccaaaaacaaccaacaaaaagacagagaaaaaugccuaacucagcuucucaaggugagggauuaauggaagcuauuuuuucuguuuuacuuuucuuagaacaggcucagucuggugucaucgaucguccugccuccacuucuccagcacugaagugauuacagacaugcucugccacacuugccuuucuuugccuuuucuauaucugaaguaugucagacagguuuuacugucccuaaugucucauuuauaggaacauuugugacugcacauuucucaguccacaccuuuagugagcgguauagcgucacacaagccuggagggugcuuuggucuuugagauagcaucuuccuguggcccacgcuggccuugauuggacccugacauucugucucagucucuuguguucugggaggccugaaaaucaguuuggcagaauaguuucucuguaugguccuggcuguccuggaacucacucuguggaccaggcuggccucaaaccacagagaucugccucccucugccucuugagugcuaggauuaauggcaugccaccaccauugcccgucucuggagaaaucaguaacugcaaaaggaagagagggucuuuaaagcacauguaguaauaauugaaaauagacugacaggcaugauuuuguaaaaaaaaaaaaaaaaaaaacaaaaccaaaauuaauuggauaauuauucacuugcaaaauuuaacuguguucaauauuccuuaaaaacuguuuuuguuuuugcucaggcuucucccggcaaucuuucucaguuugaagacauccuguuugguaacaaugacaugucagcuuccguuggcguuauggguauuaaaauggccgugguugauggucaaagacauguuggaguuggguauguggauuccacccagaggaagcuaggcuugugugaguuccccgagaaugaucaguucuccaaucucgaggcucuucugauucagauuggaccaaaggaaugcguuuuaccaggaggagagacuacuggagacauggggaaacugaggcagguaagggcauucagucuaggaacauccuucauguaaaauaccccuuccccuguauuuccuugaaccuaggaccucuagaauacaaggcuggugcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuagcacugagcucuggaugcuaggccagggcucuagcacugagcucuggaugcuaggccagggcucuagcacugagcugugguuccagcugaugaugcuuuucauuuaucaggggaaaaaaaccaguuuuaauucuaauuaaaauaauguuuuauuuugaggacaaucuugauucuuaacuuugaaagaacuuggcauucuuaagucaucaugacaaguguuuuuauaagacuugcugagguggcucagcaguuaagagcacacuggcugcucuugcagagguccugaguucaguucccagcaacaucaugguggcucacaaccaucugugaugggauccgaugcccucuucugucugaugccaucuucugucaugcaggcauaugugcaaauaguguucauauacuugaauacauaaaucuuaaaaagaacuuguuuuucauuuagucuuuucuucugucuucacuccaagagaauaguuauaguaacuaugaacuguauuuggcauguuuaucaggcauuaaauaguuaugauauuuauuucguauuuuguuggggaucuuggccaggcgugugcuaagcagguacuguaucacugaacuauaucaacccaaaccuagaauuuuucuuuaaguuucuagguuuuuuuuuugagucauugucuuacuugacagcccagguuggcuuagaacucacagacauccugccucagcagccugaguucuaggauuacucgagugcuacuacagauggcuccuguuucccuuuuaaaauuuagccuuuacagaacuuuuugucuauguuguguguguacguguauuuauuauuuuagauuugcagccaaaccuggccuugaacuuaaaaaagaaaauuagauuuauuuuccccggagacagggccucacuguguagcuguggcuguccugaaacucacuuuguagaucaggauaaccuugaacucagaucugccugccucugcuucccaagucuuggaauuaaagcugugcacuaccauagccagcuaaaaauuugugaguguuuugcuuacauguguauauguguaccgcaugaaugucuggcauccauggaagucaggagaagguauugggugucucggaacuaaaguuacagaugguugggagcccccaggugggugcugggagaggagucagugcuuuuaacugccaagccaucuccaagugcugcagauacuuuuuaagggacgaucugucugcuaacucacuggccaugcuggccugcuucuaacaggcaguccucauguuucuuccucccuagggcuaggauuacagggauggacuucgugcccaccugauaacagccuuguaguacugggcaccgauaagguucccagcaugccaggcaagcucucuaguacugcacuuaccccuagccaugccuccccuuccucccucaacauggcauucaaacucuccucuguuucagcuucuugguuggauuaaaggugugcaucaucgcaacaagcaugaaacauuuuuugaaacuuucauuuagucauaacuuuaaaauugaauucaaaguccagaguuggguuuuuuuuuuuuaaugaguggcagggucucacuguguagauuuggcuauccuggagcuccuugugaagaccaggcugaccuugaacucaaagaugugagacccaccuaccuccgccuccugaguucuuagauuuaaaaguaguuccugccgggcaugguggccuugggaggcagaggcaggcagaucucugaguucgaggccagccuggucuacagagugaguucuaggacagcuaagacuacacagagaaacccugucucgaacacacacacacacacacacacacacacacacacacacacacacagaguaguuccuaaggacuuggauagugagcagaauuuggugcguguuaguagucuucuaggcugucgauauuuuaugcuuucucauguuagacauuuccuuuucucauugauuuccucaaagucauuugaaaucuuuccuauaaacagguuauccagagaggagggauucugaucacagaaagaaagagagccgacuuuuccacuaaagacauuuaucaggaucucaaccgguuacugaaaggcaaaaaaggagaacagauaaauagugcugcccuaccagagauggagaaucaggucuguggguuacaaacaugugcuuaaaucacuacagugauguuuguaaaggcuaauucagucacuuuaaaaauugcauuuauuuauugugugcgcacacacccgugcucauggacgcacaccaccgcgugcguguggaagugggaacaacuuucgggaguuugguuuuuuucaccgugugaacccugggguaagcgcccaggcuuggugggagggucuucaucugcugagccuccucacuggccacacuccugucagauucacugugaaaucugaacucugcgucggugauacuauuguacguacaauaagguuugugaaaaacaggaaagugacuaugcauggcaguuaaucccagcacucgggaggcagaggcagguggauuucugaguucaaggccagccuggucuacagagugaguuccaggacauccagggcuauacagagaaacccugucucgaaaaaccaaaaaagaaaaaaaaaaaggaaugacuaugacuagaaaauuuuaaauauaaccucauagccuuauauuuaaauacuguuauuuuaauuuauguauguguguagggguaguaugcugcccuuaguggauagagacaugggauuccucuagagcuagaguuacaaguggaugaaagccaccuuacauaggagcugagaagugaacuuggguucucuggaagagcucuuaugugcugaacuguuucuccaccccgauaaucauacuuauguggauuguauguagaguauauguggaaggggaucguguuuacaugaacuugauaugcaagccuguaauccuagcuguuagagcuuggaucaggaguucacggcuaucuuuguaaauguugcaaacuugaggcgagccugggugguugagacuguguuucuaugaagaggaggaaaaaagucgucacaugaaagaaccugacuacugucacuucuguagggauauauagcauagucuugccugucccaccuuugcugugcaccaccaguuccaggaaucucucauaaauuauuuaauguuuuugagagagaauuuaauguuuuguuaaauaaguauaaauaugucuacagugaacgauuguuauuggagguuagcaaguaauaaaacugaaaguguguuuaccuuuaaaaaaagauucauuuauuuauuuuauguauauauuuaugaguacacuguagcugucuucagacauaccagaagagggcauuuguaccauuacaaaugauugugagcuaccacgugguugcugggaauugaacucacaaccuuuggaagagcagucagugcucuuaacugcugagccaucucuccagccccugcuuuuuuuuuuuuuuuuuuuuuuuuuuaaaugagaacauaaaacagugugggcagggcaggagauggaggcagucucagauauauauugaguuggaauacauccuuggcuaaaugaaacuaccucaaaaaggcaaauagaaaccuaguaagagugaauaaaaauccuagggcuuagaaaacuuucuuccuuccuggaaauguaaagaagcugguagagauuugguuuauuuauuuauuuauuuuuuguuuuuuguuuuuuuuguuuuuuuuuuuuuuuugagacaggguuucucuguguacccuggcuguccuggaacucacucuguagaccaggcuggcuucaaacuuagagauccgcuuugagauuuucuuacucuucaucagcaacagggcaugguccuggugcugacuucugacaguauagauuaguuuaucuuuuucuguuuguuuuuuuauauaaaugaauaauaggacuauuuuucugucuuuccuauuuugcuuuuggagacagguuucuacuuauucaugcauacuauugaaauaaauauguuguagcuuauuuauaaaugaaaguaaaaaugaaugagcaguauuuuagaagguauaaaaagacaacccuugccuguguuggcggugguggcacacgccuuuaaucccagcagucaggcaggcaggcagaucucugugaguucaaggccagccuugucuacaugucccaggauagccaagguuacacagagaaacucuugucucaaaaaaucaacagaaaaccaacaggcagucuccauggggaccgauucuagcucuccaacacuugucuauuugagaugucaaccaucuucccucugggucucccacuuguaagcaacuggguuuuuccauguuuuugagacggggaaugaccguauucuugucuggccuggaacucagacuguagucuagauuggcuuugaagucacagauccccguaccuuugccucucaguugcuggaaauaaaggcuugcgccaccacucguggugggcuucacuuugauuauacacguaugauauauauauuaucaugugagcaugugauggucaugagggugcuccaucuuguucgugagcccaggacacuuguggggagcucuuuuugccugcugugucuagggcucagacucagaucacaagccuugggggacaggugcuuuagcuacugaguugucaccagcaugagaggcugcccuuugcauuguacacuuguguagacuugcuaugcaucccaggcuggccgcacccuugacuugccuguguuggccuuucacucauggacuagaauuccaggcaugggccuccaugcccagcugaucuucuuguacuuuuguuugcauuucugguaucucgucuuaugauugaagaaugaguuauuuaaauuuuuauuuuuagguugcaguuucaucacuaucugcaguaaucaaguuuuuagaacucuuaucagacgauucaaauuuugggcaguuugaacuggccacuuuugacuucagccaguacaugaaguuggacauggcagcaguuagagcccucaaccuuuuccagguaaaagagacaacauggguuaaaaacugaauaauuaaaaaaaaaaaaaauuccuuuugcgaguaaugcuuuguuuaagggauuuguaguuuauaacauuauuggagcuagaauagauaguucuuaacuauuguauuuauuuuuucuagccucaaguaauauaugucgacguguccuagguuuuugaauaauuuugugugaugauagcagugcuuuaaaguucuauuuuaguuugguuaaacacugcaguaacugggagcagagacugggaggacagaggggagggaacuuugguuaggaugagaaaaauggugucauugagggcaaaguaugccucuguaaguauagauuaacagguugaaauuuggucuuagcuuagaaacauuugugugggggcuggagagauggcucagcggguaagagcaccagguccugaguucaaaucccagcaaccacauggugggcucacaaccauccguaaugagaucugacgcccucuuguggaguuucugaagacagcuacaguguacuuacauuaaucaaucaaucaaucaaucaaucuuaaaaaaaaaagaaacauuuuugugaacaguucucaguuuauuuuuggagaauaauacucauucuuuuugcccaaagcguauuucauguccuauuagucuuugcugauguguguguguguacguauguauuuauuucuguguucuaggguucuguugaagacaccacuggcucucagucucuggccgcauuauugaauaaaugcaaaacugcucaaggacaaagauugguuaaccaguggaucaagcagccgcucauggauaggaacaggauagaggagagguacggccuggagugugugcuuucacugccucugagcagcgugugcuuaacugugugggaaugccacuuacucugauacauacucaguuucacacucauuuuaguuuuucuuuuguuuuguuuuggaguccugguugacucugaacucaauauuuaguugcggaugagaaaagaaauuacuaugugcaugguguguuuuuguguguaugcccucuguguguguguagagacagacauacagacaggcaggcaggcaggcaggcagacgcaugagcacguacagguguuggcuguacauucguggcaucccuucuuccagcuucauguaggcuccgggggucaaacucagcaaauagacagguuucucagcgagcaucucuguccucugagccuuucucucgccuaacuuugaacuucugauccuuuugccucuaccucccgggcccugggccaccauccgcaguuuaugugguacugggagguugaagcaguccuggaaacucucguucaggaugcugugcugagcucugucccuagcccaguuucuuuucuuuuuuucuuuuuuaaaauuuauuuauuuauuuuauguaugaguauacgguagcugucuucagacacaccagaagagggcaucagaccccauuacagaugguugugagccaccauaugguugcugggaauugaacucaggaccucuggaaaagcagucagugcccuuaaccagugagccaucucucuagccugaugcuguacuuuuaauacgcugguuugauacgagccauuagcuuacacaagaccuagucccaacucgcauaccuucuauguucucacccccugucuuccuuccccuggaugauccggucacugacgaaugaaugcccuggugauccagaugacgucugaguguaugcaugcacaucacgugugcgggagcccgagagcaucagcacagaguguucagcacccuguaacuaguuauaagcaacugugacugcuaucuggguacugggacucaaaacugcuuucuuuggaaaagcagccagugcucuuggucaucucuccagcucccacgaacguugguuuuaaaaacccaguguuggcuuggugaaagaugcagugguuaaagacaguugcuuccaggcccgaugaccuagugcaucugagggacccacgcuguagagggagaagauucuugaacuucgaccuccaugugugugcugugacacaucuguacacccauguacuccgggaaguaacugugaucauuguuuugaaauaccagauaucuuaggauugauuuccagagagcccuuuggaauuuuagggacuaacuggcucuuaaaaauuuaucuugcauuccaguuaaauugugaauuaauuccuaucaaauuuugugcagcugaggaauugaauuuaacaugagugauaggaauauucucuuaaugccacucgaagcuuugauauuucuaaaguugugaauuuaaaguggcauugucaaggagacagaagucucuuccuuuuuuccauugucuguuaucuagagguguaaacugacacuguaauuacuucuuaggugguugcugaauagacuugugaaaccagcaauuuguuaggcuucucaggaucucugggccagacugaaggagcauugugauuuguuuugugcuaguguguuuugcuuuuuuuuuugcuucaaguccgggucuugcauagcucagguuggccucaaacucagauuucguguucuuccugucuucaucucccaggugcuagcauacaagcauggcuuacuuuaccugucuguugugccugaguuuuguggaagauugcucacacucucucucccucuucuuuccccuccccuccccuccccuccccuccccuccccuccccuccccuccccuccccuccccuccccuccccucccucucuccugagacaguuucucuguauagcccuggcuguccuggaaguaacucugcuccuuuuucuccuccuccucuucuuccuccucuuccuccuccuccuccucuuccgauuuauuuauuuauuuuauguuuauaaguacacuguagcugucuucagacacaaccaggagagagcauuggaucccaucauagaucauuguaagccgccaugugguugcugggaauugaacucaggaucucuggaagaucaguugcugcucuuaacuccugagccaucucuccaguccugcgcuuccccuuuuaaaguuauuuuuuuuuucuuuagcuaaccauggugauacucacauguaacaaaauuccagccuuaaagagauagaggcggugaggauagugacuugugugugugguggcuuguugccgcacauguggaagucagaggacagcguggggagucaguuccccccagccguguggaccuccuggggauugaacucaguugucaagcucgguggcaagugcccuccuguugagccaucuuaucacuuacucguguauuuuacguuacuuauuuauuuuuuuuccagguuaaauuuaguggaagcuuuugucgaggauucagaacugaggcagaguuuacaggaggauuugcuucgccgguuuccagaccuuaaccggcuugccaagaaauuccagagacaagcagcgaauuuacaagacuguuaccgacuguaucaggguauuaaccagcuccccagcgucauccaggcucuggagaaauacgaagguaucgugcggucagccagccagcagcuuuguuuuacguuagcuuuuccauuuuucccucaccccguuuuacuucccuguguucuaacaaaugugcuguuaggucuguggggauguuacacuuuccaauagguuuguuuugagucaggcccagacaggggucuaguaaggaaagggaccuugguggcuagcuguaggaguguaauguaaugauuuagcaagggggagggcaaggccucccagcaccacguuugccguguuucccguguuugggccuacuaggucaaggucagcccagacugcacaacaucaugucgcaauaaaaaggaaguccauauaguuaucuaauagaauauaugugagugagaucauguccuugacaaaggugugugugugggcacuguggagaugagcgugcuuugcauauauagaugggucguguguacccauguguacgcgugcccagagcuacacuugagaguuucucucccguucagaugcuugcuuuccuaguugggcgauggccaguugaugugugcucuuggacucugccacucccccccccucagugugagguuaucgggaggggcagccaugucuuacuccaucugggugcugcagaucuggaugucauucccauuuguccugaacuagugcuuuuggccauugagucguccaucuucccagucucccccuuagcuuccuuggauugaaugcaaguuucuacaacacuaauuuuaguuuguauaguuauuaaauaucuaacauguaaagcauuuugaguuggaauuagacaucaacaacucuuagagcuauuaaaacauaccccguaggggcuuggcaguagauugcuuauauggcugauaagcgaugagacccaguaucucaaaauagcucugucaguguuacgggaaaauuugcuuucuuuuccagacaaauuuaaauucagcuucaugaugacagaacacaaauugaguuuuguugugacaauaauuuauuuuguguaaugugcggaagcaggagggcagcuuuggggaguugguucucuccuucuauccugugggucacagaacuccgaaaucagguagccaugcuugacagcaagccccuuacccacugagccauguugugggcccgaggcaccaagguaacugagggcuaaggaguuuaagcacuugguacacaggccuggacugaaguuggggugcucauaguuccagguggagacgggaucuuugaagcuccaaccuggcuagcaagacucaucacaucagugagcucuaguuucaacuaggagaccuuguggguucgggauccagagaaaagcuccgcaguuuuuagagcacuuccagagguccugaguucaacucccucugguggaucugaagacagcagcaguagacugacauacauaaaauaaauacaucuuuaaaacagagagggagagagaccuucccucgagacugccguggggaagagcagucuggaagcuuccugacagcagccuucacuuggaugugcauccgcucgcaucugagcguguggacacacgcucauacaaacacgugggaaagaugauacuuuacaaaggguucuuauuuucucaaaggaccuuuguagaaacacuccuccucucgguugguuagaugugccaaccggugguacaagcucaucacugagccugggaccccagugaucuuagaacccaugcaguggaagggcugacuccugcagggcuccuggucugcacacacagcauggcucauauacaaaagagacagaaugaaaaccugauuccuccacucugugacuacgaauuucugcuccucgugccucaguuuccccaucacauaaauguguagcaucugcuuguuuccuuuuuauaucauuuugucugguuucagcaggaauuagggaugugcucugacugggccgcucuaagcaguaaggccucagcacacagcagcuguuuggggcuuucugcuuucauguaucucccacuguacaguagcagauagauagccuuuuguuuccuaguaagucaccuaguacacgauuaauuacucauuauuuacucaucuacucacugauugaucgauugacacaguguccuaugaagcccucccuggguggccuggaauucuguauaagcaaggcuggucucaagcucacgaagaccugcccugcugagguaaaagcacugcacaacugugcccagcuugugugauuuauuuauuuauuuauuuauuuauuuauuuauuuuuaauucucccuuucugugauuuagcacauuuaaguguucauguuugcccuauucccucagcacagaucuggucaugagaggcggcagaguuugaggccggccugguuuacauaggaaguucuaagauagcaaguacuguguagagagacucuuucucaaaaaguaagacugacugacugacgacugacugacugacugacugacugacugacuagaaaaaacaaguccuagucugaaucgcuuuugguaugagugcaucuuccucucucggcucccgguucuaaaagccugcacuucuucauccucugcuuacacaucugcuucugacccugaccgcagggcugggcugacaggugcuaaggugccuguuuguugauagauguagccagcgagcgcgcacaccacacacacacacacacacacacacacacacacacacacacgcagccugagcuuauaaacuuuaagaagacaucuuguuuuauguuccguguucccgguuuccuucuguggguccucccauccccauuauuuuuaaagagcucagcacaguucuuuagugugcggaauuuaccgugcuuuaaaaaguauauuagcauccauuauuuugagauguuacagauaauuuguccuccugugauguuuucgguuuugacucauucuaagcuugcuuuuuaguccagagaacagcaagagucagguguguucacagacagcagggggcagcagcagcuuggaaagggagggcauuugcauugguuacaguuuuucucuguaagauacuugccagcuuauugggagguucuagcuggguaauggaguuagcugcacagagguccucaacaaaagcaguuuuccuaucuuugggaaggugacugcguggcuuuaguugaccccauggagcggggugaugccuguccagccagaucacccucacaucuagaaacagggauuuucaugucuaucucaaauguuccaggguaaaauauaaaauaacgauguucuacauuggacacguuuccagcagauuaagauaacucacgcagacauacagauuauuuuaugucuaacuuaucuguucggacuuuguaaacuacuuugaaaaguuauuauuuuauguguauuuucaugucuaucugugccugaaacugguguuacagaccccuaacccuaacccugacccugacccugacccuaaaccaaacccuaacccugcuugucagccccugugaggguacugggaauuggacccuuacccucuggaagagcagccagugcucuuaacuacugagcaucucaccagccacaugcaaauggaauuuugauagagagugcauugagucuuuuugguugcuuaauguagccauuuucacaguauucugccaaucuaugggcguggggugucuucaguuuguuuaucucuccaggccugacacuucaugcuucaguuaauuuaagaaguucacaauuccuugggugaucuuugacauccaagacccuuacugagcaagcaugagagaugcugagaaggcucagagauggcucaacacuuaaaagagcacugggugcucuuccacaggaccuggguuugauucccagcaccagcaugguucauagccaucuguaaaucaggcccaggggaucugacacugucuucuggccuccuuggguaccaaacaugucagugaugccagacagacagacaggcaaagcaccugugcacuuaaggcuuuaaaaugugaagaaagagaaauuacugaugcuguauauaguggcugauacccauaauucccaaacuuaguaugcugaggcaggaggauugccauaaauucugagcuacauaaauuuugggcuacagaaugagaccuuguuucaaaagccagaacaaacaagaagaaaagaaaacaaaagaaagucagagaaacagccagcuucuaggauuugagaggcuggggagccucacuguaucagccagugaugcguuuaaggcuagcagggguuagacauguugaagucaugaagugaggugaagugauuagucacagugcuagaaaauaaggggagagugguagagcugaggccugcuaguguguguucucucuccuuaaaauuaaaagacaaaaccaaguugccuuagccugcagaguuccagacagggcauccaguacucuguaauuggaguuauagauaguugugagcuggcauguggugcugauauggaacccaggcccucuggaagagcagucagcccucuuaaccucugucugaagcccuuuccgcagcuguguaucuaguguuuguaacuuuguuucauuuugugcuacacaggcuguuuuggcuucuaauaaaacuuauuuucagaauaaugguuuuaaacauaugaaauaaaacaaggagaaaagaaacuaauuguauugaaguguaguuaucaagauacaaaaccuugauacagagccauacacuugaguuuuuguuuuuguuuuugguuuugguuuuuuuuuuuuuuugguuuuucgagacaagguuucucuguauagcccuggcuguccuggaacucacuuuguagacaaggcuggccucgaacucagaaauccaccugccucacacuuguaauuaaugcauuuaaauuguguaugcgugcguccaucugucugucccucugucccuccuucccuucggaagagacaguaagauaucaggucuccuggagcuagaguaaauguaguuguuugcugccuaguguggguucuuggaacuaaacuuggguccucugcgggagcagcguacaguguuaacucuccagcuccuuaguuaaugcauuuagaaagauuguaaggacuggagagagagccggcuaaguguguaagauggagagagagccggcuaagcguguaagauggagagaaagccggcuaagcguguaagauggagagagagccggcuaaguguguaagguggagagagagccggcuaaguguguaagauggagagagagccggcuaagcguguaaggacuggagagagagccggcuaagcguguaagguggagagagagccggcuaaguguguaagauggagagagagcuggcuaagcguguaagauggagagaaagccggcuaagcguguaagguggagagagagccggcuaagcguguaagguggagagcgagccggccaagcguguaagguggagagcgagccggcuaagcguguaagguggagagcgagccggcuaagcguguaagguggagagcgagccggcuaagcguguaagauggagagagagccggcuaagcguguaagauggagagagagccggcuaagcguguaagauggagagagagccggcuaagcguguaagguggagagagagccggcuaagcguguaagguggagagagagccggcuaagcguguaagauggagagagagccggcuaagcguguaagauggagagagagccggcuaagcguguaagguggagagagagcuggcuaagcguguaagauggagagagagccggcuaagcguguaagagcauuuguugcuuuugcagaggacagguuugauuuccagcuucuguggccaucacaaccauuccaaacuccaguucuaggguaucugauaaccucuucugacuucugugggcaccaaggaugcauuuuauauaaaauuaaagauaacuaaaucuaaaggggagggggggaugcugacaaguuggcugugguaguuuaauucuguaucccagcugcucaggaggccgaggcaggaacaucgauuuuuauacaacauaguuacagccuuguuucuaagagaggaaugaaaggccuacucuugcuucaauuucagaauaaugaaucuguauuuuaaauuuguaauuauggauaugugggucuguugacaugcgacuauaggugcccauggaggccagagucugaaacccuuggagcugggguuacagcuaaacugugagcugcccagugugggucucaacguugaaccuggguccucugcaagaacaauuuaugcuuguauccacugagccaucucgccaaccuggaaugcugaguuuaaaugaaacuuuaggauaacuccaaaagcuguuaaaugauuucagagugugguggaucuuuugacugguaacagacacgguugucuaauacugugcaccuucauuaccuguuuugggaaugcgaaaaaggugaaacgaugaccuguguccaugcucugccuugaugucaaggggucugugggccuugccuuagcuuuugcagggcuuuccaggcugugguaguuaauggagaaugcagucuuuaaaaauccaguuggaaauuggcaacuaagguucaguggagguuaaaacucagggaaggaggcugaggguggucaugaagauuccaggaggucugcauuagagaggguaggggacaccgaggaugacaggagccucacaucugcaacagcuguuuuuugugguguaguguauagugacuguucggcguggggcacugccuguugcugugucgucucaggcacgcaccuauccucuggguaguugucaucgucacuaccuugugcagacaaggacagggcucaggacagggcugugcugaggaugagaaagccacagagcagcaugcccgggcuagcgccagcccugacucugccuucuugcacauuguugguuccuguuccccuccucccacgauuccucgggauggcucucaaccgccaaguuccaauuuaagcacuggauucagccucugcugauuggagcgcuggguuguuaauggaaauuaggaugcaaauuaggucuuauucuaguggcuuugucuuuggcucacuuagucauaauuaauguuuccacacccucugaaggagacccagaccugcagggagggcagugcucuaguaguugggccuugggcacuaccacagugguccccugucuauagaugauacccuuugaguuaaagcauaaaagagaauugaguuuagagaccuggacaauuugugcuuucugguucaaaggauuucauuauuuuaauauuaugaucuguuguuuuuacuucugucucugcuuuguuuuaggaagacaccaggcacuguuguuggcaguuuuugugacuccucuuauugaucuucguucugauuuuucaaaauuucaagaaaugauagaaacaacuuuagauauggaucagguaugcaauucacauuuaauucccacagcaaaguauuuuuggaagggaaaaaguaaccagaaacaacagaaaaaucauauuaaaaaaugucuaauuugucuugaguuuguauuuuuuuggcacuuuguguggcaccucuguggccacuugauguaaacugaagugacagacaaggaagaguggacuugccaggcggugcuggggaaucaaacccagggccuugaauguggugcccuuggggucgagaauaagguggagugggugggcuuuuacuaaggcauacuuagaauugguggagauguuggcccuuggcucuguggaaugccuggcuaaggcagcucagccuacugugaagagguccccgcugggaggcaguuugcuucaccgguuucaguggaguugaccacagccuaagcugcuuggagguuugcuaaucuaugcaagcauccauccacagagaggaugggagcagcccaggcaaccaagagagcugaggagcgaaacacugccuuguugggacagagacuaggaagggcugcagaguaaacgucaucuacaugauagagaagugugcuaggaaugaagcuuggccagaaaaaugaggacggcccuggaagccuugagagagaacuguccgugugagcugccccgaagcccugugucaggguccacccaggugaaggcaaagagaaagucaauaugcagggggacaguaaagaagggagggguccuuuagguccacaaugguaaaguagaaggcagaggaggaguauuagggaggaggguagaaguguugguaaccacaggguggguuggaaccacugccauauuuaauguacugugugguaggcagcggaagcucauguacugcgcgcgcugggagagcaggagcccugugaggccgucagugggaguguccgagauaguggguggguaauggcuugagacugcagcggugguuuucagagacgggaaacuggggucuggagggaaaggaauaggaggauaaagaccagcugcgguggguagcagucacgguguggagauauuccacccuugagaguuaacuggaucuguaggauagggacaggggagucugagguagagaucugugaggcaacuagggaaagaagaugggaaucaggaaagguuaugggggccaggguggcuucaaaguagcuacggauuucauggcggaguaaaggaaccaggcagacaggcaugaccagaaacacuugagaagaaucacccuacaagaaggcagggaagaagagguguacaggaggggguuccaucuauguggggaagaacagggucuuagguguacaggagggggguuuccauuugcccccccccccgaaguuggugauaauacuguagcauuguccuuggcuuggcagggucaccgagucugggagccuaugcuaguggggcugggccucucugugacugggcacagaagaugagcccacaugggggcauacagacuucugauggccaggcugccaggggguugggcgugacuuccugggcuacugaggguugccgcaggugggguagccuucugcuguagccaagccugucaggaaacugccaccuccucucuugcuuuuauagacuuuuuuuguuuuuuguuuugugguuuuucgagacaggguuucucuauauagcucuggcuguccuggagcucacucuguagaccaggcuguccucgaacucagaaauccaccugccucugccucccgagugcugggauuaaaggcguacgugcgccaccacgcccggcuuuuuuuuuuuuccuuugcuuugcuuuuaaaggcuuuagaagccauuuucaucagcgucuguacugggguuugagaaccauccucuuccuucuuuaguuucuuuccaacucugugguuaggacuuguagaaguuagguuugguucgacugcuuccucccaugcucccagaaauaagacucagacucaaaauauauuuacaaauaccuuggcucuucucugacuagaucauaacguagauaacccaguuauuuuaaccuacauucugccacauggcugguuaccugugcucagguacuaugcauaugucuuguuccaucuuccccgcgggaaucuucccgugccuggcucuguaccagaauucucugugccucccagauagcccgcuucccauuuccugccuaagccauaggcuuuuuaaauugacaggugaugugucuauacaguaccgaaaauauucucucugcaaugacagaaauaaaauggguagcgaggaccguggccucugcuguggaggcugaguccaggcagguacugcaucguggcggaauuuucgucagcuugcugcguaauuucauggaacuuaccaaagucaacuuuaguugacucuugucuaacuccauucccugaaggaggcaauaggucauaagcucccuccucugguggccaccuuaacccggcugguaaucccaguuggguucuuuagcugaccuuggcuugucacccacuagggacuguuuuguccacugggucuacucugcauacuuccugccagacgcccgaaccuacccgggaaugagaguggaaccccguguaauguacaggucagaggucagaggccuggcaaagguaguggaacucuuuacucuagauggauagguuggcagggaaggagccucaccaccuuucagucugggugaggugguguagggagaaaggaacgggaauuggagcaagucccucagcccuugccaccucuuggagugggcagaggagggcggagucugccagagugcuguaagcagccacaggggaggagaauucaggcggggcagacuaggguguggguuucggggucauagaaggggagggggcagagucggcacggaggagggaagaggauggggagaagguugagaaaggggagguggcaaguuagaaggggagcagugggaggggaggagagggcggggaagccagugacucaggcagcucaguccugguggaugacucaggguccagguccccggguaaaaggccagcgagacgggaugucaagcacuggacacagaagugcaacuccccaaaaacuugaacagucgggagcucacacccuaugcagacauuuucaaggucauggagaguauuaaaguuuacagagugccuucugguggccauuuagauugguuaucuagagcauacugagaucaggccacagagcaaagagccagauguguuagccagguucugagguggacccaauuuagcuaaauuucucagcagacaguuuggggauugauuuuagaucuggcagugcccauuguccagucuuugcugguuggcuuauuucuugaguggagaaaaccgcuugauggcaaauggcagggcucaggauguuggcucaacugcuaccgguagccauucuagagccagaaagguuaaggggauuagcucuuggccggucauacuaacuugaguggcaagggauagccaguaaguccaucccuagagaccuucacggccaggcuucuagacgacucugggagcugaccccgugaggccaggccaugccccccucccucugcuggggcuuugcccucuugggugggguuuuuccucccauugcauucuuuaugugagguguguugugcagugugacuuggugguguucuguggcucccuauugccggaaccuuugcauccaauccguaacacgcacgucagcacccuccagaaggaggaggggccuucagggugagcacugcaggcuggggagggcugcuguggccaguagcaguuacuccucaguuacugcaacuggggacacucacaguuuauaguguagaacggucuuaaauagucacaguccuaauuaaaggcugcacuccugggggcagaccuaggcaggccucuagccguaucucagguuauaaggcaaguucaaaucaccgucaucgucgcagagauuuguaguggauuuagacauccagauuacauuuuuagaacuacuuucagaaauucuccagggacucucaguuguugaugucuaaucuuugaaagccugguugugcuccagcugugcuuaggaguucacgugauggagggucucauuuacacaguggcaugcuuccugugcccuucccucacaccaccccccaaguaaguguuucuguggcugcuuuccauaaguccucucuuuuuuucuuuuuccuauuuuagaaauguagaucaaaacuauccuaagccaaaauuccaaaaaggcauugauuuaaaaaaaaaaaaaaaaacuaaacaguuuccuuuguguuucagugaauuauauuaauuuuuaaagauuuuuggacaguuucauauguuuauaccauuauuuugaacauauccaaugcauuucuuuccacuucuccuccgugaugguuugaauaugcuuggcccaugggaaguggcacuauuaggagguauggcuguguuggaggaagugugucacuguguaggugagcuuugagggcuccugguacucacacucugcccaguguggaagaagucaguccuggucaucuccuggcugccuucagaucaagauguagaacucucagcuccuucuccagcaccauguuugccuggacacugccgugcuuccugccaugauauuaguggacugaagcucugaagcuguaagccagccccgguuaaauguuguccuuaugaguugccuuggacauggcgucuauucgucgcaauggaaauguaacuaagacacccuuggucuucauugucauguuuuccuuuuuuccuuuccauccuuuuuuaauucacuucuauuucaugugcauugguguuuugccugcaugugugucugugugaaggugucagauccucuagaacuggaauuucagacaguugugagcugucaugugggggccggaugccugcaugcucagggaugccuuccccuucccugggagcuguaacugucaguggugccgcauguagccaggauccccgugagccccugcauccgugcagggauguguacuggcucggcauuaugguuuagcuaacuguaccugcuaugaggagagcacuggcuaugucauguccauacagcauuuccugcacuccuucccauccucugccgcuuaacacacuuaacacccauucucccacgaugucacccggguuaccuacccuccaccgugugugugcgugcaugggaaagagagacagacacagacacacacacacgcucaguaaacacuucucgucauuuagaugacauguguaugcguuaccuacugaccacuacagagagaagcuucucugaccaucgcugaggacagcacugaucuggguguaagcauaaauugggaauaggcaguuugauguguccguuuaggaaaacagcaguaauaguuguccccgccuggggcuggugaucucccuagcugaggucuucugaccagguuuacaguaccugguaggaauucccuccuguggauuaggccucaaauccaauccuaaagccguugguuauucccauaaaacuucaugcugaucuuaguggucauuuuuaugauagcgugacacaagcaugugagaugagggaaccuugauugagaaaaugccuccauaagcucagccuuguagaacauuuucuuaacuagugauugaugggaaggggcccaucccacuauggguagggccaccccugagauggggucccaggcucugugagaaagcaggcugagcaagccaugcaaggcagcaagcagcaccccuccacggcguccgcaucagcuccugccuccagguuccugccguuuuaguucuuguccugauuucugucaguggugggccacaguguggaagugugauucacauaagcccuugcuuccccuggugccccaucucagcaaucguaacccuaacuaggacacugcuguugcuccagugggcaaaucuuguuuguugaugaggauugcgguaugcaguguccacuuuuaugcuuggaagcacuuuuaccaacugagcuagcuggccagcuccaguguuucuuuuuuuuuucagccaguuccuauuucugcuccauucuggaggacuaacaguccucuuagcuugcccccucugccgugagaaagaccaugcuucaccucacagauuacaguagguguggaggaugcugccuccugacuugcuccuucaccggcucagcuucucaccggcucagcuucucucuagcucagcuuacucucuuaugugccucagggcuacuguccagggauggcaacacccacagugagcggggcccuuacacaucaagucauccucccaugccuugccuaccugcucgacuucauugaggggcuuccuucuucucaggugacaaacuaagugacacagccaccacuauguauugaacccugcccggguuccuccuuucuuuccugacuaauccuagcuccuaaccccugaccccuaaccccuaaaccuaacuuggaacuggcuguguauagauaggcaaguuuggccucauguacaguugccugucuuugccuccagagugcugggauuaaaagcuuguggagccauguucuggcaugaaguagacuuugaaaugaucucccugguuuuauguuggagaaucuuuacuuggcaucagcuagaugggauuuuucuccagcugaucauuuguuuagaaaaacaugcuuauaauauuuuaucuaauacuucugggguaguggagcuuuuauaacaugauugucuaagacauauccugggcuagagaguugacucagcaguucauguacguguucuuguaaaggaccaagcuuugguuuccggcacccacaaggcauggcagcucauaucuauuuguaccuccagacccaggggauuccauggacucucuggccccaaggucaccaaagcacacacaguacacagauacuaccagggaaaucacucacauccaaaaaguaugaaaauauauaaaaccuaaaaaucuuaguaucuuuuauguuugcuuuguaauuccuucaucuuuugauguacguccucuauaaagguuucuacucuuucagaauugguaauuugauuucagaccaucucugguguauuaaugaguccucuagugacuuggcuaaggcccaacccuaccuuucucagucuuuucaucucacuguuagcuccuugcuccucugucugucugucugucugucugucugucaccuuuacugauccaguggcuuguucuagugccaaggucggugguacuguuugaaaaacaauugacuaacauugagauguccuauguggguggggcgaguggcagccuccugagcgaugcccaugggauguguguccuguaucagcguuuauuucagucacauuaaaggccuggucauuccccacauuaaaggccaggucauuuccccuguuguguuuagccccccugcagcucuuuuccuauuuuuguuuuaaacauuuauuugcuauauauguacuuuauuuauguaugugugcaugccuccguguauaugugcagcauccgggugcagggccagagaaggucagaagagacauuguguccucuugaacuauaaugauaggugguucugagccccaugugaugccuccauguggguggcgugagcguaggaacugaacuuggguccucugcaagagcaauuagcugccaguuccaucuccagucucgucacagcuuucagaggugcauucucugaucugaggaaggagagaaggauaccccuccagauuugagguuucgccucaccauuucuuuccuauauggugggguugaggguaggaacguggccuggucccuacuuugccuuuucacuggaagaagcaagugguguaguaagcacacuuccaaucuuccgugacagcauugggucccccaccccgccccgcccccgccugccuccuguaacuguuauaagucuugauccuuauuacuggauaaucuucauuauauguuuaaaugacuauuaguauucuguucuguugauggguuaugcaaauuaugugucuucaaguugugcuguaaacuuaacuguauugaggcuuugucagaaaacuguggagguuuucuccagccugugugcuuauuuugccucuauuuuaucauuuccauaaauuuucagccgaacagcugugucagaguaaacguacccaagucucauugugcuuugcccugcccuccaccuuuuugucuguuuuguguuucaagacaggguuugucuguguagcccuggcuguucuggaacucucucucuagaacaggcuggccuugagcugagagauccgccugcgucugucuucgaacaccaggauuaaagaugugugucagugcgccuggccacugcucuuuuuaaacauauaccaacuucacccucagcaggcauggcugagugagugcgugguuucaggaagccucccuagagugugccgcuccuuuuucuuagguggggacaggaaacugggaaggagcugguggaauagcugccugcacggggaaagcuacuguacaacagcucacggcuguuuaaauauucauaucuuuuauuacugcgcucuccucuccauuacucuguugcucauuuuaggugcuuaugccugcucauuugaugaccuuaauacuuuccuuauaugcaaagaagugcccugacaaaacagcuuuuguguucuuauuguuuugguaaagcugugguauaccuuuuaucuuuaaaaagaucuauucagaauuuuagcuuuuaauauuuuauauaguugguacauguuuuauuuuaaauauuuuauugauuuuccucuagcuuucuguaauuugauuuuuuuuuucuccuugugaauucacuuuaggaauaugaaaaugugcucugauuaaguggauaauaauuaggagcaauuugucucagccuuauuuagugaauauguuuuugucaucuuguuuuagaaaauugacucacucucauauuaagcuuuuauguguauugucuauuuaauaacguucaaugccugguacagauagacuucuuuuuaaaauauuccuuuguaauuuuauuuguuuaaauuuuagucauuugcuuuaaaaaaaaaaaaaaaaagaacaaucacuaggcuugaagagcuauuaacauuuaauuuucuguuuccaugguuugcuccuuaauuugaaaccaguucuauuuaguguucagguaaauugcauuuuaaaggucucuacauaauaaagacuugaaaaucccauguaugucuuugcuuuuaaaacugagauucauuuuucauuacacuuucuggcugguuaauaauauagcugguaaauaauaaaaagucagguguggugccacacaccguuacuccaaguacuccgggggcagaggcaaggagaucuccaaguucagugccagucugcagcuagaccugucuccaaagcaauagccuaggagcaguuuacaaagacaguguuuaagagugccauggcaagccgggugugguggcgcaugccuuuaaucccagcacuugggaggcagaggcagguggauuucugaguucgaggccagccuggucuacaaagugaguuccaggacagccagggcuauacagagaaacccugucucaaaaaaccaaaaaaaaaaaaaaaagagugccauggcuggauuugaucccagcauucacugcccucuaaaaugcguccaucaaauccugacauuuugagguggguguaagugugcacaccuuuaauuccagcccucgagaggcagaggcaggcagcucucuuugagucaaaaccaacauggcagagcucacucuguagacuaggcuggcuuugaauucacagagagguucucacgccucugccuucuaaguguuuaaguguuaggauuaaggacaaaugccaccacaccuggcagucacacggguuuagaaugugugugugugugccugugcacgagcgugugagugcguggcuggacaucccacccucccuuaucuguggagacagaggacaacaccagcaagucauuuuucacccuguaccacaugggcuccagggauggagcucaggucgccaggcguggcaguuuuaaguucuuuuacccaugagccaccuugccugcacuagcuagauagagauuuuuaagaaugguuuuuuggaggaggcauuggaaguggagugcugugcugaauuggagcuauugagguucuuaagguagaucuuugguuugggaaaagcauaguguagugaugauuuugaauauugaacauucuuuaguaauacuuaaggaaaaugcaaauaggguaguguuggagacagcugcaucauggacuuugggucugcuuccuguggguaauuccuguguaucuagaacucuuaagcgccuauuaaaauuuguuaauaaguagaaaguucuugguaguguuggcuggacauguugggggggucacuccugccgcgcgcaccagauaugcacaggcagaagaaacaucacguuucguaagucugucuccacacaucuguuuguaugacuuaccuaguccuugcuccugcgauagguggaaaaccacgaguuccuuguaaaaccuucauuugauccuaaccugagugaacuaagagaagucauggauggccuggagaagaagaugcaguccaccuuaauaaaugcagcccgggggcucgguaagauggguuuggaggggcagggucauucuggccagguguccccgaauccuuucucuuuucacccugagagggcacgugcuucacucagagacuagucauugcggauggcagaugucauugcgugauucccugugaacaguuugugauuuuguuauuaaacuauaauuuuuauuuaugcguggcucuuugcuguucucuuuacaaauguggacugucuauaguuuuuauugauaaauuugguugcuguuuuucagccaacaaauuuguaucuagauuuuuaaguguggccuaauaauuacuuugaguaaaauuguaagucgaggccaugauagaaaauuuuacagaucuuagguauauaaauuuuagcuagccagucauuauuuguucugugaaaucuucugugcuuaagaagaauauauccuaguuuuucuagugucuccuugucagagucagauuuuuguuuggaaauugcauuugcccacuuuucauuauacccuaguuuucagcuauucuuugguuaaaaagagaagccuggccuggggugauggcuuaguagauaaaaacaucaccaaacagccuaacuaccuaacaugaaccugcuugguggaaagagaccugacucccauaauuugucuucugagcucuacauugagccauggcacacauuuccacacacuccacauacaaauagauaaagugagaacaaauaaaucaagaaaauuuaugcagaacuacuuaagcauggguuuuuccauacccauuuucauagaccuccaacaucugaaacagcaugugcuccccaccaacagugcuccccaccaguggugcugcccaccaauagugcucugccaucuuggguagguuuacacauaugaaaagcagcuucucccaugucagaagccagcuuuuauaagagaacuuaaggauuccauagauauauuacacauaguuucccaaugaaaugggauuugaaccuuuuccaaugagccaaucauaauuucuaguaauuaugauaaaugacaauaauuucuagucuuaugauauaauaaguauguugcacuaaucagaugugguuuugaccauuuagaccaaaaaguggcuguauaauuuaugacuuuaaguuuuuucuuucuaaucguaaaggauuggauccuggcaaacagauuaaauuggacuccagugcacaguuuggauauuauuuccguguaaccugcaaggaagagaaagugcuucgcaacaacaagaacuucagcacaguggacauccagaagaauggcgugaaguuuaccaacaggucagagagccugcuugucacacucguaagcuugugguucuucauggcuucuccgguaaaagcaaagucuuuaacaaggaaucacugacuuaaaaauauuaacuaagagucagguuuuacucucuuccaagaagcuaguagauacuuuagcacuguuagcccaggaggggucguccuaaaagucccuugggaggggcaguaccccccuccuguacuguucuagaaccuguggccugccuugcuauuacuacuccuuaguauucccaguacagaaaacauauagaugggauccacucuuguaugcuuacguuauuugaguguaccgguguuuugucuuuguguauguaugugugcucugagcauaccuguuaaaagccagaagagcaugucagaccugcuggggcuggaguuaauggacaauugugggacaccauaugggugacccugggucuucuucuagagcagcucuuagccacugagccgucucucuagcccuguauuaacuuauuaaguacaguguguugcaugcugacauuauucuagguguguuagacaccccaguuaugaaaaugguguaaugguuccuuauaauaauuuuuugaaagaaguacgacaggugcauuuauuucucccuucacagaucugauaaaucucaguuccugcuuacaugcuaguuaguaauacugcuauauacugaaaccuagcucuuuuuuccccucuuuuaaacaguuuaauuuuuuuucuuuuuuuauuggauauuuucucuauuuauauuucaaauguuaucccuuccuggucccccccucaaaaaaauaaaccuaucccauccucucuucccccugcuucuaugaggguguuccucuacccauccacccacucccaccucccugcccuugauuccccuacacuggggcaucuauugagccuucaugggaccaagaaaguucuagcuagagcaguuaggcaacaaaagaaagucaaaggaauggauacaaauuggaaaggaagaagucaaaauaucacuuuuugcagaugacaugaucguauacuuaagugacccccccaaaauuccaccagagaacuccuacagcuaauaaacaacuucagcaaaguggcuagauguaaaauuaacucaaacaaaucaguggccuuucuguacucaaaggauaaacaggcugagaaagaaaguaggggaaugacacccuucauaauagucacaaauaauauuacauaccuuggugugacucagccaagcaagugaaagauuuguaugacaagaacuucaagucucugaagaaagaaaucaaagaaggucucagaagauggaaagaucucccaugcucauggauuggcaggauuaauauaguaaaaauaaaaauggccaucuugcuggaagcaaucuacagauucacugcaauccccaucaaaauuccaacucaauucuucauagaguuagaaagagcaauuugcaaauucauuuggaauaauaaaaaucccaggauagcgaaaacuauucucaacaauaaaauaaccucuggcagaaucacuaucccugaccucaagcuguauuacagagcaauugagaacaaaacugcauggugcugguacagagacaggaagaucaauggaauagaauugaaaacccagaaaugaacccacacaccuauggucauuugaucuuuggcaaaggaacuaaaaccauccagugggaaaaaagcauuuuuaacaaaugcugcuggcucaacuggcagucagcauguagaaaaaugcaaauccacccauucuuaucuccuuguacaaaguucaaguccaaguggaucaaggaccuccacauaaaaccagauacacugaaacuuagagaggagaaaguggggaagaaccucgaacacaugaauuccugaacagaacaccaauagcuuaugcucuaagaucaagaauggacaaaucggaccucauaaaauugcaaagcaucuguaaggcagaacugucaauacuguaaggacacugucaauaggacaaaaagacaaccaacagauugggaaaagaucuuuaccaauccuauauccgauauacaaagaacucaagaaguuagacuccagagaaccaaauaacucuauuaaaaaaugaggauacagagcuaaacaguuuucaacugaggaauaccuaauggccgagaagcaccuaaagaaauguucaacauccuuagucaucagggaaaugcaaaucaacacaagccugagauuccaucucacaccagucagaauggcuaagaucaaaaacucaggugacagcagaugcuggagaggauguggagaaagaggaacacuccuccauugcuggugggauugcaagcugguacaaccacucuggauaucugucuggcuauuccucagaaaauuggacauaguacuaccugaggacccagcuauaccacuccugggcauauacccagaagaugcuccaacauguaauaaggacacauacuccucuauguucauagcagccuuauucauaauaguuaggagcuggaaacaacccagaugucccucaacagaggaauggauacagaaaaugugguacauuuacacaauggaguacuaugcagcuauuaaaaaugaugaauccaugaaauucuuaggcaaaagaauagaacuagaagguaucauccugagugagguaaccuaaucgcaaaagaacacacaugguaugcacucacuguuaaguggauauuaguguaaaagcuccaaauaaccaagauauaauucauagaccacaugaagcucaagaagacggaagaccaaagugugggugcuuuuccccuuagaaggagaacaaaauccucacaggagcaaauaugagauaauguagagcagagacugaaggaaaguccauucagagauugucccaccuggggauccaucccauauauaguuaccaacccagacacuauuguggaugucaagaaguacaugcugaaaggagcuugauaauggcugucuccugagaggcucugccagagucuuacaaauacagaggcagaugcucgcagccaaccauuggacugagcaugggguccccaauagaggaguuaagagaaaggacugaaggaguugaagggguuugcaacuccauaggaagaacaacaauaucaacuaacuagaccccccagagcucccagggacuaagccaaaggaguacacauggcuccagcugcauauguagcacaggaugggcuugucaggcaucaaugaaaccuagcucuuaauauaacucauauugauuuuuccaauuuauuauaucacucccauucaauaaaauaccucuuaggcuacauaaagacagaaccuaugggguauuuagguaaaagaaauuggaaugauuggccacauggugcuaaaagcgaagaauccauuaccuucaaguuguggagaagauggcaugcuugcuuauguaucugacuucgaucauaucauuuuuccucuuuuaaagauuuacuuauuuuauggaaaugaguguuguaucugcauguauaccuacaugccagaagagggcaucaggucacacuguagaugguuguuagcuaccaugugguugcuggggauugacuuggaagaacaggcagugcucugaacuucugagucguuucuucagacucauuuuucuucuuaaaaggcccaguguguauccauuauucagaauaaaaccuuagacuauggcccauaugaccaggcaccagcccaucucuucagcaggacucucaguuuaugacauguucacgucauuucuuuaaaucuuuucauuuguguauucccuaguaaucuuuuuguguugcuuuaggcccauggccaggagccagggccaucccuuuucuuugaugucagcacuuuuggcuaacucuccuuucaauccucuaaagcaccuuucauuuuaaccuguaauuuucauuguucagauacuucccucguaagacgaaucuggauauaaaugcaggcauuuugauacucuuaauaauguuuugauuugcagugaauuguccucuuuaaaugaagaauauacuaagaacaaaggcgaguaugaagaggcccaggaugccauuguuaaagaaauugucaauauuuccucagguaaacuuaauagagcauaaaaugguggacgauauccuagcuuuuucuaaugggaugugugaagauuguuuucuucuguuuuagcuuucuuacuacauuuauuuaucucucucuguguguguguguguguguguguguguguguguguguguguauuuguggaggccagagaacaacuugcaggaguugauucccuuuuucuacuucuguggauccugggauuuaacuaaaguacucaggcggcccgcauauuuaucugcccagccgucucacuggcucuuacggguuucuucuuaucuuuuuuucuuuuaagguagguaagguaggaucuuucuguuguguuguagccgauuccuguguuguugcugauuccuguguuguguuguagcugauuccuguguuguguuguagcugauuccuguguuguguuguugcugauuccuguguuguguuguugcugauuccuguguuguguuguugcugauuccuguguuguagcugauuccuguguuguguuguugcugauuccuguguuguugcugauuccuguguuguagcugauuccuguguuguagcugauuccuguguuguguuguagcugauuccuguguuguugcugauuccuguguuguugcugauuccuguguuguagcugauuccuguguuguguuguaguugauuccuguguuguugcugauuccuguguuguguuguugcugauuccuguguuguguuguugcugauuccuguguuguugcugauuccuguguuguguuguagcugauuccuguguuguugcugauuccuguguuguguuguagcugauuccuguguuguugcugauuucuguguuguagcugauuccuguguuguguuguagcugauuccuguguuguugcugauuccuguauuguugcugauuccuguguuguagcugauuccuguguuguugcugauuccuguguuguagcugauucuuguguuguguuguagcugauuccuguguuguagcugauuccuguguuguguuguagcugauuccuguguuguugcugauuccuguguuguugcugauuccuguguuguagcugauuccuguguuguguuguaguugauuccuguguuguugcugauuccuguguuguugcugauuccuguguuguguuguugcugauuccuguguuguguuguugcugauuccuguguuguugcugauuccuguguuguguuguagcugauuccuguguuguugcugauuccuguguuguguuguagcugauuccuguguuguugcugauuucuguguuguagcugauuccuguguuguguuguagcugauuccuguguuguugcugauuccuguauuguugcugauuccuguguuguagcugauuccuguguuguugcugauuccuguguuguagcugauucuuguguuguguuguagcugauuccuguguuguguuguaguugauuccuguguuguguuguuguugauuccuguguuguagcugauuccuguguuguugcugauuccuuagaugaaguguucucuugcuuuaucuucucacgugcugaguuugaaggugugauccacucuacaguguuuguuuuaaaucauuaucuggguucacacugaagaguauggaaauaaauaucacuguaaagcaagugcaaaucacacaagacaagcugcuguugguaauucugcaugcuauuuauaaauuuucagucuauucuuggcacagcacuggggguguuguguauuuuuuuuaaagauuuauuuauuuuauguauaugaguacacuguagcugucuucagacacaccagaagaggguguccauuauagauggcugugagccaccaugugguugcugggaauugaacucaggaccucuggaagagcagucagugcucuuaaccacugagccaucucuccagcccccaggagguguugugcuuuguauuuaaagggccgugugacuuggauguuacuugccuauagaaugggugaauauauguuuagugcaggguagguaaugguguguuaggcugaggguuuagauaugaacuuagaugggaccuacagugguaacuguaggacagauggcaugagcugaggugacucagaagagccaccaugccacuguggaguguucuugccccagaccuuaaccugcuuugaaacagaaacgcaucagauaaaauggaucgugggcauucuuuuucaugcuuggguucuuuacaaguauugcugaagaagcaugagaaggacaggcucugcucaggauuaagggagacucauagggcaaaacagccaagccaaaggcccagccacugacugacuccagggccagggguguggcucgggauggggugcugugacaccaccaucuugguguaggaagggcaggaagguggccuuccucuaagggcugugagccaaauuauuuaggcgugaugaaucuuugaaaaggcuguaugcauguuuacuucuguuaagucagaagaaacagaacguaaggugguguuagcaugugcuguccguacugaugcggguugaagggaugaugugugaagccugcaugguugcagguaacugaagcgcaguaauugaguugguuugucuucuugaaucuaauuugcauuuuaaagagcucuguuaauaaaauacuguuuauuucaaugaugacgacgaagcuuccucagaaaaacaaaacaaaaacuguuucucacugugcuaguugaggcucugguuuuuaaccuuugagucaagagcuuuauauuuggagucaacuugauuuuuaugcuaaguucuuuuaaaauuagauuuuccuucuuuucuccucugucccucuccaugggcucagauuuuggcccaggcuaaucucaaaguugaaaaaaauaugcuuuaaaaaaaugauagggcuuaugaaaugacuuaguggguaaaggugguugcuuuaggcugugugaccugggguuugaucuccaggcccgacaugguggaaggaaagacccggcuaccccuacaaguugagcucugauguccacauaugugcaucagaucaugugugugugugagaugcacgcacacacaauaaauaaacgccuacuuuuuuaauuauaaaaauuuuauuuuuucucauuucaguuuuguuugagacagucuuaaacauugcgagcuagcuuugaguuccuaacccuucugccuccauacacacgccggugucugcagaagccagaaaagggcacugguagcugugagcuacccacuguggccgcagguuacugaacucagggcuucugcagggacagccagcuuuuuuaaucacuaaaccaccccuccagccccggugugguugaaaucuuaacaagguuaaaaguuauaaggaguggggguauagcacagcuguaaagugugugucuaacgcacgcgucauggcggcaaauaccuuugaucucagcacuguggaggcagagacagguggauuucugauagguuagaaaacaacacaaaacauagggguuuuuuuuguuuguuuguuuuguuuuguuuuaaugguuuuucgagacaggguuucucuguauagcucuggcuguccuggaacucacuuuguagaccaggcuggccuugaacucagaaauccgccugccucugccucccgagugcugggauuaaaggcaugagccaccacgcccggcuacaaaacauaguuuuauaauaggaugagaugauuauuuuuauguggguauuuaaaaguuaauuauuaucagcaaaacauuacuuuuaugugaaacaagagaaugaacaauaaguagugugggcauggugcacacacccuuaaucucaucacucaggaggcagcagcagcagcaacccucagugaguucacagccagccaaccuggccugcauagugagacccuauguaaaaagacaaaaaauuguaaagucaaaauuccagccauugaaacacaaaguaauuguaaaguaauuguaaaguuuaacucuggggcaucuagaaauuagaaggcacucaggcaguacugcaccccauuagcauggagacucugcugagacucugacccuuguugcugucgcauguuauguuuuauccagccuuagaaucagggagguuugugugguagcuuuggcucuaaugcugugucacaguggagucuugaauguguguuaaaugggcaccagggaucaacucaauccugcaagcaagcgugcugauccaacaaaaugaaacugcaaauauucuuggaaucuguucuugcucauugcuuauggugauuuuuuuaaagugguuuuauaguuuucccagacacgguuucucuguauaccccugacuccuuuggcuguccuggaacucacucuguagagcaggcuggccuugaacucggagaucugccugccucugccuccugaaugcugagaugaaaugugugcgugcaccaccacagcucucuugugaucugaacaggguugucaugauuucucaaauuucccaacuuuuaggggaaaguacguugugcuaguuaauugggauuucauaaggaaagaccuugcucucuguuuuugaagcaugaaggauacagugaaacauuuaaccccauguugagguucaaggcuuuucagauuuuguuauagcaaacuugcuaacuuuuuaaacggccuugagcuaagucuauuauaagguguaucuuauguuuuuacaggcuacguagagccaaugcagacgcucaacgaugugcuggcucacuuagacgccauuguuagcuucgcucaugugucaaacgcagcacccguuccuuauguacgaccagucaucuuggagaaaggaaaagggagaauuauauugaaagccuccaggcaugcuuguguugaaguucaagaugaaguugcauuuauuccaaaugacgugcacuuugaaaaagauaaacagauguuccacaucauuacugguaaaaaacaauuuuuuuucucucuuccuaaugaugauagaauggaaauguguuuucaauuaaugaagaaagucucucuuucuggcauuaaagaauguauuacucugguuggucauacauucagauccugacuagaaggaagacuuuuugggguggcuaaaguuuaggagauaauauuguuucaguauauaacucacgcccuggcucaccagagccaggacuuggaaaauggguaggaauggucuucuggaaaagcugcagccuaggccagcacgccucguaagacacucauguguucauacucauuugaaaggaggcugagcuguccugagauaguaacuagaaccagagacuagaaaauaagagagaauuacauuguagaaauuaugguuccauccuguuaguucccuaaguggguauuuaaauuauuuaacccaacccagauaaguaaauuguacauuuuccaaaagaaaugucguguagcauggaguuuacgugauuugaggaguuugcccagacugguuacauauaacuagcccacuuauuaaugaauacuauuacugaguagucagucgggcguaaucgacaucauuaaaugagucugugagccaggaagugugugugcguaguggcccacagugaugcuccagcuuagcugugcgguuuaugauccuacucucugguuagagggaucuguguggguuugucugacugaaugguaagaaaguugcauuuggggcugcguggacagugacuguccaugcauguuuuuugauggcuuguggguggguuugcauaucauugugacuuaaauaauugucaauugcaguuuuggacuacuaguagcuuaauuguuaguagugaaagaaaucaguggccuggcauauaauucacuuauaggucccaauaugggagguaaaucaacauacauucgucagaccggggugauuguacucauggcccaaaucggguguuuugugcccugugagucggcagaaguguccauuguggauugcauccuugcucgagucggggcuggugacagucaacugaaaggcgucuccacauucauggcugaaaugcuggagacugcuuccauccucagguauguguccuagucccuugaaaguggagacguguggccccguuuuauuugaaaugcauuugcagauuugucuauaauaugccacagguauucuuaguuuagugaguguuugccugugaauuguauguacuuuauauuaucuuaaaaggcugauuggaagcugugugugauggcugcucgccuuaaucucagcacuugggaggcacaggcagguggauguuugugaguuugaggccagucaagucuguguaaugagcucaaggauagcuggaccgcaaagacagacccuaucucaaaaagccagagagagaaauaugaaagguuaccaaaaucacuaaugugaguuuuauguauucuguugccuuguguuuaacaaauacuguacuacagguauccacuaccucugccucuuucgucuuucuguccccucugccaugaugagcccuggacugcauuuuuuaucauguaauuaugcguuucaggucagcaaccaaagacuccuuaauaaucauugaugagcugggaagaggaaccucuaccuaugauggauuuggguuagcaugggcuauaucagauuacauugcaacgaagauuggugccuuuugcauguuugccacccauuuucaugaacuuacugcuuuggccaaccaaauaccaacuguuaauaaucuacaugucacagcgcucacuacugaggagacccuaacuaugcuuuaccaagugaaaaaaggugggcuucuccgcucagcguggcccucagggccugaagugccauuagugcauucuuuauucuccguugggauuaauugcuuuuaagaacauauuuaccucuggcuuucuagucuacagaugagcaauauacauuaucuguaucaaaaugauaacgugggagacagguugguuuauuauagcuaucugacuauagguugguuuuguuuuuaacguaaaggaggauugcaauuucuuaaaggaucuaucuuauuuuuaauuaguguauuaugccuugugugaagguuggugcacaugacacagagucuagaagacgguauuggcuuuucucaagcuggagcuagagaggguugugaccuccccgacccaagugcuaagaacugagccuguguccuggaagggcucuaugauuuuaaccugagccagccauguuucuggcuuuuuguggucuuuagaccuggugaguccagauucucuggcacuguuagcgguggcgcugguguuggcgaucccuggguguggcguccuuccagaaaggcuacugguuagcgcccacucaucacugagucagugaugcugaccuccaugaggagguucuauauuguaggugauuauuucagaauaagggguucacaugucugucuucauuucuuaggaaaaugugugugguuguuuuuuuguuuguuugcuuuauuuuuuguuuucuuuuuuuuuaauauaauuauuguccgcaucgucuugaugcuuuccucuuuguuauuuuugccucggugggaauuaguuugcguuccuauguuugcauuauugauacuuguuagagaaggcaauauuuguaguagaucuggcauucagcacagcaugaaaccgguccugcuuuuaagauacuuguguguugugugcuacagaagugguuuccgaauacuuaggggauagaugaguauagcguggauagagauagaguaagcccagcccccauuguggucgugcuagcauguacuggacugugguuuacuuuuguuugcuccgaauugagcacuguccagcuucagguaacugaggcgggcgcagcagcuccucguagccucacuucugcuuacacgcggcugcauccuuagccguguguuacucgaguacuuucuccacugcuggugugcgguaaggcagaaugagcgagggugcagucacaugguugacgauugguuaaaaggucuaucugaggugcucugaaccgauuggcuaagguauuugaaauguaaaauuacacuuucuaaugaggugauaaacaggguauuccuuccauucacauaagugcuguuucuuuccucuuccacgccacccguuucuguaggugucugugaucagaguuucgggauucacguggcugagcucgcuaacuucccgaggcacgugauagcgugcgccaagcagaaggcucuagagcuugaagaauuucagaacauuggaaccucgcugggaugugacgaagccgagccggcugcaaagagacgcugccuggaaagagaggucggucagcagggcauucgucaggggugugaauuacugaaucugugugccacgcaaccaagaugaguugcgcguucccugugggauucuaguauuuacuuuuuggucauucuuacuggcucauauuucuuagcauaaccgaaaacccaucccuggauuauuguuguuugagguaaggucucaccuuauagcucuagcuggucuacaaccgcaggucuaauccucacccucacccuccuaaccuaagcugaucugcaacucuaaucugccugccuuugccuccaaggaugcugggauuaaauaugagaaccaccaaaaccugguucucucucucucucucucucucucucucucucccucucccucucccucucccucucccucucccucugucucucucucucccccucugucucugucucucccucugucucugucucucucucucccucuccccccccccccccccauccuuucuacgaaggaggguuagagcuggagcauaguccuggcacgcaggaaucugcggaucuggcucugucacaggcucacugcccuccugagagcuguggauuuggcagaaggaguaacgaaugaauaauguaaauaaguguucaucuagauuuaaucccuaaagcuauagaugucaauugauaaguguaacagcggcagcaaacaggacuccugcuccaugcuggucuuagacuuucugaggagagcggacugugggcagugguuauuagcagaacuagaucuuccucuguagcuauggggucaggguuagauggucacacagugcuguaguauaugucuaacuuguuccuuuuucacagccacaggccugcucaguaauaaaagaacuucacugcugccugguucuggcagcuucgcggugccauacauugugacagaccuuacugcacugcacauugugacaggccuuacaguggcauacaugugacagaccuuacaguggcauacguggugacagauaauggcguauuuguagcuuuuacccagugggcuuuuuuuccuguaaggauagacgguugcuauacaaaaaggaaagcuauauccuaccuugcccauaguuuuagauauggaaagcugccauccugagcacggagugucucuacauccagacucacuuaauauccagccagacccacagagcugacgauugggauuggcggggcuauguuacaugauuccugguuuccaagaaaacugaaauuguguacuuuuauuauaauaagacguauuuugaaaagucagcuaaaggagacagcacguccuugcugccauuaguccgggcucuugucccuuugguuuuagaaaguacauuuuuaucucggcagugccggagcuuggcuuugccugagcgagggcuugggaggagagagagggguuuuguguuucauugguuuguguguuuguuugccugccucacagcacaugugggagucagaggucaguguucagggaucaguucuguugccugccuacccuguaggucucagagauccacuucagguggccaggcuugccuuuacaugccuugcagucuugccagcuccuuccgugugguuuuaaauggagagcuauuguucuuacgguacuugccaguugccccugugaugcugaugccagguauaaaaaugggccauuuaguuuuugaugugcuguaauaaauuacacaguacuaacucuugcuucagacgugcucuaaauucuuugaaucuucacaacaaauguaugaaguugguaauauuaauauccccauuuugcuugugcaagucagggaguuucaguguuuaugccuuggaaaccuuaaguucuuuuuugcugagauuaaauuccaugucagaugaagcagaggggcuuaagagcugcucaguuccuugucagcugaaauuacaguguaaaugucuuauuaauagcuugcucuggauaaguucauagcaaccaaggacuuugggauucucagaauugcuugcccauuuaugauaaaaauguguguuaaacaucuaauagcauaucuagaggaaaauuacagaaagaguccauugcuuacgcuggagaugacccauugcugcuuucccagaggccccgggcugggcucccagccucccacacuggguggaucuugaccaucuguaaacccagcuccaggagauccgacccugucuccuggcauauaaggguguccacggacauaugucauacccacaugaguacguuguaaugacuuugggacacguguguuuuucagcaaggugagaaaauuauucuggaguuccugucgaaggucaagcaggugcccuuuacugccaugucggaggagagcaucuccgcgaagcugaagcaacugaaagccgagguggucgcaaagaacaacagcuucguaaacgagaucauuucacggauaaaggcuccggcuccgugaggggacagugggugggcgugcacgggggagcucaccuuuacugugugcuguucuggguagugcuccccacuggaaccuggccuagcagcauccggaaguguuuagugaugcuugaaaacauuaccgucuguagcugggugcuguuuaaauggggacgggcaacugugagcacuaugcugaauuuuauaaauaaaaucauguaguuugua

SEQ ID NO: 12568 - RNA, 75226 nt, Mus musculus
uccuggagucuuccuccucgcgggcugucucuguggcgucugggcuccgagcugucaugggggaggcggagaaguuccacuacaucuacagcugugaccuggacaucaacgugcagcugaagaugugagagcugagcgggagggcgggcggcgagggccggggauugccccgagaggggcugcuccuugaagggaaucggcagaacaacccacggcgaagcccccgagggcuacggagcccuuugcguguuccgcuuuugugggaauaccgcgaucugauuuuacccaggaaagccuuagggaaaaaaauucccccgcccaugagagaggaagaaaaugaaggucuucccuuuauugcagggauggaaggugguuuggggaguucggaaaucgugaaagugggauaacugaguacaugggugcagcuuuaauuacacacgaagcgaacuuuuggacaguuuaacauuuuuaaaagcagagauguugagaggacauaggagaccgugucaguuauagaggagucaagaagaugggaggaaagaggcuuuucguaaaaccucggggcagcacguuuacaauaaagauccagagcauggcguuuugaaaugagaacccucgugggaaagaagcguuccuaaaguugcuaacuucagacuaguagaaacguuuguaguagggacgcucacccuccagacaagaguaguuuuguuguguaguuuacauauugucagaacugaccugugccauuucucagggauagggagagagacuugagggucgugccuugggagccuucuugcuggugaggacaggacaucagacuccuaccuggagagaacacacuguaugguuuucuuuacuucauuugcuccuaucuccuacaugccauuaauuaggcuuaauuccggcaucuguguaagagauggcucuagaacuaaagguguauaguagcguaaagacuggguaauaaguugucaaugugaagucagauuuauuuauuuauuuauuuauuuauuuacagaacucucuggaacucucuuuggagacuaggcugaacucgaacucagagaucggccuacuucugccccacuaagugcuaguaaaucaguaaagcuaaucuuaaggccuggaucaagugggugacagaguuuaacaugaagaagcccaaagaagagaaauuuuuaaugaggacaaaacgaguuuagccauguuaggauuuucagaaugucuuaucacauacaaaagugacguuacuuguaaaaauaggaaggcguuaucggguaguuuaugguuacguaaacagagacucagcuuauuagcucuuuauguguguaucugugugugugaaaguaaacauugugucuguguuuucagagggagcuuggaagggaagagagaacaaaagagcuauaaagcuguccuagaagaucccauguuaaaguuuucugggcuauaccaagagacaugcuccgaccucuaugugacuugucaaguguuugcugaagggaagccccuggccuuaccagucagaacauccuacaaggcguuuaguacaagauggaaguaaguuguuuugaggggcagaggguuuguuguuacugguuuucuugguuuuguuuuuguuuuuugcugucauuguuuuguuuugaccauaugcgauuuucuagagugucuuuccauugccuuacuaauguuauaaguagagacaguuuuucagggauuacuguaaacauuaggcagacuguugaaaauacauauuucacaugugaacaaaguuguauugauguaguagugacuuuaugucuauauuuaguauguugacauuuugcaaaguaaauauuuuacucauuuauaacgugaaccagaaaagaaccauggcuggacucugucugucugucugucugacugacugucauaauuugaaauggccaaccugcuauuuggaucuuuagaaguagaucuuauauauguguauguguguaucuuuuuuuccaaauggaacuuuauguucauaguuuauccaugaacuugcaugacauaauagcaaggcauuguugagguauagagucacuguaagauaacaugaaauucuguauuauggauccuugaucuaaaguccugauacuucuuaucugauagacuuuauggggcauuucuaauguucagucaguguaguucuuaacagguuucgugcaagcagcuguuaguauugaaaggugcaucuauugccuaacucauaaaauaaaauauuggauaaacacuuuacacuuaaaccuuucacacuuccauuguccuguauaagucauuaccuaucagaaguagucuauguuaauuuuuugcauuuccuugguuuagauaauauauuuagaggaacuaugagguacuaguaucuaaauguccaguugugaccugugugaguucugguaauaagaaauucaccccaaacguauccaagucuaucuuaaccuguacucuucugucauguccuacaguuaagaucucuguggcucagugaagaaaggcacugucgaucaaaccugacaguccgaguucuaucccuggaaggagagaauggucuccugaaaguuguucucugaucuuagucacagcuaauguagauuugcacagagaauguaaggucuuguuuuuaauuuucuguaauucagauuaagagaguuguuguuguuccuguccuuuaggcauggucuuuuuguuuuguuuuguuuuguuuuguuuuguuuuuuccuucuuuucccacacaaugcuggagauugaacucacaaccuugugcaugcuagguaggcacucuuccaaugaacguaacugccacuuaaacuuuuuaagcuguugagauuauauuuucuucucuaaaacauuuggaaagagagacaggguggagggggauauuaauuuaauaauuuucauuucaaaguguauucauuugcccagagaaucaagucuacugggcucguggugggauuccuguguccagauucagguuugguaaucuucagaggggaucaucacggauugggcaagcaccaaugaauggggaggaagauggcaaaacaguguugagaacacacagccuuugguguuugaauugaucccuucauugauuuuggaaugucuagaguaguuuuuucauguguuagcugaaagaccacuucccgguagagaacaguguguaaagcagguugaacuguaguugcuuugcuguaaggcgaucuugggcccaggaguuagauagagagcagaagacuugaggagaaggaucccgugaucaggguacugucucucagaguguaaggguagacaacaagaugaaaacuuccauagauuaauuuggauauugacacuaguuuuucucuuuaacuuuaccacauguuaauugucuccaugucugucaacuccugugguuucuucauccacaaauaauaacacuguuugguauuuaccagucuguuuugucaugugaguaguaauuuacuuaguugcguauacucaucuguaccaucucauaaacgugcaauuugguuucuuaaagaacuuuauagaaaaaaagguuugauaauguuuugcuucuaaucaaaauugauggcaucucucuuuuccuggaguucagaauuugcaguggucauaaauaacguuuuuguugucuuugaaaauucucuuguuucuuacuggugacacuuagcuguuagcacugagcgcucccuaagaaugugcgcaaauaacuuguuaauguguauuuguuaauaacacaggauacagaaagaaccagcaauuucuuacgcucuacucauucuuaugugucagugucagugucagugaaauaagucgaagugaucaaaauauauuaugaaaaaauuuaauaaaagugaacuugaugagauagaacagaugugcaagucgguacuguucaaguguuacaaaaacaagcaacauugaaggguuuccacauuuuuuagcauauaaaccuaaucuuuuuagagccuucucaucugucugaaccaccuuuuauggguuaauuugaaagaaagauauguauguauucuguugacuuuguucccauaguuggaacgaguggcugaaacuuccggugaaguacccugaccugcccaggaaugcccaaguggccuugacuauaugggauguguauggaccgggaagcgcugugccagugggaggaacaaccgugucgcucuuuggaaaauauggguaagcauucugcccacuacugcacagagcgcugccucuuuucuuuccuagagaacuuugauuauuuauguaaugugguuuuauccugugaaaaccaguuagguccaugggccuuacacauucgugagauuggauuugaaauggauuuccuaauauucugcauuagcuacuuuuuuuccauugcuaaauuagugacaaauugcugaccaguggcaccugaugggaucacauguuuaagggcucauucugucguggcuugggagggcacgguggcagagugaggcagcuggucccauggcagcugcagucagaagcagagguuggcagcuugcuuucccucugcccaugucuuugucgaggaugcuagcuucgagagcaucacugccuacguuagggugggucgcuggaguuaacccagucuuagaaacugccucaguacauguuccaaauuuugucucuuaggagguucuacauccuacaaauuugacaaucagaauuaaccaccauagcagcuaaaugaaaacacugucuacugcuaagugaaugcuagugucguuucuauuagaaagauggcguucugaggaaugagaaccugggugcagaucuggaaacugaaagcuguagugccuuuugguggaccaugauaguggcuuucacgagcuggcugcuaccagaugccuuaguuuuuguccuuuuaacguuuaaacaugguaauuugcacaucauuaaauguaaaugagaguuaucauuuuaauagguuuauucacuauuuucuguaaauugcuucagugggaucuuuugcccauuuucuuuuucacacaacaacccuuuuugauguugcuaagacaggaucugacuguguagcccuagagcuggccuaaaacucacuguauaaauccaucugggcuugaugucauaaugaucuaccugccucugccuccugaauuccaggauuaaaggcauguaccaccaugcccagcuaaaagugccuucuuucuaauuguucacuucuuagugaugucugaggaguguuuguacauggaggaaauuggcuauauguguacuguguuaaacaguuaccuugaaaauacuauguuucuuuuuuguguguuggggggguugguucuuuuauacauauauauauaugcaugcauguauguagacacacacacacauauauauaugcacuagauuagauuuauggaagcauguuuuucauuacacuuuuauuccuuuauacuuaaaucuauaaacuuuuguggacagagugauucauuauguaucaacuuuaacaacaaaagcuugucuuuuauacaugugucucaguuccuuuacauacgcugucuucucugauaauuuaaaagaauucugucauuauauccugaaccuaagaaaaacaacauagaaguaagguaguggagcgugagggaaggagggucgggguaguuaccuggaucugaugcuugcuugccuuucucagugucuggucuccuagggugaguuagugaauagucuguuucuucuguaaaaugaaaucauauccacuucauaguuuauggugauuauuuaaguacauuuaauaagccucgugaauauuuuauuuacaaauaguuccugugauagcucauuguagauggugccagcccagggcaggugagccugagcuguaucauaaaguaggcugagcaagccagaaggagcaggcuagccagcagccaucccccauggcuucugcugggugcaguggcuuaauuuguaugggaugagucuggagguuguggguagguuaguuggguccugauagauggcuagagaguauaagggcacuggauauuugacccgggauagauguagggcuuaggggagaguccauggaggggaggaucaggcagacuauguuuguaauucuuuguguagcucacugaguaaaauuuucuuugcuucccauccaaaggaagugaaaagugugcccgaaagacaaauuaaauaacauagauugccaaggaauugguaguacuaauuuggaguuaaaucuguuugcuugaaaugaacuaagauguuuaaaucuuggaaaaaucugugcaugcuauugauccauguccugugccaccacaguucugugauuggggaaacacugcuggggccauaguuuucucagauguuucuuuagcaauacaaugucaucagcggccucuuccaaggauccugguaugcacguacuagaguagcguauaaaagugucccucaaagcuucuaauaccgcaagaugcuacagugacugccaaguugugcucuuucccaacaucuguguuguauaugugagucauuaugagggagaacuucuuagagaguucuaaugaauaauucagagacugguuuuguacaguagcucugccacagcaaacucucuuuaaugugaacaucuagcuucggagauuucuaaggcgcuuaagagcugauuggucauuacuugaauugguagaaccacaggcaagaugaggugcaggugugugcgaauucuaacgucauggcagugucugccacaguggccugguccuuccagccagagccacaguggcagcugguauugggccucugauggagcugaaggagggccugccgcacuguucuucugugucaucuguuuggcuuaauuucccaaguggacgcauugccugacucuccaccuggggccuguguaauuuucggcaaguugccauuaguguccagagaaaggauuugaucacuugaucaucacccacucagcaucguccuccccuccaccccgcucuaaacuucucuagauguaucccaagucgcauaaaucauuuaguaagcugacuuccugccaucucuggcuguuuguuuuuaguucacuucagccagaguauucacugaggaguggagaggugggcagaaggaagggacaccaugugcugugcugaagggguggguggggacacgcacuuuuaggagucauguuaguuaccucacuguugccaguuccuuugagacugcuguaagguugcucuguguuuuguuuguuuuguuuuauuugagacaaggucucauuugauugccugugcuagucuagaaucugugauccuccugccuccaugcugucugaucuguuggauuuuaaaagaaagaaaaccuuacaagaggcugucuuugcaugcuuuuguaguagccauuaauuaaaauauaauguuuguaauaaugagaaaacugaucuauaccaaggagucacauuauuuauucauggucacagccgcaccugcuguaggugcuacaacugcugcccagacccagacaagcuuacagaaaaguuagguaacuaagagcuuugcuguccauccgguaguuguggguuccuauuggcuagaagugcagugucugcuauucuaagaugucugcugaagugguguugagugcuguccuccaaacugcagacaccguuuucaucugaacagcggugaauacucacagggcucccuaugauuggccuuguugacuggguucucuucugaggaggguguaggagcaucccuggacccuuuuguacuuuccagcuauuugggugcaucucugccuugauuguauguggccucaucucaucaggaggugcuggcuuauguagacuggcaaguuaagagucaucgguucuaggaugagacuugcccaugucuagcugccuugcagucacccaaguuucuguaauaacugcucacguaugcucugaaauuuaccuugcucugccacuagagccguaugagaaaguagugaauaauugcuuaagucugcccagcaacgaguucccucaacagugauaacauguacauuagguuguauuuuauuucuuuuuuucuuuuuuuuuaacacuuuauuuuuuuauuagauauuuucuucauuuacauuucaaaugcuauccugaaaguucccuaaacccucccccugucccccuccccaacccacccacuccuguuuccuaucccuggcauuccccuguacuggggcauacucuucacaagaccaagggccucucauuccauuaauggccgacuaggccauccucugcuccauaugcaacuagagacacaguucugggggguacugguuaguucauauuguuguuccuuccauaggguugcagaccccuuuagcuccuuggguacuuucucuaguuccuucauugggguccuguguuccaucuaauagaugacugugagcauucacuucuauauuugccaggcgcuggcauagccucacaagagauagcuauaucaggcuccugucagcaaucuugcuggcauaugcaauagugucuggguuuagugguuauuuauggaauggauccccgaguggagcagucuuuggaugguccuuccuucugucucagcuccuccgaacuuagucucuguaacuccuuccauggguauuuuguuccccauucuaaggaaugaaguauccgcacuuugggcuuccuucuucuugaguuucauguguuuugcaaauuguaucuuggguauucuaaguuucugggcuaauauccacuuaccagugaaugcauaucaugugaguucuuuugugauuggguuaccucacucaggauguauuuuauuucuauagauugcucuauagggaauaacucuauuagggaaugaguucccuaagggagaaaagagugaccuggagagguuugugguuuuagccgccgcuuagcucucuguugcacaaaccaugguggucucuggacuuaauaagcaugcaugacacauauuccuuuaugaugaacuucauaaguuaguucacuucuacucugaacuuuuuuuuucucguagcauguuucgccaaggaaugcaugacuugaaggucuggccuaacguggaggcagaugguucugaaccuacaagaacucccggcagaacaagcagcacacugucagaagaucagaugagccgccucgccaagguacacaggcuucaacgacaaguagagcucugagcagagcagauccuaggguacuugauguugugaguccuacugcuugucuugucgauuuaaauccaccuuuaguagcaguuuugagauauuauucacaucuucacuccugaacgguauaugaacgguauaugguccauagccuuuauagccauccuugcggacguuuucaucucugaaagcuccauguacucaguagucaguccucagucuucccucccugggcuuccugacagcugcugggccgcugucuaucugugcacuucuauucuuuuuuuuuuuuuuuuuuugguuuuuggagacaggguuucucuguguaguccuggcuauccuggaacucacucuguagaccaggcuggccucgaacucagaaauccgcuugccucugccucccaagugcugggauuaaaggcgugcaccaccaccgcccguaucugugcacuucugcaugcauggaaucacgcucaauauggccuugugucuggacuugcaucugauuuggaaaugugggucucugguauuuucauaucauaucuguuuccuauauugcucuuuuaauugaaaaagauagccuagguccugcgugaauguauuguuugguauacucuuuugagcuuacuuucuccaaaugaauaaaacuuaagaugugcuuuggcugcucguuucuaggucuugcuuguguucuuacuggauauauaagacaguucacaaguuucccuuauguuugccccucuuugucuuuuuuuuuuuuuuuuugauuagauauuuucuuuucaaauguuauccccuuuccugguuucccuauccccuucccucccccugcucaccaacccacccacucccgcuuccuuguccuggcauuccccuauacuggggcauccagccuucucaggaccaagggccucucccucccauugauguccaacaaggccauccucugcuacauaugacucuuuaagagucuauuaacagugaacuucgauuuagcuacaucuaugauuaaacaauuaguagauuuuuuauuagagucaucucaucuauagucuguggucuacuaaaauuugaaagauucaguuuuuaagagucagaagaauauaguuucacucuggcugccuaaggauaaugggaaugugaugugaagaccaaccacuuaaauagcccaugcaaaaauggcguuggguaauuauuaaacaggagguauugccuccauguugaaauuaauguguuugcugugauucguuacuuaguuauggaagauaaauucuaacuauggaaugaauaaguaacacccaaaagccugcuuucccaguuuaccgcuuaaaacaguucuuugcgagugguuguaaaggaauacgucucucuacggauuuagacuguuuuauaaaccugccuagcuuuccuuugaggaacaauggcugggagaagaggagguaacacuguauuugcucagcuuaggucuccucucuguuuguuauuguuguuugcuuuuguuuuuuagaugcauaugaguauauuauagcuuucuucagacacaccaaaagaggccauuacaacccacuacacaugguugugagccaccaugugguugcugggaauugaacucgggacuucaggaagcacagucaaugcuuuuaaccacugagccaucucuccaggcccaugggucucguuuuuuuuuuguuuguuugguuuuuuuuuuuuuuuuuuuuuuuuuuuuuauaauuuggauuuccuagaguuuugauaagguacagaaggaaauguauguauuaaaaucuucucauuccugcaucuugcuuauuguccuuuucuucuccaucucuaaacauuuucaacuagugcuuacuucuguuucaacugauaugugaucauagugagagaccagacuuaaagacggucuguaaacuuugaccgucugggccagccucuugguaaugguggccagugucuacacuguuuccuucaccucuguuuuccggcuugccauagugugagaauuugaugguagguggcacaccguccuggggcuuuggaugugaccccugugcucuggcgucugauguauauugaaucugugucuugggacuugaaagguuagugcagagcaugcucccccccccccccccccgccuccuccucauuucccagcccggcuggaugccgcugcagugugcuuuccuuucugucaggucgauuaagaggaggccaagggaagggaacaaguagauggagcguguuuccugguccguguggagauauuggaacguguggggagcugagcacugaagccgccaggaggggaagucauggaacuuacagugcuacaucggggucuggucccugugggcuggggucuggaucucagguuuagggcuacaggaagcagaggacagaaagugaacgugguacacagaagaaacaggauggacuaaauaacuguccugacguaugcugccugcauguggcuuguagacucuaggaaggcuacucaugucuaccugcugucuguacucacauguaguacuacacugugcaugcucuucauaucauaauaugggaauuuauaaaagaacugaccggaaggcacaaugccuucagucacgcuccucaguuauaauccagauuguuaaguacaacacaaugggacauaacaguugacagagggacaacugucucaguuauaaccuagaucauuaccugacuacacaguggacauaacacuugaaagaaugagaacugucuacacaaauggggaccuaaugaaguguagacauugcuuacaaagaaugccuuuucacauuuuugaggaacauguggacacagaaaaguacccauagcaaguacuguuaggaaguuagucccaguagagacuugacuauauacaguaauaaauacacugcagauaaucacauugcccuggaguaguaacacuguaggauuggaccuuaaucacgugagcaagcacaacugccgucuucuuaaacggcuuaucuuacagaggaaaauuauuacugauuaaucagagcucacagagaaauccauuccuguacaaaugggaacauacacuccuggcccuagcauuuagguuguggaaagaggcucaugucguucuguuuaccuguuagauguuuuuuaaaugacaauaauaaaaaauaaaauuaugguaauuguugugguuugcgugagaucaccauggucucauauauuugaauacuugguccucagucggugggacuguuugaggaggaguaggaggucuggccuuguuugagaggaugugucauuugggacaaguuuagagauuucaaaagcccacaucauuucuaguuaccucucucugacucguacuugcagaucagaauguaagcucucaaauguuuagugcaauguucuugcucugccaucuuacucucugaaacuguaagcccagauuaaaagcuuuccuguauaaguugccuuggucauuguauuuuagcauagcauagaaaaguaacuaaggcaauugcuguaauucuucaaggcuuucagaauuuauacacauccaccauucccaccaugauaugcagcuuucacugaagccauccugguugcuccagaucugaccaugugucucucaagaccaugggaaauaaugaagugaauggcgucagccucugauagggcauacuuuaucugauagggaaauuggguaaaugccuggaagcuguuugcagugguaacuauugaauucugcagaacuucuguaacuaagcugagaaauaucuagaauuucuucaaauaucaagauguaaucucggcagcuauuaaguagucaucauaacauaugcagauagcucuugauuuuccauucacguuggaacucaucauuacaucucucuggugacacaugcagccaugcccacuguuucuguuugcagcguuuggaguguauguguuccaguacuuacugaauggcucccacaguugaggucugaaagguaauuuacacucagcuuuugugguggcuuuaccacauuuaguaucgcuucaguaauagcuguugaaaagauugagaaaggucauauuugguaugcagcuaagagagaggaaaaaaggccuagcauguguagggagugacauguauuagccacgacagaaauucagcugguacagaggcugcagaaaguucccagcgcguaauggagaagaaggaaaccucacgucagcauccacgucaagauacaacucaccauuaccaguucuuuccucauagcaagucauugcacggaccaacuguugggcauaaacacagaacuaauguuugguaaacaauagaaauuagaggggcccaaagagcacagugacagugugaugacacagagugagugacaggcagguggagagggguggagccucccucauaucacuccacaccagcuuuuacaggagaaaauacuaaaagacacauuuaucagucuuagcaacuagauagaaugauagcaccuuucauguuuugcaucuacuugcauauuagggcacaaagagaagauaauauuuuuuaccagcaugggcucaaaagugacaagaguucaaaaagcauuugucagugugagaaccagcucucuagcuugcaaugugacacucuccuguaagucacacugcuuggucuuuggucugucucucucucucugucucucucucucugucucucucucucucugucucucucucucucucucucucucucucucucucucucucucucacauacacacacacacacacacacacacacacacucacacacaccuagaaucaucaugugacgagaugcucagcguuuauccagaucuguaggauaaugaucuccacccacuuccauccuuuucuugauggugagauuuuacucuuuacagcugaaaaagaauuccugugugauauaugcauaucuuauuuucuuuauguguucauccuugauagauguuagaccagaucuguuucuuagcuguuaugacuggcacagcuauaagcaugaauagcaguuacuaauaucgcuaucuauuuucacguuagugauuaccaugagggaaaacagugcuguuugcuaugcaaaagcaaguugguuauuucuucaauaguacuuuuguauuacaguugaucucaaacucuuuuuagaagguuuuguuauauauggaugaguguuuugccugcauacauagaaauaaaccacauguagcccugcuguucacagaaagcagaggagggcauugaguuccuuggaccuggaguaauggaugagaguuacucuguggguuuugggaacggaaccaugauccucugcaguuacugcggauguuccuaaccacugagcuaucuuucuagccccagaaccucaaauguuuugcauaagguuaacacuuuugauuucugaaauacggaggacucacggguaugauguugccaaggauagaagauuuugauguccaguugugcuccauuuuaugaauuuauuaaaaaaggguuuugaucaguaagucacgcugauguuuaaaauauacacugucaggaacaaagcgaauucuaaccugaggcccuugcagcuuacugugauuucucugugaauuggaaaauccaguaugauauaauuucugaaacuaggccaagauuaguguguaagaccccagugggcucaaacaucagcaauuuuagaaauuuaaaucguuuaucauugucuccuaaaauaaggcacacaugcaugugcguguacauaagccuuaaaggggagauuuauugguccccaggaauuaccuuugccuaaguaauuuuuucagaauguuacauuaaaagugggaagaaaagaugauguauuauucccgaaaggaucuacucacuauaauuucacuaaugauagucaaaacauaagaacuguaaaacaugcaaauaacaugcggggaggacuucacucugcgcuuggcaagacuacaggcuugauuuuaaaacuuuuuuuucuuuuuuaaugauuuucauuuuuaagacaagguuugucucuugcuucguuucuuauucugauauaguaugcgguuuugguauguaauagugcuuucuaugugggaaucugaaauguaggaaucuuucauauguugagucuaauguccuaaguaugaagauuuauauguagacuucaauguguaggauucuucauguguguaaucuaguguguaggaacacuuaauaugaagaauuggauauguagaaggacuuaugcagaguugguauauagacucagcaucuuuuagcuuagaucuuuaaaacccaaaaguguucugaaucuuggcucauuuuagaauuugaaguauuuguauauacuugauuagauaucuugagaguaggcuccaaauaaaagcauaaaauucacuuguuuuaauguauauuauauugucguaagcagugucagaauuauucuuaaugccccguguacugcgacccauccucugaggccgauggggccgucucccuuuguggccugaaaugcuugggauugcguaguguuacagacgcuugacuuucacgucagggaggagcgauggggauggccaucuuccuuccuccuugguuggaucugugcugagauuaacccuguugcacuuuccuacagcucaccaaggcucaucggcaaggacacauggugaaaguggauuggcuggacagauuaacauuuagagagauagaaaugauaaaugaggugaguugcuuccuuccucacaucaggaaaaauucugacggugacuaagcuaacauucuuucuuuaaaaauaauuuuuuauugucaguucucggccagauauggcuuccuuuagguacugugaguuuuauauuaauaaguaauaaaccuggccuuuuagaguguuaaugucaucugaaccauuagcagggcuaccuaccuaucauaugugacgacccggcgccucacguguguugccguguugguuagguuccuuugacugcuuguugagucuccauuagcaguacugucuccucucugaggucaccacgugccaucuucagaagugcacuguccaguccacaccucuguuucagcacuucauuuacuacucccuggguguugaagccccaguaaggacuccauuauacauaguuuaccuuuucucgaucuuguguauugagccauuguaaauauuuaauuaaaagaugacuucaaugaguuuuaaaaaguuguauuuguuaaagcugacuuacuuuguagguuuguuuuaagaauaccauagguuugauggaagaauuugugucuagagaggggaaaccacuuuaugaaucagauuccgagaggagaauaucacugucuagcugauaaugaccacugugguguacaaaucacaugacuuaaaccuccacagguucuuagcaagggagaagaggagggaguggggagaaagacaauggagacugagugugacagccccauauucuugucuuaaaugaaucuugucgucgguaacaccuauauugauuguacaguugagauccuuucuaaauguauucacauguuuacaacacagaccacuagaagaguuagcuuuugcacuuuuaauaauaguuccauuagaaaaauaguuuauucaaaacccaucuguuuucuuccaggucagugcuucguguguagagauguagcguugggcgugcuuucccaccuuggcuguguugcccuuccucucugcuugucacuagacaguagacaguacugcauggggacaguagacaguacuguauggggacaguagacaguacuguauggggcugcacacuuuaagugcccuuggcguugugcaccguguacgugcaguaacagcagaagcuagaagaagggguccugauaaaagcugcuaaugacgaguuaucuuaggagcagucagaaauugugaacauuuuauaaaaauuacuuaagccucuuacuuuugauuacagacuuaaaaaaaaauaagauuacuuuccuauauacaucauaauuccugaagugaguuaauuaguguaguuuaaaagugaaaguacugaaaguuguuacacguacaaacuggcaucuuuauuuuugaaauaaaauaaaauaaaacacuuucaaguuuuaaaaucauaaacucuaaggugcugaguaagccaaaugucuuauugagucuggagauggaguaacauccccuucuagaugaaacagugaugcucuauggcuauugcauguggauaauaacauaaguuauauuuuaaguaguagucauugauuccuguauugcugaguugugaugaagacccuuauuuaagaaaguuugaaagucgucauuuauugcucucucucuuuuucuuuuuuagagugagaaacgaagcucuaauuucauguacuugaugguugaguuucgcugugucaagugcgaugacaaggaguauggcauuguuuacuaugaaaagguauucuccuuacgacucugugcuuucugcugccaagggcuggccaccaaugacugcccuuccugcuuagacacaugcuuugguugcagaagaacaaccaaccaaaggcuuucagccgcagcugcuucugcguacacagccauaccacagagcugcagcccagucgggucauguaggucugggccacaaauucaauaaguaugcaagugauuaagauuuucugauuaaaauucuucugcagaccugugaguaugacaccaaguaauagcauuauuuacaguuauccauuugcacaauaaauaggaaauuauaauuaauguuuccuuggcaagacuuugagaguucaggugucuguuauuuaacauguacacaacauguugaaacuguguguaucuuugcuuaugaaaaccuucauugauaugcuuguauauaauuuauucaaaaauuugagacaguguuuuuacuguacugaaggaacaguuguguauuguuuguguuuucucguuaugggaagaauagcucaguguucugaauguagcucuuucaaguucuuugcuuuaaauucagguugaaaagguuuccuuuagugcugcagaauaauuauauagguaaaaauaugcucguuugaaaccgccuaaguagaguuucuuucaauauuauggaaauaguguuuaaaucauuucaaaugagaacagaguuuguguaugugacacuagagaugaacacuuguagcauacaguaaguuuguauauaggucacuuguucauuagaaguagcuuauuaaauuauauuugcauauuagugucacuuguugacgccgccuccaguggcuucaugccuguacccuuugcagaggcugccucaugccuguacccuuugcagaggcugccucaugucuguacccuuugcagaggcugccucaugccuguacccuuugcagaggcugccucaugccuguacccuuugcagaggcugccucaugccuguacccuuugcagaggcugccucaugccuguacccuuugcagaggcuaccucaugccuguacccuuugcagaggcuaccucauaccuguacccuuugcagaggcugccucaugccuguacccuuugcagaggcuaccucauaccuguacccuuugcagaggcugccuagcagaaagguuuucacaagagaggguuuggauuuacccugcuauuuauuacugugugauccuucucaguugauguucuuacuucuucucccugucgucuguuuucgcuuuagugcgaaguuagaauaaguuaacuuaaguuaacaaaaggaaaagguuauugagcaagcuuuucaccaauaucuuaaaauuacuuccuguuuugugcugugcguguuuauuaaauccacacugcugcucguauggggcuucuaugugaagaaacuucaaagugggcaguacuuuuaaacauugugagggaccuuuugaaaggcagcauugcaauagaggaaauaauaacagaguagaaauuggaauaauuuuuuaaaccuuugaaagguuacuccuagguagcugcucaugaauucaugccugccugcucaccauucuuaguuccuuuagcauaaggcuugcugggccagugcagcacagucuaguggaaacagacuuugucgucaccugucuucugugacagacagccuuagugaagauuagcugccacaguugggcugaugaauguguuuucugguugugaccgagagcaggccaguuagacagcagcucuggggcucugcuguuucccguaagacucaauuacgguagugccuuuucaguugcuucugauuuuguugaauaucuacaauugagaaugcacuaagcucugaggacagcagaacuccgauagcagugcuagguacacagucacaagggaugagugccaaucauaauuagccuauugcaguaauuuugcagagacauguauuauacugaguuggauuaaaaacagaggucauucauucuucaggaaugaugugcuaacaagguaaggcagcuuuaauucuuaacauaugucaagaauuggugcuaugcucuuguccgugugaaggcuuguuuuguccccugaguugcccuguuguugcaaucucucacuggccagaaaugugacccacacuugagugggugacagccggacugauuuagguuaagauuggacuguuuucuuacccauugucauaauaaaccaagauuuaacaauuguagccacaaacaauaaaaaacaaacuguuuccagauuucauaucuuuacaacuauaauaaaauuuuuucuacuuauuuuccaaaaaauuuauuaguaauagaaauuuaaaaauguggaauugaaagaggauaagaauuuaugaacaaaacaaugauguuuuuaaaguugaauguaaauauauuagcauuuuauaauauuauauccacuuaccauuugguuaaaugucuuccuuuuuuaucuuuuaaacccugcacuauucuaggauggugacgaaucaucuccaauuuuaaccaguuuugaguuagugaaaguuccugauccucaaaugucuaugguaagcugcuuuacacaguuuuuaagaacaaugaucuguagaguagacacagacccauguaauauauuuuaaacuuguaauacacauaccugacaaacccagacauguucacuuguaauaagugcucuucagcuauuggggauugguuuuaauggaugcuuguaaggaacacuggcaucugaagagugaggucugccuaaugcaggagugacugggagguuuugucuggugugaaaguggugauccuuaaggauuuggguggggggagcccgaggaagccgggugucacaugcauguuccacuacuggaaccugacucauguaguuucacagccuuguaguggguccuagggacugcaguggcaccagagugagucaaacaucagacaucuuaaccauggcuuaaaggaaagacuuugcuguuugugacuacugaagcuucucuuuuguauaucuaaacaauucucuguauauguaaacaauuuaaaggagaauuuaguggagagcaaacaccacaagcuugcucggagcuuaagaagcgggccaucugaccacgaucucaaacccaacgcuaccacaagagaucagcuaaauguaagagaacauacagacuggauaagaacagcuagguggacauuuuauuacagccaguacuuuauagcauuucaaaguuugcugaauuccguaacuucaugguuucaaguuucaugcuaucuacagaaugguuuggauugguuauuaaaucauuuugggacuuuuaguaauucugucuguguggaaacauaacuagaaaauuguaaguauuuucacaguuuaguguucuuagaaaugagcuaugaaggccggcauguaaacacuaagaguugcaugcugauuugacaagagggggacucauuuuguuucucgugauuuuguggugaaggacauugccacuuuggcuuccuuccugucuaguugaauuaaaucaacucugaaaucauaugcuuauauagagcauggccgucucauuguuccuucaauguccuaaugaguugcuuuguaaauugaugcucagcauauauuuugccuuaauugccucugugugccucccuccaccuuguguaauaauuauguuauagaaauauuaagcaaaugacauauuauaugaaauggaaauauguaguaaguguauguuugacaaauauaauucuuuuucuuuuguuuuagauuauugugaguuacccaccaaccaagcaacucacauaugaagaacaagaucuuguuuggaaauuuagauauuaucuuacuaaucaagaaaaagugaguuuuuugaauacuuuauguaucaaauuuacuuauauucuuuuuuucuaaugaucaaaaggaaaguaaaauuacacuaaacaugcagcuauggucaagcagucuugcuacacagcaauauacuggcuacacaggaaaagguguauacacagagacacauauuccuguguguuaacuccuagaaaaugucugaaugaauuuugaaggcagauuuuuuucaguuucuaccugugcaguuuguauccguugcauaggauagaguagcguauuucauuucuucuuguucuaguggagacagcuuggcauucuggaugagacggcacagcaccuguuccguagcacgugcagagugagccugaguccuuucauucuuacccucuucgccucuuuguuccugagugauuaggaaugcagucauacugacuacaaagcuugugaauucuucagaccguggggauagaagaaauagugugauacguaauguggaaacugaauucguagagugacaggcagcugguuagcagggugggggugagaugagaacuggaccuuugguaaggaaacuggagggagaagugugaugaauugccaggucgagccucuagugugaagacuuguucuugugccuacacugcuaccacugugcagcuugguaacugcaggccagucaugauggauuaaagcucgaguuuccuguacuugauaugggaugauuccuugguaaugaaauguauauaucuugauauucuugaaguauucuaucuuagagcgagggcuaaagaucuacuuaaaaaauagauucauuuauuuuacuuuauguauaugaccauuugaccugcauggauguaugugcaccacaugacuucuuuucuuuuuuuuuuaagauuuuauuuauuuauuuauuauauguaaguacacugucgcugucuucagacacuccagaagacggagucagauuuuguuacagaugguugugagccaccaugugguugcugggauuugaacuccggaccuucggaagagcagucgggugcucuuacccacugagccaucucaccagcccaccacaugacuucuuaaacagcugaugaaugcuagggaccuuuaaauccacagcaaacccacuaugcacauuguacaucccugucacacagaucaggugcauuacagagccacggaaguauacaugcuccuucucgagaugcugguguucaagcuccagaaggggaggggucagugaagaucuagagagcauagaggaugugcagcaggguuucugaguccacuggaggcugagcagagaugcauuaggauaggaaaaguuugcgucaugcaacugccaucucaugcuggagagugaacccgugugcugcagucucaugcugugcuggcucuugauuuaguugaguuuucuaagguagaagugaaaaugaaguuagggaccaucuugagcucuucagcuuuugcucugucucauuuauugaugguuugggaaaccuuuuguggaugugucuuagcgguuacccuuuauaccuaugaaaggggaagugggauuuuauguuacuccagcuuuugagagcuugcuuuuccuccagagcaugaauuaguuaacaaccuugcugugcuaacugaagagucgugugguuacaaaucauggcuugcaugcugcggucauguaaucugcaugggaagauggagacuguaaugugaagaugcacagcgucaaaguccagggcagccuuacagagaccuuccuuaguuggaaaggcuuguaagguaaaucguugaucucaguagucacuucccacugaauucagucccuucuaaauguuugccgaugauauaaacugaguggcagguguccugaagacaguaucuugucuucagagaugcugaugaagccgcaguucucagaccagaaggaucguaaguaacuggcagggaguaaauaguauuuuuaaugugcaagaagggcucuugagcaaaccaauguaaauuggccuugaaguggcaggaguaaucaucacauagcagcccguguguccugugcugauggcagccaucacugaugcacaagccuucuuucagucugugucucgcauagggaugggcuugccgggcuuucggcucucagagaacuucucauuucuaaucucaggaaggcucuagaaacaauuuagugggcguuaguuauuaggaaaugauacuuagaauuuucauugcauuuccuugguguuauccauccccucuggcucuuacaguguuucuuccuccgcuuccauauuguucccugagccccaaagggagggcuuugaugaagacacccacauauaggacugagucuucucacuuucuucacauucuccaugugaagaugaugaugacugcuauugacugagagacacugcucucuggguauaacagauugucauuaggaaucacuuugguuuuccccuaggcccaugaccuguguaguuucgcguucuugcugacccaagcagugucaggcauggguuuuauccuauggagugagcuaaaauccaaagagauuguguugguuacuccccaggccugucacuauugcaccaggguaucaugcaggcaggucagcaguguagaucacaggguugguagcuggguugguguuguaucuuucuccccugguagcaugugaugcaccucccaguaccaugaaccuagucgggaggguugaagucuccaguuagguaccaguugauuuuucccauguccagugaguguugucuucagcaguagggccuuaaucuucaaccaagcucuggcaagugccugggcuguucaguguuuuccuugggucccuuuugacucuacuagauguaaccuguucuuggcgcccaaaguuucacuugguuaugaaagcugucuaguugagcauugucuccuccauuauuuagauuuccauuuagauuuuguucauucucauaaauacauguacauguauguaugcacauauauguauagguccauugcuguguauugugggcagggguugagugugcaugcauguacaggccaaaggucacacccaggugucuuccuugauugcucucuaccuuauuuuucgagccagggucuuucagugagcaugaaguaucccauuggcuggacuggcuggccauggagccacagagauccuuuggucuucaccucccauccuaagugccucgggcuuguggaaucugcacuucuggaggaauugacuguggaguuuuauugaaaguuaguuugaaaggaguagagcuaucuuucuuuaagagcgagucuguagaugacagauuugugacagaaugaaaagagcuuuccauuuugccuggggugcugccaggagaccuggcuuucaggguuuagugugaggaaaacaggagugugccuuucugaagugaguuguguauuguuugugcugucaggacuugaccucugccaggcagccauguccaaacuugaggacauggaauugccagagaaguaagccucuagaaaaauccugcugucuguuacacagauugcuuguggcuggcucuguaccuaccucucuugcuguuugguuuuugagugcuuugauacucuuuuuguuguuguuuuuguuuuguuuuaacugcaugucucuuuaaggaguugcuucuuagagaggcauccuggugucuuugaucucucugagaguguguauuaaagcuaaggaacugacccugauuagguaccagugaggccaguugggagauuucaccauagcuuguugugguuucuuuugacacacuguugguauugcaaagcuaagacuguuuccaaggcacguuaauguucuugggauuuaccucgcccagcccauuacugucuugaggucuccaauauuuuaaagccagaaaaacagauuaaaaaaaauuauuguguccugcaauuuuuuuauccuggaaaauauaguuacagggaagggguuuuguuuguuuggguuuguuuguuuuguguuguuuuuuguccugcacugcuacucaaggaccuggauucuucugucaaggccaaguagaccucugccuguaccagagcucuuugacccggcaaucagauauaguuccuaacugucuauuuaacucuuuucugacuccaggcucugacgaaguucuugaaguguguuaauugggaccugccccaggaggccaagcaggcccuggaacuucugggaaaguggaagccaauggauguagaggacucccuggagcugcucuccucucauuacaccaaccccaccgugaggcgcuacgcuguggcccgccugaggcaggccgaugaugagguacaugacuguucaguaccccuggugacuguucugugaugcauuuaaagaaucuagucuaagccuggcgugguggcacacgccuuaaacccagcacuccggaggcagaggcagaggcaggcggauuucugaguucgaggcuagccuggucuacaaagugaguuccaggacagccaggguuauagagaaacucugucucgaaaaaaacaaaaacaaaacaaaacaaaaaaaucuagucuaagacuaaucacuggucacaggcucuuacaugugugcgcugggagagagauacaagagggagcauauaggccagugguucccaaucuuccuaaugcugugguuccucagguuguggggacccgcccauaaaaauacuuuuguugcuacuucaugauuguaauguguuguuaagaauuguaauguaaauaccugauauguaggauaucugauaugcaaccccugugaaaagaccauugaauucccaaaggguccuggcccacaggaacuauugauccaugcagcuagacuaguuagggcuccagaagcauugaaagucuuucugcaagagcugcugugagaggagagcuacccucuaguuuguuacaugauggccuuccacuggcaccagagcugcuaguccucugucuggagaaaaggcuucuaaugaaaaaugcuuuaaugcaacacagcuagggaguaguucagauccauuccaacucaguguacaagaggccacauucaucauagcccugcagagccuguaagccuuuguagcacagaggugcauggccauaacucucuuccaacccccugccuucaccuucagcugcuggcaguugugcacauguguaaaaugucccaagguggucuugcauccucuggguacccauagcaacuguaaccuucaugugagugucuguaugcaccccgcgcagcugaggaggcaugcaguugacacaggcauuguuagacuuugccuuagucauuccuagugagguggacuaauguggcaaguguucuuguuuuuuagagugaguguguucuuaaaggugacuuacuaguuuaugccagcccaaugggacauaaaacacagugugaaaccugacuguaaauugcugcugagcuagugggacagcuguuauuaaugacacccuaaaggucauuuuuaauuagaaaugccaugaauuuuucagaagcacaugaaacauuaugauugaaauauguacauauuuuguuaaaauuaaauauaucucaaaugguuugauagaauucacuuguuuucagccaucaucuacaacacuagucuccaucacagucucccugguggguuacugacacccguucauaccuccgugcucucuuucaaauccguggucucauuuuucauuaauuguuguuacaugcaugugcguguguguguguguguguguguguguguguguguaugugugcauguguguguguguaugugugcaugugugugugugugcauguguguguguguguauacauauacacaugcuccgucuguauaauguuauauuuuugcaucuguauaauguuauauuuuuguauguauguuuucaggccugcccauguaguauuggaugaccaauuggugugcuuuucucuuaccugcuggcuaugaguuggguuuuccguguucagugucuuaggaugcauaacucgcaugacuuacagaacugaagaacacacuacugucuauugcugguuaauuagaaagggcauuuaagagaauccuugggugaaguccugagcccggagcuuccauugccauggaaguuuaggcauagcauuauccucuauguggacacagucuucaugcuauuguuugguguucuggacacuuccucacauugauaugaauaaugaaaccauuggcaacugguaacuaaaacugccccuuuggacaggcuggucuaacuuuuggacguuaauuuuuuccacaauguugagaguaacucguuuuaugaaaccuucaaaagaaucuuaaacuuaagucaacauaagagacaaccgcuuuaugacguugagccuuuuugccugguacugugauuuuauacucaggucuuuuauaaaguucuauguuguuuuuagauuaaauuauaucugacaguugugucauuauuauuacaaaguauucgugcauuucucuuauuauccauuagguaaaaugccuguuugucuuuuugucucuucacugugucucuuucuggcucuuauacauacuucuugggcucucacaucuccuacguguaaggugguaccagaaaagcugugccuguuuuucaagucuggauugcucuccucucauugcagccaagcacagauaaugucccagcucugccuugcuuucgcuuuuaugagaaugccuuuaguaucuugccaucugaugugugcuuaauggucauuuuauuuaauucuugcuaaguucagaauaguucuuuuugcgugugcuuguguucugagugugagagucugagugugagagugucaaucaagaaagccucuugauggaucgaucaccuuuuggcucuuauuccuaucauguuaaucuguguggccuuccccuccccccacccccaccauguaauuguacuguaaaucucggauuaccuguaugaauuuggcuuuuuaaggguucuauuuaggaauguguagaguguugauucuuacucuuacaagguucaggccuggaaguccugcaugagaauugagugaggaauguguuuggggcacacugaggcaaagcuguuuguguucuacagagggcacagcaugaguaccggcagggacacagcagaguguguaaagcaagaauuguacaugcgaggacagugacucuugucugcaagcacaggaacacugucucugacacagccuugcuuuccaaagcauggagucaacauuggggaagguggcgcucacuacaccacccuuggcucuagggaaauuucuauugcaucaacuuggguagaaaucuguuuguuuguuuguuuguuugcuuuguuuuguuuuuuaacacccugcuuuugcuuugucuuacuucaaaguuuaugucuuccaugcuuggggacuuuuuuauuuccagcacaaugaggaagcaggugacuuacuucguauuagcuuuaauuuauucccauacaaaugaaaaacuguguugucggagugcacacugccaaguguccagcacgccgauggggauaugugacuuaaaggagggaugcgguuucccacuuccccucuccugggcaauucagcgagaagcaguucucaugccuuauuggcugagucuuguccaucacuggaaaacgucucacauuagagaacauucaggugaggagcaacuucuuguuguguuuagcuccaggcuccugcugacuuccagaaagcagaagagggacucagccuagacacugguguuucaagcccuuuccuuaacuggaggguuagcaacugcucagccucuucugugccuggugaaaagaaggaugugagguuauuagagggcugugguggugggagccgggggauuuagagggaucuguggauaucucaaagaauagggggaggaggaggagaaggacucggguucuagagcuuuugagguuuugaggguuuuuaaggaaaagaagaacaaaaguuguuucaaaaagaguguccugagauggaaauucuuuugaaaaugugaaguguauuauuccccagcagucuuagacauggggugcauuugauggucuccuguuaacaaggcccuucuuuaaccccuuaguucuuucuguaggaaccaucucaaccucucuccuaccuucuccacucuccuguucuguuguucagacaacucuauguaacagaaaccaccauuggccacuuacuguggccugcacacuugccacuccuuuuuuuuugacuuaacuuauuuuaugauugugacuguuucugcagccuuugcugcgccggucuuuuuauaaauaaggacacaaggaugcacccagcagcucagcggcuucaugccgugccaaaggcaacaaauggaagacgugcaagucucgugucccugucugccggagagaaguguggcucuacucagugugcuuuggauuuucuaaugcccgcuucuuuucauuuguuuauuuguaggauuugcugauguacuuacugcagcugguccaggcucugaaauaugaaaacuuugaugacauaaagaaugguuuggaaccuaccaagaaagauagucaaacuucagcaucagaaagucugucaaauucuggagucaguucuggagacauagauagguauggccuuccagggaagauuauuuauaauguaacaauuucuccauuuucauguuagccucuuuucccuuccuauuguaucacauguauguuuauguaugcauagauuacuagaguuuagucuccugcucgaugccuacuuagaagaccugagauucugucuaaggucuuucuucuuccuggguuacauauucguguacauagcucugcuuucucaucucaaaaaucaggauaacagccuggugugggggcgcacaccuuuaaucccagugcccaggaagcagaggcaggagcguaucucugaguuugaggccauccuggucaacaaagcaaguccaggacagccaggguuuauuacauacacauugaaaaacaaacagaacaagcaacagcaacaacaacaaucaggaugacaauagcuccuugcuugcagaauaaaaaugucuacacaggauuuuacaucuugguuaugucuccuguuauguuuucagcucccaaauuauaaccaacccucuuccucccguggccuccccuccuccugcaucuaaagcaaaggaaguuuccgauggggaaaaucucgaggugaguaaaagcuugucaagauuucgguggaagaagaaugccagucagcauucuguguuggucuuuaaaaccuuggguugauuaauaaaccgaccauuauaacguuguucaguaauggguuaugguacaugguuaugacauuuccccucacuuaaugggcuggauauugcuucauuuauuuuauugaugcucugggcauauaaauggguuuagauguaauuuaaaaauaaucuaaguucaaauauucuauuagggagacucaggauguucauuuuaauauauuaauguauguuagugcaguuaucaauauuuguaauuuuacuauagaaauguauguuucuauagaauuauauacuaaguaggugguuuuaauucauauagacagguaaacucauuuuugaagggaacagcucugcuagacuaguagguacaucaaaacaaaacaaaacaaaaaucaccagcucuuguguguguguugaggacaugaucauggaagagcugagcucugagggggaaguagcuggucauugguguagggucugcaggucaucauguggcuuuucucaaagcugaugaaauaauugaggugaagagcuuagcagccuuagcuucccugggaaugcugugaugugaccagaugucacccuccuuaccaccuggcuuucaacuauugguugagcaguuuuuaaucuccuucugacauuuuucuugggacugauaaacuaacccccuuuuuuuuuuuuuuuuuuuuugugguuuuugagacaggguuucucuguguagcccuggcuguccuggaacccacucuguagaccaggcuggccucgaacucagaaauccaccugccucugccucccaagcgcugggauuaaaggcgugcgccaccaccucucagcugaacuaacauuuucuaggcugauuuguacucagaguucagauaauuuaaaccuucacagaaagguggggauccuucugaguguugaccucccucuuaggcaaccucagaaaaguaacaguagccuauaggccaucagcaccuucaaauugucuuucucaguuaccaaauaauuuuggucaagagaacugguaauuccauauccucugugugcugucuuaguuuguagucaguuugguguggguggauuguaggauggaugcgagagauggauggauggaugauagauggauggauaauggauggauagaugagaaucucuacugucacuucagaugaaaacuguuccagcuuaggaucucucauuguuuucuuccuguuaauagcagaugguaauaugucuuucuuuuaauuuuuuuucagcaagaucuauguacguucuugauaucaagagccuguaagaacucaacacuggcuaauuauuuauacugguacgugaaaauaauuugguuuuguaucaccccuuugaacuauauuuccuaugcuguaagcacagaugauuuaagaugaaggccaccuccaagugccuaggugccgugcuccugccucccgucuccuagcuguguucacagaagucagugcaaucguagucuuucuaacgcuaaguuuucaagagcuaagaugcaaaugacuaugguggcccccaucucccucggugggucugcuuuccuuuccugcuacuuaaguaguauauaacacuuuauaacuuuucaagagugcauuuuuacguuauuuaccagacgacuagaaugcuacaaaaauagaaaauugaaauuaaaaauuaccuucucucauuuuaaacaugaggaggcugaggcagaaggaugcucuaacugaacuuggcaggcauugguuaggauagacacugccauuucuagaggaguccaagcaaccauuuccucucuucccuguguaguuaguuauaggagacaaggauaaccaugaugguuuacaugaaaacaaugagguacagagagccuccuuucuguaccaagguaguaggaaguguggccguauuguugaggacauugacugaguggcagcgaucccugggcuuguguacugacgugugaguccugaucacguuuacagaggaucuuagggcgcagccucuugggugagccuucuggaaaccugagcuguuaacuauagagaugaucucugacuuugucuuauacuuaauguguggucuuaacuuaaauggcgcaaauuaauagauguuccaucuaaaaauuccuuauuuuuuaagaaucauaagacuugcuguucuuaaggaacugaaaaugccgucuuauuucagccugggucugaagagccugauguuuuagcuugaaugaaacuucagcccauucucccuuucucaaaaagaaauggaaucugagcccucguaaagagcacagaggcccggucugcagaagcaacguugucuaagccuuuaugguguuuuccuaccauauugauaucaauuauuuuaauggcaucagucauuuucuccacuguaccugugaguuuuccacacgcccaauggcugagcugcuagaagcgaaauaucucuauguaucuacuucagcaguugaauguaauauucauaaaacucuauuccccucacaugaagcguugggaugcccuugaacaugcauugcagaacacugugguugguuuuaaguaccaguuuuccuucuaagaguucacuuacaaauucucaucuugccaaauugcuauuuugauuuaauagaaaccuacgguuaaugguuuugcauuccuaucugaauuauuuagugugcuucuguucgcaccauuauagaaaaaaaaaaaaaacauuuccuugugaaaagcuuaaguaaauagucaaagacucaaugacauaaaaauaacagggaacauaaaacacagacagcccuacuuccauucgucagcgcauucuaucagacccagacucugugugguuucccgcucugucucuaaugcacugaauagccuguuuauuuuuggagggcuaacuagucuuuccauuucaaacucuauauguuauguauuagaaauauucaucagugaaaaaaccauugauagugaugcuuggcuuugauacugcuauuuuauagaggguaggggaauucuaugagaaaucauuucuaaguuugccuaaagugauccagcuuccugugaacgugagccaagucucaguaaggacggaguuccagaugucugacaaaugaauuuaaauuucacucauugaauuaaauaacuuuauauuuaacugauucugcuguuuucuucugagcacccuagguuuacuuugucauuuuuccucccuuuccaguaauuucaguaauauuccugcuauccuaaauccuugaggggccacuaacugcacacacaaacccuuuaaaauggauagggucaauguuauaauacacagaguuaugucucuagucuguaaaugcuggcaucagaauuuauaagucugugcaguuguguauuuucauuguccuuccaguguguugaaagugaaggucaacucuguaugcugugauguguuuucucuaacuucuuuuuuuuguuuguuuguguuuguuuuuguuuuuuuucgagacaggguuucucuguguaucccuggcuguccuggaacucacuuuguagaccaggcuggccucgaacucagaaaucugccugccucugccucccaagugcugggauuaaagccaccacagccugcuuuucucuaacuucuaauaccuuucacagucaugagcgguagacagcacuccaugaaauugucacggaagagucagccuaguggugucaucuuauguugaguacuggauagguugucacauuuucccuucagaugacagcucuccaggaaacagcaugcagggcucaguagacucuaggguauaggugugagcagcaaacugugagaugcuuagacucugggucuuuugauccucauuugaccauggagaugaugcuuauguuuauguuagaugacucauuucuuacuuagcagaacauuggcuugaaauacuagaaauguguuuaauuauagagaucaccgugcauccucgagcccuggaagcuuuaguagcuguguacuuauuuaacacugaaguuaggggcuacugaguaaaguggugagcucuguguacauggccaugcccaauugugagugaguuugcuacuucugugcauaggaaaagaaacagaacguccaguggugcuggggaccaucggugaauuucagcagccaggcuuagccuagugugagcacauugaugauuuugaagcuugcagaucucuuguucugacaauauuaugugcaguugucaugugacugcgccuucugaaauaccaucauagaaaauaggaguuuucuuguuuguguccuggcucaguccucuaagcuuguuccauaagugauccucagagcucuucaucugcccuuuguaccugggaugaaacacugaagugugagucuaaucugauuuauuauugcuuuuguuguuucuugagacaaggucuuguuucaaagucugugcugguccagaagguagguuguaccugucucagccuuccaaagagauggcauuauaggcauaugucacaauaccuggucaauuggaauuaauucuaauuuaaagacaaucauguguuccaguugugguuguagauguuccauaaggcaucucuagucuuucauaccuuuauuaauuuuaguuuacacucuuguugacaaaugauauacuauaucuaggucaggguucaauuccucacagcacuuucccagaaacuccagaucucaggcacaucugcugugguauagcuuagcucugggacaagagagagaauaagaccuauuuuaaagcaguuaucugucuauaagaucacgucagauacaacagcaguuucugaaagcauuugagguaugacacauccaucaaugcuaagagcuaaaaguauggaucagggacagacaaggaacgauugucaguacaaguguccggaggaucucacuuagcgaggaaguccaggagcaaggugcauagacuucuuguaguggagagagggugggaggauggagagacgggcaaggacagugucuuuagcacaugcugccauguuuagcaaaucacaaaguugguguuuagcagcugagaggacugaccugccuggagucugagcuauacccaggcauggcgggcuugauccucgagccuggguaagcacaguuaggcuaagguguugaaagggggaguguugaugcuucugcuacuggagguaggacaacuaaguuacuuuaagagaauguguauguugugaaguugaggacuaagaauguucuugugagagcugaagacaugcgacgcuaaugugcaauuccccauaguggcagucugacuggugcagagccgucaugugcguucaguggacacaguuagcaggcugcaucgagugacugagcacaggcaugcuagggagggguggaggaccacaggcagagcaugcaucuggguauuugagucagcacuggguguguguuagcuaugggcuucugcucucugaugcgacugugucaugccucagcccuuuuuuuuuacccaugugauggagacacguuuccugcuucacuuuuaagaaaacuuaauuuuuguguauuuuauuuacuaugugaaaaauuuuauccuaaaaccaugaagaauuuauugauagaacauucaguaauuaaagaaagguugaauuuuauauuuuuuauuuaaaaauacuacacugucuuuuuuaaaguuucuggugcuugaaaaucacuguggaugaauaugaaaccgagcuauauaauaaaauggaaaugacaccuuacaugaaaaaaagauaucuaaauucauauuguagaauuaccauuauugagauuuugccuaaaucaacggcauugaagucagacagcgauaacgaucaugagccuucugggugggguguaguggagaagagaacacaugagcacuguagucacaggcaguugauccucuagguggcugaauggauucugcuagggacaguaucuauaaaggguaacggugugugucaguuaaggaguuucuaaguuucuggugguuuuuggaguuggcguagaguugaguaagcuuggcaggauagaaguaauucuuccgggaugcucaggguagagcauuugcucuucaagcacaaguuuggaucccaaauacggacauagaaagccaggugaguggggacacuuguaacugccauccuuggggugaggagagacacaugccugaaguugagcugccaguuuuccuaacaaaucgguaagcuccaaguucagggagaaauccucucuuaaggucaacagcagagucaaccucugaccuccauagacacacaaaugcaugucugcuaauacauauacguguuccugaacauauuuguguacaugcacauacacauacacauaggcaugcacucacacaugugcucacgcaugugcgcacgcacgcacacagggcuggggagggagcaugcguaugaauauauggauucugacuuggcaacccccccccccccccccagucagccaaaagcgcuguccugagaaguacguacacucucccgguguucacuguuuugagucagggucucauggaacccagggcagcacuuaguccucugcuucccaagugcuagaguuaggcuugcacacccugccucuucuccagguucacuguugauaaacaagcagguugacagaaauguguuuaucauggcccacugaaagugauuuaaagcugcucuacagcuuagcauugguaaacaagagagaaguaagaaauauuaagucuuacauaauaaauaauaagagaaguaagaaguaagaaauauuaagugccauagggguucuacuuuuuaauuaacuacaucuaugcuguauguuaugguuuguuacuaucaaaacauuucaaaacauguauuacguuacuucucaccucagcuuauuuauggaugugugguguuuauaaccauucaggaaauuuagauuuaggaaaacaauuuuauuagcugucuaaaacaacuuuuguaauagaaguauugaagauuuuauauggguuuuugagaaauggguagauuggauuagaaauuuuuaaaaaaucaauuuaaacuuugucuucuugcaaaaauaugucugagaaaagguagcuccagagggcuuuucagugcaagaacaccuuuuauugcccaaguaugaggcaggggaguaauauguguguuggguaguuacuugguggauauguaaguuuuacugacaaagagaaaaggaaggcauugcuguuuccagguauuucauaucguaguggagcaugguuccagggccucacuuagaaaaccguggagcuuagcauguugaugcuaucccuauugaucaucaugaugggugccugcuuaguguuaacuuguaaagggauggcgcuggaaggugucuuuacuccuccucggcucuuacagccguguuuuaaucucucuuaugaagcaguguaaguacugacaggauggaccugagugucucuucucaucaccccagcaucugaacuguguuuuugaagguaugugauaguggagugugaagaucaggacacccagcagcgggacccaaagacucacgagauguaccugaacgugaugaggcgcuucagccaagccuugcucaagguacucagaugcugcagcuggcugguuuaggguuggugagauggcugcucuccuggaggaccugaguucaguucaggggaucugacacgguacccucuucuagcccgaaugggcaccaggcuugcucaaucgugcacugacaugcagacaaaacacucagacaaaauaaaauaauuaauauauguuuuauuaaaaaaggagauugauguuucuggcacaugaaaauuugaaaucccaaguuuaguguuuauaaauuauuggaacuuagucauuuccuaguguguguggccucuuuguuugauacccaugggugaaucacuacaacagguuuuugcccuuaaauaucuaucuuaaauaaacauuauauuagccaaacaaugaguaaguccaugcucucuuaauuuuacuuuuucuguccuccuuuuucaucucagcucuagcaguaguucuccuguacauauuuugccugacuucaaaaaacaccuuacagggcagggccauuuucugcugcuguugcuucucuaaagcagugucuaugucuggccagcagagggugcaagagaaagaaaaacaguugauggugcuacugaaagauuuccugguauuucuuuacugcaucugcuguuuucuuuuugaacuccuuaaaaagcuaaacuacagcuugacacacacuuuuagacaaaguacaggucccagaguagugucaggccaacuaacagaugagccccgcagcuuaccccguuauagccccgcacucucucugagccuaagcguuuuaaaugggaagauacaauuuucuccacugcacuuuccaggcgacugugagcaaugaacuagaaagugcauuguguaauauugcaugaacugggaauuccugcauggaugguuucuguguacuaagacaucuacucagcaacuguuugcugcauuuggguuuuucuuuuucagggagauuuuuacuuaagcuuugcaaucaggaucuuuuuuagcaaguagaagcguuuuaggguaaauaaauccuguugugucacauggucauauacacuaacaauugcucaggacccagguaauuuucuacucucucuguugguugugcuuagccuagacagaggguuucucauuacuucugaaucaaggucuuuuucaguuucacuuugaagguuaggggaggaagagaaagaucccacugugaaagcagagcucauguccucacuuuguucccucagggugacaagucugugagagucaugcgcucccugcuggcggcucagcagaccuuuguagaucgccugguccaucugaugaaggcggugcagagagaaagugggaaccgcaagaagaagguaagcccacaguccaguccauugauguugccauauacacaaauuccauuguuugcuuccuuuuuagggacaguuucuuacaugcucuguaaccuccugucccccuaugaucagugauagguuuaaagccaugaaugagccacuaugccugacucuagaugaacuucuaauagguaauuuuaguuccaggagcccauggcacuggugaugugggguccugguuuguaaguuaacacauguuaacaugagauggugcugaaaggcagguuagaggacuaagggaucaguugguccaguguccccaaguguagugucaucuauauugcauugcugucuuuaucuuagcaucauaguuguuuagagauguaagaucauugacaugcacacugugagaaaacaguggaccagaguaccuugcagaaccgguaugccuguaugugugcucuggcuagcagccaucucuccuaagugggaagcuugcacauaauaaaccagauagcuagguaucuccucuacuuuaaugaugugaaggauuuacauggugucgucccuucuaauccuguaagauaaaaauaggcggauguuucuugguggcuuuugucaaagaccacaacccaucugagaaauauagaucuauaagaucaaagauaaaacaggagaaguugaauugagucaaacuuuaaaaggcaagaauuaaacagagagaugaucaggaacguuguucaucugaugagagaaggaaauuggcagagcagaaauacuuuuuuaucaaguuugcauuuuccuuauuauuuagaagaaucauagucauguucaaauaaagucccagugccauuugcccaucaccacauccugccccagagcucccugggugagaagcagacccuaguggguccccagcagugggugugccuguagcuuggaucuuugaucuuaucggccauucucuggauagucugaugagacuaggggugaaaccugaggaugaagguaaguaacagcaagacuuggacuccucagacacugguccacaccagcagucugccauccaucuuuucugaaggauuggucgugccccuuacugacauacagaaacagaccuguaccugcuaagaauugauuuuaaccucagaggucuuggaguccuacugaagggaaauaaucuuguguguggcaguccuuaaauauuuguugaccauagaguucuuaagugauucuagaacuuccuccccugaugcauauaucauacuugaagcacuuuaucucucuguauauggaagucugguuuuccuccguaaagcguggauaugccugccuguuuaaagaguacaagauucuggcuucaaagaaaauggauuauuugaaguuggguagaugagcuuuaguggaugucagagaugacuuggauugcucagauucucaaaucuguguucuauccaguacgucuaugaguuuauaaaagugagaaucagagguagugcguagguagcagcuuccuccaaauuaauuaaauuuuccucuuagauaguuaaaagaugcauuaggguagcauaauggaauauuuggcuaauauuuggucaugcaaaauuaagcaccaaauacaauuacccuucucuguggcuucauaaauccuuuugacaaagaaauugaaccuuuaaguuccacuugaaugucuauuccuggcucuucuucagcugcaguaagaaagugcauuuucugucgcucucgaaggagccuagguauucaggaggagguguuucuugaaggcaugcuguugcuauugcaaaguggauuauuuauuguugcauauauauauauauauauauauauauauauauauauauauacucugcuucacauucaagugacacacaaacauacauauucauagucuuucuuauauauaagcauuuuuaacucuaguaaaaucacuucccucuucccuugccuccuucucggcccucccaguuaccuucccuuuaucccuucacacccaccccacacucaagcguuacauauacacuuggugguguguauagggcuggccgcucugcaucggacaaaacuaaucagggggcucauucucuucucccaguaguaaauaauuaauugccucugguucuguggcuaggccugggacucagugaucuuguuuuucuuuuucuauguuaacauauccauuaaucuugcuacaguuucugucuuauuuacacaaccauuucuaggacagacuuuuauagcaggcucccuggugucacaacucuagcaauggaagcagugcgaccugggagaauggaaccgauaaaggaugcagacucaagucucaugcaauagccaacuuuauuccgugccucagacaacuauacucugagaauaagaaggucacaugagugaaguucuaaugauuucaagcuguacgcaucccaauaaguagcauguggcgaaagcaugguuuuccauacagacauaauugaauagcaacaacaaguaauaauuaauaccgugaaguuaacgcacuccuauccacuacauuuggaggaauauaagacacauuccaagaacaauuucuuguuuugaaggaagugggcucaugggucucuugcuuuguuuucuugguguuuugucacaaguacucagaacucucuucacgugaguccauuccuggacuguguuccagcaccugguauugguccuuacacuucuauccccucuucugcuguguucacugagccaaagaugcagaagcucuggugugcaugcauccacuggggcugggcuccccacagucaguugagcuccgcauuggguccaguuguggauucuguggagauugcuccguuuccuggaaggggaagcuuggaugagaaguguucuuaccugugagaauaaggagaagauuuggaauggagcaaagaacuaugcuggccuagcaaagaggaggucguugaugauuucuaagguggaugcccucacuguuccaggaaguuggugagguuuccaguggaggcaugguuuccauccuuuggaguaggcauuaagucagauugggugacaguuguugcuugcugccgaugggugaaugcagcuucuuggaccucuguucucguccugccaugcugguccuugugguucauaggcguuacaguuaggcaggaacugcguaacugccucccucccuugacagcuugcauuguaucucuuggaagcaugaaagcucggucucaggaaagagcuuugaggucaguucagccucaaggugaguccuguguccuacgggugugcugucucccgcaauaggggcaagggacagcaauuuuugacaaagccucuagggaccauauucuuuuuauuuuuauuuuuuuaauguuuguauuuauucaguucgcaucccacucacuguccccccgaaacucccuuccacaacccaccccccauauuccccuuuucuccucugaguguguggggccccuuggguauccccccacaaugguacuugaagucucugugaggcuagguguuuccugucccacugaggccagacaaggcaguccagcuagaagaauauaucccacaugcggguuuuggaauagccucuguuccaguuguucaggacccauauggagaccaagcugcauauguguuacauaugagcagggaguccgaggguccaacccuguguguucuuugguagugguucagacugagagccccaaagguccaguuuaguugacucuguuggucuuaggaaccauauucuuuuauauuuagcuaaaauuacauacaauauaucaguguacguggaguguauguauagcacauuuacauaacgugucuaugucugugugcguauguguuuguguguggauauguguuuaugugugugugucuuaaaaaucuuuuaaguacucuugucugacagugcucccuacaagagccauaaacuaacagaaccuucagaacaagacauaagaaacugccuugggaaggggcaggguuguccucgagacuuccuugguugucucuuggguggagggcaggcccucguugcuguaguuuuucagguacuuuuuugugcuuuguaaaugauguuaauagaaucaguuuuauggcauuauuauauguugggaacaauucucucauuuccaccucauugcuccucucuaauucacccuagaaugagagacuucaggccuugcuuggagauaaugagaaaaugaacuuaucagauguggaacugaucccauugccgcuggagccacaggugaaaauaaggggcaucaucccggaaacagcuacccuguucaaggugagugugaugggugagaccccguguguagucagggcagagcuaccaccauaagaguguuaugccugcguguauauguggguacugcccauauaccuggugccagcgggucagaagaaggugguagauucuauggaaccugaguugcagaugguugugaagcaccaaguaacuguugggaacugaaccuggguccucuguaagagcaaaaaguguucauaacuacugagauaucuuucuggccuguuauuauauuuuaagaucuucuguuacaauuauagagacauuucuaaagaaaauaugucauauuuuuaucuccggaacuuuauuuuuaguaaauuuacuucuuuaaaucguaguuagagccauauauauguuaaaguuaaugucaggacuuacauuauauauuaaguacauaaguucaaaggucuaguugugaggcccuuuuacauuuuuuuaaacauaucucagcccaauacucauucuacauacuuuauauuuuuuuuuuuuguuacauuuuuagguaguaguucucuuuacucuuuuuuuaagcuuuucauuggugcuuugugaguuucacaucaugcacugcaguccuccucaucuccccgccccucaucuccccgccccucaucuccucgccuuuuugcccuugcagucuccccaccacaaauaaaaaacagucaaacaaauaacaauaaaaucacaaaacagaaaagaaaaccucaucccggaagauauaguauuucacagugugucccacaguauagcccucugcccagugaaucauuggucuucuguuguuggggccgaccuguggcucucaugucuggguucgagccugggaggcaucuuggaacugaaagacaagagggaaucuaggcggguagagagagaaauggagccaagacaguauucuguucgagacucaaauguuuaaugauaaucuguacuuuauaaagagggaagcccauccccaaguuccuuaugaaguugucagaacugccuuuuagcaggaacugggaagaucuuggagaaccaguuuggccucaggcagguagcaggcaguggcacuucaaaggagagagaugagaagcagcacagcagguggcuccgccucaguggucugaaccagccuggcuagggagguuacauucugugacaccaucaauuuuggacccucaccugaucuccucccaguuauucuguuauuguccugaguuguggagauccugaagcguuggaccagcuagacuggcucccucacaagcuccauuuauagaugauacagauuuuggggugggccaacucagauaacuggaucugggccuaugugguagcugcgcuggucagcacgccagcucucccuuauccauucccccagggcaagcucuccagcacugcuccugcugggccacccauugcugccugagguggagguagggucugcucuccugcccucagggacggugccagcuccacucugcugcccaguuggguugcagggcccacucucccaagugccacagcuuagccugaggggcuaggccaccucucagggccucaggacugucuuacccaugcuucucugugauggccagcuccacugaguugcuaaggcgagguacagagccuacucucccaagugccacagccagugagggggcagggcuagcuagcucucaggagcuucugcauucagggccugcucuccuuacuacccggcuggcaagggacaggggaaggcaucaucccguucacacaggccauuucacagcaggugaguggccaggggcaggggccagcucucuuucacuguccucaggguugccucacccagaccaccagggucagcucugcuuugcugccuggacaagucacauggcccacucuccugggugccgccuccagugagagaugggagcagcucuucagugagggguggugucaauucugcacagccccuagacauccacgugguccccaacaguugcccugacauaucccuguguucucagugguacugugagacacagacauuugacacccacccugcugccguguugccacagacuuagauauagcccucaguggcagcuugggcugggaccucaccauggccccagguagcagggcugaucacucauaacagacagccucucccaagguucuaguuuguucucuguccgugaugcucaagcuuccccaccugucuuucuuucccuucagagcagcacauuaugguggcuccuauugcacauuggcugcaggcuggcaguccccugggugacauccucuguccacagugcacagcuuggcauggugacaagcgggugccuuuggccugccugugucaugcacucacaguuccugcaugguacccugcuuuucuuucugacagccaguucauugcuuaagguccuguguaucuguguggguagcugagaggcggcauucccuucuguacgcgguagaacuucauucauuaacuggcauccguuuucagucagugucuuucucuugcagagugcucuuaugccugcccagcuguucuucaagacugaagauggaggcaaauacccaguuauuuucaagcauggagacgacuugcgucaagaucagcuuauucuucagaucaucucccucauggacaaggugaacacaagucugcguuggcaggggcgucaccucgcuuuagaaacugcagugugucauguccauguucacagacccagaagcacuuguggccuuuacucacaaugcuacaaagcucagcagucuccucuugaccuugaccaagcuuauuuuugucacugcaaaguggcucuaauggcaagugggauugcgcaugccaguacaacauuuuuuuuucucccaagcuucaugguguugucagaucuacugagucagauuuuugcugacugccauuccugucucuggcuuuuagagaaaccugguuccccuuugccuuguguccgcccuuccuggcacuuucugucugggaaggugagcaugaagcauuaggaauaauagugacguuuauuggcagaguguaacauagucaaaauagauaaaaaucugucuuuucaccccaacagauuagcucacucuaacccugagaguuaauguguugcccguaagauugcuccugugucuguaugguaugcacaguauguguccauaugcagcgguguguguccacaagccugcuuccgauggccaucacauucauuucauguguuuuaucuuuuaaucaaagcuguuacggaaagaaaaccuggauuugaaauugaccccauacaagguguuagccacuagcacaaaacauggugaguuccuucugcauccugauugccuucuucagauuccggucaguaacuuugccuuuuaaauugaaaaaucauuaagaaaguuagaacgugugugagcuuauucagagaacugaaggcauacuggguuguccuucccaucuuccugucccccgaccuccaguucucuucccuuguccugucguacgccccccccuccuuguucauuuccucugucuucuuccguuuccgcaucuucccugucccacuucccaccucuuugcuuuuuacagugguacagggguguguuuggaagauacuugcacaugcacaucggaauaacacaccucccuaccuccugauuggcuguaguucauaggauuuuucucauagcugccugcacaguccuugggguguuucuguggcccagaaagucuuugaaccauguuugcaaaagucacucggugagucuguagucagcugcguuuacaguauggacacaugaacacauaugcacgcauuugagcacacacguaacacguagguguuugugguacugaacagcacuuccuacgcgcuuuacccucccuuccucucccacaccuguuuggaggugucaggaggacacccuucagccucuccuuggaacaaaauucugaaagcacaguugagggguuugugcccuugugcuuuucugcagcaguuuauuucucaccuuuauuugcuccugggacaaagaaaaagaggaggccaccuaagugaguugugaauugcugucaggccgcugcaucuguguccagcucuuucauggccacuacccugcuuucauaaggcuuugguuagaguggauccccugggcuucucuaaggcucuuucagaccgagcuuuaacggugugggaucucuaucugccccuucauuuccuagaaugcgucacccgguacugccccgcuucuuaaaagcauggcccaauugcauuguggccuuugauuucuguguaccuuggaucucccuucccaacuucauggucuccucucauuuaugauguuuauuuccguaaaacuugagcuuuaaguuacguauuuggagauaagcaucuugucuuucauaugugccguaguucauacuacaugauagaaaacuaauacaugccuguugaagugaguagcuguagcuuuucccucucuuuguacucugcagggacgcccugugcccacaaggugucaggaccaccgaauauggguccuguuugcugaauccagacaugcugccucacucacucagauuugcguguuuguuguuuauacucuucucguuccaggcuucuucuuacucuuacuguuuuacauacugcacccuucugggucuugguuuugguguguuguuguuguuguuguuguuguuguuguuguuguuguuguuguuguuuggugguggucuaagggguuuacauguuccucucugcccuucaggagaugauagaagguagaguuaguggucagaacuccacauuucuuagagggauuuuuacauuuuuacuguuguuaauuccucuuuguuuuaaaguuauggaaggcugcuagguuugagaaauauaguuuauuuguguucuuugugcuuauagaaacgcauucuagagcauaacauaaauaaaucaaacuaguugaaaaaguugccuaguaauucugugaccagcauaaaguuggcacaguggccacagaccuugcucugcaaacagaagagugcauggcuacagggcaggguaugcccaucggagccuuggcuucucuggcuaggcagcccgguggaguggagagcaucagccuuccugaugggccuggguguggcgagcgugguguuuaaugcauuacuauuucuuuccacguaggcuucaugcaguucauccagucgguuccugucgcagaaguucuugacacagagggaagcauucagguaaugacgucaucacggaauacucaagguugacgaagaaggacucuguuaaaagucaagacuccguuuuucuugucucugcaagguuuuguuuccuuaagauauaagaauuguuuguaguugaaaguuaugcuguuagucgguggaugcccaagccuuugaacugacauagcuaucuauaaacacuuaacacgaaaccuccccucccccauacgccauacagacuaaagcuuagaguuguguucuccuccaaagugcagauauacuaucauuuauuuagccaauaauucaugaacauguuuaguuauuuucaauguuuauucauaaaaccaguuuacaccaaaauuuuucuucaaacauccuuuguacaguugugcccauguuguggcaaauuuugaauuuggggaauuuuuuucuauuuuucuuuuuagaggucuuguaggggaauuaugcuuauuucauccccucagaagaaagagcugucuuccacaucacuuugccauuuuuccauccaaucccgcuguacgcccuuucccuguggccacacuagucguguccucagacugugugcuugucuguggaguugcuggaguaugcugccuuugaugacaguuugcugaagcaaagauuuccccugcugaguccagccaccgcugauguuuguagguagcuuagcagcucaugugucauuuauuuuuagauuugauugaauguaaagguugcguucacaguagucucaccuuucuaucuccaccccugaguacaugacagcgcccaucaggaagcucuugcaggcuccucacaaugacauuucuagcuuucggagucucagugcagcuuuccucugucuuuucuuugaagaugcaugugauaguccucccgcagagugcuccuucacaucacagcgcuccucuggggauguuugcauuuugaucaguguguaugagucaccacauauccuagauacagaucuuuccacacauucaugcagugucagaaagcugaaaacagaaggcugauucucaggucugcuacggaauucccaagucauguuguguguuuaaggcucccacuagaaagggcuucccuguggguaggaaggaaauaaccagaucuccaggcucuuguaacagcauguauuaccgagcccugccauugcuguguuuauggccucgaacuguuuuuugacuccauuuuaaacuagucgcuuuccauuacgcagaauuggguaaugccuaacuuguuuaccuguguuaauuuguaaacauguauaucauaucuuugcagaacuuuuucaggaaauaugcccccagugagacuggacccuauggcaucagugcagaggucauggacacuuacguuaaaagcugugguaagcguuuugggguguugguuuucugugggugcauuugagggaagcugguaguacugauguugcuguauuaacucauaauuacaacauguuacgauuuaaacguuuuauaagagaaaaaguaaaagauguaggugguaaaaggaauccguggacuuuugaaauggccauggugacaucugacugcuguuagucacagugggugcaggcucccucucccucacuguucucccaugcaggagccgauuagccccaacugaagacuuccuguugggaaccuuuaucauuaaaggagauggaaaaccucagucagaaauaauguucucauuaaugcugagcagcucuagcaguggcucucauggccuuggaagcuguuuguucucggaagaaaguaggaccaugcuuuggggcuuuuuauacuuuccugucaugugugucagucaccaugcagcuuauauucaugagcacuaguuuccuuuucuuuaagacccuguuguauaaugauacuuuuaaaggagggauuaaauagagauguaaaucagcuaguuguacauuauggggugauuggcaguuuaccuuauauguauuuauuuagauagucaccuguagcauaucaguuucaaugacaaguucuaaaugaguauuucagcuaagguucaugaaucuuaaguuacaaaaauaaauaaauaaauaaauaaauaaaaccccaaaaccugauaauuugacaaaaauucuugaagauuuguuguuguugcaaauuaauuucucuaguguucaggauauaacagagccaggggguggggugcagcuuccuuaaguugggggagaaauuggagacaguaaaaaccacguaggaauuaaaauagcaccuaucacucucauggucaauaugcaaccuaagugcugaguguaucuuucccacccgcuuguuuuccagcuggauacugugugauuacguacauucuuggaguuggagaccggcaccuggauaaccuuuuguuaacaaagacagguaacaagucagaagaagauggauucuguagugggggguuuccuuuuauucuagaaucaaccuauuaauauaauuugcacacuuauugguaaaguguagguccucuuaaaauuucuaauucauuuucuuucuguaugcguaugugcaugugguuguacaugugccaugguguauguguggaugucagacgacaacugucaagagccaguucucugccaaccaugugguccagggugauccaagggaaguugcugggcccauguggaaagugccuuuaacugcugagccaucucgcugagccaagguuuuucuuaagucccuugaaauggggcacaggaaggacacuuaggggaagcccggccuguguaagagcauguuuacagggagccugugagugacccuggugccccacucugcgcucggagccucuguagagagcagcugcuuguaggcagccagacgcuuaggagcaucucaggcugaauugguccuucuccugcuccugcccauuuccucagguuacaacuaucucaggguuuucuccccacagaggacaaggaauagccauuccuuucucccuucugcaugacaacuuguuugcucugaaaagauuuuucuuccucagccuccgagguacuaggauuuccggguuccagcccccaccuggccuuggcccagauccuuauaugcaguuucugaaccugcaguucuacaagucacucuguccauagcuucagcuuggaauagccacuuaagcuagcuguccccuuccaugacaccucccugcagccuugcucuccccucccuucccaucagcagguaacagcccagucccugaagccuccugcuccaccucacgauguuucccuuguuagcaaaucuguuccucaccuccaggaccugucaauagcaugccagcucuguauuuucacugucccuuauugaagccaccaacauaaaaucucccacccacaucucugucuuguuaaaucacugcugccucaaggcaagugcccucuuuccagaaaguucugugcucgggucucucuagggcacacuuugguuaccgucucauaugacuuaggauguccucagcacauccgcaguugucugacgucugccuuguccucugucacucuguacuuaccacuucauuuugccuuuuugauguugguuggagguguuuauuuacaccagcagguguguuuuaaguaccuguuagaugcaaggauccuuccugacugcccaucagugaucccaagucagcaugcaaggccuguggagcaggggccuugucugucagcagcaugucuggagagcggcagaaacacuuaacuaagagaacaggaaggucguuuggagcaauugaguuaaucaucucugcucuuccuuguaguccuuucucuaaaauaaguaaucaaaggcccauuaugcccugaacagggaucuuauaccauaguagacauucagagcuuuggguucucuguguagcugcugucucucaacaacugaugcagaaugucucucugcuucucuucccauugccagcguagccaaggucaggggaaugcucugccaaugacaguggcugugcugugcguagucagaggucccugucaucugauugagaggccaaaggcuucagauuaaauucgcagaugucgcggagaauauagaugggccagagaggaacugacuguggacucuaggcauguggaaauaggucguccacuuaaaguggaaauuuaaacauguguguaaaggcaaugugcugagaccaggagucugaguugacauucaucccuaaauuuccuuucuuagcuugaguacuuuuaacuugugugcaguuucccuaguugugcagcagggggcacuguauauccaccauuaaauugaaggcuuuaucagaaggccuuguagucaauuauaaggauuuuuguuuguuuuugguuuuuguuuuguuuuaguggguuggaauggaguuucacuuguuauugaauuauuaugcuauccuggagaaagcaggaagcugcaaauuuaaacuggcaugagauugagaagaggauuuuuuuguuauucagaguugaugucuguggaugaaaccauaguuuagccagggugaccagucaugguaggacuuguuuuaguuguugaucuauugcucugaugaaauaccaguuaagaagcucuuagaaaagaaagcauuuaaauuggggcuugcuuauauuuucagaggguuuuagucuguguccgucaugacagggagcaugguggcagggagcauggcacugcagccaggaccuuauuauaucuugaucugcagaaagcagagaaagagugggccuggcaugggauuuugaaacuucaaagcccauccacagggacacacuuccuccaaacaaggccacaccuccuccaacaaggccacaccuccugauccuuuccagacaguucuacuaacugggaccaagcauucaaacauaagucuaugggaaaaauucucauuauaccaccauggggcuaaguuaaauauggcuuucaaugaaucauuuuuauaucuaaaaacuagaggcagguaaucaaaauaacugaagaacuccuuugucgcuuaugauauauaauauaauaagccacagaaaccauaguuuagccagggugaccagucaugguaggacuuguuuuaguuguugaucuauugcucugaugaaauaccaguuaagaagcucuuagaaaagaaagcauuuaaauuggggcuugcuuauauuuucagaggguuuuagccuggaugcucggggucuugacuaaaugggaacacacuuacagguucucaaauagccuguccacuucugagaagccaguggugcuuguauccauuucagauccucaaagugaccaguuugaguggcacuggacacugcugaccuaaagggacaguuauuuaaaacaucuccucuauuauucuuaaagaaaagcugacauagcaguucagguaucugucucugaaguacgucucaggacucugggcuacuuagccuagucugugccucuuagcugagcacaguaagccuagauccuuguguuugugugcuugugugaggagguagugugguccauguguguuggugcuguaagcacuauggacuucccuuagggguaagcuguguucugacugagcuaagagugcccuuuuggcucauacugauaguuggaugcauaauuuuaaagauaagaaauuaccugauauauuuugauauuuccuuuuaucugcagcauuuuugaaugaugcuuuaacaagaacuugauggcuuaugagaaaauuauuuauucugauuauuuaguguuauaauuucuauguaucagauaagguacacuucgauauuucaaaacaaguagaguguuuaauuuuccuuugucgggguauggugugauuuuaagguuguuuuucuuuuuucuucuggaguggaacuugacuguggagucagguauacuauccuuguuacuccugguuuccuuaguuuaaucuuguuguuuuucauaagaagcucuucuuagguuaaaggggaaaugauuagcagauuauuaggaugucaguacugauuugaauuuauauauccaacccuuuguuagaauuacuguaaaagugguuccuuggccuuagcuggcuaugagacuccauuuaauaaacaucauugguauugcuacauugcuuauggugggcgugcagcuggccuaagucugagguucuuuacaaugguaucacuuugggcgacauuuuuguuucugaguuuacugauaaaacaacaagaaagguauagucacauaggaaagaaauaaaggaauuaaggggaaaugguaaaaugguugucuacagaaagaagcugaacuaaccauggaauagagugagagaggcagcccuacgguugggauuauaggggaucuuaggagguuagaauuuucagagcaggagugacagaagauggacagggagcaaacgagugggaugccaagcagggugggacaaaguaaaaaugacuuucagauugucugccauuaaauguuuaauuuuaguaaugugugugaaagaauaacaauaaaucaaauuuguaauagguuggugucacucaaccacauuuccuuagcagcucauuuacuaugucuuguagggucagaggagagaauuaccaugggugacugguuugcuuuguacacacuuuacugcuugcuugugugugguuaugaacgcgcuucuugaauuucuugauuuuuuuuuuuuuauuuuauaaggugcgcuuuuuaaauuuucuuaaaauuaauauccucuuaaaauacauggcucuuugaacuugugaaauucaacaacgguuucacuguuagaaccuacaauccaugcaauugagucguaaccucgaccugugaauuuucuugcaagcacugauaaacagcagaccuuggaauuccagcaguacuuauaaggaaaugaagaacuuggacaaggugcuccuuagacaaacgaugacacugguugaggagggaagauggggcugggcaucugcuccacugugagucccaggagaaaugacaccaugaacauguccauuuuuucgugacucggacagucuuuaauacugugugcgucccaucucuucccccuccuagguaccauagcuaccauaagagcagagugccuggacacaggcauccuaguuaggcagagggcggcacucagaggcuaagcugugacauucuuaucaugaugcccuccacccuuggauuguaagggauuaggaaacgugcgauuccauugagcuggacagguuccagcucccuuauuuugcagcagauugucauauuguuugaaaaauagccauauuuaagaaguuuccaaauccuuucauccugcuuggaggggaaggaagucuauuuugggauucuuaaaaggcggugucuuuuuguuuuguuuuagugcuggacuuaaagccuugggucuuuaaaccucuaugcguauacucuaccaccaaaucccagccucuaaaaacuuguuugucaauccuaagaguuguuuuuaugucaaguggagaugaaggcuucacaauauacaacacaaauuugauauugaugucuuguaugaguaguuugacauaacuauaaaucgauauuuauuaaauauuaugagcuagugaaauuuaauguaaugacauuaaugugucagugaauaugcuauugaaaccaugugccguccagugugacgcgguguggauuugggcagaucugucccuaugaaggugcuuagguguaugucacaugaaccccuauagauccacugucuguuccagucuugccgaaugacuggaaugaagugcaaacugucucugacucaauauaagugauguauagucauuaaaaaauacauuuugaauguauaguuguaugauccccucauuuucuguggcagcagcaaagagccacagcucgcagacaucugugugacccugagacuaagcaggugguccucugucgaauggguggcugccagagugugggguuggccggcuggguucagggagugaauuauuuuacuccucacauuuucauuuuaugguguguuugcagauuuguaaucauuauaauugaaggaacaucuggauaacuggccguucugucaguaucauuagcuggaaacaucuagaauggccgugcuguagauaaaacccucagcccagaaaucacaaggcacaucaaugcaguaaacagcaccauggcauucagauggacucggcugucucuuuaauacaagaucaaggaagggaagaaaggcauucaaagcaucuccuaaugacucuccagccucuaucagcagcauuuaccauugucugggcuauaaccggaauuaagagguccuugguuuaauaaaugcaaaacagaugcauugagaguuccugguacuagggauuuuccagguuucaggauagcaacaauagaauauuacucuugauuuuuaacuuuuauuggcucauuguaaguagaguaggggagaaagaugagugaacaagcuuuaguuuauaggcuuuaucucuaaugugguagcaacugcuuagggcaagucugcucugcuguagccugcagagcucaugagcuguuaccacaacugucuucgaaacaaagcaugcucccuucucuggggauaucagggugucuuggucuggaacuuaguccugucauuggcccuuuaaacaagaaauagccauccaaaaauaaaccaguuccugcauaauuugaccauuucuguauuuauggaaaggcuucgugugauggcucaauaaaagagaagcuugcuuuucuguguaaguguuuuucugugagcgcuguguguucugugaaccuuaggguaguucagauaaccauccauuccucccuggccugcucccucugcugugagguuguuccucagaccugguguuugcagcugagcucuucaggcacagucuccuuauuccuuuaccugaaaauguccagcuuaacuaaucguuuacuuuguucuucggacaaagaugcuaucucagugagggucuuacugcugugaacagaccaugaccaaagcaacucuuacaaggacaacauuuaauuggggcuggcuuacagguucagaaguucaguccauuauuaccaaggggggaacauggcagcauccaggcaggcauggugcaggaggagcugagaguucuauauccucaucugaaggcugcucgcaaaauauuuauuggcuuccaggcagcuaggaugaaauucuuaaagcccacacccacagugacacaccuacuccaacaggaccacaccuucuaauaguucuacucccugggccaagaauaucacagaugccuaaaaguuacagaaagggagguggcaucucuguaucuguaucuaauuucugucgucuguaaucuuagguacagucaaccuucgacucucagacaucuuuaaagugguuguuauuaacauuuuauuaucauuuauuuauuggccgacggugcaggugaaggucagugaguaaauugcuggggucuucucuccuuuccuccaugugggacucggugaugagacacagaucgacagccugccagcagauacguucccugcugaucagcuugccagccucaagaguuauuuuugagagaaguucagaguuuaauuuuuacauguuauuugaaaugcuuaaauauuuaugagcuacuugaagagacuugauuauugcaugguaaauggcuugauuuaauuuuaaauaaauccuaucauuuuaaauuguuuucuucuuuacagaacaaguuaagacuuuaaucaccccugccuuaaggguuuuuguuuguugguuggauugguaguuuucuugauaaucuccgugugucugugugugugugugugugugugugugugugugugugugugugugugaaugauaguggcaacuggccuuucaagcauuuacugagugcagugccagguacuguguuacaguguucucucuuuugauucuacaucugagguacuuguuaauuauaguugacauaaaggaucuaucacuguugcauaucuuucagggagaaugcacuuaacugugauauacacaauguguauaugacuucagugacuguguauaucaaugugcaaugacugcgacauauaaaauauacacauuuacacacucuacacaaugagugugacagcacucaggaaaagcagugaacaggaaggcaugacuaacaucuugauuaggaguccguguggaauauuggcuugcacagggucccuugugcucaugagcaauaaguuuaguacucugaggcagggccgguacccuugaugggaaaaauaaggugauaauucugaggcugcaaggaacaaaacuuagccccaaggcucugcucugagaauucagucuagagcauccuugcuucacgcagccuguaaaucacuagaugcuucaugguuuccauggugaaucaccacuaggaucccguuccuguggcucugcucugagacaguguaagacuuuucucagaggaauuacagcucuuggcaguccugaauaugguguucaaauccccagucuccagcuagggaacagguagaggaagccaaccauguaacuugaaauuugaaggauuuuuauuuuguagucauaguuucacagcaguaguuauagaaagagcaguuuaccugaccuuaauacacaagacaauuucuuccgaauuugcugcugccgauucuuuugaaaguuauuuggguguaugcuccuugauucugcacuucuaaaccugagcuuuuaucuuuuaauauuaacuggaauggcuuuaagguuuuuuucuuucucauguccaagaauugaacugcacuguacuuugaagggcauguuugaagguauagaauaauuuaaugaauuaaucauucuuucucaaaaaggcauuuugaugaauuguauaugguaucuccuuccugguuugcagugcuaacgacugugagacugacugaguuucuuguucacacccaggcaaacucuuccauauagauuucggguauauuuugggucgagauccgaagccccucccuccuccgaugaagcugaacaaggagaugguggaagggauggguggcacccagagugagcaguaccaagaguuccgaaagcagugcuacacagccuuccuccaccugcgaagguaagguccugcgcuagcuguccacgugugcugcuggcacaucuuucucagaaagacaggaugcuuuugaaauacacauuugcuacauagaauacaaugccaguauccaagccuauccugcuuucccacugacugucacguguguaaccucccaguugagaugcugguguuuugugagugggagauuuggcaaaccaagagaaguuucacuucacccuuuguccccggaggcaguggagaugagcauggcagccacggcaguggcuuagggacagucgugauacuccagccguuucguuuucuagcauuugguccagcccagcuuuggaugcuguucaggaccauccagaaguuuccuuuuguucuccucacugccucguggcucacgcugcuuugaagaaggcugauuucacucguucuuucuucuucggugucacucuuccaucuuucaucacggcuugauuaaaaacacuagaugacuuauguucucaggagaaaaggcaugcacuugagcaugaacagaacucugacucuuagucaaaagugacagaucauuggacucuuaaccaccuaacuaugcaaaaggaauuguccuagugcagcagaaauucuaucguaagacaugccgacauucucuccgaggaugugaggagggcggcugcggccagccugcauggucugugucacuaaccuuaccauguucuuauaguauuauggcauccacaaauagcagcaguuuuauuuuugauuuguacauauuuauuucucuugccuuguucuguuaguuagagcagcuaauacuaauuaaacaagagcagugagagcaggcguuccuucuuggacccuacuacaguauuuagucuuaugaaauuaagaacaaugcuaacuguaggguuuugcuagaucuuucaguuuugucuauccugcagugagucauguguuaagcggcacuccuaggggguucuauagacuuuuaggaggaaucuuuaggugauuagucaugagcccugugacccugagaaagagggcaggcaagaggucacaugcugauagcuguauggaugccugagaacgcacacacugaaagcagaaggaaucagugugcuuuauaaagugcuaguggaccauuggcagcagguagguagagugagaaaauagaagcaaguuacuaauguagagcugagguucugccgcagaccagccucggucgcccccccucaaucugcgggagauaucaggguucugguuacaggcgagcaaggaguuggcaugggugacaaacagacauggacacagaucgagaguguaucugaauuaauuucucaaaagcaagcacuagucuuauaauaccgaagaaaaacaagaaagcuaggccaauacaucugccaagguacaucugacacaaaacaaagaaaauacguacagaaaaagcuagggggagcuaggccguguuuacaacugagaauaggaacaacccuuaauuaagaucagcuaaacacaggagccaggugaguugucugagacuaugcuagucuauuguuaaacccaccaccagggguccucuaguaaauaccugauuacgcuauucuucugggccuagugaaaaauaugcaccagaagaauucuguucuacuaacccuuucaugaauaauacuucaguuccuccuaaaaccacaacccaccugcuuccuaggccauuguauauuccuguguauggaagugacuauuguucuaaguaauuacuauguagaccagcccugagcuuucuagcucuauucaaguaaauuguaaugccuguuuacuuuuacugucucuacuagagguaaauuugaauguuacugaauagauaacauucuuacugaauuccaagcucaggguuggcuucaaggacuuucuaggacauugaaacacugauggaggcuaaucuaacuuagcuauaugucaaaaucaguccuuaaaggcacuuauaauaaaacaauauugagggagagcacacagauucauacaccagacuaacguggggacaggauuggagcauacgugcuauaggaaugccaaggauccaggaggcuaaguuuccaugaaacucuuugucucaggacugcuuccaggcuucuaggccuaucccaugagucacuacuggaguggguguagcaagguucgcauuccuucuaagaaauaccacaaagacaaucaauggaagggaaauagcaucaucccacgagucacucaugagaaaucccagggagucgaacaauaauuucagcaagcaggguguauuaguuagggcuuuauugaugugaacagauaccaugaucacagcaagucuuauaaaaaacauuuaauugaggcuggcuuacagauucagagguucaguccauuaccaucaaggugggagcauggcagcauccaggcaugguacagaaggagcugagaguucuaugucuuuauuuaaaggcugcuaguggaagacugacuucuagccaacuagagugaggaucuuaugcccacacccacagugacacaccuacuccaaccaggucacaccuauuccaacaaggccacaccuccaaauggugccacucccuaguccaagaauauacaaaccaucccauacaguaacgagcgaaugcuuacgccugcugucuuggaguuaauaauaaucauaaaguuacaguugucaccacuuuugggguguucuugauaaggcaaagaaaucuaaaauucuaucucacugauuucauuuucuuucuugcuuuuuuagguauuccaaucugaucuugaacuuguucuccuugaugguugaugcaaacauuccagauauugcucuugaaccagauaaaacuguaaaaaagguaauuuuuuuuaauauaacacaguucacauuugacauauaaaaguggguaaagaauuuaacagugcaugccuucuuuuugucccagcccuuggaccagugguucccacccuuccagauacuacagccuuuaguacaguuccucauguuguggugaccucccaccccaaaauuacaguuguuucuacuucauaaugguagcuuggcuacugugaugaauucuaauauaaauaucagauaguucgcaggcagaucaggguccugagcuacagguugagaucuacugccauagaccauugaguauuaacagagucuaaggaagaguccucucuguacauuuagucacauuucagaccagcaaacucucagcucuucuguggcaauccuggucaguccugucuggauucaucucuguacccauguggguagcuccaccuuugccauugccaacaaaaugccugacuugguggaugcagguggaacaugcugaggcugcccuaucauggagaugaagcugucucuauagccccauauguccucccucuguuuuggacuuuacuggaucacuauagagcccugcuuuuaguuuucuuuguaaacaaccuauagagaugacagguaggauccgccaccugugagcagcagcagucagcucaaugucuuaacgagacuuggaccaggccguggauuugaagccuuuccuuuaaucugauuucugguaguagcuucagaggagagcugauagaagagugcuuuauguauccaaagggaaaaagaugauugucaguauucaacuucagagaaagacugcagcauauuaacucagaaaagacuaaaaucuccgaaagacauucucuaagauagagcuagcugcucaggauuuaaaaguggaggcugacaucaacagauccuaugucuaauggaauggacuggagaauuacguucagcucuaacugagccagagggaggucaguucuucccuuagguggcuggcuaagaggaguuugaauggagguauuuuauuuagucucuucaugaaaugaacuccuaagaguuccuguuuuguucagguggaugacacauuggccuuucuguuuuucuuccuuuacccagucugcacuauucagaggaauuguguuuugugccagagaagauaaccugaguagguccugguuuuuguccuuuuauuuuuacuuuacugaugagggccacccaucaggaaauauaacugauugaugaaaauuauugaguggugaaggaugccugcaccaggcuucaagugacuuggaguucuguuuggaucugcucuauuaaguaucucuuccguaguguguuucaagcuuguuuauaugaucuccaucguguucacucuucccugaguguggacguucagaagucaucugugagauugcaggcaguguuuaucagacagggacuagacagugguuucauuggcggugguaccuuuggccguuuaagcuguaccauagacaguggcauccuuggccaguucuaguuuucacugcauccucucuugugccaccaccuauuccaagaagucacagggcuuccuuaccagauguccuuacagugcuguuuuaaagcaugaaacaauucccuuuaugaaaaaugagccaaaaaagcaaaucuguuagauauuuucuagacuaguaauuccuaccacuuuguuucaguuuaauagaacuuuaaaaagcauuuugucauauuuuuucaaaacuguauuuuauaacagauggguuuguuuucugaucuuuuauccaaaugugaaauacccaguuacaacacuugaaauuuaugugguaguugacuaaaauuuuuugcauauuaggugcauugcuucuuugaaaagacguagauuuuugcugagguaagguggccaccacuauuuccuuguguuauugauuaaauaguauacuagcuaugggaacacagaguauauaagaggcaguuuguucacaggcgugagggucagauugcccaagcgguccuaacauuuuguguuuagcuuuguauaggaaguaacaacuuuuauaauucuuugggaaaugguuccuugcacuuaacaguuuguuauucagacugcugugccuggacacacgauggcucugaaaucugaaauggaguuaacagggcucaaccccuaaauaugggccuugcccuuuaaugaagcagccgagauaggaaggucucugguguggaccuuccagaauucgcugaucuucaucuaaaguaagccauaaagcccucaguucagaaagccuaccacaaacugggggauaaggauagaaaugguaaggaagccucagggugcucccuguccucaucaggcuggagaggagaugcauacagcugcuccuguuccugggucaucacgcugugaaggaggaaaggguucuaacguuaccagaacauucuuguuuuggauaaacaugugugccuuucuguuaauauaaauacuacauguuauggauaaacgccuacauuccugaacauuacauucaguaugaacauuacauauuacagauacaugugugucccuuucuauuacuauggauauuacguuauagauacaugugcgcaccuuucuguuacugugggcuuugcacaaagguuauuacccugaagcuugugugggaggcucccucuaccugcaagccagaaguuaagcauccuaucaucagcguaaacagaguaccgaguagccaugggucagucugccaaagaaagcccagguagaggaaaagcucacucaaagcugucauaauucuuucaagccaguugcucaaagcugucgucauucucucaagccaauuacuucgaauaaagacugucagauaguuuaauaaauaaaaaaauguauuuugauaaaguuuauuuuguuauuaauauaaccaaagcuuagugaauuaaauuccagcaaugaauaaguagauccuuaguugauuacauaagcauaauaugcuuauuuaugaauauuaaaauguaugugugaaauacugaaaucauaugaaaauaaacacuuucggaauagcaagaaaguugaauagguaaaguuauuugccauuaagccuguugaccugaguuugauccccaaaaccuaaauaguagaaggcaaaaguugauuuucagaaguuaucgucugguuuucacagcugcaugcccauacacacauacaugcacacacagaugugggagugugcuaaaauagguaaacaagcaaacgaacacacaugcacacuaggaagcugaggcagguggauuugaguuccuagccagugugguuuauauagcaaauguugugccaugugggucacguagcaaaacaguaucuuaaaaaguaaaaagaguauguaaauugaaaacuaaaaguauaaaacaccuguaugcuguuuggccuguguuaaggaccugauguguguagaucugcuuuucugaagugagcauggcucgccugcaccaggcugcuccagcgcuccccuucccauccccacucccuguagacugugagcagugcugauuuguuccugagguaguccugguguuugcuugaucaagauuaguagaaaccauuucccugugccagggaaccuaccuuguaaucacagaaucagacaacaaacagaauacgguucguaaaguuccaacuuccuagacggugguggaugcuucaggugagagaagaggguggggcagcacacugagcuggcaguaacggugaugugagguuagcugugggagagacacaaagucuuggugaggaaauugggaggagacauuucauaagcccacagcacugagaugaaacuucuuacuacagaggcgcacaucacuuaagcaaaacgcguacucccuaacaggccuuagcuuugugacuggggaugguagguugaaaagaugaccuuaucuucuaggaguuugaaauguuuguuccuagcuuuucaaauguauagcuguuuuuaguuggagggagaggacaccaaaguggagauauuaauggauucgcauauaaacauggcuuagcagccuuguuccugcucccuuuauugccauaauuaaagagaaaccucuaaauucugaugcugagccuauuccagaauuuacgguacuguuuucuaucggaggauuuaauggagacauucuuucuuuaaauugauuuccuacuaaacuuuaaaacaaagaaauuauauguauuacaagaagccauaaauagaugacuauauuugagaugaccuuuaaaaguaaauuacccaugguuccugugagguugcccauggcuccugucggaucagccugucggcucugcagcacaagcucuuuugcaguuugggaggcugucguuggcuuguacagcagcuccugucuuuguaagcaguuccaggcgcuggcucuccuguagccacgguuagguggggauuggguuuuccuuuuuuuccuuuuuuccuuuuuuuuuuuuuuaagauacucuuuaaauccuuuucuauuacacuaaggaguuuuggguuauauaucgcacaaauaaaugagcucagcagaaaaauaaguuuaagccuguccuuucuucuggcugagucaacuguguuauuucaccugccuuucuggauaagaauuuagugaggaaaagucuacauugcuuuuaauugaaagcugcugugugugugagaaauccugaacauugguuuuuuaaacaaagguuuuucuauauuagcuuguguaaaauugaaaacauaaaaaaauacuuaguuuaaacaaaaccacugugcuucuuaauaugaaaauguguuucaguaguuuauuggaaauuuccuccaaauugugugugugugugugugugugugugugugugugugugugugugauugaauauggcaaacuuaggcuaauucugguauaguacaaaagcuuuuagcuaaucuauagauguuauuuuauuagauucacauuuaauuguucucuauaaauaaaagacagaguuuuauuguuaguaggaacaggggaaaucaugucauuguuuagagauugcuuauacaaauugcuuguguggccugaugcagguuagcgggagucgaaugcuuuugagguugcuaggugcaucauucggagagggaugugugcauaucccaugcaggcaaagacacuaggucuuuaacuguauuaugcuaaagggugacugcauaaagaggcuucaugguuaaauaucuccuacguuuugccugccucuguuggcguuugugggcuaggacucuccacuguuacaguuacuggagacacuguuagauguguggcccgcuguugaguagaaugucaguguggcacagaacuggaccuauauuggcuuacuuaugcuuuuggagcguuugagcaucuguuaaugguaacgucgacuccucaaagcguaauuauccacugcagaaacguuguugcugccuaagugacugucuuagagagguugcuuguuucuugcaaguaagugguugaauggaucugcugugguccaggucacaaguagauuuucaggaaccaagcacugccugcagucccaaaaugaagaaacacucugaaugcacagagucuuuuccauguucucauauaacucccggacugaccguuagaggacccugauucacaagugaccaagaaugcaaguggcacuuacaagacaagguacaaguacacagaacugaguuucuagcaucaagcauaagcagacuuguuguguagcaguggauaaaauuucaguuuacaacuuuuugcuucuaggcaauuuccagauuguuugaguagguauaaguuaguaaauaugcuuuaaacuaagccagguguucagcaguccuuaguguucaguguaaccucggccaguuuaacugccugcccacuaggaugaccuuucacaucaguacaacacaauuuuacagucucucuccauaccgucuagacuguauguuaauaaguauguuagcggauaggcaaacgugacacaaagccggagaacacagaagcagucucugcagucucugcaguugcacacgugcucacgugcacacgccuaaggaagagacacuugcggagugcaggacugcgcaugggaguccaucaggaaaacuagaaagaaaggccaaggacaaagugaaaaccagagcuggaaguguggcccgucaguguuaacucccacagccauaacagcaagguguguguuguggcaguuuguggaguuacauagaugaaggagaaaggauacaagcuauagcuugauuaguuagcugacucuugcaaagccagaggacaaugacagguggccuagcacagccagggagagcaaugcugacugaaugcgcaaaacuucuuuaaagaagauguuucauauuucguaaaaagcauuuuaugcccauuauguuuucuuucuucauguaaguaugucaguuaagugcacaaguuugauaagguaggcuagaguuuuauuuugauccauuugcuuucuaauuauuguuaauguucuugaaguaguucuaauguugucagauguccugccacagaaaaauaugaagagcaaagacucaaacuggaggagacccagaucagcccuccaaagugccagccugucccugaguuugcaucuacuuuccucuugcccuucucuccugggcuauggaguaugacaugccuccauguuucaaugugcugugucuguggguaguuaaaucccauaaaucgcacuuugccuuuucuaaugaacucagugagggaccaauacucaaaccaaagaaacagaaagcacggggugguagaacaggauuagggugcugucugggaagaggaaagcaguuuacaggaaugaguggcagcuaagcaggcaauggagggcaaauuugaugacuauacagugcugugaaaaauaaaaggaaauaccaaauuaaauaguauuguccacuugggaaucuugcuuucucccauucuauguugaaggaguauaugugaauuauuuauguguaugugaguuauguauaugugagcaguaaagugcagugauuaugugcagggcauaagccugucuggauacacacaccccuuuaccaguuacgaguuccuguggcaauuuccagcaugcuuggcuucugaagacaaacauuguccuuaguagcaccuuaauaaagucaaauaagagacuuuauagacugcuuacacggguuuuagccaaaauaauucuucagucacuggcuuuuauguuuucagaaaaacacagguacaugaaaacucaugcaugcauacacuuuauucuucuaguacugagugcuauugaaaaugagcaaugcuuuaaaguaugaauuuaaaaacccacaaucccaucuuuggacauuauagacccauugaaauaaucccuugccaagguccaaggggcugcugugggaaaggcuuuuuuagaagaucuuuagguuaccagggguugacguaguugcugugcacuagcaccagguguaugcaggccagggcgauaauguaauaaauaugcucccaccuuauugugucuauuucuguuacauaguaggucuugagcuagaauguucaagcagaaagugcaacucugagcuaaaguaauagcauuucuggauuuaaaaggagucagugucugauugggagagagcauucagagcuccugaugggcauaacucuuggcauccuaaugaugucucuucagagcacauuccugacucauucauuaaagaacuugauguugucccugguccucuccagguucaggauaaguuccgccuggaccugucagaugaggaggcugugcacuacaugcagagucugaucgacgagagcguccacgcacuguucgccgccgugguggagcagauccauaaguuugcccagguacgucccaaaggcuuagggaacuuuggguggcauuuggucuuuaaaaacuucucuggugaggccagcuuaggcuaaagggccaaacaccagcuaaugucuguccaggagagaaaaucagcucagguaaggacuaaccuagacauguguuaccauucaugccauuucuauaaauaaauaaguagaaaacaaaauauacaccaauuuuugaacacaccauuaaauauccgaaguaauaaacauuuccacaaaaccucuuugugaauuuauuauuuccuucuaaaaauaccuacuggacuuuacuccagccgaggucaugagugggaacugagggagcuggucuguugaauccuggcuguuccucgugugcuaaguaguagagauuuuucuaauguuuauauuucguuuuuaauugugugauuuagcauaguauucccuuuggggggggccauauuuuuguuuguguucugugcuuuuggaguuucccuguguauauauugaugagcaaaaccugauucuacugguuauauuaaucaugcuuaccauggaguucgaagccauauaucugacaguuguuaacugaccacauucucagccaaacuaucauccuucagggugcccggugcccagacuccucucucuccucuguaaagaagcagccucauuguguauaauaaccaaucuguuugaaagcggaggcaucagccuguuuucuuuccuagaugcaaaauaacuguagaagacaagcaguagaugcuguugagaguucucauuaugcaguucucauuuuaccaguaagauggaagaauaggcauguacaauuucucccagacaaaauaaaaugcugaguucuuuuuccaaagaaagucuucacuaaaacccacuuuuuucuacauuuagaaauuuucugaagagccagguuuucauuguuguguggcagaagcagugguaugucagcccguguccuacauguauucccagugcacucagcuuaucugaggaggaauaacaaggcaguacucauauggcugagaaacaguaacgacggacccagcagccaccuaucggacaccuauauaagccaccagugaugugcacucuguguuaccuuguuugaccugugacauacguucccaucugguaaauugaggccaauagguaacgagcucuggguccauaacugucacuaaagguuuuucauggcuauauacgcgaucgaggguugcucuauuagaccugagcagaguuuguuaugaauagguuuuuguuauuuuuauuauuuacuuauaaauaaaaaagaaauauucucaucuuuucugaucaucagaaauaaaaacaaaguaucugacaugaauuugcaugccuucaaucucaacacuucagaggcagaaccaggaggaucuuugugauucgaauucuuuuaaucucaggacuugggaggcagaggcagguagauauuugugaauucaaagccaccaggacagccagugcuagauagagacccuaucucaagaaauaaagaauuuaaauucaaaauuuuuuaaauugcucaaaaaaaucacaaaaauaugcacaugaguugcccagaauaguuaaucagaaauaaauaguauaaaugcugaccaccuugaauucaccugaugggcauagccuauccugacuggcucuggcccgugcuuuucucuugacuacagucagcucugaagcuuggcugccagucacuugguacaugguggaggcauugaggucuuccaauugcaccguuacugugauggcaguccccuaccuaucugauggaugccugcuaaaauucccucgauaauuuuuuucuuucauacaucuuccacuuaucuguguaagaaagguuuauaacacuuccauucauaugauccuggaaauuccuguccucuuuuuuucacuguucuuuuaaguaccuauucagucuauuuaguguuuucaaagcuaacuguuugacagucaguucgaauguucuucuuggggaagcccaccucuccuguguccaguguuccucaguugacuauaguucuuggugugggugaggccucgugggcuuuucucacguguuuguuggcuucaccuuggucaggucacguuuggagucaggcugguaagauguugugggugugacuucugauauuacaaggagacacaaucucacagcguacucccugagccuuaggucugggcuggcuccggccccuuuaaagauaguucuucaggugucaggagcugaauguuuggauccagcucucacgcuuaguagucucaauuuuucccccauaggcagacacuuuugaaguguuuaagaaagcauuugagaccaucuguucagucacaggauuuuucucacacacacauaaaaacauacagaaacaugcguggggauuuuacuucugggaugcuuccaggaucuucagacugcuagcauggcaguguggguccuugauaguuugucuuuaccagcauuuucaauauuuaaucacgugaaagcauuugagaagaacccuguagguuucaugacagucccucucuucagagucucccugacuccugugcugugcccggaguacagcuccugcuugugaggacucuagggauaucuucuucuucugggcugccuuggcuggccccaguggaaaaggaagcaucuagccucaaagagacuugaaaugcuaggggauggggauacccaggggggcuccccaccgccucagaagagaagggggugaccuggaaggggucagugagcaggauguaaaauuaauaaguaaaaaggaaauaaagaaaagaguugaguucaagaguaucaggaccucccugcugggucuaaagcauccgccaggauuacccauugaccauaaccugcuucuugccuugugauucuguguauaucaaggaccauccuuuagagaguucauuucuuugauggauccuauaaugaaaauauuuaaauugcuucugaaaauguaaauuauuucuuucauuagcauaaaauaaacauuucaccauauucuugcuuagguugauacuuauaucagauuaaauuccaugggaaucucagcaguaggugucugcaacuguaacucuuggcaguaagaucucucacugucauuucccaugagauggagucgauaggcacuaaaagcaugagggguauuggugauaugggaugcgcccaucuuagacucagcuguuacugagcuguuugcuggcuuaguucuuucagaauugcuuuagcuuugguuuucagaccaaugcagaauucagcacuuccauucuggaagacauggcagcuagcuuguuguuggcagagcggggcacugagagcuaaguguacuauuugcagugugauuuaggauggcccgccuuccuaugcuggguggagcucugcuuuucucuccuacauaacaauuugccaccuugggcuugggcuugcagugaggcagcaacucuucccccaaguauugucucacguaagugauuccugccagccuugggaacccaugcacagccacacaguccugauccucuugggagguuuagcaaaccuuuuauugaucguuguuuaaucuuucuucauaaacagaaaacuaaauuauuuuuuguuuguuuuuaauuuugauaguacuggagaaaaugaaaggggauuugacccauccugaugccuggcucaauaagaaaacacaggagaagccacugcuguguacuaaagacaucaaagaaagaacaaggaagagaggguguccagaaguuacgucgugccugggcuuuguguccuugcaugccacugcuuaaauccagcccacaggguuuguuuaaagcugcugcagacagaguagucgcucaucucuaauuccaaaacucuggaggccgaagugugaagagugacacauuuuugaagccacccucagcuacauaaugacuucugggucagccaaaaaucacuguauauauuuguguuauaguguauaaagauggaaagaggauuauguauaugaaacaguaaagcauuuuacccucuga

SEQ ID NO: 12569 - RNA, 101208 nt, Mus musculus
uaccuugggggagcuucgggcgaaggcccgggagcagcggaccgaggcuggcgcgaugcuguucccggggagcgcagucggcuaccguugaggaagguggagugaggaguggcccuuccagcgcccccuauguacgccuuccugcgcucggggccggucgccgcguugcccgccuccguaccgcccgugacucucggggcccggagcuccggcggcggccggggucgagucccgggggaggggaggcgcccgggcggcgcccgagcuugcggccgcggagcgagcgucuggcaggugagugcggcugcgcgugccggcgacucccacccggggcggcugcgcugggacucgaccccagccgcccgguuccgccgcccuccggucugcacgcuccugacuugccccgucuccggccuucugcuggccacgggcucgcagguuucccuccccaguccgcggacggaggucgcgacucccgccgcccucgcaccuuuccuuaccucgcaggcagccucgcccuuacuagcagucuucuguccgcucuaggugcgugggucguccagcccauuucuuuucgcguucaaccuuuaaaaaaacaaaaaaccaaaaccugaguucugggaggauugucugagccugacuuaugggguugcagaggaaaggcugguuguucagaggcggaugugaucugguuuugaguagagucccgguaggcugggauggguagguuaagagcccgacuccugccugccuaguggagucuacgauggcaaaccgauuguucgcuuuuaaaucauuuaucucugucauaggcuuuggacucagcuuuugagacggaagcguuagguuuuguagauccauugaaagaauuggggaguguuauauuccuuaaaaaacaaagaagaccuuauaaauguaagauaaugccuacuggcacaagggaggauuacuuucuuuagguauuagccuaaggagcgcauagaggcuuuaaaauccuaaugugcaagcccuuuguuguuuugcuuuguuuuuaaagaaaggacugauggaaaaagcguuuuaaauucaaaacuacucaaaugucuuguaugcucgguuguuacuagugcuuaacagcacucgcagcacuugcuagccucuauaacgugggguugugccaaucucagcugccccucaaggguagucgcgauuuccaguguggaaaaacuguccugaguaacuuaggagccuugccaaaguuugcaagugcaaacugccccuucagaguggcaguggaggaagucaucugguaguuugucgccucugacucggaugugucaagagccccaacgugggauuaaaaauacauagaaaaugcccaaugagauugcaaaugagugggguuuugaaagcugguuuagaagacugaagcauuagcucagugguagaguacuuguaagacggacucuguucauucuccaggauuguuuaaaaaaaaaaguuaugggggcuggagagauggcucagagguuaagagcacggacugaccuuccagcaguccugaguucaguucccagcaaccacaugguggcucacaaccaucucuaauggguucugaugcccccuucuggugugucugaagacagcgacagugugugugugugugugugugugugugugugugugucuuuuuuaaaaaguuacgaauuaaaguuuuagaaauagaauugcccaccuuaaaagaagaacucuuuuugaguuuuauaucucauuuauuuguugucaguuucucucuucuagcacugaagacugcaugcucuuaggucugccugucccuccagugcugugcuuuccuuucaguuuugaagggacaagggggaaguggagccuucuaaacuuaguggcugagagaaucccagcugucugagguguaccucuuccaucagcugucugaggucuaccuccugcguuucccagacaagagggaaguggagccuuguaaacucaguggcugagagaaucucagcugucuggggguguacuccuguguuucccagggcuuuuuuuguuuucauuacuaccuccuuaauugcucauauuucagagcugugugccuuugcaagagcaacccucuccaucucucucuauucagaucuguccauuaucacuauuuggaggccucucccaguuucucccucucugugcuguaugcauguuacuguuuucuacugagcugccagauacaaaucuggaggcacuuccagauuccaaauuucccuucaggauucucccauccagggacucagauguaguuagacucuuuccuucaguuuuggcuuugacuuguguuaaaauuauuuacuaguagcuguggucauguuaccacuuagacuucuguaucuguaauaccuugcacgguggaucuagagggagugaauguguuaaauguccaugucagugcuugccacauccuuaucgccaucuuuuguuuucacugugaugucacugugaaguggaagucccuuagcguuccacugugcuuggggccaucuugacagggggucaguagguaaacgggccgucuuggaaccugacagcuggaguuagcucuccaggacccaugugguugaaggagauaaccaauuccugcauguuguccucugaccuacaucauacacaauaaacguaauuaaaaaaaaacauuuaaaaaaaucacuagagaacacuaagcaccaaaccuaauggcaguuucucugucaucguugguuacuauaggcaauuguaaauuacauaauacucuguaguaguaaaugacguauucuuaguguucuccaguguacuuccugguuuccugguccucguaaguucuuugcauguccugcccucuuucaacuuuauucuuuccuuaucccuguaucagcuaggcugcgaauagauucacaaacaaagggaauguaauuggccgaugcauauuuagaagucacaugaagugugguuuguuuagagaucauguagucaguacuaaaaguccauuuuucuccuuuuuuuuuuuuuuaaacauuaucuuccuguuugaguucuuugcucaaacuugcuucucuccuguuaacaguguucauguuauggccuucauuuacugccguaggaaguuggaagacuccuagacacagcccagaguccucagcucuucugugauagggcgagcacagaucgauguuaagucuggagcaguauccguuuguccugagggcggaaggacugcagcacagcauggggcggagugggucccagacagggaauucaagucaucgagccuuuguauguucuuugguguguuuucuugauagaucaugccauucuuuuucuugaugauauaaaucauuucuguguggauuguccugauuucuggaucucuauucccacuaccacuguuugcuggguauuccuaucuuagaugugcggcuaaaauucacaugacaacaaaccgaaucaguuucgugggcaugcaucucuguccuaugguguguucauauguguuuguacguuuggcauucucuuccucccuauuucuuguuguaacugcuuucucuaguccccagucuugaaccuuauagucagguaggcucuucuccacugccggguagucaucagcucuuaaccacggguuaguuaggcuccaaguuacagaauacuuaacugggugauuuaaucaguaucucacauaaaaagaugaucagaguuagacggccucguggcuagucaauguagcugcacggaagguucucgagggcccaucucucugacugacucgucuuaguguauuaaccuuugaacauaggcauaugccgucaugguucuucauggcucccuuuuuccagguaucacuuaauugucuuugguagccaaaggcaaaggccucuuaucucuuaauuagguaaguaaaucucccacaaaaggccuguaucaaucaggugccucuccuaacuguaauauuuguagcugaagagagacagaguguccacggcauacuucuacauuguucuguggagagauaaauuuuaaaaagagaauuugcuaaugacaguagcagcguaaagcacuguuuagcugugcauuguuauaaaccauacauagacuauuugccaaacauuuugauaaccauaaauaacuguuuaaaguagauucuuauggaaaauuugcaagaaucaaauagccuguacucucccugagcuuacauuuuaguugaggacauggccagcaaacagcguacaucuauguacaggucauacuuaggcuuugaaguaaaucaaauggguuccagugauaaaacucaguacucuggauaagucuuaaaaggacuugaacggaggaaguaguggcagagucauggaaggggcuacuugggugauggucuguauuguccuugccaccucagucccuguuaauguacuuauuuauuaauguacauuaauaauauauauuuuaauguaugcuauauauuauaucaauauuauuuagaguacugcauauauuuacugaaucuuacauuuccuaugaacuuucuauguaggaucauuuuuacuaaucauaaagaauaugaagcucauacuuuaaauguucuccuggcugcuugaaaggucuuuguuuuccauucuucgguuuuucgagacggcuucucuguguagcccuggcuguccuggaacucauucuguagaccaggcuggccucaaacucagaaaucugcccaacucugccucucaagugcugggauuaaaggcguggucacaaugccuggcuaacgccauggcucuuaacauuuucuuuuaaaauaauuuuguuauguccuuuuaaggaaggaaaccuuuuuuaacuuuguuuuccacuuuauuguucugugauacaguauucuuuggacuucgugaauguauggaucaguucuuaucagucccacacauuugccagccaaaggugauucagauaaucaccuucaauucaguauucuccuuuguuaauuagguucuucauugugaugauuucugccucuuaugugcccugcccccucuuauuuucucuuaaaggcuuuauucuggacaguuuuguccuuaaaguaucuauuuuucaucuauaucuaauauuugaucacucauccgauaagugcuuaaguuauuuuuuccaaauguauguaacuuuuuauagucugcaguuccauguauauauaugucauauaugacauaugugauauauauuauaugucauaugugugugugugaaacuuaguuuggccauuauccucgugaguauaauaauuaggaguuaauuauaauaucugucaguuauaauaaucugcaaacuccagaguuuacaaaucucuacaucuguuggagaacuaauuugauauauaggaugaaaauaaucuuuuugugaagauuuuuaugugguaguaucaagaguuuggggcugcaagaccaccuuaaccaaauuucacauuguuaacucugccagacuaccugcuugacuuacaugugaucaaaggucacgaucucugcuaugaugugaauguggggaguggccugaagaggucauuauuaaaggcuugguccccaaggugcugcuguuaggcgcuguaaugugagauguugguauugguagugucuccucaaaggucacuuugcuuuuggggcucaugugaugagcugcuugcuuugacuuauguacacccaccaucuugugcugcucaccagcguuccagaguaguggagucaagagguuaugggaagcucuucucuuugugcuaacuucucaggugauuguuggaauggcaaagcuccguggucuccuaguucuuuguuaucuuaaaauggagggacccuugagaaccucggucccagagccaaaguuguuuuuacuauucuuggcagcugugucugggacucuuaguuugguuagcccccagucuugcagugaaagcaacauuaaguguuuguuuguuuguuuuuaauaaacucaccaaaagcaaaaguugagaucacuuuucugaguugcagcuuucaguggguuugaacuguuuacuucucauuauguuagugguuacuuggugcuuugaaggagauuguuuaguaucuaacuuaaaguuauuuucagagcaaguuggucugaauugcuuguuguucaauuuccaaagaaguccagacauuugacaacauguuccaagaagaccaaacauucuuuagucaucucuuuguguuaaucccucuuuguggcauacaugagagacucaggaaacauaaaaacuaacaugcaguuguuuucuuaauacucuauguuuguuuuuugagacaggcucucucgauaucccuggcugccucuaacuuggagauuccccugccucuguaauuagagaucugagcugagccacucccagcucugauauauguuauuugccagccuaguuccucugcagagcccaaggaagggaggcaggauacuguauuggauuguggucuaaccccugcagacaugaugugaacauuguaaagcgggacuuugcagggauggagaggacgagcgcugaguuaccagggcuugcaaacaaauugcccuuuaggguuuuuuuuguuuuguuuuguuuuuguuuuuuuguuuguuuguuuguuuuccgagacaggguuucucuguguagcccuggcuguccuggaacucacucucuagaucaggcuggccuugaacucagaaauccaccagccucugccucccaagugcugggauuaaaggcaugugccaccacugcccggcccuuuaguaguuuugcuagcacuuggguguauuuucaauaauuauugugagaacucuuaugcuaugugauauuuugauuuuuuuaaaaaacuuuuuaagauuuauuuauuuauuuuauguauaugaguacacuguagcuguacagaugguuguaagccuucaugugguuguugggaauugaauuuuaggaccucugcuugcucagucccugcucccucuggcccaaagauuuauuuauuauuauacauaagaacacuguagcugucuucggaugcaccagaagagggcgucagaucucauuaugggugguugugagccacuaugugguugcugggguuugaacucaggaccuuuggaagagcaguaagugcucuuaauagcugagccaucucaccagcccugauauuuugacuuuuaaaaucacauuuauguugggguguggguguccaccugugucacagcaugcauguggagggucaaggacuguguggggggccucaguacucuccuucccccauguaugucccugggaucaagugcaggcugucaggcuuggaggucagcaccucuauccacucaggcaucuugccagcccagggaguugugaauuuuacucucucagggacaaaauaggaguuuuaaaucuuacaugucuauaaaaugcauaauuuguauuugaauucugaguuugauuaaaaguagaagucaagcuuggaaauucuggacuuuacauuagugggcugucuuccuuguuuggaagguuauguuggaaauuuagaauaacauugguauuuuaaaauuauuugagaugccauccauaucugcaaucagauugaugcaucaaaaacauacaaaagcagcccucucgguaggaaaacuagaauugcuggguuuugcuugcuucuuuuuuguccucugccaaaugaauaacuaaagggaagagccgugccguguugguuauggcgccuuugcuuccugcguugucuuuccuuugcccacuugccuucagagcacuggaugauaaaguaagaagcgauuuuuagacucagaagaggcccugcaagcauggagucuguugggcucucccaacuugccaccuguguagacugugacguaggaaugcccuugucauuguuuccucacgugcuuucugcuucgcaccuaguccuaggcaaggccaggaugguaucuuaucagaucuguugaauggcuaaugcaccuugauuacuuacauacuuguugccagagcaguuaaucuuaggcuucaugaauuaaagaguaaauuuuuauuugaaacagucuuagcccaugguauagggagcuguuaauuuuugugccaauccugagccuggccugucuuaacuauuacuuacccaaaaugcuugagacgagaaguguuuuggauuuuuauccuuccuggauuuugcaauauuuauauaugcauaauuugggagugggacccaaguccaaguaugaacuagcuuauauuccucacacaccucaagcugugcauguguggacauagucauauagucuucugguugugccaggaccagacccagggccuaaugacaugaugagcacagacuguauuacucuuauuuuguacaucaguuuguauuuugacucuggccuguuacaugagacuugaguguucauuuuccggucauguugguacuuaccaaguacuuaauuaugggaaguuagauuugugguuuucagauuagaagugcucaagcuguuuauuuucugaagaguuuuacuuaaauuguaaucucaguaaagcaauuguguuagauuauguaccccagacaaggaacaaaugauacuauuugauacuguuccacagucauagcauuuaauagauuuaauuagugauuuuauuaccuuauuuccaaaaucucauucugcuugacugacaaauacuacgcucaguuuuuccuguuguauucuuuugugugcauuggaguguaguuucaguuccuuuaaccucagaccuucuacccaccucggucuuuuaauuucuucauaguuuuauuucagaaaaaucuuccauagguuuuauaaauuuccggcagccuuuccuuaguuucucacuucaaauacauuucuccugugucuucucuaacauuaauuuacauauugauagcauuuaagaauauauuagcuaucuguugaaacaaacuuaaggguuggaaaggguuacuguggacagguaucuuaaaauuuuuauuguuuaaauaguuuauccccuuaauuuuguguguauguaucugagucuaucuaaguguacaggagcuggaggaggucagaagaggcaucagaucccagaauggaguugcaggcaguugugagcagucaugugggugcugggaaccaaaccuguguucucugcaagagcagcaggugcucuuagucaccgagccaugucucuagccccuaaaaauuguuuuggucucuguacuucuuugguugaauacuuaccagcuagcugcauguauguccuaaucauacaucauauugaguugaaauuaaguuaugacuuucauagaaauuuaauacucacuuaaaaaccaagucauuccgggcgugguggcgcacgccuuugaucccagcacucgggaggcagaggcaggcggauuucugaguucgaggccagcuuggucuacaaagugaguuccaggccagccaggacuacacagagaaauccugucucaaaaauaaaaaaacaaaaaacaaaacaaaaaacaaaaaaacccaagucauauuauagaaaaaugaagucaguuacaacaauauaaugucuaugccaacaucaaaauuuagauauuccuucacuuucauaaaaaaauuauguauuuuugguauugguagaauuuuucucacaacuuaauauuuaauaaggaguugucauguuacaauuucccauuaguuuauauugagcuagugaguuuuuugauucagaauagaauuaggucuuugauagaaaguuauauuccaguguagccaagaacuuguucauuaaauauuauaaaggugcugagggcugaauuugaaccaugaaaggaauggcuuuucaccuguaaccaguggugagcacuuggcuuucugugccuggaaaguagcuggcuguaugcuuaggguuuuucuccuagucuguuucacuuuuguugaguuuccaguuaaaauguuuugucuuguagcugcuaaaggccuaugauucuaggagcagaggcuuccuguuuacugcuugaucuguaccugucauuuacuuugaguauuuuauauaauuuaauucuuacauaguagauguaaacugucauuuuauugaaauuaagcucucaucauugguauaagaaaaaucuguugagaauuaauugccuuuaguucuuagagaaagcaaacuuggauucaaauuuggcaauugucuuaguguucuauugcugugaagagauaccaugaccaccacagcaauucuuuuuuuucccucuuuccagacaggguuucccuguguggccuuggaacucuccuguugacuaggcuggccucagacuuacagaggugcacuugccuuccaagugcugggauuaaaggcaucuuacagcaaccccuguaauaaaagaaagcauuuaguuggggcuugcuuccaguuucagugggucaguccauucucaugcagggagcaucguggcacaccuacauggugcuggagaaguagcugagaguuguacaucuggauccccaggcagcaggaagagagagacaugggccugacuuaggcuuuuggagccucaagagccaccuuaagugacauacauaacucuccccaccaaugccucaucuacuccagccaggccacaccuccuaguccuucucuaauaguaccacucccugaugacuaagcuuucaaauacacgagccuuuggaggccauucuucaaacgaccaucacagcuuuaauuugaucaggaaaacccauugaacgucuaugugguucacuuguaagucuacaagaugaaggcauaacauauuuuaugcuuuuuaaauacauuuucugagcuuauaauauggagccaccucuuuuauacaaaagauaacuuauacagagacauuuaaaacucauaucccacuuagaugaacaaacauagaucguuucuugucauaucaccuugggugcucucagauuguaacacuugcuuauucaccuuaaccauagcugccccucccccucccaccaaggaguaaaugucuagacgguggaggagagcuugucuggcaggcacaaggccguggcuucaacccuuagcacuaagauggagggaggaguggugaugagcauaauuuuaggcuaaaaguaguugacuaaaguaguuugaaguuucucccacuguuuguguacaccuguucacguguguugguacacguauguacauguggagaccagauuacaaccucaggugucauuucuuaggugccauugaugguuuguagcuugccaaauaggcugaguuggcaggccagugaguuucagggaucuacuuguccugucuccaacagcugggauuauaagugcaucaccacacccagcuuuuuagaugucaguucugggguugagcuugggugcuuguugcuuacaagaaaagcacucuaccaacugagccauuguuuguuuuuuguuuguuuguuuagguuuuuguuuuugagacaggguuucucuguguagucuuggcuguucuggaacucacucuguagaccaggcuggccuugaacucacagacauccaccugccucggccuucuaagagcugggauuaaaaggaugcacuaccacugaccagcuaucguucccauuuuaaacauaaaagaaaucagcuuugucaagaaacagacuugaacauuuuuuuaucuuugaauagguauugcaugcaugcaguccacauuucagaacugcaacuauuuguauauaaaacgaaaguaaaucuccuauuuugccucucagacauccauagaagcagagauaaccaguuaccaguuucuuauuugucuuuucaaguucuaucccacagaaagacaaauuucaauaaauugcucuggauaguccuuuggagggcagaaauguauauuauuagaguauuauauucaggaacuugauguacuuaagaauuuucauugauaacuuguucacacuacaacaaacuuuucaucucaaacacuauaaagcaaauauuagccaacaguaaacagccuuugaucacaaagcacuucaguuuggaaauccuacuguuuggaguuuaaaaguggcuccaugaucagagguuacaggaaaauguggcuggggcagcucaguuuguagccacugggcaggggauuucaaggaauguccacugggaauuaccaggcuaaggggagagaaucagagucuugugcuaauugcuuaccuauauaaacaauuuuugucaccuugacuggagcuagaaaauucacuuccaaguugacuugcacacucaccugacuuuagguuaguguugaucugggccccucauguaagccucucuccaggguuccuuaaguauccuguggacagugggauugguucuagagucaggaaaccaaggcaggagcuaucaugguuucugucaccuagcuguggaggucccuaacccuuacagcaucuccuucaucacacagcucugccuuacucaauauagaguuuuaaagucucuagggaucaucuuggaaaguggucgucgucccucaacauaaccucuacacauaaggauuacaauaacuuuccuggcuuggugucuguaguuaccucaaggauaagacuuucagaguacuuucuacuaugcaugcauugaucacuuacuguuuggaauaaugcuugcuggucaaacuugaggccuugcccuuuaccauuugagcuaccuccccggcucuugcuuaguagcacaggcuaccugcccuugaauucccuguguaacccagguugaccucaccuucacuuccuuuguguugggauuacuauuacaggugccccaccaugccuggcuugguuuacuuugaugacuuucucuuugauauuguaggacacauguauuagauaugguucuccagaggaagagaacccagacagaggggugugcugggagggugugcuggccaucuaaaggguggagaggaagggaagaagcaggugugaugcagucugagucagaaggccugugggggcggggcugaggaaugaggggcugccugauacccuggagacagagccaaggagcuaugcugccuuaacccaagaagacagagcucauccuuccgucuuuuuuuuuuuuuuucugucuagaucucaacaggcuacaggaugucuguccacaugggugaggauagucuacugguugagaugcuaaucucuuucagaaguggucucucauagguacacuaauaacacgagauacaccagauauuugggugucuauuaacagucaaguuucaucacuauuggcaaaucuuguguuacucugcuauagcuguuacuccuuaaucuagccaauggauugucauccagauuuuaaugggcauaggguaucuuuuauucauaaagguaugaauuuuuacuauauucugcauuaauuuaagaugcugaaauaauuaugcugcuugaauaguguggaagaauaagugucacacuauaagauggaacuggaaaauuaucuguuauuguuuaaagagagcuuuugaugggcucgggagaugacugucagcacgcuugccacauaagcaugaggaucugaguuagauuccagcacccauguaaagagccaggcguggcagcaugcgucugugaucccacaccuacucacaguagggagguagacagacagaggauacauacacauacagugcggcuugcugacccaccaggucaaacugguaagcuccagguucacugagagacuccaucucaaaaacgaggaaaggagcaguugaagaagauuuuacacauuaaccuuggccuucagacacacugcacacauauguucacccaaaguaguaaaaauacccaagguaauuuuuagaaaugaccuugaaauauuuaguugcaagaggguguaaggacagaaaagucuguaaaucacauauuuauuuaauucaugugucucgugcauccaaguuaaaugucagguagguaguugaauauucaggggauaagguuaagauagaaauaccaguuugagauuagcaaauauaguugaguacuaacuagguaagaaaaugauaauguaaguggacaauccuagaauaaacuaucccuuagauaacuagugaagauuguuagugcuuuuaaguaaaaguuuuguugcaguuuuccucuuaacccagauagcucccaaauaauugagucuggacuaugauauuuauuucaagcuuuaagggcacaacaacugaacaguauuacucuaucuuaauccucuaaacuaaucuugcuaccucucagucagaaucccagugauacuugcauuuuaguuuugcugugguucuccgggcuccagguguuucacaugaugucuccuggacucuugucuuucuccuucccuccucccuuggcugggaagaagucuaucccuguucucuccccugcucagucauuggcugaucagcucuuauugacaaagcagagaauaaauggggagcaguguuuacauaacauugagauaggaaauucucaggauaaaaauugcaaccagauaugggggacacagaaaucaacacuuggauaaucuucacacagugcccgauaacauuauaccuacaaaagaggcagggcuauucagugaaauuagaaggaggaggaaaaccauuagaacaugaaauagaagcucaaaguugaaguaugucuaagaagaaagggaguagucauagucaaauauuacuaagcagauggaauuugaccaugucuuugacagaaauuaauaucaaggagggauuuguacagauuaguaauacuagggugugugugagugagaaugguccacuagaaaaggagagauuauguagagagaaaagacuaaguaaaacgauaaagaguggcuagguaaaaucuauugcauagguguuaaccuuugauagccgcaagggaaccuuagaggggguaagguuaacccacacuuauggcaccagaucggaaagauggggacuugugcuuggaauugcagcacuugauaggcugaaguauggggauuucugugaaaucagaucagccuagagacaagaauuggaacaaaagagacaaacaacaguagggugggcagcuggaucugugauggucauaaugaaguugcuugccuaggguuccagucaccagccacuaccgcccagcugcauauaccuugagaugugcuggaguaugcaggagguggaaggcugacuuugaguugucggcaguggaagaauuccccaggucagagcagaaugggaaaggcagguuuauuaaaaauacugcaagggagcugccgccauaggaagacagcgagcuguguguguaugcuaguggccuuuguuugcuguucuuaacauacaugguugguugguguuugacucaggggugggggucggggcaggguuuguaggguagaaguucuguguuggaaguucaugggauaguuaauuuugauuggcugugcucagucauagccuuucuguagugcccaucaaccuaacuugucccccacagcuaggacucuucagugguccagcugccugacuuucuuguuacccuuucuccuguaagcaacaugguaaacucauugguacccuuagcuggucuuggauggaaucuuuuuucuggucuucaauguccucugaauaugaguaaaguagacauucauuuaugucuucucaggaaaaggcaugcuacagauauaauuauaaaucuguguguuauacuugacaggguauguaaauaguuuuucuuuaguaguuuuuauauuguuaaauaauuguauugauucccugagaaucuaguacaauauacuuugaacguauucgacccugccagcacucccaucccuucccacccaacuguaugauuacuucuccuuuuccucugucuccaucaaauccagcuugugguccagcuagugcaguaguaguaggauuggggccugcucuaguggguuacguuauuaaaccaacaaacaacugacucucccucucccagcagcuauuagguauuaacacacacacacacacacccucacccucgcacacccuuccucugccaagauuuagucuggcuagagcguguucaggucuuguacaugcuguccuguuguacauagaaauccaggcgcuuuuauuguaucagugaaguuggucuuuaacugagcacaucauagguaguaaaaauagauuuguuccagguuugaggagacaugcaaagcuuagaggagggaagcaaacuguguaggaaagaguagcucugcuaggcagugucgagugcccugacaugucuauacguuaaauggaaaggaaagugaacuagccagcugucccugaacaguaagagugccacuuaguucuguccccagcgugcagaggaccuacuucauuugugcuuucagaacuuugcaggcagcguacuguucuuagggccagaacaguguuguuuguuucccccucuuuuagaagauagggugccaacccucuacuugcaggcugaugaguucuuauauagucagcuucugugagacaguuaccaaauucccccagaguguuuaucacuucaguggauuugucucucucucucuguguauucacuugcguguaugucuguuugucuguaaaaaagaacuuuguacucucagucaugaaagacuacuuacuuagaaagguacucuccugccccacuuauuuuauuuuauuuuauuuuauuuuauuuuauuuugguuuuucaagacaggauuucucuguguagaccaagcuggccucgaacucagaaaucugccugccucuaccucccgagugcugggaucaaaggcgugcaccaccacgcccagcuucccacuuauuuuauugaaaaaauuuuuuuaacauuaaauagcagaauucugaggaaagacuaagaaaaggcccuuuucauguucuaugggauauaguauggcuuaacaucaagagacuuuuugauaguugauaccaguugagaaagguauuugaaugugagaugaaauuuaguucaguuuuugaaucuuacuuuugguuucuauaaaagaaccugugugcuauuucuaccuaaccuuggauacuuuuacaaaagacauucuuaaagacuuaugaaauuauauguuuccauucuaaauacauuagcuggacugggaguguauuuagugguagagaauguacuuugcauucagacgcacuuguccccagaaccaggaaaaggccaccacaucugaucugagggagggaggucucauguguauucugugcauugaauucauuccucucaucucucuaaauguaguagagacauucuuuaugaauccauugauuagcgacucguuuucuuacugaaauaaagugaaaucuguguguuaagugcuaccuguaguagcccagaaacccaguuuucuguucugagugacaacauuguguuacauuaaggaagguuuauaauuuguuuuccacguagcaaacuuggauuauuuggccuguaauaacaagcuuuucuuuuccgauauacagacauuauuguuuaaagugcaagagaaagcaaaaggaagauacucaaaagaagaaaucggccuaucagcagaagaugcugccgucucuaauugcuauagaguaauagaaaaaggacaugugggcagggccuuguuuguuuuguuuuuguuuuugaaaguacaagcuuagggauauugccagguaucuagcacuugguucagggacccagucugggcuacaugagauauugucucaaaaaaccccaaaacaacaacaacagaaagcaaacagacagacaaauagaacuaggacguauugguaugaaaaucaaucuuuugagccaagaauuugguuuaaaguucuaaucauagcauucaucaagcacuauauugauucuuuucuaaucuagguuugggauuuaaaaguuaaauuauaauugauuuuucuuugcaaguucugauauagucaagggcuaauuuauauuacaaaguaauaaauaucucaucagguaaccuagacauuuuaugguaacuggaauauuaaugagaaaauugaguccuguuuuacuaggauaaauaauuucugaaaagcaggauucugugugcucuucucuccuauagcccucccuuuauauucaugucagauagacagacagauagauagauuuugcaugagaggaaacauguuugucuucccucauuguccuuccaucccaaauaaucuuccuuguuaugcccacacauguacacacacacacacacucacacauguacacacacacacacacacacacacacauguacacacacacacacucuuuguacuuuucguaugagugagaacaaagugcuugucugagucugguuuauuuugaguuugccaauuucccugcauaugauauauccccuccucauccucccaugucuaaauaaaauuccuuucuuguauuuuuauuacauuuaucugagauggacagcuaggcuccuuccacauagacugaauauugccacaguaaauaugaacguugaaguaucuugguauauuugcucagguuccuuugguuguauagcuaaguccuuuggugguacuaguguuaguuuugugagaaacuuccauguugauuuuuguagugacuugcuaguuuaauuuacagucucaccagcaguauguuggaaucuauuggagucugcugcauccccaccucuucacuagcauuuguuguugauuuuuuuuuucauucugaauagggugagauguaaucuggugguguguguguggugaaguaagggguguguggggugguguguguguggugaaguaaggggugugugggaugguguguguguguggugaaguaagggguguguggggugguguguguguggugaaguaaggaguauguggggugguguguguguggugagguaagggguauguggggugguguguguggugagguaagggguauguggggugguguguguguggugaaguaagggguaugugggaugguacaugugggugggguaagggguguguggggugguguguguguggugaaguaagggguauguggggugguguguguguggugaaguaagggguauguggggugguguguguguggugaaguaagggguguguggaaugguacaugugggugggguaagggguauguggggugguguguguguggugaacuaagggguaugugggaugguacauaugggugggguaagggguauguggggugguguguguguggugaaguaaggggugugugggaugguacauaugggugggguaagggguauguggggugguguguguguggugaacuaaggggugugugggauggugcaugugggugggguaagggguguguggggugguguguguguguggugaaguaagggguauguggggugguguguguguggugaaguaaggggugugugggauggugcaugugggugggguaagggguauguggggugguguguguguggugaacuaagggguaugugggauggugcauguggguaggguaaggggugugugguguguguguggugaaguaagggguauguggggugguguguguguggugaaguaagggguauguggggugguguguguguggugaaguaagggguaugugggguggugcauguggaggccagaggagaacauugagaagcuuuuauuuuuuuucucccccaagcccacuccaugccuuuuuguuggaccuggggucuaacugaacauggaacuugccaagacagauugccugguccagcaaagcaaggcccuggggugguccugucuacucccuaaugacagaccaaccgauggcacucugccuuugcugugggcacugguguccagcccaggcccuggggcucaugcacaggcgcgcucuaccuguggagccaugcgugcagcaggcgcucuauccagcucccagcugaguguuuauccgaauuuuccacauagcuaaggaggcugauuuuaaauguuuuuuuuaauauguauuuuagcuguucagcccuugccuaguguauaguaggcagacuuuuucuucuucuguaagcuguucuuuguuguguggaaucuuuuuaauuuccuggaacccacccaucagcccuugcuguuaucuccugagcgcuugaugaucuugucagaaagaccuugucccugcuucucucuugaagggcuuuuuuuucucuagcucuucuuaauuuccaaguccuacauuaaagucuuuggcucauuuugcauuuauuuuucugcaggguaggguaggcaauuggucuagauccauccuuguacaagugacugcacaguuucccagaaccauuugagaauaucuuuuauccagggcacuuuuuuuuuugacaccuuugucaaaacuaagauguuuauuuucugcuuguuauucuguccaguggacauacugccugugccuauacuguccugguuuuguggucugaagucuauuuugugauuuuuuuuuuuuaguuguuuuucuguuccugcuaauaaugucauuagauccucuagauuauccagagaaacagaaaauagcucuaaaagucguaccgaagcacaaaagaccccagagagcuaaaauacucaaacagaaugugcagugguagagggaucauaauaccaaauuacaaaauauauuuuagacuuuaguaacagauuuuguuccuuaagaaagagcaguuuauuaugugccuugacucuggggcuuuaacagcuuacuauaguaagaauuuaggaaaaagaauuuaaagguugauaaauaaaauuccuauuauagucacacuauauucuuuuucuuaagguuuuuuuuuuuuuuuuuuuuuuuuuuuuuuuuuugagacaggguuucucuguguagcccuggcuguccuggaacucacucuguagaccagguuggccuugaacucagaaauccuccugccucugccucccgagugcugggaucaaaggcgggcgucaccacgcccggcuauucuuuuucuuauaaacauguuuuuccaguugaaaauacuuucaagcauuacacuuagcuguaaauuuuaaggauauaauuucuuaucauuuuuccuuuugaguaggaagagacgcuaguccuguugccuuuuguagauuuuacucuaaucuuacauucuucucuauuuaaaaauauguauuccauugccuguagaaggaagcuuaaaguugaaccuaauagguaagaugaaccucucagcccucagcaccuucagggcugcuucugucacugucacucucuagucuccucuugauaagcuaggcguguucugaccugccaucuuuuaaccauauaaaacuugaaucagcuaaugauuaaagcuucuauuacacaugccccaguccuucccagguucaccagcugaugcugucuguguuuaucauuauguccuguaugcucacacacuuaacaaaacacgugagacauuaccgugcagacugagaagcagcaaggacaggaacaucaaggcuccaguccgggaaacaacgagaggacaguuuaauaaauguauagagagggccuuuucuaguucagaugcugcgagcacauauagaacaccauggugugugauagaaagcuggaggaccagagugguggugaggcuaucauggagugucuuuaaaaauggagggcaugaagaaacaggcauuaagauuuggggagcagaguucuuugauuacuggggacugaaucaaagguuuucuucaugguagguaaguacucuuauacugggcuggacccucaguucuuuuuuguaagcacauacacauauccauacacagacuuacacacauacacauaauuaaaaauagaguuguuggcuggugagauggcucagcaguuaagagcacugagugcucuuccagagguccugaguucaaaucccagcaaccacaugguggcucacaaccaucuguaaugagaucugaugcccucuucuggugugugugaagacagcuacaguguacuuuauguguaauaauaaaucuuugggcuggagcaaguggggccgaagcgagcagaggaccugaguucaguucccagcaacugcacgauggcucacaaccaucuguacagcuacaguguacucauauacauaaaauaaauaaauaaaucuuuaaaaaaaaguugcuuuuuaaaauguuaagagaaaaugcauagccuagguuauaacucagugaugcacugcaucguacacaaggccuugguucacucuccaacccccgacucccaaaguuaguuggcauuguauauaaaauuuaaauggucuauauuuuuauuauaucacaugaauuauguaauuguuacuuucuacaauauucuaaucuuggaaagguuucagaaguacaguuaaccaaccuguuguuaacauucguaaaguuuuuaacaucuuaguaauaaugcugaauauuuuuuuacaauauaaauauuucucucucuuguuuguuugguuuuuuuuuucucauuuguauuuuguugauacuaggauugaacccagggauaagcacuaucauugaacuguaucccuuccucuuguuuuuaauuuuuuuuaugugcaugaguaguuugccuacauguaugugucuguaucauguguauguuuggugccugccagaggacagaaaggggcaucuuauacccuggaaauauaucucuuuguaggcagaaaucuguucuuuuuuaauucuguaaagagaugguugaauuuaccauuaaaagcaagagucaacuaagcuucucaaagaggaguauugauucuuacucacuucaaaaaugaauuaauaucauuaauguccuugucaguucuuuaaacugucaaguuuuuuaaaaagauguaguauguacuggucugguaugaaauugaacgguacucugagggaggagugaggaugauuguaggaaagauggaaaaagaugcaagagacagacaugggagggcugcagguccuuaccacgccagccccgaguauauuucucauacacuucuuauacuacaguacuguaggaagcaaagccauaagccaacagaaacaguuuugcugaaauguauguauaagacauuuguucucaccuaaaaaccucccuguuccuuccaucaaggucaauagaaucuucguccccucgccuugagcuucaagugcaccuccucuuaucaugccaucccucuacaggcugggaaaucugccaacagacgaugaccugccuugacucugccugacaggcagacuuucuuuuuuucucugcuucagagaagcggcaaacagcugcugacagaugugugugcgcgugcgugcgugcgugcgugcguguacuguguuugaaugggugcccucugaggccagaauagggcaugggaucacccagagauggaguuagagacagugugaacuuucuuaugugagaaccgaacuuggguccucuggaaaagcauucuuuaacugcugagccaucucucuagccccuaauugugagucuuaaauugggcuugaugaauauauagaacauagaacauacaguugaagacuaaaaaugucuauuaaucuuauuugguuguguguguauauuaaauauauuuguaaaaagccuaucugucuauugguuauuuguuugcuuguuuguuuguuuuugagucaggguuucucugugcagcccugucugucuuggaacuugauuuguagaccaggcugggcucaaauucagaggucugccuacaucugccuccugaguguugggauuaagguguaaacuacuaccauccagcauggucauaaauuuuuuaagguucaaauuuucaaagauaaauuuaauucgcuaucuaauagcacuuacaaaugaagccauuuauuaaaaacaaacauaaaaaugaacagauauuuaaaauuagaaguauuucugaaaaaaaaugaaaucuuaaaagucuugauauaaaacuuauuucaguguuauaauuuggauaaaaguuaucuuuaugcaggggcaggcggauuucugaguucgaggccagccuggucuacaaagugaguuccaggacagccagggcuauacagagaaacccuaucucgaaaaaaaucaaccuucccccuaaaaaaguuaucuuuauuuuuuauuacuucauccauuugugugagagagugucccuauguguaggugaggggcccaaaagaugguguccuugaaguuggaguugcaaguuauugugagcuaugcaagaauacuggaauccagcccucagcccucaugauagagcaucaaaugaucuugacagcugagaugucucuguagcccccaaauacuaucuuuaauucauguauauguaaugcagucauagcauagaauauagauauaggagcucuauucuuauauauguaucgccugguacuuauauaucaauucacacuuagcaaaagguaucaucauuguuuaaguuguuaauuggaguuuuaaaaaaacaguaaguuuaaaagagaauucagucuugaggaagcuggcuuaaaaaggcuuuuauuggauaauugagguuuuuguuuuggcuuguuuuuuuaauaauccagauggccgcaugauuacaguauaaaaagucuuuggguuucuuguacuugaacuguagugguucagcagcauauaccgagcauagcuuucauugaaauguagucauuuggugaaccaugucuaagaaggcaguggguucauucuccagcgccccucggucauugaaccacucaccacuaguagugcaugugguaaaaauguugacagguuuugaaugucaacugauuucuuaaagucuaaguuacuuuuaacucauagccugagucaaaguauuaggcuuaauuguuucauagacuauuagaaaauuguuuugaggaacuuuuaaaguacauucuugauuuuacaagaugauuuuucuuucuggaaggucagucauguaugagaaauucugagugugucacagaugaugacuguacagugagugaguccuacagagugagugcgacucuuccaguuagaagaucuuaaaagccuuuguaaaaccaagccauuucaugaaaggcacuuaggauccagucaaggcgauucacagguuuccuuuguucaguaugacuuuuuuucuaaauauguuaagacuuuaguguauaauucuaguuacaguuacaguguggucagucuacagaaaaagaaaaaagaacuuauuuuccacaaucucaacuucaaaagaauaacucuauuuuuguuguguuuuaucucuaagauuuaauuuuuauuuuauuuguguauuuguguguggguuugugcguaugagugcauugcugguugaagucuggagagggagucagcugcccuuggcuauggaguuacaggcauaagguugcaggcagugugugcaggagcaguagaguucuucaccaccacacccucuccagcccucauuuucuauuacuauauauaaaaugucuuaggaaguagaauugccucuuaaaugcuacuuaacagcuucuugucauauuugaaaaaauacaagaaguuauaaugaaucuaauucauuuaaaaaccuaaaauuucguuuaucuuuaacacauaaguagauaggggcuagggcagagauacagcuuauuugguagaugcgugccuagcauauaacaaguccuggcuucagugccuagguccucauaaacuaugagugguggcauacaccuuuaauuaauaccaauuaauaccuuuaauuaacugauaccaaaucauggaggcgaaguccagggucauucuugguucucuuaagugugaggccagccugguugcacaaggcccugucucaaaaucaguuuuaaaaaauuuccucuuuuaaaccgagcuuaaauuaaacuuuuacacuagaacuuaaugugacucuuguccuuuuaacucagaaaucaguaaaugaaauguaacuaugcauuaggauugguaguaauuaacagcauguauuguaugcccgggggugcuuuaaauaugcucugcauauaccaauuccuauuuuaugcuuguucucauuuuauaaaagaagaaaucuaaucaccaagaggucaagugacuaguuagagggugggaggagcaaaagcauuuaguucaggcuggaacucugaggucagacacaagucacucugcucugucaucauggcuuuucuaguagcuguccgaaauacaguuguaauuagaguuaauuuaccgaauaaguuaaugauuugcaaugucaaguuauucguugucauucgcggacuagaauuauguuucucugcugcaucugaaucaugggaaugaaaccuauuuacugccccucccaccgucaguauccugcaucccgcgcggggcuuuccacccugcggagcuccugguuaugagagucaguccgcgucaggcucucuggguuugccgagguagagguuugaaggugcacaagaggcuugguguuccucuggacagugcagugcgguggagucgggggggggggggggucucuguccugcugugaagcgcggucagaagugugaagcagcuguguaauccgcuggaugcugaccagggcgcuccccauuccagucaggagccugcagauuggcugggcguaggcacacgugaccgacauguggcuguauuggcgcagcuugccggggugucacuggagacagaauggaggugcugccgggcucgaaaaugggguaggugcugggcugugauggccagguuugcuacaggggagagggaggaggugauuuuuccguggacugccuuaaaccguugaccuuuccuuggcucaggcucugcugccacaugccaagccugggaggcaggggcgucgucccacuccucucccccaccccccacugcaguacaggagaugaauuuccugugcuucugauccugggauuuugacagaagaggaagaaagggggagggguagaagugguaaggggaggcuggggagaaagccguuuuguuuuuuauaaugccuguugacaguggaguggaauaacaguaucuaaggaaacgaguagaggacaacaaagaauggagcauagucauggcgaggagagaaagcccuagcccuuugaaaggcagcuuuuccuccuuggccacaaggacacaggcagugguagccaagagugggcauucaaagcugcagcugauggcucauguggaaucuagcagaaaggacucccaaggaugggaggaaaaaaggacaugcacugcggagcccaagugaucauuugguugacuggcgaaauauuguucaguaguaauaugccgcuuuuguacaacauauaagugaacucgccgagaauaggguggcaaagagauaccagugucuuuguuagcuccagaaugcaguggucgaggcuuucuguggugacugcagcagggcuuugcuguagacaacugcagagcucugaguaagugccccugagcacuuacucaguagcagaccgccgcguacaagacgauggcucagagcuucuccccaaauaggagaaaacacauauuuugcuuuuuaaaggaggagauauaucagauuaugaauauuuuggcaguaaaauguaucaaacgcuuugauuuuauaucacaagagagaugccagaugguuugauuuaauauaaauccuauaggaaaucuuaaugcauuauguauggaaguggaucuuucccuuuguuagucuagcuuuuaugcuguuaauuagaucauccgagaucaaaucacuuuagaauguaaauuacuuugugggcaguaaauuuuuuauaaauccugguacuugaaaccuauauuuauuaaguaaauuuguauuucucuuuuguuuuuuugaauuuaauguaauaaaaucuacagauaacuacuuuagauguacgucaauuuacugaguauccauaagauauacucaguauaaaguauuuuaaugacauugaauuguacuuuuacuuagauguuuaaaaguguccaucugcaggucgagucuucgccuuauuucuguguaugucuauggcaaccuccugcacuccugaugcccugaacuagacuagcaguggcuuuguggagcccucuaggagcaguguccaaaacagucccuuuuaaauuuaugugguuaucuuaagagaauuuccaauuuugucucaguaguuuuucaaaauaauaaagaauuauuacuugaguaaauaauaugacauaaaauuuucauugacaaguuagaacaguuuauucauuucugcuuugcucuuuguugcuguuuugagacagucucauugucuaguucagacugacuuccaacuuacuguguaccccagagcaaauucaaacuuucagccuuccaagugcuaggauuauaagacuaucccaguaugccaggccuaacuuuauuccugaauuuuguuuuguuuuauguuaugugauuguuaauaucaggauuaaaagugcuuaggauagccuuugaaucugauagaaaccauagcuaggaguaaagcuaucacacagagcugacaagugaauuaguagcuaacauuagccaauccccagaaucugaguguaguucuugagcuuaucaaauucucauuuucacagauauugccucauuuaaucaacuagcgaauguagcauuauuuucaauuuauguguuucccaguucucuuacucggguguguguaaggauaaauacuucaguguauuucacuucuauaaaauuacuauuaaugucucaguguagagcauacaaaauaguauauggcaauugauuugaaaagcagugucaugccuguggacaagaacccccacaugaaugacuugaauguuuucuuuuuugagacaggguuucucugugucccggcuguccuauaacucacuaugcagaccaggcugccuagaacucacagaaaccaccugccucugccucccaagugcugggauuaaagacuuacaccaccagugccuugugaauuuuaacuaugagagcgcuuuagaaaagauuuuauagcuuaaguuacauuuaucuguucauuugcuuauguauuuccugugugugucgguacaugacagccuaacuggacuugauucucuccuaccauguggguuccagggaucaaacucauuuuaucaggcaugaugacaaacacuguuaccuguggaaccaucuugacagccccauucacuagcauauuuaaaaaucaggcuucuaaacauuucuacauuagguugcaguaucuuucgaaguuaaauaaauagaagacuaauuaaaaaaagaucacuccuauuuaguguaacauucaguauuucacugggcuuuuguaaucuuuaaaauuacuuauugcuaauuacuguaucuagaauuaugugaccuguuuagaaauucauaaauuaaauaaucaaaaguauguuuugugaacugaaucaaagcuauucacgauuuuguuugcaugaauuacaauguagguuuuuaucucccuguuuuucuccuuuacugauuuuccgugcugugacuaguaucacaguuguacauguuuaaacgcuuugugacucuaaacucguuucccguuggagggugacucugagcgaagcccucuacaccagcgccugcagugcgcuagcacuugauuuaggaugacaggagcaccugaggaaguauaugagcuacauacucaccagcgugccagccacaugccagaccucgggaaggaaaugaagagccaaauaaagccugggaacgcaccuuucugagacacaaagcgaaccguuacauugaaggcgcacugaacacugguagcuuuagcuagccuugggcaccuuuuuuuuuaaaguugauauuaucugaaaugugcugugauuugcagggaaaggguagaguguucuuugaggauguuauauagggagagcuuccuccucucuguuuccacuucuccuuccauucuuccgucaaagugugugucuugguuuuguacugcuggggauugaaccccacagccuucaugcuacacgagccucuguggugggggccaggagccuuuugaaguguacaguucuugguguugaaugcaucgugcauccacagcugcugucaucuccagaauuucuucuuguuguggaaacuuuugagaacauugaagccccauuucccuuuuuucuugucaccuagcagucagcucacuacuuuauaccuuugugaauuuaccuguugaaggaacuuguuacaaaaagauucauauauuugaccucuugugacuggcucaguucauuuagcauaaugucuucauauaucguuuaaguuauaccaugcuuuaaucuccuagguuuuagcuucuuuccuuuugaagcuaaggaauacuguuacgugcacacuaccuguuguuuauucguccaccuucauucaggugugcucccaacuguccccaguagugcuggguaaucaugugugcucugagagcuguugucuuugcuuucauguccugugugugcuacccaaauguuuuaacucacugccauuuugaaagaccuacccauuuuacuuccugcccacugauuuugugcugcuaacaguuguaugccagccuguaggguuccuuuuuccuaauucuucuucgcucagacugcaguggucuauacucgcucacgacugcucacuggcugucuuagguaugcuacuaucuuacacagcacacaacacuuacuggcuugagguggcguugugcuuagguuauaagcaugugacuguuucuaugaagaggaguucaggagcaucuugcuugugugagaaaacucuuaauuucucgggaagcuucagucaagauuuuggucaucuuggcagucauggggucuugacuagacccgaggcucauuccaagauggcucccucauagccucagcuuccucguggcuguugucaagcagucucaguggcuuguuuuguggaucuccauggaacuucaaugucuugauggcauagcagcuggcuuuccccaagugaacagagccagagagaggaaaacaggaaagcacuugugacuuggucucagaaugucuguacaccauauuucuguuguuucccuuuauuaagagcuacugagucuagccuuaaaaaaaaaaaaaaaaaaaaaaaaaaaaaaaaagaccaguuaggccucuuaccggaguagagucagagaaucugcauaaacauuugaggguuguugcaugaaccaagaaaaugucacuggaauuuaguccuaagagaaguacguugucaucauauuggcaguguacuguuguaaaaaauuaccacaaacuuaguagguuuguuauguauuugugaggauuaguugguugguugaauuuuuuguuuguuugguuuuuagacagggucuuuauagcucagguuacccuugaacugugcauguagcugaggauaaccuugagcagucacugauuuucucacucuacugcugaguuucuggauguauauccaguuuuauuugguggugggaucaaauccagggcuuuaugugugcuaggcaagcacccucccaacugagccacagccgcagcccacugcaugguuuaaaacaaaauuuacuauugaccuuucuugggggucagaaguugacaugguucucccuguacagugaagaggcacuucagaggcacugcguguccuaaaagcuggagagaagcagucaucuuugcccuucuuuccccuggcuucacucccuuucuucauccucacuguuauaaucugucucccucugaaccugaugccuugcuucuguugucacgcccuuuccugacugacccuuugucuuauucugaggacauaugugguaacauugguucugccagaguucagaagaauuugcugcacaggccuuacuaaucaccucugcaaaguccucguagccaaggacggccaugugguuaugggcuugggagaugacggugcgcacagcuuccuggauugccauuguguugccacagguguccuaacacagcuuuuuuuccuugaagcauuuuaaaaauuaauuuugaaaaucauucuuuugugaaugaguguuuuucuguauauuaacuacuuaggacuuagucuaugauagaaacugaaagacuuuuugcagcaccuuuuauggacuuuccaaucaacuccagccucuuuauacuaucuaaccacaugcacagugguguuuauaucucucccucccugguuuccgugauuccucuauaugugagguaggugugugugugugugugugugcguguguguguaugucugugucuaugucugugugacugauguguguguguguguguguguguguguguguguguguguguguacacacacacauauauaguauuccuguuauugaacuugggagucacaaccggugccccagguugggucuggucacccauccuuagugauuaaaagccaauugaaagaaccaaauugaaaguggaagcagaagacuucuucaguguggccacauugggaagagagagaugugacucccucccccauccaucuucucuguccuggauugacacaaggacaggucacccaugaugguaggauuuguacaucuaagcaguucaggucaguuaugugaccacuaccaucaugggugaccugucuuugucuggacuuuagucucauucuguaaucugaaaaguuuuuacaacuauguggaaucucuuuccaggggacaaguuucccucugcuucuuccaucaugagauucuugagaaauuucuauuucuuugaggaucccuauuucaauaguaugauagucagacggaaagacauggguaucccuuuuguaauauccucauuucugccacaucuguugccuuucuuuccuggaauacauuuguauugaugucugcuguggucugacagaugaagcaguugugagccaagagaacaguagguggcgcacacagucugauagguccuuuucaaggaguagucuccugccccccaaauuccaguugaccagaacaagggacauauuagcuuaucuuuuauaauauuuucccagagcuauuuuaacaaagugccacagacuggugguuuagaacauuaggaaucccugauuuuacucuuuuggagaccagaauauuagaaagauucuuucugaagacuccaaggaagaaccugucucuuucuuaguuuuugaugcuugcugacauccauuaccucacagcugaguccucagccugucuccauugucagacaguaucccuacugugugucuacuuguaucuguuuagucacauggccuugaauugcaucagucauucauuuagaucccuuuuuaauacaauaucuuagcuuuauuacuaugcagagacccugucuccaaaagguucauaucuauagauuccuaugacucaagcacaacccaaaccauuguuggaaaugaaaguuagcaacacauaaaagaacacacaaagcagaaauaguuuuccaaggugauuuuuuuucuuuuuguaaaaaggguagguaccagagcccaaccccugcuagccaucguacucugaaagugaaaaccagcagcugggcuugccccugacuuagauggagacugcaucucuucccacugauggagcuuggcuuuguagucugacaugauuggugcugucagcacagaguggaaggggcguaacuacuuuugauaggaaaagguuucuuauaccacuaacccccacccccuuauaauacuaguugauaguguauggauaagaaguuaucagauauuuuuuauuccauuauguagccacagagaggaauccauuaugcuuuaauggaagauaaucuuuuuguuuuucuuugacuuugucuugcuuucuguuuguuugcuucuguaacugaaagggcauuucaugucuguuuuucucaugcauuuaucuucugugugacuagaauugggaagauuuuuuguggaauuacagaagcuguguguuacauacaggccucuccuaaagaugugugugugcgugugugugugcacgugugugcguaugugugcacgagcgcgugugcuugcgcuugccuuagcuggggagacaaaacaugucaaaguaaaauagagugcaguuaggccaagguuugucauauuuaccacuccuuuggcaggagugugcaguguggacuacaauugucaggaaggcuuugugugaggcagcugaucuggaccuaaaagaauaagaugcauccuaacaaagcagaggaggaaacagccuggcauccacagaggacguuaaaguacauacaugcauacaugcacacacacacuccaaagguacucucaauucuuuucuagacuuaugaaaauuagucagguuccugaauaccaagcaaacuuuaaaaaagcuaauaccagugguuuccacacacagucuguggccagucucaaaggcagcagucagugacaguaaaaggacugguucuuuguaccuuguagagaagucauugaaggaacaaaagaccagacaaacaugaaggagaaaaaaggaugaagaaguuuaaaauggcagaauauguguaguguugacagugugcuuagacagcuagaggagacaaguuggcauaaagcacaagaaggccgaccucugaagacauuucuacaacaguuuaaagagucuuucuucccagagggaacuuuccgauuucaagccuggcugaguuucacagcuuaguauucaaacuguuucagaccacauuaaaaaaugagacaugcaccacuucauuuuauggauguagcauaaucuucauucaaaaucuuaaggcacacauacauacaugcaugcauacauacauacaugcauacagggucucauaaaauacugaaauacuaaaaauugaagagaaaagagcaugaacaagugggguuuguuucaguaauggaggauggcucagcauuagaaaaacauacaccauaagaggaaaaacacccagcaacugucuuaguuaggguuucauugcugugaacagacaccaugacaccaugacaaggugucucuuaaaggacaacauuucauuucgccuggcuuacaguuucagagguucaguucauuaucagcauggcaggaagcauggcagugugcaggcagaccuggugcuggacgagccaagaguucuccaucuugauccaagggcaaccaggaaagacugucuucuucaggcagccaggagggggcucucgucuuguacuggguggagcugaguauaggaccucaaagcccacgcccacagugacacaccuggcuccaacaaagccacacuuacuccaacaaggcauaccuccuaagagugccacuucccuugggcuaaggauagucaaaccacuauagcaaccucuuguaaaacuuuuaaauggaaggaaagucccuaaauaugcuuaaauauuuauuauaaaauuuaaggauuuuaaaugcugaacuuguaaauugucccucuuaaaaucaggaauaagauaauuuauguaacacuuuguacguucaagguaauaauacgauaaaaagaaaugcgauguaaauauucaaacaagaggauaaauguguccuuaguuuauacaauuguauugcaguaaaugugcuagaaaaacuuaaaauuaauaguauuaauaauccgaaaagguuagcugcauaaaggauacaugauauagugcgauauuuuaugcauauaaacuuaaauuggggaaaagagaauaaauggcucugaaagcauauguucuuucuugguagauaauuuagggaauuuuacuuagggugcuagauggagaguccugagacauaguaugauuuagugucauagaaauuuaagucucccaaguuaauauaaauaaaguacaguuggguuauaauuacauuucuguucaaugaaaaauaagugguugaauauuaaaaauaauugauuuccuacacagaagaccacuauacucuuuugauauacaguucuauauaaaauggaauuuuugauucaagccuucucugauaguauucacuacagauucuuguugaccaaucuuucauuccugaaauaaacaccacuuauucaugcuuuauucuuuucuaguauugggaauuuccugucuccuaggacacuauuaaagugauaguauaguuuugaaagugugaacuuauaaucucaaaagagagaagcaaccaaauggaagacaaggaaauuaagggacugaaaaacaaacaaacaaacaaaaaacucagguagcuugagaugagccuccucaucacaguuccuuucggcaugguagacugccucuaauuauaaauuggcauuauuaaagauagucaugccuucucguuuuugugguuuugaggauccuuucugcuggaaagacuaggugcaacagaaacuguguuggccuacaaaggguuauaauauugguuguuuucccguacagaaaagggcgugcagcuuggcauggcggugcacaccuuuaaucccagccccugggaggcugagcgggaggagcucagagagugugaggucagcacacagaccuagggaggucuagaccagccagggcuacagugagacccugauccccaaaaaauggucgugcccuccccgccccauaauuuaacugcgauggccaccuuagaauuuaccacacuugguccagacaacauauauagucguugcagggaguaaggaaggaggguggagaaagaagacaacagacaagagcgaaugucacuggcugaggccuagaaaagaggggggggggggggagaggaugggguugcaagguugcauugguuguuacagugaaugagauauauucuucuuggaauuaaauccguuguaaaaaucagcauaucacuuggaaucugacaguguuacaucuucacauugaagaucucucuuguuuuguuucuucauuucccagucauuauucuaagaucucuaggcugugguaaaaaguggcaaaaguagacaaacaccugugguucucuguauuuuguuguuuguuuuuuggaaagaggcugaaugccuuuuuaugugaggagugugugcauagguucaaccugaugugucauuccucaagugucauccacucuguuuuugggcaaaggcucucacuguccugauuaggcugggcugggaagccaggccugcugaguuccagggaccuuccugucucugcucccccucccccaugcuggcauuacaagcagacacugccuuuaaaacaaagcgaaagcuuggguguugggcaucugcugggauccucagguuugcuugcaccgugccuggcuguauuguacaucuucuuagaaaaguaucucaucuuuuuauggggucaguuugguaaauuauauuuucuggcauguugucugucucauugaaauuuuuaaaauucuuggacuaauggucuuuuaugauuugccugguuuucaguugguauuaauuccauuaucaucuaaaaguauugauggauaugucuauuuuuaaaaaacuaaaacucuauuacuuaaaaaaacagcacccccagacuuaaaauaguaaugaauucuccacauuuaauccuaauuauguaucuuuuacauuuacauuuucugucuuguuuauugaaugcuguguuuuucaguaagccuuuggagaagagucucuagauaauugcuugcuuucacccuaccucaaauauuucuggcacaaacagagaucuauauuggcucuuaacuauagaaaacuaaguugaggugugugcaugcucucaguaaagucagguuuugagaguauuuucccaucucacaaggcauggugccauugugugaucucaucuuuccugugcuugugugggugcuggggacugaacccagaaccuugcacacucaaggcaagaagucuaccacugagcaauaccuccaaacccccaguuaaaacaaaaaaguuguugaaugacuuucuauuuacacugucugauaagaaauucuuaggauugcaugaaauguauucccaaaguaaugcaugagcucacaaguuuugugaagagcagcugcaggugagggagugaccucaccugcagcugcagcauccgaggaggguugcaagguagagaauuccugcuucaugcggcuuacuguuuccuuuuccauuguuggagcagaaggacuucagugacugagguuguuuaggggaguagaggucacgaaagucacuaaagauugccauucaaaacaaaucuggggguucagccauuaagagugcaugcuguggcuuccagaggaagccaggguugguucucaugcugacugacauuaagcagaucacagccaccuggaacuccagcuccgaggaucugaugcccucuucuggccucucugggcaucgcacuccugugcacaaacugacccaacaucaacccccaucugaacacuuguaauaguugcugccugcugugcacauuugcucuuuuugugauuguguaauaaguguagccuaaguacacuucauuuuucauuguccuuguuuguguguugcuuuagaguagcaucuguuauuguauaugaaauaaaugacuuugaaacuuaauuauuagagcuuggucagacccccacuugucaggugauuucaaugugcucuguauuucuggccugcuuauuauuggcgugucuaaaacagagaaaugguuaaucccgugaguccuccuccgucucuaggagcucgcauugcccugcagaagugguuuacuucuguacucaucuguugguguagagaaggacggcuucccuguuaggucuuguuaagaagcuaugcuacauauguguuuuuauaguuuauuuacuuacacauuuuuguuuuucagucuguacugugugcugacuccuaacaguguuccuguaaguuauauuaaagcaguugguaaauguccagcugcaaguugaaguaauaaaggggcaaauguuagcugacaagugaugaccccgagccuaagacccguggguccaagugcaagugcuuguccuuugugcuuuggagacuuccuguagaugcccagguucgccagugacuuguagaacugacuagauccaagucccuugauguguuguuaaggucccugagucgcaccauucccauauaucaugaguagccagaauaauauucuuguguuacauaauccagaauuguuauuuuuaauuuuuauuccaaagugaguugacauuaaacugcagagagaaugugggcuuccugacucuuucuugauccauccuaguguaccuuguaucauucugugugugcccagucaugccaagggccucuuaguacugagcuggucucuccugucuccuguauuuucucuccuuucuuugaagucuuucuucugagggcauccaccuuaaccuuucuaucuuuuagucucaguuuaaauacugaccacuuagaggaugggcugccuaccccaucaggauuuuauguuuuccuuugugcugacuuugugaauggcugcacuucuguggcaucguaaaucuucagaacuacuuugccauagauuaaauuaaaugaaugugguagggaugaacucuggucucauucauguauucuacuuccgaaggccuauaggccauguccaaaucagaagcuaaagugcagcauuacucacacaaauucuuuaucagugguuguauucuguaaguuugacauacaggaggaguuaggucaucuuuaaccuugaaacagucucaccagauagagagcuuaccuguagcacugcagaucucuuccgaugggacugaggcucugccuuuugcuugaacccuguuucucuucagcucagaccccauguuccauccucuuaggaacuguugcugcugggaccauggcguuuggagcccaagccugcgaauaagcaccacuccuccugucuggagagcuuugcugccuuugucucuuucuucaaaacaaaacaagcagcuacuccauucuuaguggugaauuucaaaauccuuuuuaaccuuauagguccaaggguagccaaggauggcugcagcuucauaugaucaguuguuaaagcaaguugaggcacugaagauggagaacucaaaucuucgacaagagcuagaagauaauuccaaucaucuuacaaaacuggaaacugaggcaucuaauaugaagguaucaagacugcaacuucuaauuguagcuuauccacuuucaguguuuccucuuguaaacuuggaauagcuaagacacuuuauuuacuuaaaauuauacauaauaaacucuuagaaaaguuaacauauucuuagaaaaugcauuaaguuaaucuacugagucaugcaaagaaaauaaauuaaccuugguguugguucauucuuagucuuuaauccuagaaauaagauuccccccaacuuuaucauuagacuugauuuaauggaaagguuuucugugcacguauagagacuagcuuuauuuuacaguguaucucaaguauuacauugucuucuuuagaaaauacagguaucaccaagccuaggugauaauuuccaugguacuuccaagcccugaaguuggcuuuccagguagcaaagacaguuggagaguauuuaguguguagaggugaaagccuucugucuucaaagcaacugauuuaaauuucaguuacuuuaaucuccaguuaggcagcuucccacuacauuuaauaacuucauagaauuggagauugucaauagaaauguuuauuuccuuccuuuaaaaaaaucuguuuguguuguuucuguugcuuggcuauuuuaacaucuuaauucuagcuuccuccuucugaacacucuacuuugcauaucuucacauauuuccuagucugucuaguucuuucucugucauuucaaagucuccuuucuuuucuagacuucccuaucacugaggaagcugaucuucucuuuccuacuuauucuuuagcuccaacaucccauccuaacaggucagccuuuugaucucacaacucucuuaccuaacuuucuaucgaucucuuuuuccauucuaauugccauaaaacacuuuggcaauaaaaucuccaaaauauucacuucauaacccuuuggaaauagguaaacuauaaaaacaaacacuuauuucuccuuaucauuagcuacauaucagugacuuaaaauaccugagucaguuaucuaauagguuaaaaaggccaucuguuaccuuaacacuccccaacacgguguacuuuaacugcuggacagggcugugcgggagaguuggaggaaaccgcguacagagaaaugucugcuggacugggauacuuggcagaccuccuccuagagggccuguuuagauaguacagaucuaauuuguagugcagaacucagaucuugauuuaaauuuuuauuuaauuacuuaugaauucaaaaauaguuuuuaaagaaacacuuuggacaagacaggcauuuuaauuaacacuuuaaucuccacucugcugaaguagagugucuuuucagagugauuguacaagucacaaaaacuuguacaaugggauaucaggauguauguuuaaaaacuugucccagucuauaucaggagaaauagaaucuaagguaucccuggauuuggugauuacccaacugguuaugcacacauccuggcagaucuauccauguaugucauuaguauugggccuaugguaaaauagcaauuacagccuucauugaaguuauugauguauuacuuucuuaacaugcucugcuguuaaagagcagaaccguggccuguuuagucuuccacugauguauaaaaugaugcaauugaacccauuggugcuuuccauuuuggguuauaauuaaguauagccguucuucucccuaaaaccauguuaguagacucugggacacauacaaucucaguuuuccugaccuuuauuaaccuaggcaucacagagaaagccaagacacagcuucagauuaaauuagggaagccuaaaacuuaagcaauaguaccaccugcuggcaaaagaggguacauccagcugucaguuacaugacaucacuauaaaauacaaaaauacugugagguaacagccaggagaauguauauaaagaguuagggaaauaugagcagaccacauauuugaggaaauugaggaaauacuugguauacauaugauauuguggcuguguucagaaagaauaccuauuuaaauauaccuauuaaaauauuguaaaagaaaugauaugcccacuccccagaaucaugaaaagcaaagcaaggcugagauuauugugauuuuucucucuggggacacugaauaaguacaagccaggcuuauucuggucaccagcaggcaacucugcuggaagguaucaucccugaaggcaggcaagaagagcucuagagaccgcugccuugaauaggaggaggucagggaaaggcauguguuagcuuguaaggccugccacagagagagaaacuuugguuucauaaaguauuugccaaguuuugaacucuuuggaccagauuaaaaaccucagcuccaggauggacuuucagugcuaagaagacaagcaccaucagaaaauaagcagaaguggaaagccauagugagauccucaagagaugcaucugcugugccuggugucggaugugaguuuacgaaaaguaggaaguuaaaggccaaggaagccaauuugccauauuuucaauauaaguaaaaaaggacacacucaagaaacaaaaucaguuuuaaauuaccugaaaacuaaguuagguuuaaaccauucacuguuacuaauagaauggaaacuagcaaccccaacagugggaaggauaaguucuggaagaagaaugcacccaccaccuuaagccuuucuucuucuuacauacauuccauuggcauacugucaaguuugaagaauaagaaaaugguaaucaagaaaacagaauauaggugguaauucagagcaauccagguguugguguuaguuagcaauucuuuacauaaauauaagaaugucuugaaaaaaaaggauauuugauaaaaugcuagaaauacuauagauuuuuugacagggaauuguauuacaauaaaaacaaaucagguguggcucacaggaagcacaaaaguuuucaccucagcaauguugggcucuucuuaauuacugguaauuucucagcucuagccaaccagcaucaaguaucccaagcaaagcaaagguuucgcuugaguaggucuagacuuguuaaucacaacugacucuucauccgcaguuaaccagaaccacagaaucuuaauucaaaauaacaaaugaccuccauagagucuuuaaacuucccucuggaacaucacaagccaggccuccaucuuuugcacugcccucaacauucuuaccuuccaagcuccacagaacagccuaccaagcuuugaauacccaauggcuuuuuaccucaaaguuccaaaauccuuccauagucuuccccaaaacauagucaggucugccacagcagaccucaccauccuggcaccagcuugucuuaguuacaguuguauugcuauaaugaaacaccaggagcaaagcaacuugaggaggaaaggguuaucaggcuuacacuuccauaucacagugcaucuucaaagaaagucagaacaggaguucaggcagggcaggacucuggaggcaggagcugaugcggaggccauggaagggugcugcuuacuagcuugcuccccauggcuuucucagccugcugucuuacagaacucaggaccaccagcccagggauggcaccacccacaguggacuaaucaaucacuaguuaaccaaaugccuuacagucugaucuaauggaagcauuuucucaacugaacuuuccuccucucagauaacucuagcuugugucaaguugacauuuaaaacaaaacaacaacaacaacaaaacccagccagaaaaggcuucaucaaaauuagaaacaugucuucuagaaggcuucaauaaaaaaaguuugaaaaaacaauucgucuuucacuauugaaaaccaccuaccauacuacaaaaaaauucaacaaaagaacuuauuucaaaauauaaaaggauuucuucuauaaacacuaagauagugaauuuguucggcagguaaaggcacaaacauggugagaacaagcagggugagcccagaagaaaaugaugugcugcugacaucuucagucccagcacuccuaagagcugcgagaggagaggcagagagagacaggagaaucauuucccagaagguccuguuagccugggagucucuggcuuagcagcagccucagcaaaauagaugagaacugacuccccaaauuuuucugacccccacaaguguaauacacacuugaguagacagacagauaaguuuaacuauccagguuuuuuugcuuuuguuuuuguuuuuuugcaacauggccucaaaaauuaaaaagauaauuagaaaaggaagauaaaugaccggguaugggccgaagaguuggcucagugguuaagagcaccaucugcuuuuccagagguccugaguucaauucccagcaaccacaugguagcucacaaccaucuauaaugggauccaauacucucuucugaugugucugacagcuacaguguacucauauaagaaaaaaaccuguccagguacacuacuggaaaauaucucaguaucaccugucaucaguaagacauuugacuccgacucagaugacuaagauuuaaaagacagauucacacugauuggaauauugaaauguucacacugcccgugagccuauuguaaacacaugcacacgggcacagaggcacacaggcacucacauacucuacagcauuuucuuuucaagguaaacccugugauugaagcauuggaauucugagaaauuaccccaagagaaguaaguacuucuguccacuagcugucuguacagagcgaucauauuagcacucuuccuagcagccuucaugaaugcaugugcuaacauggaggugucuugaagauaauuauguuaaaguagaaacacagagacucaaaggacucucuacugucuaguucuuucugggaacugaagaugcauugaccagaacuugaggggaccaaagcuggaaaggcuaagccaccaaggacugaagaucuguaccugugcacagugagcuucaaaacaaaacacaauugagcuuacguuuguuagcaggcguagaguauucauuacguaauguaagucaugcuagauguugucgucguaaggcaaaguaacuggaagugagugaguuggcuuguccggcuuugcuuggugaaguucguaauuaaaagcacuucacaaagauagccuagcagacacauuggaauaagcuaauacuuuauaaaauugcuacucuuaaaacccuugaaaauuguagccuuaaauuucauuuguuuuaucuacauggcugcuuuuaucaguagauuucuaacagcuguacagaagcuuugguauuggccuugagaauuaagccuaaggugacacagguucucaacaaaaagcauucuacugcugagcugugccuagccacggagacuuccuguucaguuauuuacuugcuauguccgugcauguccaugugugucccugugucugugugcauguguguuggcacauguggaagucaggacaauuggugggagucaguucuuuccaccaugaguuccaugacucaaauucagauacuaagucuucccuuagagcaauaaucucauuacaguuguggauguucacuaauuuuaagauuagaaaaugugagcacuuaucagaaucacucaguuuuuacagggauuuggagagggacuaauuaaugcucuccaacuaggaccugaguguccuaccuaagcacucuaccagcuugcccacugauuuagauuguaauucugucacuaaagggagagggaaguuuucucuuuguuuauucaauauaaacacauuuaaugggauuuuuuuuugcauacuuuguuuuucuguaugauacacuguggcccucuuggcauaagaugauaggauuggucaaagacugcugcagcuguuagcuauggcuggaagagcuagaacccuggaaaaagaagucauagucugcaguguuagucugaagcuaaggaagagaagugaccugcagcucaguuaugcauuugggcaugcucugcacccgcugaggcgaggucuccccaucccacagugaggauucaccuggagaggauuuucagcgugaauauccuugaccuucacauugccacaccuaucaaagccguucaaaugacagcacagucugcugugugaaggguacaugcuaagaccacaggucauuuguuuucaaugcauacugugacagaccaaggcaggaccuggagcugucccucuagcaucagcucgccuucugcuagguucccuuucagugcuuccaagaucaccuuaccauacagugacauggccuuaaguuucaggguugcagauguucagugcauuuuccuggacugccaaaaacaaaucggugaaacaaggacaugccggaagcucccauggcaugcgucacuacauaggaaguaugaaaguuauuaaggagcacuaauuuaaaaaaaaagauuuauagguagccaggcagaaaaauuggauagaaaauuauuucaaacuuaaaaaaaaaaaucaagaaguacuuucugugaggagaaagacagugacauaagggcggcaggcagcuagcaugcaguuacaugagugccugcagaaugaacccaggcuccggcggcucuccucgggugugccuggcugagugguaagucacuaaacagcagacuuggcuccugcucaugcagauacaggccuaagaagugugucuucuaacagccacuuuucuauggcuuaagcaagucuguaggugucagcugauggaaaaugguaauaauucuaguuucuuaaaaguaauuagcccauauuguaaaacauaauggguuuguuuuacuaugccuuuuaauguaugcauauaaucacacaccuuuaccuuccuuuuaagugugccaugaagugucuugcauggagacuccucaaaucaccauuaucacaaaauaccacuauuauuuuuguugggauauaacagugaauaauagguaauauguuuaauauacacuauagccuauggcauguugucagugugaacugaaauagcuuucucaagaacccagucagaucuaaaugccaagaaacacagaaucauguguugcaaagguuauuuggcauuucaugcugaugcacugugcucucucaauaggaaguacuuaagcagcuacagggaaguauugaagaugagacuaugacuucuggacagauugacuuacuagagcgucuuaaagguacguuuuuaaaagcacuuuaaaauacugugugaagcucaguguccaggucagcugcucucacuggaugcugggcucagcuugcucuucuuccccaccucccccuggguuguagcuguugaauacaaauagauaaaaagcuguuugcuuguuucugugucacaucguugguuuuagcuuauccccucaauucugaucuguuuauaagacuuguuucauucuaccagucacuaaauacgcuucaguaggccgugugccgcacggcuucuguggcagauggguucaaagggguagagucuuuuugccugucuuucuaugccguuucuaguaacaucugucuucaaaugucuuucuuacucuguugccuaaaaaucccagugccaaacaggggccuugcucaguaauaagugaaaccagacaaauucguuuugaguugcuaauauuaucucccgggaaucuuaggauuuuguaugauuucccuuuaacacacuuguuuucuguaugacucaugcugacuuugcagggcaaguuuuaacuauucuaaaucauuauucaacuacguauauuuguaauuaaaauacaaaccugaggacucacuuuuaaaauaauguaauaacauuaggaauauuuuacauggcauaaagcaguuacuacauaagaacuuguuucuguuuagaauuuaacuuagauaguaauuuccccggagugaaacuacgcucaaaaaugucccuucgcuccuacggaagucgggaaggaucuguauccagccguucaggagaaugcaguccuguccccauggggucauucccaagaagaacauuuguaaauggaagcagagagaguacuggguaucuagaagagcuugaaaaagaaagguaacaggggaguggggguggguggguaugggggacuuuugguauagcauuggaaauguaaaugaccuaaauaccuaauaaaaaauggaaaaaaaaaaagaaaaagguaacauguguuccuugugcaguaaguacugugugugcgugggaguuuuacagugcaagaaacugacaggugauagccugcaccaucguucuugcuuuauaaaccaggcuggccucgaacucaagagaugccaaugccucugccucugccucucucugccucugccucccaagugcuggaauuaaaggugugugccaccacaaucuacuuguucuaaaaauauaaaugauugugcuugcaauaauucuaaaaguagaaauaaggaauuuucuugaaauucuaaagucuuauauuugacuacuuagguauuuuaaauauucuacacauggugaauccuugguauaguggugagcauagcuaccuuucaaauaauuuguacauugaguaaaacccuaaaucauaauauuuauaucuaguugaauuaucagugacauaguagaauuucagguuaucuuuugaaugaaguucaauagcuacuagauccuuuaugaggaaccccuucuagaaagcagaggaggaggaagcacagugagaggaugguucuuuacaugucauuuuccacuuagccugggcucugagcugaguucuugcaaugagcuauucuccucgcaaguuagaauucucucaccacacauggcagaaccaucaagauauuuucaaguauuuuaggacucagugccagguggcgacgcucuucuguaaaacacuuguaaaagcggaguguuaaguuuacauauaaagagcaaagccuggagcccugcagagauggcucagcucugccagugguccugaguucaauucccagcaaccacgugguggcucacaagcaucuguaaugggauccgaugcccucuucugaugugucugaagacagagacugugugcucacauacauaaaguaaauaaauaagccuuggccugggggagaggcagccuggaaagacagcuuagcuguuaggagcauauagugcuuuugcaaaggacccagguucaguucccagcacucauaugguggcuuacagcuggcuguaaaccuaguuccagggacuccauaggcagcaugcauaugauacacacacauacaagcaggcucacauucacauaaaauaaaaagauaaauaaguaaaaugacauauagaacguaaugcagcaugcuucacugggagacaaaggcauuguuauuauuuuggcuugggguaaggccauugguaacagucaggcuggccauguagacuaggaggguguugcgcucucuuuaaucccuuaccuaugcuggucuuuauuuuuacccugggcuacccaaacaccguccugauccaaaaggagagugcucaggcccagggucuuuguucccuuucauucuguaaagcagcaaaggccaugugagcaggccagacuucccaggcacuuacuuuggugcugauauuauuaguagagagcuuuagcgaaaagaauuuuuuaaauggauuuuacugccagugcuagguuucauaacagcucuugguaaugaagacuugcaguggccgugcuccuuuuaucucagccucucugacacguagggggaugugcucugggcuccugcugcggcaucauuuaucucuugccagauccuaccuacccauuuauuuucucacaauugagggugcuuaacuuugaaauuauuucucaggaaaggucuucuacauacauuuguacucauuacaaauauuucccaaggaaauaccaaacagaauuuuuaaaauaauguaucaucagagaggggagcaucauugcauggccaaauuccagaccauaauagaaaauuuucacagaucugauuacaugaaaauccagauuuuccaaauaacaaaauuaucuuaagugauaaauugaaaagaaaagaaugcauaugcagccuagugaguaagguguacccuccccagucuagaaguccccuaaaugagaagcagagguuacagaaaggaguggguugcagaccuggaagagugcuucgucucauucacaucagaagaaaugagcucaagucauggugauauccuggagguuuauaaaucuguacucuaaaagugugucauacacuuaaauuuguaaaaauuauagcucauacaauugauacaacaccuuacuaggacacuuaaguucaaauucauguacccucaaauuuuaucaugugugcaugcaugaacauguauagagugaaguacauaaagacauucacauaaaaauauauauuuugauuauauauuauaucaaaauacuuaaaaguccccaagugcccccagcaaagaauuggccauaguauuucucuuucaugaguuuaugaauauuaugagguacacagaguauuaggcagcuaucaagaaguauguagcaagucuuuuguucucauauggaauaaccuccaagauagaugaaaaaaacauguauaggacaacauauauauuaauaaaucuaguauuuauguuuuuaaguauacauguaauuaugcagauuauuauauuauuauuguucacauuuuauagaaaaucucuggaaacaacacaagaaaauuauaccguacauugcuuggggaaaggagccacacagaacaacagugagcguguacuuguuaguccuauugagcuuuaucucaguaacagccuucuauuauauguuuauguuuauaauggucagauguguagugggacugguuccuagggaauuacguaaauucauccugagauuccaagauuuaagucucugccucaggguagcacccucuggcuguggaugugaaguuuauuuacagaguugcugcacaguggccugccucagcauagcauccucccucagaugcagcgccaggcuucucucuuccccagcgucagugcaguguuccuucucuuucuggcugugaguucuguugucgccuuaccuuucacuugguacucagaagucagugguuguaauacccaagugcuacuucaaaacccaagucagugcguucucacugguucauuauugucuuccagcagcagcugcugagagcuaccaggcaauauguauuagcuuguguaaauuuaccuuucuucuaaacagaucauuacuccuugcugaucuugacaaagaagagaaggaaaaggacugguauuaugcucaacuucagaaccucacaaaaagaauagauagccugccuuuaacugaaaauguaaguaacuugacagugcagcuuuuagauuugguaacuugaccuuugaguacucagauuaucuaggaagaauucaagagaacugaauuuguaaugauauaaaauguaaugugucuuaaucagcuauuaaccuaaauacaugauuaaugaguauuuucguuguuguuguucuugcuuugguuuguuuguuuucaugggguuuuguuucuguuuuugaucagauacagaauuugauguauccugggcugacuucagacucccaaauacuaggauuacaggccuccuuuacuguacccacuuguuaguuaauuuuuaauagaagaaaaaauuauuguguaccaacagauacuuauuuuaauuccacauguguuuggaucugaaucccacuuagacaacuauauuuuuaauggguagaaacauuauacuaucugcuugcaguuucuguacaaugcaggaaucaugccagaugguuuuuacaacuaaaauguccuugacaauaauuugaaucuuacucuuuguaguauaaaugucacuggcuauaggcccggauccuacuguguuuguaaacucugugcccuuuaacaaauacacugagguuuaaauugucuaagucucaggaauacacagaaguaccauagaagaaaaccaacuuacugcaacuuccacauucauguugugccgugcacauggcucugaguuaagccagaucaccucacaaaguggauacaugauacgugccuguaauggcuguguccagaacagcuuuagagaugggcaugacugagagagacagugggggaaugaagaaaagacagacaagacagacacauggacggacgcacaugcacacacacacacauacacacacagaaacagcagauuggguucugauggagaaacagcacccuggaugcucaguguuuauaguguuaaacgaggaggugaaguuauugcauacagaaaaacaaggaggcaggcuuagcuaaucucaguaggaacagucucuguaggagagcugucuucaagccauaaacaucaggccagagggagaaagcuguggugggcauucucuauacauaccaucagaauucacacuuagaccaggagaaaggcugugccauucuccauggguccuuggcauaggcuugcccauguuagcagcacacauucacucuggccuuccucugcuccucacauggagucuuagcacccaggaauuugaagagaaguaucagaaauucaaacugugauggcucaacaguuagaacacucacugcuccucagcggaucugaguuuaguucccagcacccacauggacauucacagucaucuguaacuccaauuucaggggauccagugcccucuucugaccucuguggacaccaggcacucauguggagugcauauauaugugcaggcaaaacacuugugcaugaaaaauaaaaauaagucuuguuuuaacaaauggaaggccauccuuaguugucuauaauuugacaccagugugggauauaugagguccuaucuaaaaguaaaggaaaaaagaaaacuuagaaaaacguucauaaucucaagacuauauguuucaucgauauuuuguacaguauuuaaaagggaaaauaagacagguguauguggcuuauuaucuuauccaccagacuucggaggcugacccuggggguaguagugaguccagggccagccugggcugcaggaaagugcuuucucaguauaaccuucauucuuagcuuagauuuucacguucuuauaguaguuuuaagagaacccaauaggcagaaauugaaaauagaaggaagaaaagccuuccagaauauaguuaccugggcuuccugagaguaggagcuauaacucaaggcuuaaagugcucacuucacuuguuacaacucaagagcagugggucaguaccagagaucaaaaggaaagagcaggugucagauaaauuuauuauuugcuauuuaugaaguaaccauguuugauagaauacacaaaaauacacgaucaucgugggccauuaguaacacuaauaaauuuaaaccugcuuguauuuuauagucacuauacuuugcuuucugauugggaaaucaaguuaacaagcaucuccauauagaaauauuuaucugugccauauccagggauccaccccauaaucagcauccaaacgcugacaccauugcauacccuagcaagauuuuauugaaaggacccagauguagcuaucucuugugagacuaugcuggggccuggcaaacacagaaguggaugcucacagucagcuaauggauggaucacagggcucccaauggaggagcuagagaaagaacccaaggagcuaaagggaucugcaacccuauagguggaacaacauuaugaacuaaccaguaccccggagcucuugacucuagaugcauauguaacaaaagauggccuaaucggccaucacuggaaagagaggcccauuggacacguaaacuuuguaugccccaguacaggggaacgccagggccaaaaagggggaguggguggguaggggaguggggguggguggguaugggggacuuuugguauagcauuggaaauguaaaugagcuaaauaccuaauaaaaaauggaaaaaaaaaagaaauauuuaucugcauaucagaauaucauaccacuuaucagcucuaaaccauauuauuauaacacucugugacauauucagcauuuugauuuuuguggagugguugggaaauggaggacaaaugauaaaaauaacaguacaggcucaaagagaacaaaugacgugcaggggagcauggugaugcuugucuucaguccccaaagcccagcacuuagccgacagguaggcagguucugugagaugaguccagccaaguagugcacuucaggcuuaaggcugcauagugaagcucugucuuuaaauaaaugaacagcgugcaggcuguuucaucugucaugugcuccuaacuuuggugugccuucaagagugcauuauguguauguuuuguuugagggcaacuuaaaaguuuggaguucuugaacccagacugccaggagcaguuuccuacaagagggugaggagcgugaagagcacgcccuccugcucuccauggcucccagugucuccugacaguuaccucaguacaccugugagggugucagagccacugggauugcguuuacuacagcagugaacggcuuugugggcacugugaguugaaccccagucgucugaaaugggggcagucagugcucuaaaccauugagccaacucuccagauccaguguuuaauauauagacaguuuucuuacuccauuuucuucauauggcacguggaauuuuucucucuguuuagccuguacacguaagcccuaguuaaaucagaaggguaaggguagugaacaucugguguauacuaggcuuuuguuugugauagaaucucacguggcccaguucuccugaacucccaguguagccaagaaugaccuuggacucuugacccuccugccucugcuuccuaagugcuaggauugcaggcaugugccaucacaccaagcuuuauguggcacagguugggugagcacuguaacaacugagcugugucugcugucuaaaauacuaauuuuaauaauuagagauaguuccucgggguucugacuuguaauucaaugguacuguaucugccuagaguguucaaggcucuaguugauuccuaauaccacaaaaauuaaucaggugccccagaaguucagcucacccuaacuggaccaguugcuuauuuucaucaacacagucuaaguuaaagccagcuuuuaccuugggcaguucccuguguagucagggaccccaguuaagccugcugccaugcucaugauuuuggguuucucaagcauggugacuuucauaguuguuuacucaauuucuuaacugauacuuaugugcuuuuuggcuuuacuaguaaacugagaaauuaaugugcuguuuguggucuuaguuuuccuuacagacagacaugacaagacggcagcuggaguaugaagcaaggcagaucagggcugcaauggaggagcagcuuggcaccugccaggacauggagaagcgugcacaggugauucucccacugcacacuacagcucugcugaugguucuguuacuccauugccuguguggcgggcggggcuguaguuagugaugcagcgguuaccucgcuuagaugaggccgucaguugggccuccagcaccaucaaggagaacauucagagucugccuugaauuggcuucaggauaacagucucucguggcuguuggacauuauaaccaguacugacauaauucugccucugcuaugacacuuggguauuaaucuuucugcauagaauuacagggaagaaauauugauucucccacagauaauaacuagcuucaauuccuuugagauugcuguuucuugugcucuaaguuuauguagcaacauucagaaguucuuucaaaaaauaaaaaaggcagcaacggcacguguuugagacacaaaggaggcguaaggaguaccuaagggaagggagcaggagggaugagggagacgauaacccacaggaaggucgagaaagaacaagaacugccuugauuguagagcacugccuuguguacagcucucugaguggcuaggguggcccuguagaagacagguguaauuacucccuuaccuugcuuuucuggccauucuguuaccuggaaaugacauaguucauuuugguugcuaagauuaacauuuuaggaaauuuaacuuuguauuuugaguaacacacacauuuucuacuugguaauaacugugugaaaauuaaguuuaaaaaccacaaacaagacaaaaagccagcugguggaagggcuggcauucagugacagcagugcaaauggugucuccuuuguaagaacagaagagaaaugacaguggcaggagugguggccccaagaguacaccagagcuagcacagugcaggagucauagaaaaucaguuauucuguaagaguuuccauacuuauaaggacgucagcaaaggaugcuacagccccuccccugcucaaucuaaaugggcuuuauuuuguguaguuguaaauguucuagauucaucucauagaccucaaauacuauacaugauacuauuucuuugcuuguuuauaauauguaacuuacacuauaaugaguuaaaaggugaguauacaaauguuuauaacauaucugagaguaauuuucuguauaguacagugaaugccuacaaaugagugacaacagaaagcagacaccaaaauagugagauauaguucagccacugugugugcacaccucuguaagccagcacucaggaggcuggagcaggaaggugggauuggagaccagccugagcuacgugcugauuccgcucugaagaagaggggcuuggauguggacagcuccacccuaaaacaaauucaguuggcuaauagcugugaacaaugauggcacucuuagucuuaacauaaagaagcuacaauuaauagaagaaaauguaaaacauuugaguccuuaagauagaauggaaacucaaaaaagcaauaaaagucauuuucauaaaaauuuaaagcaccuguccuacaaaaaugaaaacgaaaaauauuuuuaacaguauaaagaaaaacaguuauuaucccugaaauguaagaggauuaauccugagggcuaauucuuuuuugguuugguuugguuugguuugguuugguuugguuugguuugguuugguuugguuugguuugguuugguuuugguuuugguuuuuucgagacaggguuucucuuuguagcccuggcugucuuggaacucacuuuguagaccaggcugaccucgaacucagaaaucugccugccucugccucccaagugcugggauuaaaggcgugcgccaccaccgcccagcugaggacuaauccuuaaagacugccuuuguuuuuaaaugaccaaggauuggccaacagucuguuuaaaggauggagauguccaguauaacauguagagaucacugguaaauaauucgaggaaauuuaaaguagaacccagcccugcuccugccuuugugaccuuuaucucuguuacuaguuugguuauuuacuuagcuuccucuuucaauggcaucuggucccacguuagcauguuaguaaaggcuaagaaaaugcccaucagguguaacagagccuacuucugggccagugcgguguacacaccuuuaauuccaguccuggggaggcagaggcaagucgaccucuugaguuccaggacugcauaaggucaucuccaaaacaaaagcagaaagcaaucucagaucauguguuugagcagacaugccuuucaguaguuccuucacaguuugaauguagaauugugccaucuuugugguucuuauauugcaaauagaaguaauguucauuuggaaagcagaagacagagaaacacaauucuaggcuacccucaaccacacagcaagcucuaggcaaagugugcuagacaaagagacugggggucaugggggagcagggccagcaaucagauguaaaguaaauaagcuaaaaaaaauacacccaugucaagacacuccagggguaccacauauuaauaugcacacuacacauaaaaaucaaugaauaucugacuuguucucgucuucuauuucagcgaagaauagccaggauccagcaaauagaaaaggacauacugcgcgugcgccagcuuuuacagucccaggcggcggaagcggagguuaguaaagcccccuucugguacaagucauguaaggagcucucccagaaaagaagauguguguagucaauggggcaucauugagauauggaccuuuuagagagaaaggcgguugucauuguuuuaauuuaugcauuuuuauaugcauugguguucugccugcacauaugugaggguuccagaucccccuugaguuagaguuacaaacaguugugagcugccauaugggugcugggaguugaaccuagauuuccucuccagcccuaaaacauuuuauacuuuucagcaauuaaaauuuagucuuuaaaugaauuuauaaaauucuuuggcaaaugguuggaccuggagggcauuauccugaguuagguaacccaaucacaaaagaacucaaaugauauguacucacugauaaguggauauuagcccagaaacuuagaauacccaagauauaaguuacaauuugcaaaauacaugaaacucaagaagaacgaagaccaaaguguggacacuuugccccuuagaauugggaacagaacacccauggaaggaguuacagagacaaaguuuggagcugagagaaaaggauggaccaucuagagacugccauauccagggauccaucccauaaucagccuccaaacgcugacaccauugcauacacuagcaagauuuugcugaaaggacccagauguagcugucucuugugagacuaugccggggccuagcaaacacagaaguggaugcucacagucagcuauuggauggaucacagggcccccaguggaggagcuagagaaaguacccaaggagcuaaagggaucugcagcccuauagguggaacaacauuaugaacuaaccaguaccccggagcucuugacucuagcugcauuuguaucaaaagauggccuagucggccaucacuggaaagagaggcccauuggacuugcaaacuuuauaugccccaguacaggggaacgccagggccaaaauugggaguggguggguaggggaguuggggggaggguaugggggacuuuugggauagcacuagaaauguaaaugaggaaaauaccuaauaaaaaaauuuuuaaaaagaagaauaaagagcaaucaaaagaaaaaaaauuuagucuuuagcauaaacugucaguuuguauaaucaaaucaccacuugagcuaucauuacccuuuaagugggcuuuuucuuauauguaauucauaaugagaaauuugaucagacauguuuauuugugguuaucccacaguccuuacugaaauguaguaaaagcauuaaaugaagagucacaaauaccaaggaaagugacaggaguaaaaaugggggcucuggaaaaaaguucgacagacuuaacuuuuauagcauauuaagggcaccaaggaaggcugugacagagcuugguguguaucauggaagcuuaaaggguucccaacuggcuaugcaggucaccugugaauauaaguauuagaagggacugaaaugagcauuggcugcacuuccagaagaaccaggcccagcaccugcauggcagcucacaagcauccauaacuccauuucugugggaucuggcgcccucuccccuccuccauggguagcacacuuguacgcaguacacauauauguacaugaggcaacacccauacagagaaaaauaaauguaauaaaagaagcagaugagccccugacauugcuccacauuuucagcacaacuguugcuguuucucuuuucaguccuaacagaaaauaaguuguccccacacaccacccccuucgaaaaggauagggauuuuugacuagauuacaguaaacuagcacaaugaauugaagcuggagauaaguguauagaaagcugacuugguuggaaaucuacucaguggugagaucccugcuguccuccagccuugucaucucucggaagcuucucuaaggaacgcagcuuacccaagaaaaggcucaagagcuaccagcaaaccacaccagccauucucuggucacuguagcugcaaaccuucauuuaauuuuccuguagcuagcccacucuucagucuguguggacacuaacgacugacugcuaggcauuuuaauaauguucugauaagaacgaucauagaaggagagucccuuguugcaggcagaaggaaagcucaacacuacagcugaccuucauaccccagcagaagcagggugugauuguacacgcaugccugaaccucagcuuauggaagcagagcaggccagccugggauacauaagagccuguuacagucauucacucaggagaauuguuuuuaaaagaucucaugagaguuaaauuuaaaaccaugauugaaaauuaaaagauuauuuuuuuuauaaaguagaacaagacaaugaaacacaaaauagaaugguaggcaggcaggauacucagcaaaugcagguguccaccauagcuugcuggccugagcucacugccccagccaaggacccauguguugaaaggagagaaccgguuucugcagucuuucucugagcuccauaggcgugaauacggagaacgugcacacagauuaaacaaguaguaaugaaaagggguuguuuuuaaaggaaaacucuaaagccuagaaaaggaagagaaaugccaauaaagccaauaaagcgaguuccuguagauuucucagcagccaacaaccuaggaauccagggaacaagacuuguuuuauuuauuuauuuauuuuuuaaucuuaagaaaauuuucaguuccuuugacaccaaguauuugaacucauucuuugucccacaauucaguucaguuaccucaaguugguauuagaucccacaagcaaaauucauaguuauuugcaagacuuuucccauuuaacaacaggguuuggcugugcccacuauaacuguuucugccuggcuaggaaucccacugaaguggaugcacuguagaccuuugccaucuugacccuaccugaccccacaugacaaaaaccaaguccuuuauccuuuaagagcccugacaauaugcuacccaauugacauaacgcuuccuguuagcugugauaauacccugguggagaagucacagcagcuggaaucaaggacaguggacacuauuuauuugaccaacuuucuccuuuuauucagucuaggaucccagcccaggaaaugaagucauccaugggggcaugucuuuccaacucaaucacaguuguuguauagcaauuuagaaauucaagccuuuccaaacuuccagagugcucagaauucacuaaaagcucuaaacuuaagugauucuacuuuuauuaaauggggacacgacaaaagccaaaugggagacacauugcaaaguccacggaugaggugaggugguggcaggugaaaauaucaaguguucuccucuugggaucuagguuuguaaucccucauuuuccaucugaguugaagacuuacagguuuugacuuguguuuaggaugcaccugaaaauacuuggcaguuccucaaaacauuaaauguaaaauugccacauaacccagcaguucuagucucagguaucuagcagaaagucacauaaugaucuuaaugcuauuaaugaucuauucaaacagccuuauucauuguagcccaaaaggaaagaugggacaaaugugacacuguuaggugcacuuaaauuuggguacuauaaguaaaauguggauaacuuuugaaaacucguuaaguaaaauagaccacauaaguccauuuauaaaauugucagaagacuggggaaacggcuuaguggacaaagugcuugcugugcagugugaguuaggaugcccagagccuacaagcucgcuagugacaccagcuacacacugagcucuggggucaguauguaaaguagaaggugaucucacagaagaugcccagugucagcuuugggccuucacaucugcguacaugugugcacauacuuuuaauuaaaugucuagaaaaaauuuauuuugaagauacaacucaagcaugguagcacuugauagguaaagggaauugggaguuucaagggccaaccuaggcaacauagugagacugucucucccugacaaaaacucaaaacgaaacaaaggagaugagcucuugccugguacacugaguggaaauguggauuaacuguaagcaggugggagagaauuuacuuaaugauaaaaauacucgguaaauuuaucaacaucauuaaauugaacaccucacggguauauuuuguggcacucagcugcuuaaacaaaacugcuuuuauuuauuucauuaaaccaguaauguacucuuauuacccagcacucagaaggcagaggcaggaggaucaguaauucagugcccaucucagcuacagaacaaauucaagaccagccugaacuauauaagauccugccucaaacggcaucuuucuuccuagucugccaccuaggguagaagccuggcccuguuuuacagcagguauaggauuguuguuacuagaagucaguaacagccacccucucucccagcagaagaguagugaugaggacagggacccaggagugcaguguucaacucuaggauuggugggaagaaaagagacggaggaggaaaaggaggaggaggaggaggaggaggaggaggaggaggaggagaggugguguuaguuaucaugagugggcuuggcaguugcucugugaccuucauagacuugucuuucuuuuuuuuuuuuuuuuuuuuuuuuuuuuuuuuagauuuauuuauuuauuauauguaaguacacuguagcugucuucagacacaccagaagagggcaucagaucucuguuacaggugguugugagccaccaugugguugcugggauuugaacuuuggaccuuuggaagagcagucgggugcucuuacccccugagccaucucaccagccccaaucuuucuuuuuuuuuuaccugagugucaguuacaagucuuaagguuucucugugucucucucucucucucucucucucucucucucucucucucucucucucucucucucucucucuuccucuuccucucucucccuuccuuccuuccuucccucuucucucucuccuuucuuucuuucuuucuuucuuucuuucuuucuuucucuccucuuucuuucuuucuuucuuucuuucuuucuuucuuucgcucucucucuuccucucuuucuuuuuccuuccuuccuuccuuccuuccuuccuuccuuccuuccuuccuuccuuccuuccuucuuccccuucucuguaucuucucuuccuuagacaaucucauuaauguuuuaaggcuuuagguaucaucuauaugcuguuuguucuugauuuuuuuuuaauccccuugagguccagauucuuaauccuguguuccuaccauguaucaccacuuaggauuugucauagauuuuaaauucaaccuacuuaacacuugggugacgcaccccuuuaauccuagcacuuggggaggcagagucaggcaaaucucugaguuugaagccagcuaggguccacacagugaguuccacuucagccauggcugcauagcgagaccucucucaaaaaacaaaacaaccaaagcccgucuaccgucuuuaccagcccccuucuuucucccuuuuaguccccaucuuuccucuccauagacugugugagcaaaaggucaucagaauaauccugcacgcccuuuugccacuguuaguaacugcuuacgcugccguagcaaauaccagacacaaagcaugugaagagagcagacaguuugagagguuccagucugccuuguggguagggcauggaagcaugagcuugggguuacagucaggaaaggagaggcaagcgcuggugcucugugccuucucccaccucacuguuuuauucggucuagaacccagcugcugagugaguggcaccacccacauucaggguagguuuucccuccuugguuaagccaacgcacccaggguuguaucugcuaggugaguucagauccagucaaguuauaacugugaugaagauuaacccucacaagguccacccaccccuugucaaccugacacccaaacacauccuuuuuaaaucauaaaaucccaccaucacugucaaauauucauggucuuuucauaagacagugcauuuaauccaucucuacacauuucuguugcugucuggaaauugccacucaaaccauacaaacucugaucucaguuaagcaagaguaguuuauugaauacauaccuuaauccuggacugcccaguggucagugagucaguuguaaacauaacaguucauauugaccuuugaauugaaggguccuacauaaagcuuuguggaauuucuuacgauuagcaaaccucauacagaacaaaacgggacgugugaucagcauguccuugagccaagccuucuccgagucagugacuggcaggccgguuacagcaacaauaugaaguagcuggcaggcuuggaacaaaauggcuacagcuacuggggagggaggucagacguaacaauuucauauggucaucagggcuaacauuguucaaaaccccagucucuuaacugaguaaaauagaauaaaaaaauagcuguaacauuuuuaaaacauggugauaacaguggcgcaauaauacugacugauggaccagaaaagcuuauugucauaaugauaaaaauacucuaaaacuggauugugaugagacugguaaauuuauugaaaauaacuuaauggaacacuuaguagguauguucuguagcacuugacuacuuaagcagaauugcuuuuaaguuuuuacuuuuuuuuuuuuuuuagccaagccaguaaugcacuccuguuacccagcacucagaaggcagaggcagggggaucaguaguucaaggcucaccucagcuacauagcaaacauucccauuccaacaugaaagacugagaggauagcaaggacagaugagaccaaaaugagaacgacagcauggcagauccggaugcugcccgccucucuaguucugccuccugccaugcaugcagccucucuguuaggcugcuucuaucccaugugugcgacucucugcgguuuggccaucucugaucuacugagcuuuuacugcagugaggcuuuaccuucacagccucaugaaguggucucucggggccucccugcagggacucugccucugccucaugccccagcagcuuccuagacucuuggcacaaguuucccugagcuauaaaucuuaaaguuugcacagcugcaagaccacuugagcaacucuguccaguuuugcugccagcgugaacaguagucugaccaguuuuuaucuaucuaucuguugugcaccuuggcagcagagccagggaacuuuccaugauggauuucaagcaaggcaacauuguuauuucaguuucuccccuucccuaugaauugcacuuuuccagccuggagucuucaguggcuggagucuugccuguaaggcaccuuuccuccugagugugaguuucuagccuuuaucagccagccucuaaccuuuaucauuugucugcaucaguccuuaaucagcuucagacuccccuccugcuccuuuguuugccagacuccacauuuucccaauauuuuaguucucucuuacuguaaaucuaagagcaguacacgagaccauaccacagccuguaugguaugcucucgaaauuuccucuauaacuuaguguauuaccuuugaauuaugccaguuuuucaggaugcaggguuuuuuuuuuuuuugguuuguuuguuuguuuguuuguuuguuuguuuuugccagauguaacacagcuggcuucuagcccagcuccuaucgucuuuguuacccugggaagccugagagcauaguuacuacugugugcccuucucccagugcucccaccagaacgguucaucaagcucugccuaggguagucuacaaccuguagguuucaaccucuuugggggaggaagacugucagaaaacucagauauuuacauuaagauucauaacaguagcaaaguuaaagaguagcaauaaaauaauuuuauggcuggggagucaguaggacacaggaacuguguaaaaggguaacagcauuaggaggguugagaacccguggcuuacugcauuccaggcuucuguagccacagacuagucccgaagccuaucuccacaugggcaggggcgccacagcagcagcccugcuccucaugccacuucugugagacguacuuuccucauugcugugaaaaauuaccucccaaaguugaagaaggguuugaggggacacagcaucuuguccugggaaggcauggggucgggauugugaggugggcaacuacagcacccccuacagugagaaacaggagagugaaugugggugcucagccacuuuuucuuuccuuucgucccauccaucggguagugaugcccacaucuagcauggccuuucuuccuuguuacuguccauagcacucccucucucauguccaggagaguguccaucaaguuagccagaguuaaccaaggucacaccaguccagcaccaaauccugucaggguucucucuauagcugugcuuacaucuccacuuacccuucugugacauaccagccucuucuuacuaaugcuacugcauuagccucccaacugcuacuuaagucacuuagguuugacccguugguuuguuaguguugaccacaugaggcagcagguggcauguaguguagcuggcagaguacugaccuagcaugcacaaaacccuagguuuuaucccuaguaccacauaaaaccagggauagggucacacaucuguuaucccagcauuuccagagaugaggaccagaagaaguucaagacauccucggcuacacagcaaguuugaggccagucugaguuacaugagacuaucugaguaguuaaaauggauggauaaugugguagccucagaauaacauaggcaaauccagcaacaucagaacauuuuaaaaacuagcauauaaaauuauuuuuauucuauauguaugaaugccuuuuugccugcaucuguaucuauguaccacauguguaacuggugccaacagaagccaaaagaggucaucagauccccugggauuggaguuccaccaugaggauucuggagcucaaacguggguggucuggaagagcagccagugcacucaccacugagccgucuguccucuccuguagccaccuuaauucugcucaucacuuuccuugugcuugagcaaguuugugaccuuuuguucugcuacaagaagucauguuccccugcugcagcucuuuccgugugacccucuguuuaccauccugguuaucagguccucuuugcagugccacuuccuaagaaagcgcucugcugcuucagacagcucccagcuuucuucaugaggagcucuuggcuuuccuuugacacacuugucaaaguuuugacuuuauuguuauagcuuugguuuuuugaaaguguguucccucgcuaggacaagcagacagugguguuugcugugagcaugcuggcaucuuccccuaugcuucugcuauguauugugcucaccggaauccuugacuaguuuuaucaugggugacuguauuccuacucugcuugauuggagucucucuccugcuucugagucccuucccuuuugcuuagcuacagcuguuacuaguuuugggugaaaaugauacaugucacauuuuuaacuggucuagaaaggcuucggggaaggcguuuuuaaaauauaaugguacuuuuuuaugucagacuguuaaagcauaaucuuuacauuagauuaugauaauugcauuuuccuaaagcaaacagauaggaguuucuguagaagauaugggagauuauuuuaguucuugugucugugcuacugguuuacaaaguacccgauuuguauauccuguucuaaaauuacuacuuuuacuagguauaauaugucacuuuuauuucauauaacagaggguagguacauuagcaaaauuuucuguuuuauuuaucaccuucaaagagcuuaucacuugguuucauaugacauuugcagaagaugugcauauauucuccguaaaaauguaacuacggggagcuauuuguaacccuugguguuaguuuaacugcuagauuugcaguucuauuaaaugccaaagucaugugaccuugcacccaaggacuguuauuuucuguagguggauuguguuccugauaaugagagagcacaucugguggagaauggcuuuacugugagccucugaaauccuuugucaguacagcccaagugcucaggggauacuuagccaggcuggaggucggacgugcagcaugcacuucugugccguugucagccuguauaauugauucaucgagaguuuugaagcaaaaaauaagcagugagcucuaaaagcaugcuguuucuguauguaaugauacuaacuccauguuaacagaggucaucucagagcaggcaugaugcugccucccaugaagcuggccggcagcacgaaggccacggaguggcagaaagcaacaccgcagccuccaguaguggucagguaugaauauuuucaaacugacaaguccugucuguuuccuuagaaugugugccucuagagacauucaguaucaaagcacucucgauucuuauuacauuuagagacacuuucugaacguguuggaacauuuccugcucggaucgcaugugcguggccuucaacugcugccgugcgcauucuggagagaguuuacuuccgaggggcugacccugguguugcauguuagcacacaguucugcucuccuuaaggccucaggacaaagacaugcuucugauucuuaacugucacaaaggcucuuuuagcucuuacuuucugguauacuuuaaguuuacacaaauugagaaauaaaucuuaauuggaaaagauuuuucugaugcuuauaaauaaaaagcuccguacugcaucauguuuagcugggacuguguccauuuuuaccaucucuacacugugccaccaguuuucaacaaaugguuuauugagauacauucauguauccuauauuuuucaaauuuccuucaacagacaguuuuauguuauaagggaaugauauuuuaaaacuaaaauuuuauuaaauugauuuuuacuaucaacacagaagauuggucuuucuaaguugcuuuagauauacuguuuauaucuuuaaaaaagggacuauucuguuaauccacuaauauauaaagcuuaaaauacuaucaaaauauuuccuuguacugaaguuaaagcagauacuuuauuccgcaucgcuaguuaguauuguacaggaaaguuauuuaauggugaauuaggauaaaauagugagguuuaaauagaagguuugaguucuuucucuguguuacuguuccaggaauuccuugagaacuguauauuccuacaguguaggagaaagaagauaaguuucauuugacaguuaguuguugaggcuucauugagaucauauucuaauuacuguauacuuuaaagucuuauucauaugguagacaguaucuauacaaaucugugauacuacaugaaaaucaucuuuaaguugauuauacucgauagcagaaauggagacuguugcaaauauaaaaggauaagaaggaacuuuuuauaaugaagugggugggaaaaccacaaaagaaggaucaguaggugucagaagaauuugaauacuuuguaucugaggaaacggaaacaagauagguagacacagaagaucgggauggagaggcucugcaguuaacagacuggacagucucccagaggacccagccuccagacgcagcacccacauggcagagcacuccagucccagggcauccaguuuccuuuucuggcuuccaagagccagccacucaaguagaacacagacauacaugcagacagaacacccauacauguaaaauucauuauucaauuacauuuuuaacaagaaauuauuuuuuuacuuuuaccuuuuuuaauugaaauauaauuacaucauuuucccucugcccuucagucccuccuguguccaucugucugugcccucuccugaaauucauugccucuuuuucuuauuauugcuacacacacacacacacauaacauauaaguauauaacauacuuauacguuuauguuaaauguauauguaacauauaaguauauaaacaaaaccugcugagucugucuaguguuugaguguccaugauuucagggcugaccacuugauauuggauaaccaguaaagggacucauuucuggagaagacuacuuuucaguugccuguaguucuuugucuaggcaugccucccuccccaccacacccuaaauaucccccuuccacacuggcaugucuguugguauuguccuuguucaucagguccuguuuaggugccggaucgugggugaaacuucccugucauuuuaagagacauaauuucacagcagauuuccugguccucuggcuuuugcaguuuucugacccacuucagagauguucccugugguuuacguacaagaguuguguuguacacacgcacaggcaguuguucuaucuacauucuuacuuuucuguaauggccuccaccucuuucagagagaagcuucuuugaugaggggugggagcagcacugagcugugggugugaggauaggauuuagaauggaguuaggaggaugcugcuuuaauaaaguauuggugauagucuccucuaagagccgugaccucacucacucgcccuggguggcuggcuagacuuccagcuccaagcauaguuucaguuucuuccuguuuagcaggccuaguucuaguuaggcaacugcugguuaaccgccagcuauguaugaggaccacugugcacccuuagggguauuuaauauuuuucuuccuucccucccucccucccucccucccucccucccccucucucucuuucuuucucucucucucucucccucccccuuucucccuuccucccuuccuuccuuccuuucuuccuuucuauauuuauuuauagguuuuuaguuuguuugaguuuuucuauuuguuuuugaggcagggucucuguaagccugguuguccuggagcuugcuggcuggccuugaacucagagauccuuuugccucccaaguacugggauaaaggcauaugucacuacugcccagcucccuuagggcuaucuuacaugcuggguuuuguuaaugguuccuagguguccuagcuggguagggcucuuaguuguuccccucccuugucagcuugcauaacaucuuccaaugcuaugaaagcuagucgucagggaggaggcuugacuuggaaaagucaagaucaaagcuggacauaauggccuguaccuagaauccugugauuugggauguagaagcaauaaaauuuuggaguucauggcuacccuuggcuauagagccaauuagaggccagccuggguuacaagagaaucugucccagaacaacagcaaaaaagucaagauuauguuacuugcaaacauuuauagaaaacaaaaaauuuaaaauauaaagauauuuacaagucagguauuuaauaaagaugcuucagaauuggccagugagauaauucauuacauguguuuguaugcaacugcauaaggaaugucggggucaguguuacaguagcugucauugugugcugaggucuuuagagcuuuuguuuuauugcuuauauauuuguauauuuuaacuuuccuagaacucacucuguagaccaggcuggucuugaacucagaaauccaccugccucugccucccaggugcugggauuaaaggcgugcacuaccaugcccaguuauuuuaacguuuuuaauaagucaaguuuuuacauuguguaacaacuauaaggucauuuuuauuuugggaaaauggaagaaaaauguacuguuuuccauuccucugucacuuaggguguccccagaggccugauugaaauuguuggggucuaggaaucaccccacaaaccaucagacacugaucucagucaaacagggauaguuuacugaacacacacacacacacacacgacugaucaaucagggaugcagucagacucaggagcugagacugcaacccugacuguuuuccagggguagcuaauaaaggcaaaaaccacagaaacucauagcaaccauaaaagcucacacacagcuacaggaaauacugccgagugguugggcagaugguucaagucuaaggacgacaaggaaggaguucaacauagacaagcaguauaguuacuguuguuagcuauacaaagcuguucugaccuuuauugcaauugccccuagaggagggcgagggucugggcaauuuccaagaauaccaaagcauauccaaacaggauuugcggugguuaauaguuaccuuggacaugaaaaagguccucgcaacaguauuaagauggcugaccacagauauaaaacaaaauggcuaugguaaugucagaaggcagcagccuucuuacagagaccucauguuauuuagugugaggauggcagaagagggaaucauugaaaggagucgaucagucaugguagccuugucaguaaucccagcacugugaaaacugagguagaaaggugggcggugguggcgcacgccuuuaaugccugcacuugggaggcagaggcaggcagauuucugaguucgaggccagccugaucuacaaagugaguuccaggacagccagggcuacacagagaaacccugucucgaaaaaaaacaaacaaacgaacaaaaaaaaaaaaaaagaagaagaagaaagaaaaggaagaaaaagaaaacagagguaggauggccaguucaaguccaaccuggguuacauaguguggccagccaugagccacauguagaaacacugucucaagaaaaagaaagaaagaaauugguaauucagaaccaaauauuauucccucucuaaauaaauucuuuuguuuuacauuaauuccaccaacauuguauacauaguuauuaucaguccucucucaaaucuucauguacaugaacagucaacaucaaugaguccaagauuccuuagacaccagucccagguaugugaaaggcugaugcagaauuaucacuuuagucaauuuugugccuccaggguacugagauuaaaaggcguaucucccuacaauuggcucuucaaccuaucuugauaggauguguauacaagauaucuuuuauuauuauuauuuauuauuauuauuauucucucauuuauauuacauacuuaacugaaguuuccccucccucccagacccauacuccuccucuguuucccuucagaaaagagcaggccucccagggauaucagcugcacauggcauaucaagauacaguaagacuaggcacaaagccagauaaggcaacccauuaagaggaaaggguccuagagcagagauacccccucccaagaacauugagcuacacagccguaacuauacaugcagaggucgcggucagccccauacaggcucugugauuaucacgucagucucaacaacagcaagaggagcgcucgcuaucuaguuuuuuguuuuaugcaccacagucucugauaaaugauuggugguuaaauaauugagcgaaaaacuagugguuuuaaaggagaacgauacauccuugcuaggaaaaggauuucuugaucuguaguaauuucuuuaggaagcuaagugaaguaaauuauucaggcaagucccugcuuauuuauguuagacuucuuccuuaauggguucucagcuuugcaguuugaagaucuuugauaaugccuuuggcagugaugaugaagcucaagcacaaguuagggagagguggaccaguggggaaagccaugcaccgcugcuggucucuaggauuccuuccuuugggcuguuagagauggcauaagacaagaguaaccugguuccguguggaucauauccacugugacuacccauuguauuucugaaaauuaucuaucauuuguucuauaaauauuucacuauucauuuccaagauaagaaugcuuuucaaaaaugaauaccuacugucauuaucuccccagugaaacaaaugauuuuuuaauagcauaguauagccuaucaugauucguuugcuauuguuucauaaauguauuuauaauauuuuguuucacuuuaggccuagauaaagaccaugaaucagaauauuggcuuauaucuaaaaucuuugccaccaguaauuuucccauccuguccucuguucuuuuuaaaacauaauuuagauuuugccagucucccaccuaaaguccacagcuuaaauauaacaucuuuaaagccuccucagauacuuaauuauuuaauccaaccuauguccacauuagaauacaccgugcucuccauauuugucuuuagagcuaccuuaaguuuuauuuacugcagcuuuucuguccagagcaggucaucgccucuuucuguuuuccucugguaucuugugcagccugcuauaguuuuguuauacugcaguuauuuaucucaucuuuccccaauagaaucucagcuucuucuaaauugggagcuucagaguggccuauauuuauaaucuaaauugcacugccuauaauuugcuuaacuucuagaguccagcuacacguguggaucacgaaacagccaguguuuugaguucuagcggcacgcacucugcuccucgaagguugacaagucaucuggggacaaagguaacagcagauuacaaacccucuugcuagugcuagggguauuuugcuaagauggucuucaugaacauuuaaagaauucucgcucagucucuuaaaaagaaaaaugacauuuuuauacaaagaagcauaaaugagaggaaaugggaauuauaaaaacuacagacuuguugccuguuaauuucguuuucagcucauuauccauuuaccugcaagcauccuaagcuccagccaggcugacuucuucaucaccccugugccuucccaccucaguguugugucugcagcagugcacauguuugccccaccuugaagggcugucagucuuuccgcagcucaggcgucugagcugugucuccaaaagacaguuucuuaacuccacagucgggaugaaacgcccucuuaaaaaucagauuguuuuucucugucuuuaggaucucaccaaggcuacaaaugaguguuaauauuuauugaaauggacagaaaaauauucauugaaacugaauuagccaauauggcaaauaucuuacaguuaugggaaaaaauguaugagaagaaaaucauuuuaguauuuuacuauggugaaauuaugagcaauaugucuucagucaaaacugaagaauuacugucuucauagcauauucugugcuuuguaaauaauaugggaauucuuaggaaacauuaaaguaacauuaauuuaagacaugaauuuuagggcuaaagaugaaaaucauugauagaaugcuugugaaauaugcucaaagcucugagcucaauugauuaagaaaaaacaguuaauuaaagaaauggcuagucagugguagcucacaccuuuaaucucagcauugagaaggcagaggcagguggaucucuggguuugaggucuacacagugauagcuagggcuaaccacagaaacccugucucgggagucgggguauuaaagagauggauuugagugaucagugguagcucaccauaguuucuguugggaccucucuaagcugggccaauaaguaauuaucucugcauugucaccaguucucuagauucuuacugaaaaggaagacgcugcuucaggccaucaggccuagagcugaugagauuggcucagcaucaauacaggguugacucaggcaggaugcauuuccuuuagcagugauuugugcauaauaaucuucaggccugguuuccuguguaauguaaaucccuucauuuuguagcucagaaaauugaugcucaagagaaaucacauaaguacuaguaccgugcugcuugcuuaaaagugauggagccaaacuuuggaacuaagccugaugaaaacacauuuaucuucaggccuguugcugccauaauagaacuagcaucaguggaaaguguuguguuuacacauuccaagcaguguuuggcaaccucagcaacauggacuaagucauucuguuucuauaggauauuaaguagcgccccuggcuucugccuucaaaacccccuaacacuuaugugccgcuguuguuaggaccaaaauuaugucucagcguacagccagauguguccuugugaaucucugacuuacacaggugaugcgcucuuccuaugugcccucuccuuucauggagcauccucugacuuggaagagaagcugguaacaccccaugcuaacuggaugcuguuuuucuguuugacuugcuucuaagcuaauccucccaaucugucaaagcaacuaaugcuuaccacuugcuucucagaaagaacaugauucugugauugugguauuuuucuuuuuaauggcaaaauaauuuuauauaacagauuauauaaguuuaaaugucauuauaaccugaugaaauguaaugauugcagagaauuagaauuuaguagauuauaauuguugcaaauguuuucuauuccuuagaaguaaaaaaaaguuuuaaauuauuugaagaauuuaauuaaacaaauugcagagagagagagagagagaauaugaaugugaauggaguaucugagagaagaaaaauuauuuucauucauaauaaucaauuaccuuuagcugauacaggcaaauagcaauuucagugcugugagaaucacagucugcacuauuacuauuacuuauucacauaaaccaacuguggauguaauuuuuaaauagcugucaucucuucauccagaaaaguuuucuuuugcuuuauuuuaauuuuuauugaauauaguaaauaaucccauucaucacuucauuagaucuaguuuuggguauuaaaguuauaauuuuguuucuaaacucauuuggcccacagguggaaaugguguauuccuuguugucaaugcuugguacucaugauaaggacgauaugucacgaacuuugcuagcuauguccagcucccaagacagcuguauauccaugcggcagucuggaugucuuccucuccucauccagcuuuuacauggcaaugacaaagacucuguauuguugggaaauucccggggcaguaaagaggcucgggccagggccagugcagcacuccacaacaucauucacucacagccugaugacaagagaggcaggcgugaaauccgaguccuucaucuuuuggaacagauacgagcuuacugugaaaccuguugggaguggcaggaagcccacgaacaaggcauggaccaggacaaaaacccaaguauguucuuuauagugugcaucucaaugcauguuucaaaagcuuucgguuagagauucuuuuuaaguuaguaugcugucuuuaugaauagaaggaauuugcauuagcuaacuaaugcugcuaaaaaauuuuaaggcuuaaaucugcauuucccugaaaaauuuuuacaaaggaaacuguuauguaugguacuguguaagcaggucagauauaaagguaaucugggugggcaggcuugccuuccuuccuuccucagugcaccauugcucccaccccacccccaaagccaaguacucaguuaaagaggacagccuuccccagaagacaaggaccauccagucagggauauaugagaaguccugcuagaacuucaggcaagcuuucaagaagaaaaaacaaacaaacaaaaaauuuaaagguagcugcuuugaugaugugugugugaucucugcauuugggagauggaaacaugagaaccaagaguucaaggucaucuuggacuacacagauuucaggaucagccugugucaugagacccuguuauaaagaagcacaaaaaagaggacucuacuuauuagagcuagagucagugugagcaguuagguugccuuuggaugaacauuucuuucuugauggggguacccacaauuauuuaauaauuuacauuauugcuucugaaaaaauacuuucugucaaauaaugacuuuugaaacuuacauauaauauuuaauauguaggugcauauucuuggauacuauuuucuuuaaauuuuuacaauaucuguuuguauaggaagcuuucugcuggguaucacauuuguaugcagccauaugcuuuuaauuuaugaccauaauaguuguuuacacugaaauuagaaacaaaaaucuaacaguauuauaccaacguauguuuaugauuagcucagcaaaccuaggagagauuuaguccacaguccugguuaaggcuaagcaugcuuauggaaccaaggaaagcccuccgcgcagcugcuauucugcagcugugguauauacucagccguaagcagaugaucuacuaaccuucuauacaugagggaugugucaauaacgucugcuuauuuaaaaauguaacgacaucuuuuuuaagauaacaaagcauuaugacucagguaacuuuauuuuucagugccagcuccuguugagcaucagaucuguccugcuguguguguucuaaugaagcuuucauuugaugaagagcauaggcaugcaaugaaugaacuugguaagauaaaagcuuuccuaacgccacaaauacaugcugcugaguguuuaaaacacaaaagaaauugauuauuacuacaaguuuagacagagaaguugaacuaaugugaggcugcuaacuuugaucagcuguuuccaucccuauaggaaaaagaaaaaccacuauucccuguccccaugggagacagaaacaucuauccuccuaugaaccaacuucaguauuuaaaaucuuaacuaaagauuggaaaaauuaccaaguggaccaccugggucccuguugcccaaguagauccuguguugugucugaugacaguuugaaucauuguucuugcaaucugucgggcaucuuagaugaacaccaagaaguuauuaagauuuuaauuucucuuaaagguuaucaguauuuuacuggauuuuaacaaugguugaaacuaguguauauagaaagacauguucuaacugaaguuagaagcacgugguuaauuuuguagaaauuacuccuuuagguauacauccuuuaaacccuauguaaucauugagcacccauuuuuucauguugguuuuucuuuaauuucuagguuuauuuuacacauguauucauaaauugcaucaugcugagccaugucaugugaacuggauaucucuagucucgccacacagcaagagccgcacacugaguucugucuuaguguggcuggcccgcuuuugugauguucguuccaucacacccagccccugccuugcauccucaccaccucauuguuauucaucaguuacuguaagcgugguacaguugugagccuuaaauacgacagacugcacugcaggaagggaguguuguccccuucagagacaucacuuugggaagcucuggucugugguuugaggccugcccuccauucgugcuuuucuucccacaggcccaccugguccucuuuccaauguccugugaaaccucacuuaaucuuuuggguuuuccccauuucgguucagucucagcauuugugaauuuuuuaccuaaugccaauaauuaagaaaagggauaaaacuaacagccaggaaaacucaguuuuaagauauuggagagguuuuucuauaaauguucauauguuccaauggacuguagacuaggacugacacauuaauuaucugaauuugagaauaaaacuuagacucaguauuuguuccucuucuucuucagguaggaaggcuacccggggcauuucaucccaggagcuaggucaggggcuuucaggugaggagcaggauggggccucugggggcguggcugugggacgcagccacagggugaccuuccucucacuccucgccuucacauucgcacuggggcaaaggagaguugggcuuugugagucagugagcgaguacaggauagcacagggacuuggcagaagggggaagggaggaaggaaggaagaguucuuaggccuagucagugagcucugucccuuggaugugugugaggguccuagacaguuugcuuugggcacuggaguuuucagaugauuaagacacacucuggcuuccaaaaaaauuuacauuaauauuuuacaauauuucuaggucauaacagucaguagaaguauuugccaggccagauauguccagcccuguagcaaacagacuucccaaaguagcccaggaaucccauuaaauaucagucugaaugaugcuuaugauuguggaaccagaauaucagucugcagaauauugauauggaccccaauacucaucaugcuaaugauggcuagccaagccauguuauaaaaauuaaauaucuuaaucuuguuuugacuaagucuaaauuacggguucuguuuaauaucauuugacacaguugaagugcaucauauuucagugaauccuuuuacaguuuuaaccugugaauuacguuuuuugccucggaauucacugauuuuuuuuuuuuaccugccucaaauuagaaagggaucuuuuucucuaaaaauugaaguuuuauuaauguuucaucagucauaguauuguugacguccaguauauucuccuuuccucuuugcuuaaaaucagguccgaaaacugauacaaguucucugacaauugaaugccauccuagcaccuucuuuagaccauuuuaucuuucuuaggaggcagucuauuacuauaccaggcaagauuucaugcaaaugcaaagcauaguguuuuacuuggcaacugagacccugcuucucaaugcucuacaucuugaguaaacaucaguauccugggccacagucuucaggucuacagugacuugcugguugacaagagugucagcuauggugcuggcuccuccuuugcucaaguguacaaauacuggucuucauuuacgcugggccugccugaugcucuguucucccucucuguguuguagcauccaucccuagugcuucacuuaauguaucggucacgguugagcugguguucuugagauucacgucucaaucuaacuuucccuucuucaguuuuaugugugcaggcaaacacucuaccaccaagccccuggacauguuccuacugcuuaucugacauuucucuugacaaugguauucuagacacuuguagcugaacucucacaaacagaucuuguuagcuccauccccaaaucugucuuuuucagcauuccuuuuggaguucuaauaacccagcugcucaaauaaaacucuuagaaaaaucauacaggacuucauuuaaaucuccuacaguuagaaacugagcacuuucauccuuuuucuuaaguguaucucaauccaggcgugguagcacaccuguaacauaguacucgggaggcaaacaagauugaucucuauggucuacauaggguguuccaagucagucagggaugcauagugagacccugucucagaaucagcaguguguguguaugugcauauguacauguaauuguuauuucucauccugaggcaaagcaccauugucucucugguucuacauauguuuuuccuacuuucagucauaagccauucugcacauugugcccaccguacuguauuuacaguauagcucuacuuacacuuuccucugccuaacauccuuaguauagcauguagagucucugugcucuggcaccacccaccucuguagugucagugccccgccucacugaguucuuacacacacugucuuuucuaccuagaauaacucuuccuccuccuugucccacccuguuagcugcucagucagccauuagauuccaccuucaggguuguuucucagacccuuuccuuggggcucugcccacuccagaucucggugcuucacaucguucauaaguuucaugaaggcggggacugaauccggcucacugacuguacuucucuauuauugcaaauagauggaggaaagucuucauaaaugugguuuggauuuucuuuauacaaauuugcuugccuauguucagagaauugccugucaucucuucuugccauaagggucuguaugagucuucauauagucaagacaccuuaucuuacaguucuuaggucagcauagaacuugauuuuguaaaugugcagauucugccaaugaucuuuuuaugccauucacaaaacguuagugcacuggccuuucagguuagcagcuuacugagacuuacaagcaugguugguauuguuuuaaugccugagccaccucuggagcaguacaauacccaagucccaugugacugauguugaugauggugaucuaucaauaguucgugugcauuuuuaucuuucuuuuauucucauccucaccauuuugcuucgcuuuuuuuuuaaucuccucccuuuacugucuucccucucccuuuauguucccaguccucaccuccuacuguugacggcgugugauucagcacaccugcuaguuagguaguaggaagaagggaaauacugaaaccugguacacuugguuauuuuagaguaucaaagaaaauuaagauuauuuuuuaaagaaacuugauaaaacuuuguaguagguuaaacauaucguucuuuucaugaaguaaguuuuacuucaagcaaaauuucauuuaaaaguuucauuauuccuaaggaucauuauuugacacauuaaaaaaguauuagaccacaggauaugacaaauggaaaguaauuuuaaagcccuuauaauagcaguaaguuaauuuuucuguuuagguuuagaaagaccaguguuaacaaauagccuucauuguuggcaagguacaguguacgucagugaauagaaaauaauguuuauuucauucaguaaagcaaguggugggagggucgagacauugacagagaaugacaucauugucaguuguaauuauguuacacaaaaauuauuuacaacaguuuuguggcuuuuaauuuuaaaggcaaauuuaaaccauguauucucagucuuagcguucuuuccccucugguuuuaaauuaccaaauuauaccaguguauuugauucuagauuauucuauguuuccuuuugcccuuguuaaauuagggggacugcaggccauugcagaguuauugcagguggacugugagauguaugggcuuacuaaugaccacuacaguguuacuuuaagacgguaugcuggaauggcuuugacaaacuugaccuuuggagauguugccaacaagguaugucuuuuauaagguuuacuucuuaaaguagcucaguuagaacuaaagaaagaauuacuuauaacuaguuuuuuggcgucucccacagcagcccaguugaacagugacuccuggaagcaccuuucucauggugacugcauagcccuacuuaguggguugucuuuugcccaaacaaagcaaaagcacaccugaagauggagcccuacacugaaauuauauuggugcuccaacagcauugcucauacuaggaaugcagcuaaaaaggauaguaccuuuaccuagcaaguauaggugaccagcacuguagaaaaggauaauuaauaaaacacuguucccaggagugagauuaaaacccugugacagggcuggagagauggcucagcagguaagagcacccgacugcucuuccgaaggucuggaguucaaauccccgcaaccacaugguggcucacaaccaucguaacgagaucugacuccccucuucuggagugucugaagacagcuacaguguacuuacauauaauaaauaauaaauaaaucuuaaaaaaaaaaaacccugugacaaacaauauacacacugaggccaucagacagaacgccgugcucugguuuuugcuuaucauuucucagaauuuugcuuggguuuccuaguuagauaacaaaaauacauaacagaaauaggaggcaucuauccuucauuuaggcaaucuuguucugguucuugugcagguaaaauaacauuuaugacugaaauaaaagcaggucugaaauuuaguagcuagaaauacggccauuucaggcagauuccuugaugacucuacuccgcuucuacuguuacaggcuacgcuguguucuaugaaaggcugcaugagagcacuuguggcccaguuaaaaucugagagugaagacuuacagcagguacuacuuagaauuuuagcaaguuaauguacuaauuuauauuaagcuuugguuuaguauuuaguggcuuguguuaaaguauggcuuuacuaacacuaaaguaaaguaaauaauuauauugaaguaauucuuucugucauccaaguaacauuuuugaaaaauuuacuauaggcagagcauuccuauuuuuauuacuauaaucaaucauauuuguugugcaaauuagugggcuucaccugugaccucucaguacaugcgaauaccaugcuuuggucuuagcgauggggcauuccuaaccuaaaaccuaaaccagacaccacauguggaaaaucuguuauaaagcugcuuuguguacuaaguuauuaauauacuauagaaaguuaccgucagguuauacauguaaggaguauauauguguggaguauuaucucauacccaggguaucucacacauacuuaaauauucaaaaagccaaauuuaaaaucaaagcacuuacgcauuuagauaggaugaauuuaaacugcaacagauucuacucuuaccucuagcauuagaaacaaaaagacaauuagucuuacucauuuuacauguaaauuguucuaaacuugauuauuuccagguuauugcaaguguuuugaggaauuugucuuggcgagcagauguaaauagcaaaaagacguugagagaaguuggaagugugaaagcauugauggaaugugcuuuggaaguuaaaaagguaauguuaaaauguugggugcuggaauaggagacccacuagccucugacucuuuagagcugguauuaaaggcacacuccaccagagagacccugucuaaaacaaggagggaggcaagggccagcauccgagguuguccucguuaacuugagcgugguggcaggcacacacuauacacaacucacacaagcaguuacaugcucuucauacacacgcacauagacagauccauauuaaaugugcauaggcucuauauaaagauaccuuugagauuacuaaauacaugauuaggacugauacuuaaggaaagauaccaauagccacuaagugcuggcaaggguacaugauguuauuugccacuaaaacuacagugaaaugcuauuauacauaccauacuggauuaaaguuaaaagauuaaccacacgucaagguugcugaaccuauauuaucauugggaauaugaaauuguauacguacuugggaagacauuuagagauuuuuuguuaaacauacaccugccauacuaccuugccauuacacucuuaagaauuaacuaguguucucacagauuuauacaugauguucuucauaauuuuguaauggccagaaguuagaagaaacuauaauuacuguuguuacauuuacauauacgugugugcguauacauacauacauacauauacauacauacauacauacauacauacauacauauauauauauauauauauauauauauauauauauauauauauauauauauauaugaaugaacaaugaaauucuucacagccauaaaaagaaugaacugguuaaaacggaaaaaaaaaaaaguauugcaugcuaccgccccagccuacccaacaaguuauggcggaguucaagaccucccugggcaucauagugggguacuggcuuuaaaaaaugagaguagugugggggggggggugguguuuuuucauaagugcacaugcaaacuagagcuauguguaggaugucuuccuccauccccgccccugguugguugguugguuguuuucaagagcaggccucagggugggacuuacuauucagccagggcugacguacaacuucugauccucaugcuuccaccaacugcuaggaucacagacaugggucucagcucuuguuuuacacggucccagggcucaaacucaggguuuuauucgugcugagcaggcacucuuaccugcugaggcaaauauguagcucuccgucuuuuuuuuuuuuucuuauguauggguguuuugucuguguguaugucuauguaucagaugcguaccugauauccucagagguguugggcccucuggaagcaaccaguugcucugaacucccgagccuucacucucagccgauuuuugguaggguccucucagugaacauagaacaccucuauucagcaagacugacuagacaucuuccugucuuugccuuccaagcugccuuguccagcuuuuuacauggauuuugggaaaaucaaacucagguauucguguuuguguagcaagcauuuuaccagaugagcuaucuuccagcccaaagaacaaauuauugaaaaauaaaucaggccgagcgugguggcgcacgccuuuaaucccagcacucgggaggcagaggcaggcggauuucugaguuugaggccagccuggucuacaaagugagcuccaggacagccagggcuacacagagaaacccugucucgaaaaaccaaaaaaaaaaaaaaagaaagaaagaaaaauaaaucaguaagauguauuuaaagacacuucuccgguugguuuuuguuuuuguuggugugaaugcaugcaugucuguguaucugcuggcaucugcaggcacguguggaggucagagaaaacucucaggaguugauucuuuucccacugugggcuugaacucagguccucaggcuuguguggcaggugcuucuuguugacugucuccucgccagcccaccggguaucgugugaguggucuuaguaguuaccuguaacccuauaucuaguuucuuugguuccuggaguuuucuuuaccuuguacuuuuugaaacuuagacaguagcaccagcuagaaagccauggaggggagguguuaauuaacccuuugcucauugaggagggugcuaguguugaaagcaagucagugcuugucuaggcccugggguaaaaugaaaagauggguuuggaggcaugugaagaaaccuugagagguguaaauguuuguccauugauuggagugaggaguagcuacauuuaaagugauaagaauguauaugugaaagauguacaguuuauuucucuucaauaauaauuccauaaaauuguaccaggaaauuagugccguggcucccacuugcugcucacuuagagcccucaguccuuccuucccucugcuuugucuuuagauccuuuuuguuucagcuguguauuuaaaaguagaaaguccuccauggcuucuaauuacuagaggauuucuuuuccuauaaugacuaaaguccuggcuggucacuccuuaguuccuccuaaucugauuucagauaaccuuuuccuuugucucagaaucuacagagguuuacuucacuaggguuuucuuuugaauuuccuuguacauuguauuuuuugaucagccacuuauuacagcuccuugccuccuuucuaaucuccagccauuucuuuuccuucuccugcccugcacaucaucacccaucccaucccguguguacugugucuauagcugugcuccucagcuacaccccagcuugcaaucacuucaugccuccuguaauuucaacuguaaaacuugucuaauacagacuuuugguccuuagccuguaaucucuggagcauccuacacuuaaaucacauuguaauuaaaauugaacucaggaccuucucauuugugugcguguguauguguguguguguguuuuagguguuuuguuguugcuguuguuguuguuguuauuguuguuguuguuguuguuguuguuguuguugugagacugggucuuguggagagaggcuggccuugauuuuguaccaauccuucuaucuuagccuuccaagugcuggauuucagacaugaacuagcuagcugaugaguuacauaaaacuggccauuuauguaaggcucugugugucugcauaagacccuggaguugagacuucaaguaguuccuggugggaauuuuguuucugguguuuucucucuuacauuaucugcguuauccuccuauacaguguugucuccuuugugagguauuuguuuuaaauucagacugcagcagccuccuuuuugcuguuuugcaucuggauugucugccucuuguucugacaggaacauuccuaauaaagagucuuugaugaugucauaagaagaaacacugacauuuggaguaugacaaauuguaaccaaauaucacuaauaucagaguuuuucugcaacaauuagaauuuuuauaugugagggagcuugggccuuuuuguaauuuguaguuucuuuaggaguuuuaaggauuugugggcuggagagauggcucagcaauuuagaacacugacugcucuuccagagguccugaguucaguucccagcaaccacgugguggcucacaaccaucuguaaugagaccugaugcccucuucaggugugucugaagagaacaacaguauacucacauauauaaaauaaauaauuuuuuaaaaugaauuuguauguuagccaggugaugguagugcacaccuuuaaucccuucucaggaagcagaggcaggcagaugucuuuaugaguuugaggccagccuggucuacagagugaguuccaggacagccaggguuacacagagaaacccugucucgaaaaaaaaaaaaaaggauuuguauguuuucuaguacuuuucagacgucauguuauuuuuuacucaauaacacaugaauacauaaauuuguuuuuaauacaaauaaaguauuauauaaccuguucugcaguauguuaucauucaguacuuagauaucuuuccauauccacacauaguauaugaagauguuuugaguuucuguuauccugauaauauuauauugugauagugaauaucaguucuguaucauggaaagauagguggucauuaguuuaauccuguguugacucauagaaacagcacugacccaaauuucauuuugugugaaacuguaaaugaaagguuccugauuuacuagugaggaaugucagaagggagaccaaaagaaaaaagacucuuaacuaaauggcacauacuguguuucaaucgugacuaggaaucaacccucaaaagcguuuugagugccuuauggaaccugucugcacacugcacugagaauaaggcugacaucugugcuguggauggagcacuggcauuucugguuggcacccucacuuaccggagccagacaaauacuuuagccauuauugaaaguggaggugggauauuacggaauguguccagcuugauagcuacaaacgaagaccacagguauauaccaaguucuauauuauucucuauucuuuuaugugaauuauuauaguuuauuucuuuagaaaaaccuaauucuaaauuguuuuauauuauuaugaaagcucuaagcaaagaggccucauuguagugcaaagauaacuaucaacuccaaaaauaacucauuucaauguuguugcuaauaaaguucaaaauauccuauaggaaucuacaaauaugguaguugagaaauccagccaugcuguagaaaaaagaaauaaaaauucauucuccccuacuuagauggcauaaagaaacacaaaacuaauuuuuaaacaaaggaaaacuucugaguaugauggaggaaauauaaaggcucagcguuuuccuaaugaugucuuaaccaguuuugaagcuuauuuauacccuuggcaaucaguuuuaaacuaaaauagaguauguuauuacuagauguuaauuuuuuuauauuuaaaagacugcagaucucuccaaggcccagagcucauuauauugacuguuagcccuuauauuuauaugcuuuuuguauuuuuaaaaccuauacuucauguuauuucuuaaaauaaugcuuauauacacagucugccaaagugugcuuuggacuuggugucuucacugagacagagaccccguacucuguaaaguaaguuugcugcucuagaagcguacugggugcucccagacuacagacccaucugccagucacuugucuucugcuuccaagauaccucaguagucauuucaugauguauguauaauguuaaauuagagaauuauuacuauguaaauguagaaaauguaucugcucaaaaaauaaaaauccuuucucuuauaguggaucagaauaggacacagaauaaaugaaacauaacaaacacuguuaccacuuuuggaaugauagaugauacuuggaaaaaauaaacauugacuggaccaagagagcaggaagagaggagauggcugaugugcucauaacgugcuuuguaaucaucccuguguuaaaacucuuuucugccccuuuacuuguugucacuaaucacauuuuccccuuaaucucauguguuuuuguuuuaauucaggcaaauccuaagagagaacaauugccuacaaacuuuauuacagcacuugaaaucucacagcuugacaauagucaguaaugcauguggaacuuuguggaaucucucagcaagaaauccuaaagaccaggaagccuugugggacaugggggcagugagcaugcucaagaaccucauucauuccaagcacaaaaugauugccaugggaagugcagcagcuuuaaggaaucucauggcaaacagaccugcaaaguauaaggaugccaauaucaugucucccggcucaagucugccaucccuucacguuaggaaacagaaagcucuagaagcugagcuagaugcucagcauuuaucagaaaccuucgacaacauugacaaccuaagucccaaggccucucaccggaguaagcagagacacaagcagaaucuuuauggugacuaugcuuuugacgccaaucgacaugaugauaguaggucagacaauuucaauacuggaaacaugacuguucuuucaccauauuuaaauacuacgguauugcccagcucuucuuccucaaggggaaguuuagacaguucucguucugagaaagacagaaguuuggagagagagcgagguauuggccucagugcuuaccauccaacaacagaaaaugcaggaaccucaucaaaacgaggucugcagaucacuaccacugcagcccagauagccaaaguuauggaagaaguaucagccauucauaccucccaggacgacagaaguucugcuucuaccaccgaguuccauuguguggcagacgacaggagugcggcacgaagaagcucugccucccacacacacucaaacacauacaacuucacuaagucggaaaauucaaauaggacaugcucuaugccuuaugccaaaguggaauauaaacgaucuucaaaugacaguuuaaauagugucacuaguagugauggauaugguaaaagaggccaaaugaaacccucaguugaauccuauucugaagaugaugaaaguaaauuuugcaguuauggucaguauccagcugaccuagcccauaagauacacagugcaaaucauauggaugauaaugauggagaacuggauacaccaauaaauuacagucuuaaauauucagaugagcaguugaacucaggaaggcagagucccucacagaaugaaaggugggcaagaccaaagcaugugauagaagaugaaauaaagcaaaacgagcaaagacaagcaagaagccagaacaccaguuauccugucuauucugagaauaccgaugacaaacaccucaaauuccaaccacauuuuggacaacaagaauguguuuccccauauaggucaaggggaaccagugguucagaaacaaaucgaauggguucuagucaugcaauuaaucaaaauguaaaccagucucugugucaggaagaugauuaugaagaugauaaaccuaccaacuacagugaacguuauucugaggaagaacaacaugaagaagaagaagagagaccgacaaauuauagcauaaaauauaaugaagagaaacaucauguggaucagccuauugauuauaguuuaaaauaugccacugacauuucuuccucacaaaaaccaucauuuucauucucaaagaauucaucagcacaaagcacuaaaccugaacaucucucuccaagcagcgagaauacagcuguaccuccaucuaaugccaaaaggcagaaucagcugcguccaaguucagcacaaagaaauggccagacucaaaaaggcacuacuugcaaaguccccuccaucaaccaagaaacaauacagacuuacugcguagaagacaccccaauauguuuuucaaggugcaguucauuaucaucacugucaucagcugacgaugaaauaggaugugaucagacaacacaggaagcagauucugcuaauacucugcagacagcagaaguaaaagagaaugauguaacucggucagcugaagauccugcaacugaaguuccagcagugucccagaaugcuagagccaaacccagccgacuccaggcuucuggcuuaucuucagaaucaaccaggcauaauaaagcuguugaguuuucuucaggagccaagucucccuccaaaaguggugcucagacacccaaaagucccccagaacacuauguccaggagacuccgcucguauucagcagguguacuucugucagcucccuugacaguuuugagagucgcuccauugccagcucuguucagagugagccauguaguggaauggugaguggcaucauaagccccagugaccuuccagauaguccugggcagaccaugccaccaagcagaagcaaaaccccuccaccuccuccacagacagugcaggccaagagagaggugccaaaaaguaaagucccugcugcugagaagagagagagugggccuaagcagacugcuguaaaugcugccgugcagagggugcagguccuuccagacguggauacuuuguuacacuucgccacagaaaguacuccagacggguuuucuuguuccuccagccuaagugcucugagccuggaugagccauuuauacagaaagauguagaauuaagaaucaugccuccaguucaggaaaacgacaaugggaaugaaacugaaucagaacagccugaggaaucaaaugaaaaccaggauaaagagguagaaaagccugacucugaaaaagacuuauuagaugauucugaugacgaugauauugaaauauuagaagaauguauuauuucagccaugccaacaaagucaucacgcaaagccaaaaaacuagcccagacugcuucaaaauuaccuccaccuguggcaaggaaaccaagucagcuaccuguguauaaacuucugccagcacagaauaggcugcaggcacaaaaacauguuagcuuuacaccaggggaugaugugccccggguguacuguguagaagggacaccuauaaacuuuuccacagcaacgucucuaagugaucugacaauagaguccccuccaaaugaauuggcuacuggagauggggucagagcggguauacagucaggugaauuugaaaaacgagauaccauuccuacagaaggcagaaguacagaugaugcucagcgaggaaaaaucucaucuauaguuacaccagaccuggaugacaacaaagcagaggaaggagauauucuugcagaauguaucaauucugcuaugcccaaaggaaaaagccacaagccuuuccgagugaaaaagauaauggaccaaguccaacaagcauccucgacuucaucuggagcuaacaaaaaucaaguagacacuaagaaaaagaagccuacuucaccaguaaagcccaugccacaaaauacugaauauagaacgcgugugagaaagaauacagacucaaaaguuaauguaaauacugaagaaacuuucucagacaacaaagacucaaagaaaccaagcuuacaaaccaaugccaaggccuucaaugaaaagcuaccuaacaaugaagacagagugcgggggagcuucgccuuggacucaccgcaucacuacaccccuauugaggggacgccguacugcuuuucccgaaaugacuccuugaguucucuggauuuugaugaugacgauguugaccuuuccagggaaaaggccgaguuaagaaagggcaaagaaagcaaggauuccgaagccaaaguuaccugccgcccagaaccaaacucaagccagcaggcagcuaguaagucacaagccaguauaaaacauccagcaaacagagcacaguccaaaccagugcugcagaaacagcccacuuucccccaguccuccaaagacggaccagauagaggggcagcaacugacgaaaaacugcagaauuuugcuauugaaaauacuccaguuugcuuuucucgaaauuccucucugaguucccuuagugacauugaccaggaaaacaacaauaacaaagaaagugaaccaaucaaagaagcugaaccugccaacucacaaggagagcccaguaagccucaggcauccggguaugcucccaaguccuuccacgucgaagacaccccugucuguuucucaagaaacagcucucucaguucucuuagcauugacucugaggacgaccuguuacaggaguguauaaguucugccaugccaaaaaagaaaaggccuucaagacucaagagugagagcgaaaagcagagcccuagaaaaguggguggcauauuagcugaagaccugacgcuugauuugaaagaucuacagaggccagauucagaacacgcuuucucccccgacucagaaaauuuugacuggaaagcuauucaggaaggcgcaaacuccauaguaaguaguuugcaccaagcugcugcagccgccgcgugcuuaucuagacaagcgucauccgacucagauuccauucugucacuaaaguccggcauuucucugggaucgccuuuucaucuuacaccugaucaagaggaaaagccauucacaagcaauaaaggcccaagaauucucaaaccuggagagaaaagcacauuagaagcaaaaaaaauagaaucugaaaacaaaggaaucaaaggcgggaaaaagguuuauaaaagcuugauuacgggaaagauucgcuccaauucagaaauuuccagccaaaugaaacaaccccucccgacaaacaugccuucaaucucaagaggcaggacgaugauucacaucccagggcuucggaauagcuccucuaguacaagcccugucucuaagaaaggcccaccccucaagacuccagccucuaaaagccccagugaagggccgggagcuaccacuucuccucgaggaacuaagccagcaggaaagucagagcuuagcccuaucaccaggcaaacuucccaaaucagugggucaaauaaggggucuucuagaucaggaucuagagacuccacucccucaagaccuacacagcaaccauuaaguaggccaaugcagucuccagggcgaaacucaauuuccccugguagaaauggaauaagcccuccuaacaaacugucucagcugcccagaacaucaucucccaguacugcuucaacuaaguccuccgguucugggaaaaugucauauacauccccagguagacagcugagccaacaaaaucuuaccaaacaagcaaguuuauccaagaaugccagcaguauccccagaagugagucggcaucuaaaggacugaaucagaugaguaacggcaaugggucaaauaaaaagguagaacuuucuagaaugucuucaacuaaaucaaguggaagugaaucagacagaucagaaaggccugcauuaguacgccagucuacuuucaucaaagaagccccaagcccaacccugaggaggaaacuggaggaaucugccucauuugaaucccuuucuccaucuucuagaccagauucucccaccaggucgcaggcacagaccccaguuuuaagcccuucccuuccugauaugucucuguccacacauccaucuguucaggcagguggguggcgaaagcucccgccuaaucucagccccacuaucgaguauaaugacggaaggcccacaaaacggcaugauauugcacgcucccauucugaaaguccuuccagacuaccaaucaaccgggcgggaaccuggaagcgugaacacagcaaacauuccucgucccuuccucgagugaguacuuggagaagaacuggaagcucaucuucuauucuuucugcuucaucagaguccagugaaaaagcaaaaagugaggaugaaaggcaugugagcuccaugccagcacccagacagaugaaggaaaaccaggugcccaccaaaggaacauggaggaaaaucaaggaaagugacauuucucccacaggcauggcuucucagagcgcuuccucaggugcugccaguggugcugaauccaagccucugaucuaucagauggcaccuccugucucuaaaacagaggauguuugggugagaauugaggacugccccauuaacaacccuagaucuggacggucccccacaggcaacacccccccagugauugacaguguuucagagaagggaaguucaagcauuaaagauucaaaagacacccaugggaaacagagugugggcaguggcaguccugugcaaaccgugggucuggaaacccgccucaacuccuuuguucagguagaggccccagaacagaaaggaacugaggcaaaaccaggacagaguaacccagucucuauagcagagacugcugagacguguauagcagagcguaccccuuucaguuccaguagcuccagcaagcacagcucaccuagcgggacuguugcugccagagugacaccuuuuaauuacaacccuagcccuaggaagagcagcgcagacagcacuucagcccggccgucucagaucccuacgccagugagcaccaacacgaagaagagagauucgaagacugacagcacagaauccaguggagcccaaaguccuaaacgccauuccgggucuuaccucgugacgucuguuuaaaagagcuagaaggacaaacguagaaaagcugguguuaaucacuacugcuguauagagacuuuauuucaaagaaaacuuuaaagguugaaaauuuuuguaaauagguuugauucuuguuagagggguuuuguucuggaaaccauauuugauaguacacuuuguccucacuggucauuuugggaggcacucuuauuagguaggaaaaaaugguaaagccaaguauauuuguacaguguguuuuacauguauuuaaguagcauccaucccauuguccuuuaauuaucaccugucuuaaaaauaacacuacagauagaaacuauaugauauauugcugucaucaaucacuuuuagauuauaaauuaaacuuacaucagggagaaauugguauuuaugcaaaaaaaauuaguccuugugaauccaucuaaugucauaauuaaucauguggcugugaaauucacaguaaugugguuccccaugaauauguuuacccagccugcuuugcuuuacugcaugaaugaagcugacgguucaauuucagaaguaacaauuaaugauucugugaucacauggugugcagagagauagcuacaguguaacgauucacacuauuuugugcucaaaucuguguaacuguaaagcauugaaugaaacuauuuuaacugaacuagauuuuaucaaaaguagguagaauuuuugcuaugcuguaacuguuguauauucugguauuugaggugaguuggcugcucuuuuauuaaugagacacgaauugugucucaaacuaaaugaacauuucagaauaaauuauugcuguauguaaacuauuacugaaauugguauuuguuugagggucuuauuucacauuuguauuaauaacugucaaaagggccucuuuuaaaagcuaaauguaauuuuuuuucuucagauucuaugcauuaagaguaaaauuuccucuugcuguaauaaagacaauugaagaagauuguugacacuuaaccauuccuaaaauuuauuuuuauguaauuagcaccucucaaugcuugguauuuuuccacuuuuuuucuuacuccuuggggguuugauuaaaacaaaugccuauaauagcacaagacuaggcacuggacauaagggcccacauagaauaucuccuuuuccuuaauagaauccauacuugaaaaccauugauucuugacaguuaccaguuuugucuuucaggcuuuccagugcaacugucuuaccccgucaucuucuccguauugauacugggucugaaauaaaugccuacuaccacucuguauaguaaggcagauuuuuuuuugcaaucaggcauaaucaguauuuucucauacucaaaaaauacaagucagugaaacaucagagauauguaaugcuguuaugauaauauuucaagaaagauucaaaagugggccaggucaguagguaaaggugaugccucaaagccugaaggcccaguucacaucacaggaugcacauggcagaaggaaagaaccagcccccuaaagucauccucugaccuccacucgccugucuuggcacauuugcaugugugcacacacagacuucuuacguuguccaugaggacauucagggcuaacgagaaggcucagcagguaaagccuggugacaugaagucuguccccagaauccuccaaccuccacacacgcuccauaauuagaaagucacaaguuuuuuuuuaauuccuacccgcuaaagacaacuucauuuuuaauggguccggugguugggauguuauuaagugcccacugcccauaugaaugagaauacacugacauacuuaauagccaagaguuucaguucuugucaaauguuaugugaaguuguuuuauaucaguauuccauauuguucuccaagguugccauaagcaaugggagaugggaauauaggucacagcugguucucuuucauuccuaguuuuccauuagaauuacugcacgucaguuuuuauaaggcacuucaaguaguuuuguggaaagagaugagguuuuaguuagaauacaauugccuuuuaauucauguuuuaagaaauuaauguuagaaguaaaagaagaguccauuccaccuauuggagacgaaauucccaugggcagcccugcugggaagggucugucuuguguugucccuugaagauggaguugcuggauuaaacccuuuggcuagagauaauggcugugaaagcaaagggguugaccuuaguugugcuuucagaaguucacuggaugauuccuuaacugguagcaggccaaguacuccuggauuuugcuuguuucagauggcacacuaagcccagucaguguuggggcuugguuacugggcuggaugcuuauuaaaagggcaaggaccuacuuagcuuuggacugcagcaaagaaagccuaagguagcaauuucaaacaggugugguuggaucaccagaaguguuuguuagaucauuucugggcacacacccgcaguuugauaagaguugaucuggagagggcuacaagaauuugcaucuguaauguauuuagggauggugggugguaugugggcuucugguguggggaccguacuuggaaaaguacuguccuaaguguguacagcacagcucuuaauaagcaaaugaguuccugaucuaccaaguaaaugcuccuuggcaugggagaccugaauauugacuuguccagucuccuagccuaugucgacucauuguagggaggaaacucaccauacuuaggaauacgaaagucaagauguccacugccucugagugcaucacucuugucccuuugaaauaacuacuguuaaaagagggugugugugguggggggggggguacuuaaaauacuuaguuucgaugggcaguaagaggcuauggaaagggaaauucaggaugagggaagauugguuguaagugaaaggaaacuaaucaauuuguuaguacacaguagaagugauuaauuggugaaaaaaauuauauuugauaaugaacuuuacaaauuaccaggguacuaacuagguaaauaaauaaaagauaagcccuguagguaucaaccagcaauaaguaauguuagaguuuucuuuauaguguaaaauguggaucauguuaccacaaaguuaauugaaagaugacuuugucacugaaaaugggagaugguugccaggguuucuuugcagcuaagaaaaugaaaaaauuaaacuguccaaagcuaaaggguuuacauggucagauaauucagauauaccuaacaacuuuucaggagucaaggcuaaaauacaguguauauucuuucucauuuucuagugagccuaucuauuucccuguguacuaaccuuagaaaacgacuuuguaauguggaauucuaugaaccgugacuucuguaaacccaggucauuuuccuccuguucuaacucugcuuuuuguuaggccauugaugcaucuuuccgacuguauguucuguguauaaugcuguucuuggugcuaaauagacuuucuuuccucugauauucaggauaauuuuucucuauacuucuguucacuuguuuucuugaaguuaucugauuguuauuuuuaauuaaaaauacuuaaaugua

SEQ ID NO: 12570 - RNA, 135865 nt, Mus musculus
gcgggagacaaagcggcggccgucggcuuggcgccucaggagucgucccgugcucgcccaguucgcugcagguaacucuucguaccuccccucggggcgcgcggggcccccuaguggggcgcggggcuccucaggcuggggucccggguguccggcucgggcucucggcugccgccgcccuagagcgucgggcuagggcggcauccccgagcagccugggccugggcgggcggagcccgacgcucgggaagcgggucgaccgccggggcgccuucuuggaaaacuuucucccucuuucuaaacuuuguucccggagcagggagcgcgcgcgggacuagcgucgcgccucaggccgccucccucacugagggacaaccgcggcgugucccuggcggucgggcagugggguguuguagggacgcgauuguucccuggauuuguuccggccacuccccucccccuucccgcugcugaaacuugggcguuugcgggaccagaggucggaggagccgacauuccugcccggcccacggagaaugggagucguagcuuccuguucuccagcgcucuuguccuuaaggugcgccacacccguguggacuuguggcaaggacuuuaauuuuuaccuuaaaauuacucagucucuuuugcugugaaaccucacugacauuacgcucaauuuccaggaguggcuuuagaguuacuaacuuuggguuaccgagagcggguagcccagauuggccugggacgcugggucucccugccccagcuucccgagggcggguaucgcuggcauucgaugucaaugaccugccuuucgacuuuaaaaggaacuuguuaaugugcguguagaacuugggggcggggauguuguugacuggauucguaaccuugguuuucaagcaguggccaccccaauaauccagugagcgguuggcucaagucaaggauugauauccucucauguucugugccuucauaacacuugguuugauuuuagaugugaguguguauggaauuuacaauaauuuaugauguaaauauaugcuuuaucauuguaucuuucagggguuuuaauaaggauauuuuguguuuagcguugaguuuuaaagacuacagguggauguuaccuuaagaaauggaauuuguuuuguuuuacuaaaggauugaauggggaaauaauuucauagccucuguuuaauuguucauccuuucugacuuacuaaguuaaaaaaaaacaaacagguuuuaaaaauucuuucuuugagaccugaaagcuuuucuagugucauauccuuuuuuuuuuuuuuuuuuuuuuuuuuuaaauuccauucuggaucucacuaugaagccccaaacuagcucaagcuuccugaguguugggguucagaugugugccaucacaccugucugggccauauuguguauaaugcaaacaacagaagcgagugggagcauggaugggguguuaguaaguuuuuaagucuggcaguucugaggugauggcuuuugaacuggaugaagcaugaguugaaggggcauuuaaguggaaucgugauauuauucuguucuuucccccuauacuuuucaacuccuuuucuugaauaugauucuaacagaauauauugguuuucagcaccagcuaugugguaccauccaucuccauucccaucagagacauuuuauauagugaucagaggugaggggugucuguuuucuucucacucacugccuugugccuuuucucaucaaaccccaccccaacacugugguauuggagagcaaaccuuauacuugcucggcaagugcucuguauuugagcugcgcacccccuaccucugucuuaagccuuagcugcaaacauccaguucuguauuuugaguguaguuucucuccugacccacaugggucuccuaucuuguaauuuuaaagaaagucacguuagugauaguacagcuaucccugcuuguugaaggcagcaguggucugaguacuggcugagacuuagacaggaugaaggaauaggaugaauaggauucuuaacaggaguaaguggccugagcguuggcuaagcauuuggaggccuagagguuuaaaggagaucuauuuauugaguacugaaguagggagaaggucucaccuaagguggucagggaaggcaaaggccaggucacagaugucuauguuuagauuuuauucuaaagcuguaugaugccauuguagggguuuucaugaucugagcagcauuuuauucauugcugaugcuuagagaaaacuugaauugguguguguguaaagcauggaguugaguggggaaggucauguggguaaaggcgaucuggaucaguggaaaggauccaacuaaagauuggguuaggguggcaccuaggcaucuggguaaagcuucggaaguguuggacucuuggucauaucucaagauccagcauuuucauuccugguagcaaauuuugugucaguuuucuuaguaacuuauguuuguguuguauugauaucccuguuugcuguccuuguuggaaaguauaaccucauguaaaccucuucaaggcagggcucaugcccuaccuaaccuuugguuugguaauugguaaggggggcaaauuagaugcucuauugaaugaaggaaggaggcaggaagucuuucuggagucuaagcuuccgacaguaagcacaaugacacgugaggcaauugauuacaaucaaauugcuguuuugggcaacuugagcuuucuucaacuuuguccccuuucuuuccuucuacccagaucuagucagugacagaauccgcucuaguguuuuguuuacaugucuuucuuuacuuccacuccacuuuuagacuugacuuuucuuuuuucuuuuuggugcuguggacuacuaaguaguaucugaguaagcuguuuaguuguuuguuugguuuauuauuuauuuaguaaagggucuggagugaauuuagugaucuuccugccuuagucucccuaaugcugggauuaauuguguaccaccucacuuuacuuuauuuuauucccccuguguuuuuccuucuggaccauguugcuuucuuuuaaucaccuggcaaacuuacuuauuuuuugaagccucuggauuuucucuugguuuucagugcuuugguaucuuacacaguuuuuauauuacauuuuuuauacuguuugguaaauguuuucugggaaguguauguguagggguaauaaguuuuucagacaggucuaugcaguccuggcugucuuacaauucuaaguagaccaggcuggccucaagacuuacagagauccaccugccucugcuucccagugccaggaucaaacaccugugccaucacuccugguuuaaggcuuaaucuuuuuuuuuuuuucaauuaauuuauguaugugaguacacuguagcuguacagaugguugugagccuucaugugguuguuggggaucgaauuuuuaggaaaucugcucgcucuggucaacucugcucgaacucugcuugcucagucccugcuugcuucagcccaaagcuucauuuauuguuauauauaagcacacugcagacaccagaagaggacuucagaucucauuacaggugguugugagccaccaugugguugcugggauuugaacucaggaccuucagaagagcagucaguguucuuacccacugacccaucucgccagccccuaaggcuuaaucuuuaauaggaaccuaaucaaaauugaaguauaauuagagaaaagugcucaaauuaggaucacuuguccagugaauugauauaaacuaaacacuauguauauccacuaagaaacaacacacuguuagcaccccaggaauucccaguaucaguugacuuuauuugcccuucugccucuguauuuugaaaccaggcgcuauucagggugauugagcucuuaaaguuucuaaaagaaaaaagaaaaccccuuugagaaguucauguuauuuuguguguuuguguguguaaguguggucagaagacaacuuggaaaaguugcuucucuucuuugaauaaacaugugggucccagugacccagcugagguuguuagguaggcugguggcagguaucuucaucugcugagccaccuuggcagcccagaguucccacacuuauguuugaaaccuaaugcugcuguguaauugugcugguuagucuuaugguuggguuuaagaucuucuaaauucuagcuuuuacuuaaaauuucagaccaauuuacuuucauuaauuuuugggggggugugggaggagguggggcaggggcuggugcaauggcucauacugcagaggcagaauugaguucaaagccagccugguauauauagggaguuccaggccagcuaaggcuauguaguaagagucuguuucagaacaaaauauuuuucauaagaauauuuacauucauguacuuacacauucacacaagugaagauacaggacagcuuuugugaauugguuuuuuccuuccaccaugugauuccuggggaucuaacucaaauuucagucuuauuaguuaagugccuuuacccaaugagccuuuuagcagccuguaauucuuauuuuugagaccgugucucauguagcccagaauggucucugcuuguuauguagccccagaugaccuuggacuuuugaaacucuuguuuccacaaccugaguguuggaauuacaagguucaccaucagguguaugugguacuggggauuaaccuaggaccucuuuugcuauacccacuccaguagugacucucgugacagcacuuacuaacugagcuacauaccaggcugauuuucuucuguaaauuauucccuauccuuuguauccuauccugggucguuggccauuuguuggaaugcuuuguaauaauugcuuccauaccccuccaaaaacugaauaacaccccuccacccucguuugagaaaggauccaaaaaucuuaaaacuuguaaaaaugaaugguaguguuauuuacuauccuucauuucuuguuaggaauuuuauuuuauuucauuucaugugugugcaccugaauguaugucugugcaucauguguguguaguacccauagagaggucagaacagguaucugaaugagagcuagagacaguugugugcuaccauguggauggugaacugauuauguuuuuuugugguaagaugugcacaacaaaaguuaccauuuaaaccuuuuuuuuguguguaugcacgcucacugacuuuaaaugaacauuauuaugcaaucucugccaauuccagggaaaccugugagugucuuugugccaccagggcuaacaaagugacaauccacauggggccagaaggaaauccaguucaacgcaacucaguggucagcaucggucugacacugggcaguuuauugcaggcacauuuaaguauaguacaacaugggaaaauguuuccugauucucuagagcuauuuuuaucuguccaaagugaauucuguacuucuuaaacaguaguuucucauucaccucucuccuggcagcuaaccauucuuuuuuucucuuugaguuuaaccauuuuuaugauuacccuccaccccccaaaguaaguuuuuaaguuugauguguacuggguuugccagcauggguggcugugcaccuugugugcuuggugcccuggggccagaagaagguguuggauuucuguugucagcacagagauucuugugcucacagauggcacuagggaaaccaagaauguuaaauauucaggguuguuguuuacaaggaaaagauguaggaccugcuuucuguccggaagacugggaaugguggcuaauaacuugggugauucuuguccuaucuguaggggcaggccauaccaagcucccccaagcaggaccagaggaggcuaauuaucuaggcagcuguuguauuaucuauauggcuaggggcucccccaacccccugcagucaggaccagaaauuuuuuuuuaaagauuuauuuauuucacguaugugaguacacuguugcugucuucagaagagggcauuggaucccuguuacagaugguugugagccaccaugugguugcugggauuugaacucagaaccucuggaagagcagccagugcucuuaacugcugagcggucucuccagcucccagaaaugcuuaauaggcagguguccuuuguguugucuguauggcaagcuuccauaaccaggacuggaggugacugacagcccaaaugaccuuuguacuaugugucugacacggaccacaccagauccccuaagcccuuaagauaauacauguagccuauuucuagaacccaucuucaugaaagaaaugacauguauuuugagaagcguuuugauguaguuaugccuccugugcaaagaggauuguuuuauaccaggaaacuuuuaaauuuaaccaaacuuaaauuuaucuaaaauaaacugcccaauguuagacucuagaaguuugaaccaguguaaugaauuauuuugaacuggauuucauucuugcuccaugcagacuguuacucuguaggcccuggugguugcauagauuuccuuggaacuggcagaguuaaagaccauugugagcuaccauuuggguauugggaauugaacccacaggaucuuauguguucaaggccagagcaauaccacugaucagaucucuaauuuuuuuuuggugguguacuugagcuguagcuuuuauauauuuugguccuuuuuuuuuuugagacaggaccucucucuauguucccuggcuggaacuccuuagguagcugguucuaucagauacugccugccucugcuucuccagugcuaaagauuaaaaauauucuauaugguaacccuuaucagagaagugauuuguaaauacucucucugguuccauuggaugucuuuuuacucccuguugauuguauuccuuuguuagacaaaaguccuauugcaucccuagacaaggguggcuuugaacucagaaaaucugccuuccucugucugcccccugagagcuggagucaaaggugugcaccaccauugccccagcuuaaaaguuuguguguguguauauguguguguguguuuuuaaaauuguuuuuguucuuaaagauuuauuuauuuuaugugaguacaccauaacugccuucagacacaccagaagagggcacuagaucccauuacagaugguugugagccaccaugugguugcuggaaauugaacucaggaccccuggaagagcagucaguguuuuuaaucacugagccaucucuccagcccaguuugcuauuuuguuuuuuuguuuuuguuuugcuuuguuuuuugagacaggguuucuccuuguagcccuggcugucuguagaccaggcuggcaucgaacucaaagauuagcuagucugccucugcuucccaagugcugugcugggguuaaaggcaugugccaccacugcucagcucagaauguuucuauuuuugaugaaguguaauuuguacuuuaguuuucucugcuuuuggugucaugucuaaagucaugaaauccaaagacgcggaacuuuuccccugugggguuuuuuuuuuucccuaccccuuucagcuaaauuggacacuauaagggcaggaacuauguuauucuaaccacuucacuucuguucauugggcauugaaguuugaaauugagauugcauuuccuauuguuuuacuuugaagcuuucucuaacucaggcuggccucaaacucaaugguuaucuuauugucucaguuuuccaagugcugacauaacaggcaugaaccaccaugccuaaccccauaauagaauuuuuaaaauauauauuuuuuacuuaugugacuguguguaucuggguguaugccgaaaugugugcauaccugugugugugugugugugugugugugucucacagaggccagagagggugcuauucccuugugugugugugugugugugugugugugugugugugugugugugcucacagaggccagagagggugcuauucccuuggagcuggaaucacaggcauuugggaacugcccgaagugugugcuggggucugaacucugcuccucagugauuggguagcaagugcucuuaacuugagccaguuuugcagcccuuaauauauaauucucuuauaaaucuuacuuguuuuagauuuauuuauuuauuuauuuuauguaugugaguacacuggcacucucuuuagacacaccagaagagggcaucggaucccauuauagaugguugugagccaccauuugguugcuggaaauugaacucaggacccguggaagagcagucagggcucuugacuguugagccaucucuccagcccccaauauaugauccuuaaaaggcuaaacuaaacaguagaguuagaauuaugugaugagguauuucuuguuucuaauuuuucacugaucguaugucuguuaucugaauuaugauagcaugaccuuuggaauuuuuacucuuacgagacucaggcuuaguuugaacuuuuucaucugucuaauaagaugauggugaugaugauguuaucgauguauaaaggguguuuauuuucacuuccgaugugauaaaaugcuaguagagucuuucuguuacaaaguucuggacaagcucuauuuuuauuuauauuacauggguuuucuuagggguaaaccgaugaaucaaguuuaaaauuuaaauauucccauguuguuaacuuccuuaccuuaaaauucugauaguagggcuggagagauggcucagcaguuaaaggacuaacuguccuuucauagguccuaaguucaauuccaagcaacuacaugguggcuaacaaccaucuauaaugggaucuaaugcccucuucuggugugucucaagaaggcuaguguacucaaaaauaagucuuuuaaaaaauucugagagucgccgggcgugguggcgcacaccuuuaaucccagcacuugggaggcagaggcagguggauuucugaguucgaggccagccuggucuacaaagugaguuccaggacagccagggcuauacagagaaacccugucucgaaaaaccaaaaaaaaaaaaaaaauucugagaguaaagauuauuuugcuagcugcucugcuagauggugaaauccuucaagucaagauguucauuuuuaucauucugcaucugugguaccagacuuguuucuuuguucacaguagguaguagucaauaaaugcuaaguuacugggagugccaaguaagcugaggggaugguucaggagcuaaagcauugcugcacaagcaugugggucugaguucuuauucucaacacucauguacauaaaaaagugggcauacuagcucaaacaguccugcccacaggaaggcagagauaggcaugcaguacuaugccuggcugguuguauaucuauaccauguuuuuuauauauauaaaagaaagaauuauauguugaacacacacaugcacacauacacacacaagugcgcuugugccuuuaggacagcaccccuguaccuuaaugacuuucacuagacccuuccucuccuuuugaagacagagucuuuaaaggcuugccuugaacucaagauccucuugccucauccuacccaguacuaauacuagcuacggauuauagccauguuaccaugcucaguccugccaacuggggacuaacauccucaauccauauguaaaaaacacugaggaccaggaagcaccaugauaacauucuaaucaccucuuuccccuauaugauugccuuuacauuuuuuaaacccccaucucccagaagagaauuaagagaaaaauuaaguaggagggaagaaagguguugguucacuacauuuggggaggaauuauauuuagcuggaggagaacuagcauuagcagaaguguaauaguggaugcucuucuguuucucuaucucccucauuagaaccaguaauuagcaauaagaguacaauuucucauuaucuggagugcagggcccuuauuugcccaccugguaggcuguuggguaagaugugccuggcuggggggauagaguagggaaguuucaggauuuuuuuuuccccauucuuuuucaagacaggguuugccuguauaucccugcuguccuguaacucuguagaccaagcugucucaaacucagaucuaucugccucugccuccugagcacugggauuuaaggcaugcgccacaaacccuggcuguaggaccucaaguguuccaaaguaguuaaaucagauagacucugccaauauaguuguuagguggguaggauuauugguguucccuguaaugcuguuuuucuuccagaauuugucuuuuaaaguugaauaucauuacauuguacacaugugcaauauuuuguauuuguauguguguguuuguauaguauaauauguguacagugugcauguuuaauguguacagguguguguguguguagacaagaggaccacuuuuggggguuuguucuuguuuugcacccuguuuugagggagaugcucucuuuuuaaacaauuuuuuuuguauguguguggauacaugcauaccauuugaauguggagaucagagaacaaauuauggggaucuguuuuaucucuacagaguuagaguuuugagaauugaacuuagaugaucaggcuugguggcaguuggcuuuucccaaugaaccaucuagcugacuaucuaguuguucuugcuguugugcucuuggauagcugcuuuggagcuguggguaggugauuccacuucuaucacucuguaugauugcugugauuacagacagaucaucaauuuauuucuuuuauuacagucauuaauuuuauuuguaugugaguguuccugaguaugggcacuguaugcagguaggcagagagagcucuagaccugcacuuacagguugucgucagcugccugcucucagugcccccucuguaagaguaguaagugccuuagcuguuuacuauuaguuaucucuucagccccuccgguaauuuauuuuguguauaugugggccaugguacaaguauggagauagaaggaucaccuguaggaauugguucucuccuccuaccaugcgaccggaucagaaggauuugaacuuagguugccaggcuuggugauaagcaccuuaacugccgugccaucuggcugccccugcaucuggcuuuuucaucuugguccaugaacucagauggcaaggcuugugaagcaagugcuuuuaccauugaaccaucucuggggacucuauauaccgugacauuuugauuauuuguuuauuuguuuagggacauuuggguuacuuagaaguuaagcuuuuucuuauagcuuuaaaauuuuuaggucagcugggcaugguggugcaugccuuuaaucccagcacuugggaggcagaggcaggcagauuucugaguuugaggccagccuggucuacaaagugaguuccaggacagccagggcuauacagagaaacccugccucgaaaaaaaauuuuuuuuaggucagccaugguggcacuugucuuuaauugcaacacucaggaggcagaggcaggcugaucuugaguucaaggccagcuuggucuaaguagcaaguuccaggacagccaagguuauauagauagacccagucuaaaacccaaaaccaaaaccaaaaccuacccccaaaaagaaaagguuuuuuuuuuuuuuuuuuuuuugcgccaguuuuuucuccauaaauguacuuuaucugugguaugucauauuauuuuacacuuuagaauucaggcucuguugauguucuguuuuuuaauagacuaguuguugagugaagcuagaagacuuggaugacagaugacauuccuuggaugcgaaugccaaugucuguccuuucugcuguguagugaggcugugagaguuccaaguuggugcuggugucauuuagaguauaacucucaauugucuguguccagcagugcucugugucucagaugguuucagacucacuuucucaucuguaaucuuccuucugccucuuuagagucuguauugcuguagcucugaaagcagauuauauauuauauauuuuuaguauuaauuggaacuuaacaucagauggcugaguuguaugcuugugcaguucuugguuuaccuugcuuugggugacuacacaacuuuuuuggggaugguauuucaaagaacuguguuucauaggucauuuuugaauccuggacucaguaguccuuguguaucagccuucugauaacucaugguuauccuuucaccucucucugugugcugaguaugcucagguccacauuugcuagcaaucucuuuccccacuaauaacacauacauauguauagaaauauaugcagacaaaauagagaaaaauugaaaaaaaaauaaacaauucaguggaggagaacacauuuuacauucuguauggggaugaagugguaguaacaugaacuagaacauuaggaauuugaccucuguagcaccuucuguuuccuuuugggauacagggaguugaguguugggcaugagggagaggccugcagagcagcagccagugcuugcugaagaugaugcuugugcagccuagucugcucagcccgcauguuggggaucaggaccuaacaguguaaugaucaggggcaaucuggcuugaauugcuuaguuuauuuuuucuguaaguggugagagcacaguacugaauuaaccagauuuaaaguucucaaaguguguaaaaguaaccauguuucacaauaaaaugucuuuuuguguuuuguuuugguuagaacuuuuuucuuuuuaaaaaagauuuauuuauuuauauuuaugugaguacacuguagcugucuucagacacaccagaagagggcacuagaucccauuacagauggucgugagccaccaugugguugcugggaauugaacucaauucauugugcuucuacucuauuucuaauggggcucgaaaugagcauauauuucuauuuacuugacggaaucaaacucaguuucuauuuauuuauuuaacagccuuaucacagcuccccucucucuucuccucccauuuccacuuucacucacaccccuauccccuagacuuacuuuuugacugugauuuaacuuauacucccuauagguuuggagucaugcacaugguguaauggaguuccaaaggcaacuuuggauucucuauaaacauuuguaacuaagauuugaaacaaguauuguggguguaugacuugauuuguaaaauguuagccuuuccuuauucuugauuuauuaaaagaagaaauggaauuguggaauuuauguaacuuuaauuuuuagcauuaaaauuuauuuuuuagauuuauuuaugucauguguaugcauauuuugcuugcauguauguauguguguguaccacguguguuccugguaccaucagaggucagaaaagaggacauuggauccccuaaacuggaguuauagacaguuguaaguugcucuguggugcugggaaaugaauccaauccucucuguaagagcaacaaguggucuagccacugagggccccgucuuaaaaaaaagacugaaaagacauuccaaaauauuuaaauuaguguuggaauuuuauaaugauuaauccaguuuaaucuuggugcuguaauuuaucuaauuuuugaauugcuaauuuaaagacuauuuccuggauuauuuaauuuugguuuccugucauuauauaaagcuguguuuuuuucugucuuuuucugaguuuguauuguuaaaauuggcaaaauaaguggacuauugaagguugucaugaaaauguuuuauuguagccggguguaguggcgcacgccuuuaaucccagcacuggggaggcagaggcagguggauuucugaguuugaggccagccugguuuacaaagugaguuccaggacagccagggcuauacagagaagaaaccuugucuugaaaaacaaaacaaaaaacaaacaaaaaaacaaacaaaaagaaaauguuuuauuguuuuaguuuauauuauuuuauuaguauuugacuccagaauugaagauuuaagauggaaaccugaauaagauuagguuauauagccaugcgcugcuuuauuagucaggcuaagcugcagaguguucuugaagcugggaguaucaucuuaacucaggaaacacauccagugugcuccauuuccaucugguaccugaaggagaggggccuuugcuaaugaguccacuugccuugcacgguggcuccaauacaugcuuucuuuccaagauaagaugcaguauuaccauuuacuuauacugcacuggauauuuuauuauaucauauacuucauuauucgggcucuuaaucauuuguaaaauauagggagugaauaagacagaugcugaaaaggagagguagguuacaucaccaaggaccaaggucacuuuacagugacuuugaagugcaucuuuaaagcucugucauuuuagagagaaauggucaaaugaaaugugagcuugaucccuugggaaggggugaaacucaaggaaauggaagaagcuaacccuuggggaaaaaugauguaaacuuacuucagacuagugaaagauaaaggcuguuuucuagguaguguuauugagucuaaggaaguguuaugcagaaugucaauaacauuaggaaauauuuacuuaaauauagaccuucauuaaaaaucugccgcugugcaagauucuuccuagcuaaugaccucagcccugguaguacagugauaggugagaauugcaaucuguagugauuuuugcuaaucuuuuuccuuauuucuuucuauaugucaguguugcuagaugaaaacugaaguagcuuugggucauguaaguugaacauacaagauuauaagcauguacccuugcaccuagguagaguguuauuuuaguugaaucagaaaagugaugcuggaccagagagacucaacugucaaugcaccugccuucacgcaggaugauuagaauuccuggaaaccacagaauaggagagaauuaacaaaguuguccccuguccuugacuccuguaaauaauuguuaaauaggauuaggaacaggguuucucuguguagcucuggcuguccuggaacuugcucuguagaccaggcuagccucagaacucagaaauccaccugccucugcuuccugagugcugggcuuaaaggcgugcaucaccaccgucuggcaaguguuauuuuguuuguuuguuuguuucuaagugcuggcuuaugguuuugguggcacauaccugaggcacaagaccgaggcagggcuuaauggcauguaagggcuuaauggcgguaucuugucuuagaacagacagccaugauccauguguguucacagugacucgguuuuauaguuucauguggcaaauucuggaggaaucuagagaagcaggaacaacccuuuccaugagguagaggacaagaugugucugagucuugaaaaaagaugaguagcuuuccauuuggaaacuucugagggcucucuuggcagagggaaagugaaugcaaagaccugaaggccuuccuguucuacuggguugaggcugggaaggcuagugggccagugcaggugaaguuggcugaguaagguuuugacuuuauccuccuuguucuccacccaaugacagugauaacaagagcugcuuguagaagggcagggaauguagauucauggguaacaacccuuccacccacacucuauaagcaguucugggaauggagcccagggcucagcagcuacuaagaaagugcugugucacugagcuuaacacugcuggcuuauacauauacuccagaccagagauaagaccuaggcuagagcuucagaacaguguguauuuuaucaguaggaagguugugaggucaguguugacuaagggaagaacuaggaaggggagagaagggaagggaaaagaaccuagagucuccuuagagggacacgauuggucucuaaccauaaaauuauuuuuauugcuacuuuacaacuguaauuuugcuacuguuaggaauuuuaauguaaauucuuuuggagauaagagguuugccaaaugggucucgacccacaggaugagaaccacugcuuuaggagacggggccuaaugagaagucuugaagucacuggaggaaugucuuccaagggcuuuauggaacauuggggucucucccacauuggccugcagaauuuauuucaccauguuuuucuuggugugcugccauagguucaaaguuguggagccaaccaguuacacacucaaauaccuaaaaucaugagcugaauacaaucuuuuuuguuuuuuugggacagggacucucuguguagcucuggcugucuuggaacucucuguagaucaggguggccucgaaacucagagauccgucugccuuugccuccugagugcuggguuuaauggcaugcaccucuaugccugacccaaaccaauguuuuaaaaguuaguugauuauccccagcugggggauaaaaaugaaacaaaagaaaauguugauuaucucauguauuuguuauaaucauagcaaacugacucuguauagacccucuucaccuuugaagaggauuuuuguuucauaaaauaauuguuauaaacaauaagaauaaaauaguucuagaauauauaaguuaggaggaacaaaguccagagaucuguaaugccuuauaauuucuuagguuuuuguguuugauuugguugcuguuuuaccaccuacucuguuuuucaguuaugcugugguugcuggaaggugucuguguuauucacaaccugagagaaccacuugcuucugaagugauaccagacagaucuuaauuaggccucucugacagcucggggcagcuccuuuaagcuuucagagccucuugugaagaacggagaccuguacaaccuuagcuuuacauuuguguucgaacucucuauaccuggaacauuuuucuuucccacucuucuucuuucuucuccccucuuugagacaaagguuuguauagcuguagcagaccaagaacuuuguagaccaagaacuggcuuuaaacugccucugccucuucaguggugagguuaaaagcaggugucacuaugcucugcuuccuacaacuuuugaggggaauuuucaaaccuaauagagaaguugaaauaguaaaguauuaguugcuuugcuuauuguugugacagaauaccugacagacaauguaauugaggaagggcuuauuuugacuuacaguuugggagaacagucagucaucagauuugcuauguagcacaguugaaguccugaucuuccuaccucugucucccaagugcagggauuuuagacugguacagguucaguuugacugguucuuggcccucuaagcaccccaccugcuuucauuuuucuucuggugcugauauccucucuuguuuaugcugucacugcaguguuuauuuuaauauccaggcuuguucucuggucucagucucucgugcuagauugcaagugagagccuccauaccuaguucauuuuugugguauccacuguugacuggaauaguguucuuggagguggcacacaaauacuggcugaaugcaugaugcucaaugguugaauaccauuggauuuagauuuugucuuuugcuuagugcuuuuuguauguuuccugaugguuauggcuuaguaugguuguuuuaauuuugcuauuuccuuugguauguauccuagaaaaaaauaaaaaaugaaaaaaauaaaaggaaaaauaagagcaauuggagugguuucuuuuucuuuuuuucuuuuuuaugucugucugucuaucuaucuaucuaucuaucuaucuaucuaucuaucuaucgagacaggguuucuuuuuugagacagccuuggcuguccugggcuuuguagaccaggcuguccucgaacucguaaagaucugcuugccucugcucucucauggacuggauuaaaggcaugugucacuaccaccuggcagaguguuuugcuuuauuuacaaugaugaugaugaugauuaagauuaaaccuaguugucauugucguccugucauuccuccuuuacaguucuguauaauugcaaguggagugacaucuacuuuuugugccagaggauaccugaugcucuggguugaucauguaacacaugauagaugauucaguuacccuuguagcagauggggaacuuaaaaaacuuuguuuauuuguauucuauguguaaauguuuuuuucucuguauguguguguguaccaccuguguaccugguaccugcagaugccagaaggccccagaucuccuggaacuccaguuuuggaugauugugagccaccaccugaaugcugggccugaggggucugaauccagguccucuggaagagcagucaguauuccuaaaccaucuccagcuccagggaaacuugagaagauauauauauauauauauauauauauguguguguguguguguguguguguguguguauauauacauuacuuuugcuuauguguaaaugcauguguauaugggguacaugcuugcguuagugcagguaccuacacaggccagaagagggccaggaguagguuagaacucaaauuauaguacucaccauggguguuagggucugaacucuugguccucuucaagagcaggauacucuuuccagcugugugggaaacuuuuugcucuggcuuuauauagauagauagauagauagauagauagauagauagauagauagauaguuagauaguuuggcugucagaccugacugagaugcugcugcugaaauuguaauuagaaauauuggcuauaauuauaagaaaauaauuuucuuuuuaugaggacuaucuucauuuaaaacuuaauauuuccuuauugcucccuuaaucucaacuaguuuauagugcaaaauugaagaugauaggcugggauuuagagauuuagucaaauacaauuugguuuucagagugaguuaauuauaaggguuauccuuguuuuuugggcaguuaccaagagauuugggagcugagguuccuacagcuguguuaagucugcuuaaugcagauacaaccuggcacaccuauaacuguauagaguaauucacaauccuggauccugugcacugugacaaguuaauguugcugugaguacuuuuaauuucuaaaucuccucugauuugcauuuaaaugaaccauccuaacauuucauuaacauaaccuugcuguuuaaaaaauuggcuucgacuugcaucccaagguuggaaaagacacacuuuaggaaugaugugaccauuguguuguaaaugaacuuguaaugucuugugaggagguguauagcucuucucacaaagaggcaguuugccaacagucagcucccuuggguucuaaugggacugugcuguauuuccuuucuugcuuuuccuuucauacaggcugcuagacaagcaauugaagcucuuucuggguuuguagugauauuuugcauuauagacaagaucacuauuuuuagauaaugaagaccaaauaacuacguuuuagcuuuucauuucauuccacuaaguauaauucuuccuggaaaaacuuaaguuugcuguuuuuuauuaauguuggccagcucuagcagauuuuauaauagauuuuggaaaggagugcucuguaaguuaauugggaaacuagaagcugccaagagcuuuaaaaguuauuuguuuagcgauucuaaacaauaccauuaauuguaaauaaccaggagaauaugauuaagaugaaggcaggaacuuuuucuugguagguuugugaauauuuucaaauggguugcauaaauucaguucagcuuguacugcugugcccuguacaaaguacuuuguuagcaucuuauagaauauaaaaauguauaacuauuguugccuuuaaauuuaaucacugagccauuuccccagcccccuaccuuuaguccuaaaacauggaacauauauuaagguugagaaaauuaaguuuaauaaaacaguucaaaggcuguuaagucaguggguccuaagcucugggucuucaccccuuggggguccuauauccuucauaucagauauuuauauuacaauuuauaacaguagcaaaauuauaguuaugaaauagcaauaaaaauuuuuaugauuauaauauaauacaguucugcaacaugagguacuguauuuaaggguugcagcauuaggaagguugagaaccacugacauuagugaaagacccuguugcugcagauaccagccacauaccuugcuugcaggaugcaguuugaacuggaagcuuacuccuuguuggcuacuuuuuauaguggugagaggugcuaccuguguaggcuaguagaggagaaaaaggcaucagugguuuuaauuagauacgaaccuuacugcaauaacaacuggccaagaaagaucuguugucuuguguaauaguggugugacuguuaugggcguaaccaaccaucuucugauaggauauaguccuacuccacaggaggaaacccauguacaguacuguaaacuuggucaaaaauaugggucgggaagugauaggcacuaaugaggaacuuaauacaguuuaguuggauugauguagugucaauuaaguaucuuuuaaaugucuuuguuuggggguuggagagaugacuuagugauuaagaaugcauauuguucuugcagagaacccacauuugguucccacacccaaaucaggcaguugacuuguaacuacagguccagggaauccaaagccccuaacggcaccauacagaaagggauuugugggaaggaggaguugucagggaugggaaugcauuuuauacacaugugaacauuuuaaagaacaaauuuaauaauaaaaagaacacuuugauuacagaacucaaaggauguagaauaugaaauauaacaucuuuaaaauaaaaaauguauuuuuauuuuauaauuuuauguuuaugaguguuuuaaaggcuuagauuuuucaaagccuauuuuguuuaggguucucaaaugcuucaaccucccuucuagcccaccgaccaaaguggggagaaagauuguuaauaagaccaagggaguuguggaccuguuuagaaguaguuguuugggggcgauuccaagcuucguugucaggauaucagcaguccaguccaauagcaaacaacaaacaugaauaaguagcagcagcuuaaucgaguggagaccucacugcucuggcaaauuagcacgagucuguggaagcagcaagaaucagccaguacaguguugcaaggcguuagcaaugcaagaguguccucucacugucugugggguuauauuuauauucuuucuaaauaucacacgcccuuucaagcgucugcuccagcaaaacaucaugcccucucaugugucugcuucagcaaaacacccucucacaggaaacuuccagaaaaacaucacaugacacaacugaguuuccaaagaaaccagaaauuuccacuucaguguuugcuauaugugcaccacauacacggaguaccuggguguaggcuuagauuuuucaaauccuucuuuaacaaggguucuuaaucuagcucacuguucaaaggcagggggagaaaagaugguuaauaggacaaggggauguggaccuguuuagaaguaguucuuugggugaauucaauuuuaguuugucaggauaccagcaguccaguucuguagugucagguuaccaacaguuuuaaagaaucgcuaaacacagaucagcaguggcagcacagccaggccucugcugaauugacguugagucagucggagugacuaggacccgcugaauauacaguaagucaaacaaaacaaccugaaauucuuaccaauauacaauaauucaaacaaaacaaccugaaauuuuaauaguauauaauaaaaacaagacaaccuuaaauuccuaucaguauauaaugauucaaacaaagcaaccuuaaguuccuaucaauauacaauaaaaacaaaacaaccuuaaauuucuaucaauguauaauaaaaacaaaaccuuaaauuccuaucaguguacaacaauuuaaaucuaccauccuagaugauaacaaccauagcauaucaaacacacaaacuguccauuccaauuuaagggguuuggggugacggucuucuuauaauugcuucaugcugaauuggggugaagaauuccuguuuggagcccaaggggcaaaaugauuaaucccuagcacguauguagcagauguggaucucaaacaacuaaagugggggcuaucccaaaugcuguugccuguacaugggauauguucuucuaguugggcuggcugccuugucuguccugagugggagaggaugcuccuagccucacagagacuugaagugccaauacucagggguaccccuauaugcacagaggagaaggggauaggggaaaggguugugggagggggugaccaggaggggagcaaugcaggauguaaagugaauaaguuaaauaaauaaauaaauaaauaguuacuaagaggaaaacaaaauaaagucuagcuguagcaucuguugcccagucucuguuuuuauccagucuauguguugucugucaaguuuacguauuguccagucucugugugauugaucauuuuggcuagcccuuugaaguugaugugcaugcauauuuuugagaaaucaguaacugagacagucugugaaagugcaucaccugggcuauuugcuuugugaagauauugaugucucagcugguuuucccuggucagaucuaaucuuuauaaguuuuguugguaaccauauuuucucauccccuguagauacauaaguguaaccaugucccugucuuaagagcauugcagguuuccacuccaauguuaaacuuuuuuauaguauauugguuggcuuagugccuuagguuuuuuuuuuuuuuuuuuuuuuuuuuuucccguuaacccagugucucucagaugccauuguuccucuucacuaacauuaagaaaauguagaguuaacaaggcauuauuuaaucuguuucugaggguuuaauucucccuuuuuguuuaauaagcaucucuucuaagguaugauuggcucuuucuauagugggauugugugguauaccaguaacaugcuuuauauuguaacauauaaagaauuauuucauuuuauuggauauauaugagggaccauuaucagucuuaauuuguauagguauccccauaauugccauuauuuccaauaaguguguaauaacacaguuaggcauuucagaacuuaaagcaguugccaauuuacacccugaguauguaucagugguaugguguauauaucuuaguuuuucaaauucugcaaaauggaaaauauccaucugccaaaugucauuucuuuugguccccuaggguuacuaccagcagguaacagaauuugauuguauagagaacaaaguaggacuuuuuuuuuuuaauuaauuaaaaaaauuuuuuuuuggcuuuuugaaacaggguuucucuggauagcccuggcuguccuggaacucacucuguagaccaggcuggccucgaacucagaaauccuccugccucugccucccaagugcugggauuaaaggcgugugccaccaccgcccagcuuuuuuuuuuuuuuuuaauugccaagugaugggaauucuuuaaaccucucccauuaauaugauauuuuuuuucaugaaauuuugaggcuuauaacacguuucuauuaguaauggucaauuucaucauuuccuugagcuaauggaccuggcaaaccuauagaagaccaaauaugaguaacauacaauggauaguuucacuucugauggccuguuguaauuguauacauaaugagguuauuucugaguuaucagguacaaauuuagcagucucuauauccaugcaaguuucuuucugcauauaaagaauacgugauuauguuaagagauucaggauaaucuaguaauauaaggauuucauauaauucugacuuuugaacugaggcauaaggacuuuuuugaguaccuugcucauuuugucugauuuauaaccugccauccccaucuuggucacaucaguauaaaguguugaugucucugcauuugguguucccuuuaugauauguggaagacuccaguuuuuuuuaugaacuguauucguuugcuuuuuggguauuuguuauuaauuuugcccaaguaauuacuacaagcucuaugccagucuuuauugauccccauaaugacauaaucucagcauuuguaagagauacuauaguuuuggcugaauuuauuccugacaauuggcauaaucuuauuuuaccauucauaauuaacucagaaaucuuuguauauaugucuucaauuuuuuaaauuuguuuaugagcuaagaaaauccauuccauaauacuaucuucucuuugcauaaugagccagcccacuaggagaaugaaucgaaggcaaaaugaccaaaauacaagcaaguuuagaaucaauuugauuauauuugcauguugcagucuucguuuuacaagaauuaauuaauuacaagaauucuuuuucugcuucagcuguuuaaauuugaaucuucuugcaauguugaaacaaauuacuuaacucauauguauuuaauccaauuguaggccacagccaguuaauaacacuaguuaauaacauuugaaaaucauuaaguguuucaguuggucccuauggaucuguaccuuuugugguggaauuuucuguugauugauuuuauaacccaaauaacuaaaugaaccuccucuuuguauuuuuucuggagcaaucuguaagccccagcauggcagaauucuuuguguuaccuuaaacauauucucuaaaacaucuuuaucagaaucagccaacagaauaacauccauauaaugauaaaugauagcuuaagggacuugcuuaccacauaaaguuggauuauuuaacauucccugcgcaaguaccuuccagugguaucucuuuccagugguacugagaaagcagaccuuuccuuauccugcucaaaagaaaucuuucaagucaguuauuuuuauaggccaugaucuuggccuauaaaagauuguaaaggaaguccaggcuguaaaggaucuauugauugaauuaccuuguuaauugcuuuugaaucuguuauccuccuccauuuuccuaaucuauuuuuuacaucaaacacaggagaauuccauggacagguagacucuuuuauauguugauccuccagcuguucuuuaccaguuguucaagugccugugauuuucuuuuguuaugguccacugcucuugcccuacaggucuguuugauaaccauuucaggggcaaggcuguugguuugucaacaguggccccuuuuauacauuuggaaaugugauuccugugauaucuuguuuuuggaccaugagcacaguuugugauuuuucucgaucccuguaucaauaccuuccccaggagcaucuaccauauaacacucaauuuccucauuugcugucccuggaauugcaagaauauuaauuugugugccccauugcuauaaaggauccaaagaucccuuccccauaaauuuauggguauaucagcuacauaaguuucagcuucccuguuugccuuucuguuccuacacaguuccugucagacacuucgauuuauuccugauaauuuaucaauucuauaaacuauggccuucugaaguagccaaucuggauucuaagacuuuugagaauguauacuaacaagcuccuguaucuaccaagccuucuaugucaaugccauucauuuacaucauuaacuuggguuucugaucauuaaccaaucuaaucauuaauguuugccagaacacacauuuuucuguauucccaaaagcuuauguccuuucuacuggagcagccuugcccuuuauguaagaaaaugagggggcaggugagaugacucaccguguaagagcacugacugcucuucugaagguccugaguucaaaucccagcaaccacaugguggcucacaaccaccuguaauggaaucugacgcucuuuucaggugcgucugaagacagcuacaguguacuuacuuuuaauaauaaauaaauaaaagucuuuuuaaaaaauguaagaaaacgacaguugaacaguccuauucccuguaucaauuugcaucucuuuucuuacauaugccacgauucuaauuucuucuuugcuauccccaucuacuauaccuggaugcauaauaaguccuugagaaguuaaccuacugcucccaaaauuauucccacuguuucugaggguacauuauucccacuguuucugaggguaccagugguagcuaguaacauucaacuuuuggggauagggaaagagguguaacuguggccagauccaaaccugcacuccguucuguggcauguauaagauuagaaauacuuaguuuuaguuuucuuuccugcuugguacuuucugguugacaaaggaagacaacuuguauugcuuacugugggaccuggagcugacaugcccccugcucauuuccugagagcagauuaccucacgugucccucuuggacuggcaauccuuugaccaauauuugcccuuaccacaguagcuacaauacccaggaaaccuuugugguuuuuaacagucagaaccugcuuguucucuucuaugaauacuuuguucccuagagucaguguaccugcuauuuugagcucugaaucuucuagccuuaaaucucuuuggaaauggccaaaccuaucauaauuaaagcaucagguauugauuucuaagacuucuagcuauucauugccuuaugauauuagcaugaugcuccccaaaaccaauaucaguuaucucucuuacccauuugucuauuggggcuccucaugcuuccaguuugauugcuuucugaugaauacauucaguauucauguuuucaaaggccaguauuucuaucaaugacugguucagggucugauaaggcuauuaaagcuggacccaaucucuguaagaaaucggugaaugcuucuacagguccauguauuaccuucauaaauaaaguagauuuucccccuccuggcuucucaguuauaucccaggcucuuaaagccccaauacaacauuguucaauuaugccaucaacagauuggauuuguucuuggaaaucagcauaaagcccuucacuaugcaguuugucuuuaguaacauuuauccuuuuuugcuauaucuuauuguucuauuuguggcuugcaccaccaccacgacaucauuguaauuguccagcuuauagaauagcuaacaccaaucucuuccaaucuugggggaauaacccuauucugcauagcccaaguauuuagcauuucuuuaaguaauggagagugcaagcuauauaauaccauagccucuuuaaaaugcuucaguucuagcauuucuguuggaugccaggucagcucauuauaggcagaaccagcaucauuaguaggcuugugcugcacaaagacugggaaggcugaaggugccugugaaggccugagcaaauccucugguggugcgcuggacugaauacuaucccaugguaccuguacugagccccuagucagggaggugcucuggguaucucuagugaaaaugcauguagcagagcaaggcagcaguuuacuuucuagcuuauuuaguuucccuuuuucuuuuuuuauuuuuaaagauuuauuauuuuauuuaugagaacacuguagcuguuuucagacacacuggaaaagggcauuggaucccauuacauaugguugugagccuccaugugguugcugggaguggaacuuaggaccccuggaagagcagucagugccaucucuccagccuccuagcccuuccccuuuucauugugugguacauuccuggucucagacaucaaguuugaacacuguuguuccucucccacuggcuuagcacuucuaccucuauuugcaaacucucuuaagugcuuagcuaacucugcaaucuuaucuaacauaaagaguauugucaggggcuggagagauggcucaaugguuaagaguacugacuguucuuccgaagguccugaguucaaaucccagcaaccacaugguggcucacacucaucuguaacaacaucugacacccucuucuggagugucugaagacagcuacaguguacuuacauauaauaaauaaauaaaucuuuaaaaagaguacugucaguuuuccccccaaucuuuuuaaaaaggucuuaaauuuuuuuauuuuuauuuuuuuaaaccaggaaacaaaaucaaaaaccuuccuccaagaacaagguaguagaucacuuaccgguuuucacugcuauuuugccaaccuuaagguacauugcuaaccgcucauaaccugaccuuuccucuagcacauuagaagaauuucccauuaugucuaagccauguugggugucaucuguaggcuuaaauuucucaaaaccuacuuuaauaagggcucucaaacgccccuccccuuguucgagcccaccauccaaagguagggaagaaagaagauaaauagaacaagaggauguguaccuuauagaaguaauuuuucaggauacuagcaguccaguuauauacugucaggauaccaacaguccaguucagaagaguuagcaauaguuaaguuuggggauuucaaauagaaauuuguauguuugguuucucuuaaauucaggucauuugaaguaacuuugugauaauugcuuggaguugaucaguuggacacaagcuuuuugaguuggucuuuucuguaggacuaucuguccaucucugaccuggggaggcugggugucauuugacuuauuguuggauuuauaguuugucaguuguuguauuuuugaaaguagcagagccuuaaaccacaacacccccccccccgccccccguuuuucgaggcagggcuucucuguauagcccuggcuguccuggaacucacucuguagaccaggcuggccucgaacucagaaaucgccugccucugccucccaagugcugggaugaaaggccugcgccaccacugcccagccuuaacuuucucacuggagcucccuuuaacacaugggaagcccuggggcucugaauccucggauucaggaaaguaaaagauucagaaggcuuuuuguuguuuugggaucagguuucguucuguagcuaaagcuggauucaacugagugucuaggauggccuugagaugauccuccugccucaaucaaguguuguuauuauagacauagaccaccauuuccaucuuguuaaaauaauuuaauuugggggcuggagcacuugcugcuuuuccagaggauuuugguuugguucuggugcacacauggcaacucauucaguuuuaggaaauccgauggucucuucuggcuuuauaggcacucuguaugugugugguacacauacauaacaugaaagcaaaaugaaacauaaaaagaaaucuuaaauuaauuucacuguagguguaggucuaauuccagcacugcagaggcagagacagguagaucugugugaguuccaggccagccaaggcuauguagugagacucugucucaaauaaaauaaauccugaaacacugaagcgucuuuucuuuuuguuuuuccugugucuagagaguuuuuuauaucagaaaaauauuagaagaguuucuuugggaaaacgaggcagcgucaguggcagagcuucuccagagcuuugccuagugcaugucuggcaggcucuggguucaguuccaaguacaagcgcccgaccccucaaagugagaauuguguuuugcgucucagcaacuaggaguugcucuaaaugcccaccuggguuugcuuuccuuaaucacagggucuaguccucuaauccugaaagguucucguauuuguacuggugcagucucuuugaaaugccaggaagcuaggauccacagggcaaauacuuucuucugaacugucuuaucuaugacauuugaugacauuugcuugaaguguuaguggucuuuaacaaccuagaccaucccaucucuuaaggauuacugacuuguguuuaucgguuuaguggacaaauaaccuuuaaagacccaaaauauguaggcccagcauaauguaaguauagggaacaaauugucuggaaacugcauuuugugauucaguguuuuauugaugcguggauaauuuaaagugaaauaaugaaaauuuggaaauuuaacaugaauuacuaugcuuauuauaaauaaagaauccauuuuaaaauuuuauacauuugguuuucuugaccuuuucuuaauuuuguggaauaugccuuacuaacacccugguauuuaccaacauuagacugaaguuaaguaguuuugugauguacuacaaaaaugauuuuuuaaauuaaauuuuaaauuaugaguauguauguguguuuuuugugcauguaaguguuggugccuacagaggccagaggugucaggugcaguggaguuagagauagaguugugagcugaccaaugugggugcugaugauugaaccugggucuucuagaagagcagucucuacucuuaacugcugagcugucccuagagccucagaguggguuaaagggccauggggccagguggauuucugauuuugaggucagccugauuuacauagcaaguuccagaccagccaggccuacacagugagaccuugucucacccugccaugucccccccucccccccaacuguguguguguguguguguguguguguguguguguguguacauaugcagucuaugguugugugcaugggggugcagaggcauugguuccgucuggacugggguucuuuguaggaauaguaaaugcucuuaacuauggagcugucuuucugccccaugcuuuagucuccuugauucuuacaugaaucaaggaaucauugauuacuuuggauguccuaaaaggugcuuucccuuuuucuuaacuuuaaacuuguuuuaaauuuugugacaggauuuuuauuccucagcccagauuggccuuuaauuugugaucuuucuuccuaagucuuuugagugcugguacuaacagaguaagcuauauucuuggccuaaauggugucuuauuuaaauacauuauccuauauuuauuagaucuuuuguuugaagaaccuuuuccuuaauucauauuaagauagacuguacguacuauccagaggaucauaaucuauuuuaucuaauuaaaucuguagaaaagcuuuuuugaaaaaggugcugguugguagucuucauguauaaaugagacaaguugaaaguaguuaaaaugaugugugcucuuggaugcuguuguccucauuauauuauguagagaguuuaauuuuguuaauuaugaaaauagcuuuccccccugaauaguaguuauauaguucuauaauauuagaaaacacaguuaauaaaaagaaaaauguuaaugcuacuuuuaauagguuguuucuaacuuuuagacuugacuuuguuaaauauuuugguagaugcauuucagcuccccccuacucuacauuuauuuauuuauuuauuuauuuauuuauuuuucaagacaggguuucucuuuguagcccugguuguccuggaacucacucuguagaccaggcuggccuugaacucagaaaucugccugccucugccucccaauugcugggauuaaaggugugugccacuacugcccggccccccuuuacauuuauacuucagauuguuuucuguagucaguaguauacauuuugaacauuuuucauauacuucuguaaaguguuacuaauguuuaauuugaggucccccccccccaaucuuuaauuuugguguacaccccccacucccccgagacaggauuucauucucuuuaagauuagacuggccugaacucacuaugcagacuuggaguuacaaaauuccugcuucaaucuauugaguguuugggauuauagccaugcaccacucugcccagcucccuaguucccucuggcauuuuuuuuccuuuugugugcguaugggccucacuccauagcucagacuggccuugaauuuacaucauuuuuuucugacucauucuucugaggguuugggauuacaggcaugcuaaaccacaccuagcuuuguuuaccccaucuaaaacuuuuuaaauuuaagcuuauuuauuguuuauaugauagcuauguguauguuccauguuagguuuguagaggucagaggacaacuuuggagcagguauucuccuauccuacucuuacuuggguuccaggguuaucugcugagcagccaucucuuauacuacccuugcacguuuuguuuuucuuuuuugauacauagucucaaguguaacuaagguugaccauaaauuuauagcagucuuuuggccccagguucccagaugcugggauuauaugugugaacuaccguaugcucaaauuaaucugaauuccuggguucaaaugacuuucaugccucaauuuacuguggauuuggaaauacagacagauaccacuauacccaaugagaaaaagaaauuuaaaaauggggucuugcuauguagacauuuguaacuaacuaggaaauauacuguucaguccaggcuggccuugaacucaugaacucccccugccucaaccuuucucuagugcuaagauuacaggcacggaccacagugcucugcuuagagcuauaucuguuuucucauagacaugauuacuguacuucuguguuuccuuuaucuauuaacucaaaauuuaguuucgauuaggauuucuuuauauuuuuugaaagauugguuuuuuauuauauauauaugagugauuugccugcauguauguauaugcacauguaccauauuggcuagagcuggaguuacaggugguguuuagcugccauauggguucugggaauaaauccugggucauucagaagggaggccaguguuuuuaaugcugagacauuuaauuaaugggcugagauucccuccuucccucccuccuuucuuuccuuccuuccuacaguauauagcccuggcugugcuagaacucauuguguagaccaggcuggcuuugaauucacagagauuuacuggcuucugccuccugagugcugggauuaaaggugugugccaccauaccuguauggauugaaauuucuuuguuuuaauuuauuuuuuauuuuguguguauugguguuuugcuuguauguaugccuguguuaggguguuagaucaccuggaacuagaguuauagacaguugugaacugaaaacuucaguccuggaaacugaaccugggguccucuggaagagcagccagugcucuuaacuaccgagucaucucucuagccaggauugagaucuuaaucuauagugaauuuguauuggaaaaauguugucaagauugucucuucauguaaacacagaguuccuauguguaagacucauuuguggguuaguuacaguuacuuccucuuguaaaugcugcaguacugauaggaaagucuuugugagagcuugauaauguauuucauguuucuguuugauguuugccugacuuuggguuuuuguuuaucucuuagaaaugacugccguccacgcaggcaacauaaacuucaaaugggaccccaaaagucuggagauuaggacucuggcuguugaaagacuguuggagccucuuguuacacagguaacaaucugaaaacacaaauaguuguaacauucuuuagcaauaggccuggccaccaaacccuaacuaagguucuuuagcucagagucuuaacuugaguugguugaguuuuaauuaguuugacaguccuuuugaauacugguacauuucuuuauuuaauucuuucuacuguugcaauugagacaagguuuucuaucaccacacugaccucaaccuccuuagguauaugaggguagacuugaacucuccuggucccuguuuccaccucuugaaugccacuuguauuaaagucaugugccacuaugccuggcuuuauuuaauucuuuagacuacagcuucacuuuucugaaaucuuacugcugauaguaaagguuauugguauuauauaguacagauuucuaaauauuugugcuuugcagauaacuucacccuccaucagacaggaaauucaaugaaggugggacuugaugguuaagguucuccacuuaucuuaaugcacccuucauuguguaggauuaguuagcagguaauuuaguuugaggguguaggcuugguauauucuguuacaaauacaugcgucauagugugaugacauugauuagcuuagcagcuguauaguuuuacucuuuuggcauaguuaauguauguguauauuuauauaugagaggagagagaaaacaagaaugacauuugcugucuuuaaaaaacuugccuucuaagccauaaacuaagguuuuauaugucuauauguagauguguggggguuagugggauacuugcugucuugaacccaguauucuguacuuuucaggucuuauguuuggcagguuuacacuguaacaaaacuuuaaucaucuucaaccuacagaucaucuggcauauuaaacuuauuaaugaugucuaaugcucuggaacuuuuaagcaucaucgcaguaggcuuuugugggcaaucuuucauuucuuuauuaaggaccuuuacuaauuaaugcuaagauuugcauuaauaaacuugagcagacuucagaaguaaguugucugagaacauuuugcggacuaguaacaaugacaaaaauguagucuucugguaaaucuaaauuuauuguccagccguuucuggaauaccuugacuuaaaaaaaugacguuucacuuauccccaaucauaguuugagucugaagucucucuaaaaacuuaaugauuacuuaagaacuuaagauaugcauuauauuucucucucucuuuuuuuaagauuuauuuauuuauuuauuguauaugaauacacuguagcugucuucagacacaccagaagagggcaucagaucccauuacagaugguugagagccaccaugugguugcugggauuugaacucaggaccucuggaagagcagucagugcucuuaaccacugagccaucucuccagccggcauuauauuucuuaucguauacauuaagaaacaaaauuauuuuggaaacuaaauauagcauaauuuuaagaauuguguuauuucauguuuaguaagaucucuaagugugucugucaccuaacuuacuuaugaacuuggaauugcuaucuuuaaagauacuagucuacuauuuuucauucuaaaugauuuuuuuuuuaaauuaaacuucuagguuacaacccugguaaacaccaauaguaaagggccgucuaauaaaaagagaggccguucuaagaaggcccauguuuuggcugcaucuguugaacaagcaacugagaauuucuuggaaaagggggauaaaauugcaaaagagagccaguuucucaaggaggagcuugugguugcuguagaagauguucgaaaacaagguaggucaauauaugaagagagacagguuuuccuagaaauacauuaaaauuuuaaauuuacauuuauuuauacgugugucugugauucuauauaugggugccacagcauggcauauggaagucagaagacaacugugggagcccccucccucccucccucccucccucccuccuccccccuuuccccccucccuuccuuccuuccucccgucaugugagucuggagauugaacucugguuaucugguuaucaaauguggcagcagcucucacugagccaucucacuggcccuaacugggcuucuuucucauggguuauucaccaggggagaguuggcugcugugccaugagaacacuuaggaaguucuguagcaaggagguaacgucugcugcuaauggccagcagcauacuuuugccaagcauaugaauggacuacuuuggacagauagccauuuacauucaagauucagaagacagcacucccaacuaaccccaaaggauuauaaaugcuccuuuuaagcuaucauuaauuuuugaaugauuagucagcagaagaaaauaugauuuccuuucucuauaagguuuucaguggucugaaacauaaccuaacuugucuuagguuagcaauuaaauaauugcuuaucuaaggaaugcuuaguugguaucuauggaaacauuugguuccuuaagggacuguaagauguguuuguucuggaucaauguugacuaccuuugauuagauagggguuucuaguuuuuuuuugguagagggccagcuaguauuuuaguuuuacuggccauagagucucuguugaagcuacuuagccaugcuauaagcaugcuguggagaauauauacacaaaugugcaagguaugaucugauaaaacuuacaaaagcagagguaugcuguuuugauauacaaaauauaguuugcuaauuucuaaucuaagauuuuccuacacuguuaaaaauagaagcuugcuggguucaaagaagaaguacuuguuuaugugaguuucaagucagauuucuguguuugggguuugugugugcccugugcuuucuaugcaaccauaauuuuuaaaaaagauuuauuuauuuauauaugaaugcucuaucugcauguacaccugcaugggagaagagggcaucagaucacauuacagaugguugugagccaccauggguugcuaggaauugaacucagaaccucuggaagagcagcaagugcucauaacugcuuagccaucucuccagccccuaugcaaccauaacaaugaaugcauacaguuuuguauaauuuuuuauaugaauaacguaugaaaauuugggugucuuaaaauaccaccauaaaugcuauaaguguaucagaaacauccacauucauaaaacucaaguccauuuuauuucaagguaaugaaaugagccucccaagaaccuaccaugggagccaguuaucaauuucacagcaucuaaacucauguggucuagggucacaucauaaugacaaucugcuuaaacuaggugcugagccuuauacaggcugauguauauugcugcuuuuuguaugugcccuuucuuguuuaguggguacacauccauaugucuacucuuugguuaggucaaucaaguguuuucuaauuuuuauaguaauaauuaauuagauugcccuccccuucccagucucuaguagggcagauuacuuuauaguuugguggucuuuucugugcuaccuaacauggugucaggucugugguagauaauagguauuguguuuuaggauaauuagcuauuuccuaaagaguauggugugagaaagaaaaguuccuuucucacauuuuaaguguauuuacaaauaugaaugcuuucauguaggugaagaaucauaaaaagcugauguagugcauacuauaucagccuuucagaguuuguaguauauucuuaggguuguguagcugugguugcugucuuaaguccagagcauuucugucacccccaaagacaccuguacucaucauaagucacugacgucuuuggcacacaguagggucuuacuaucuaccucaggcuugcccaggacgcuggaucauuuugccugguucccaaauguuugaauuauaaucgugugccaucaugauauauauuucaaaaguucacaaagaggagggcugccucugguuauuuuaaguauauuuuaugaguccuugaauaauaaguguucuaacuagaaaaagaaagcauuuagcuggcuuaagggaugccagacagauaagaugaggcaaaugauuagaaaaugagaaguauagaaaacagaacuagugcuguuaaguuggaaguaaggggaugaggaauaguuucuguguuaguugcuuugucucauugcucuaagaaaguuccugacaagugcaacauaaggaaguuauuuuggcucgaaguuguaggguuacaugcauacuguccagccuggugaggaagaucugaaggcaggaagaggagguaucuguucacauugcaccuccaccuccacucuagaagcagagaguuaggaauacuugugccuagcuuguuuucuccuuuuuaucaguccaguaucccacccauuaaauaguauuguccacauuuaggguaggucuuucucaguuaacauaaucuagauaauuccacauagacaugcucagaaaauuguuuccauaacucuaaaucugaagaauuuggcaaucaagauaacuuucagacacacauuggaauaggauuuuacuugaugguuguuguggggcuuuccuguaaucuuaccucuuagaaagcaugagcaggaagauugaaagucauaccuggacucuauagucaaccuuaccuuaaaaaacaaaacgaaacacugggcugcagucaguaguuggcuuuuaaaagcuuauaguagggacuugcucuaauaugaguaacuucuuccuugcuacucaugugcacgucugagugaugacucaagaagcagaugcacaucuuuguauaauccuacauugcauucaacauuugguucaguaaaaaaggcuaagaagcuagccugagcuacugaaugagacacugucuggaguguguguguguguguguguguguguguguauguauauguguguguguguguguguguguguguguguguguaccuacaaaaaccagaaagaaaauagaagagggcucaauuaagcauaugauuagguaaaagugaauuuucuaggaaggauagauguuggggaaaaaaccaaaugggguaaguuggcugguuacauguguuccucugaugggcaagacacucuuguauagccuuuaguuacuuuucuauugcuguacagacaugaugaccaagaccacuugcagaaggaauuguuuauuggugcuuacaguuucagaggguugguuagaguccaugaugauuaugguggggagcuugggaacaggcagggguggugcuagaguaguagcugacaccuuacauuuuugucacaagcaugaagcagagagagagagagagagagagagagagggagagagagagagagagagagagagagacagacacuggggauggugugaguuuuugaaaccucaaagcccccauccccagggacacaccucaucuuuaccuucuaauccuuaauaaacaguuucaucaacugggggcaaacauuaaaauauaugagccuguggaggcaauucucauucagacgacugcaaguagaaaaguuguuuuuccuguuuuguuguagaaugauacaugggcaugaaauguaaauuaauagcaugaauauuagaaagaaugaugagcagauaaacagcagguuagaaauguuucuuauguguuaaaacauccauuggaucuuuaaauggagaagaaagggaggaugccaucuagggaaguuggagcacaguaagccaugccuggggaauguugagggcucuuacuuuaggagaacauuauggagcacugcugauaggaaagguuaggacaguguaugguguuuuggcucaaaucauagagcacacacaggguccuggguuugaucucagaaaauauccuucuuccaaaagguuuagaaaauuauuauguccugugaguuuuugguuguguuuuguuuucagaaccaggcuguccuuuaguagcuugccuuucagccucucagcuaaagauaagggugugcucuuggcuuagggugccacuugagagugguuuggaaugccagguguggaaugaaggacuucuagggaaugguguagaaccacaggauucuguuguuaggacaaguuuacagcuuaguauaucaagugauacagggcucuuuccaguauugguuuguguguauuuauaaagcuuuuucuuaauuuaaaccagaauguuucuuuaauuuucuuauguugaaguucuaccaucuggacaacauaaaacauagggacaggugaugcucaugggagauuaagucucuggaacucgguacaggaagguucaagagguugacagauaggagguagucuagaggcaggauucugagucuagacaccauuaucacugcuguaugguaacgggaaugcagggaaaaaugcaaaggaauaaguugucaugugggcuaacucuuguucaaauaacuguuccuuuuaauggauaaaguuaagggaugugguacaugaaauacugcgugauuuauuuucuuguaaccugaaucaauuaaggaacauguugaggccaugggagcuaaaaacuuaggcauauuauugaaaguuaaaaguauuuguucuaggugcuuuggauguagcuaaggugguagaguacuugcuuagugugcuugaaacccagguuuugaucucagcaucgcauacaaccaggcagaaguggcauccuccuguagucucacuacucaguagguagaugcaggaaguucuaggccauccuuagauacauagugaauucauagccagccuaagauacauccuggguuauaugagacacugggguuguggggguggggguggggauggggguggggaaucuuaggauagagccaguugaauucaguugggccacuucuuagucaaguuaacauuguuugacaauauuuaguccaguaguuuaguugauuaacaacagucaguuaaugaguugcuuuauuuuaacuuuuaaaaaaaauaauuauaaaucacuggaaauuguaaaaauagagaagugcaguguauccugcagccagcuucucacuuguuuacaucuuuuagaacuauauauaauagugcaauuucuaaaucaggacacuagcacugguucaauguguacauacaacucuuuguccuuuuuaguauaucuguagauuuuauagaacuacuguuucaagauucaaggaauuaguucauuuucuuaaagaucuaauuuacuuccuuguucucauucauuuaccucuucucuucuucucugaaucacuuuguaauucuguuguuuuaaggauguuauguucaagugaucguuuaaauuuucauugcuacuccauggcaugguuguaacuuagucaccggaaaguaaaaagaugccucuuguaaauauucucaacauuuuuguguguguguguguguuguuuauaaagguuuuauauuuaacuguguauauauguguuugucuguauuucugcaugggaaugugugugugaggugugugugugggggggugggggugucuaggugcacuucaaagacagaagaggauguuggauaaucuggaacuggaauuacugcaguuuugagcugcccaguaugagaguugguaaccaaaaccgggucaucugcuagagcaaucugcagucuuaacuauugaaccauuucuucagccucuuaacaacucccaccccaguaaaaacuuuaucaucuuauuuaucucuuuguguagguagcacuggcucuccuagaacucacuauguagacaaggcuagcuuucaacucagauugccccugcugggguuaaaagcaugugccacuaugcccacuuacuuuuguauuuuuaaauuauguguuuaaaucugaauuguuuuggguugcguuuuauuuauuuauuuauuuauuuauuuauuuauuuacuuaucaauuguguuuaggucaccuucuccuucggcuucuuuugccuauggagaacucaguugccucagcauuuuuggaaauguugucuuuuuucaguugaauuaauuuugcacauuuguuaacaaucuauagguuguauguguaaaguuagauuuccuuccauugauuuaugagucuucauuuucuuucuaccaauucuacaaagauuugguuauauaacacacuguuuguuuguuuguuuguuuuaaacuuucuauagcagaacaaggagcagcuuguauguauguguauguaucucauaagugugugggugucuguagaggucagaguuguugggucuccuggagcugcaguuguaugcuuugugaacugccuaaugagggacuggauuacgaauuugggucuucugaaagaacugcaaauguuuuuaacugcugagccauuuuccuagcugcaagagaaauacauguacuuuuuuaaaugucuugauucugugucuguguaagagagguaccccugcaaugguguacauguagaguugucucacuucauuagagauugaauuuagauccuuaggcuugcuggaaaguuccuguaucucagccauuucucuggcuuaguauuuuauuuuuauuuauuuuuuauuaucuuauuaaaaauguuuuauguguaugggucuuuuuugccugcaugugucuguuguauaccacacaugucuagugccucugaaggcuagagaaggguauucgauccacugggcaaguuaaagaugugugacuugcuggguaggugcuggaaauugaaccuagguccucuggaagagcagccagugcuuuaagccacugaguugucuucaaccugggacagaucuuuuuaaaaaaauaaaauauaaaauacauacaacaaaauacauauacucagcauacagcuuggugaaauacauuuagaacauuucccaaggguauaguuucuaggaacuuaaaagauaguuuuuguaaaucauuuucuagaagaguuuuaucuucaguuuggugauguucauauaaccucagcuacuaugugccauagaaauccagcucagaccuguuugaccugggagagaucuugaaccuuugcaauugggauuucuagaaguaucucuugaguauagguauuggucaaagaugcagggacuugaucccgagaaccuuucaccucccaguuuugguaauuugguuugucucuguuuucauguacucuguguacauguccuagacagaugccaacauaagauagucaucucaguuaggucgucagcagaacaucuuuucuuccucagugucuauaacuagcccaguuugacucaugcucagucuggaauagguuuucuguuggcagaggacaguaaaacaaaucuggauacaucuuuaccccacacacaagacauuggggggagagcucucuauaggcucauguauacuccauaaagugauguugugcaggaaaaaaaugguagucuugacagauacuaggauagucccauaugauuuuuguuuuguuuuguaagcguaaaauguuuucuuaaaaaaaaauuguucuggagccagagggguggcuuaggggucaagaacauuugcuguacuucccgagagccaacauuuguuuuauagcacuugcacugagcagcucgcacuugaguggaacuccagcuccaagcgauccggcacccuguucuuuccugcugggaauguauacacgugacauauauacacauaaauaaaaugacaaaaauaaguuuuaaaaaaaugagucuuuugaagcugggcuguagcuuagugguuaaauguuuucuuagcaugcauaggauccugacuuugauccccugcagcaaggggaaaauuauacuguuguuggugguagauacugaauuuuuuauugcuauauuugaauuguccuagugcaguacugguuaucuauaagccuuaguuuucuuuuguugauuuguugaagccuuuguuuuucuuauuaauugaaacuaccaguuuuuuuuuaaaguuuuugugguaugugugugugagagagagagagagagagugagagagagagagagcgcgcaagugugcgagagcacaagaacauuugcaggugcuuguagaaaauagaggacagagaacuuucaggagccaguccugucuuccuagcagacuugcaggauugaucaaaaugaccaggacuguucucaagcacuuaguuuugagucaggaacuaggcuggucuggaaucuacuguguguacaaaguugaucucgaguuccugaucauuuucccacuccugagccuuggcuuuaaacucgugcaccaccaugcucagcugaaauaacugugacuguuauaucaaccacaguaaauuacuucucgauauguacuguaguucuccuggugaacuucaggagcuugguaaccugauucagccuuuucuucaguaucaaagaaacuguagugugaaccuuaaacgucugcuccaaauggcuagaaggugaagagggggucguuuaguaaauagaaagagaaugcuuuaauauuuuggcuugcauuucccuccuuucaugucuguuugcgcuucaguaguaagcguuuuaagauuuggggggaaacuucuuaaguucuggccuuugggucaguauuccauuguagauaauucgguaaugaugcauugcagagauaaaauuucaaguuauugaaagcaaccaaaauuguucuaaguaucagucuuuacauaaguuccucccucccuccuucuaccucucucccuuccugagaacaggaucuuacuagcucaggcuggcuuugaacauacuauguagucugaauucuugauuaucuuccaucuccugaauugugaaauagcaggcauguaccauguucuagacuauuaagcccuuuuaugugacacauaacugauucauuucagagcaagaaacuuuuucugcaaaagcucaggacuuuguaagcacaguugcuuuguaaacuucucuaauggcuuaguuaucuccagcuauuuuuacauaaacucagggacauacaguuuuauaaucauguaaaacugguggucuuuuacaacauuccacagaggaugaauaaugaaagcuuuuguuauuuuuuuuaguacaguucaaaugauuuguagugagugugugugagcuuuauuuuauuuuaggaguguguguguguguguguguguguguguguguguaaugguugucaagauugauauuggaugucuugauugcuuuccagcuagugcaacaagccagucugcucugaggauucccccucucugccaagacuuguagguucuggcuaucagugaagaauacuucucuuuuuguuuguuuguuuguuuguuuuguuuucuucuucaauuguuaaucuuggcaagggaauuuuaaaugauguauuuaguuccugaccaaagggauuuugaguuuuaagauguaugugugugugcgugugcgugcguguauaauuuuuaaaaauuauuuauuuauuuauuuauuuuccugccagcugaugaaagucacauugaaggaagugaaaauuggaccuguguccaguguggauguugacagcuguuauucaaucuguguaaaaugccuggaaaauagauguuaaaagagauaggacagaguaacugucagugaccacuuugaacaggguuugagagguuaacaagaggcagaaugaaguccgagguugcugaauuuaugauguagagacaagcagcuaugaggagauuuguguggaugugugggucuuucuagucagguggagguugugagcuugauauuacacaguggcccuuucauaggaaacaaucaacaaguguuucuacuuuggaaugccgaguaugaguuucaagacauaacgaugcucauggaggagugugaaaacaucuaagucacuagguucuuagauugcuguaauaacuuucuucauuagguccaauaacucagcugauuuuucucauagucuuccuuugagcccuggcuugcuuuucaacuuuuuucucuuugcugcauggauaaaauugucugaucuuuccaacccccugccccuuuuaugucucucuucauuugaucuuuucuaucuggaucuguuagaaguacauccauuuucuaaccuccauauguucugaagccuaugauuagauaaaaacauuguuuauuauuuacccucagaccccugaucuuaucacuuaauucuucucuugcuuuucauuuuaguugagcaggguaagcaaaauauaaauuuuggaaaaucauuagcaaguugucaccugagagcuuuaugucuuaaguugucugucggucucaaauuguaagucucuaggguugaggcuguacuugguuugacuugggaugugucaaggaugcugucugcuucuggaucagugcccaugugugagcauaugcugcucugcagagauucaagugcuaaugcagccaacuuguaagugaggaaagaagagugaaaucauuaaauucuaauguuucuuaccauuuugaaauuguuccucuuuuaaagaucugucuuguuaaauucacaaaaauaacacccacugagauaaugcucuugaguuacagcagguaauauuguugccuuaauauauuuguacaguguagcagagguuaucucaguauuguucuguuuuuguuuuuuaaaaauucuuuucucuuuuaauguuuauguaugcauauauguacaucugugugcuaugccauuggaaauuagagaaaaucaguuuucucaccuuacucuguugggucugggagagaacuugggcuauccagcuuggugguaaguaccgcuguuaccugcugagccagcuuguuggccccuuuuaaaauuuugagauggaguuuccugccacuaacugaccauguagcagaggaugaccucagauucuuggaccuccugccucugucucccuagugcuaagaguauaggaaugcacuccacugacuugguuuuguguuuuggagacugaaucucauucugaggccaggcuggccucaaacuugcaucaauccuccuaccuaagcauacuaaguggugauauuacgggucugcaccaccauacccagcuuaauuuagguguugacuucaugugugauauugcaguaacuugguuacugcuaguuaauuucuuaaagaaagcgauuccagguugaaaugcauguuaugcauuuauuugaauguguaaucaggaagcaagugucucucuuuggaguguuucugaauagcagcagggcacacuugaauuagaaaggaaaaugagaacaugaauaugugugguacucuauuuuaauuuaaagaaauauucugucaacuauaaaaguggaaaaugcaaagcuucuuucugugccaccaggggguaggagggaggaggguaaauugaaagguuuucuaggcucugugaguucagauuuaaauaacuugauauuaacuugaugcaguugggcugacucuaaaaagauaaaguguaaaaaucacgugucagagauuuccugggaucuugucuuauguuucuguagcugugcuguaucuggggcccagggcuuugccagaccuccuucagugaauacagggugagagaggacgcugccucugguuuagaggaguaagugaugcccucucuuccuuuccucuuuauucucucucucuucugaaauucuguaucuuuagggguuaagaucugagacauauguaugaagauguuaaacucuuagguacaggauacuugguaguagagcuuucuguaaugcccauuucuugcuacucuggguagaauggaaaacaaacaaacauggaucuucuuagggaguugagaugaaacaacagucuuaccauguaacucaaggugguauugaauuugugauuuuucugcucagcuuucugaauauagacauuauaguccuguaccauuuugcgccccccccccuguguauguguguagauaggaauaaagaguauuauguagcccaggcuagccuccaacuugauauauggaugaccuagaacuugcugacucuugaaagguaagauuauagauguguggcaccaagccuggccaaaacaauuuuaaucgaaaucuuacauuucaaaaacaaagcaacauuaacaaaaaggagaggaggagaaguaguaguaguaauaauaauaauaauaauaaucugagccgggugugguggcgcacgccuuugaucccagcacucgggaggcagaggcagguggauuucugaguucgaggccagccuggucuacagagugaguuccaggacagccagggcuauacagagaaacccugucucgaaaaaccaaaaaaaaaaaaaaauaauaauaauaauaaucuguagugaauguauuucgauucuagucaaaaaaagaaaaguaaaaguuaccuauaauuuuguaacugagauacuaaaaacauauguuugugauuggggagauaguuuagcaguuaagagcauugacugcucuuucaaaggacccugauucaauuccuaguacccaaauauucgcucauagcuuucuguaacuugaguuucagaggacucaaugccaucuucugauuuccuagggcuccuucauauucauaauacacauacauucaggcauguacacagacauguaaacuaaauaacuuuacaggcuguuuucccugacugugcuaacaugaguaggacagugugcuugguugcuucauucguuuauuauuuauuuauuuuaaauuuauuuauuauuauacauaaguacacuguagcugucuucagacgcaccagaagagggcgucagaucucguuauggaugguugugagccaccaugugguugcugggaauugaacucaggacgucuagaagagcagucagugcucuuacccgcugagccaucuaucucaccagcgcucacccccuuuguuuauuuuuuacuuuaugauacugaaagauguuuaggaucuaguuuuuuuuccuacaauauaauuuuuauccuugcaaaacauuuuguauggagugauuaaauuuagacacacuguuuuguuuuuuuguuuguuuguuuuuuuuaaaaagauuuauuuuauuuauaugaguacacuguagcugucuucagacacaccagaagagggcgucagaucucauuacaggugguugugagccaccaugugguugcugggaauugaacucaggaccucuggaagagcagucagugcucuuacccgcugagccaucucuccagccccacacuguuuuguaccagcaaaccauacauuuuaauuuuuccguuuuauuuguuugugugugugcacgugcacuauaguguguuuguggaggagccguuauugccuucaccugcugggcucuguagauggaaccuaagccugguggcaagugcuuucauucauugagcugacucccuggcccuaaugauuuaaaaaauacuguuaacuuuacucacuuuucaugcuuguaagcacuuuuaaauuuuaaauaaaagacugaaggcagguaugagauaagggagaaggaaaaagguuugagagcauuaauauaauauccuaaugaguuagaaagaacaauugaacaaagucuuggaaaacacgacaaggugccacaauuuccugaauguccaaaaaaauucauccuggccgggcgugguagcgcacgccuuuuuuaaucccagcacuugggaggcagaggcgggcggauuucugaguuucugaggccagccuggucuacaaagugaguuccaggacagccagggcuacacagagaaacccugucuugaaaaaacaaaaacaaaacaaacaaacaaacaaaaagauucugaaauaauuucuacauuuugaaaggugguuaguagcacucaguuguuuaccuaaagcuucugucauuuuaacacagccccccccccuuccccugguucgcagaaugcacaucuagguagauaucucaaaaggucauuugaauuuggcaguuaauaagaaacaguaaaauguuucagaaaugacuaucuaaggucaucuaauaauuggaauuuuuuucuuuguguuagcuguaaacauaaaauaaaaaugugauugggcuuuguaaauaaccacuuuaucuguuuaaccauauuuaaacaccugauuuuauaaagcuuuuaaaaaggauuuuagagacuagaaguagugguauacccuuguaagcucaguauugaggaggcucagucaggaggaacagaagugugagacucgccucgucugaaaccucgucugaaagaagaaaagacuuagcaauguauuaauuuugccuuuucaguuuuguaauaaacuagcaaacauaagauuuuuaugccuuaaaaacaaaaaauuugaaacaugacacaauguguacacacacacacaaacacacgcacacacacaacacagacacacacagacacacacgagaauuuugagacagguuuucucucuguauuccuggcuaucuuagaauuuguucuguagaccaggcuggccucccucugucucccaagugcugggauuaaagguucuugucacuaaugcccaucaaauuuuauauauuacuuguauaaauaacagauauuuuaaugguuuucaucauuuauaaaccuuuucuuuaaaaaauuauauucgugaggcugaagugauggcuguucuucuaggggucgauuucuaguacccacaugugucucacgaccaucuguaaguccaguuccaaggaaucuguaccuuuugcuggccucugaggcacagagcaaacauuuguugcauagacauaaacacagacaaagcacucauacacauaaaauaaugaugaugaugauauugcuuauaaacaugcagagaacuauuaggaaaauaaguaacucauagcacaccaccuuugguacaccauagucuauugcacucgauguagugcacauacacaccaguacccuguucacuguccaacacugauuauuauauaccuguuauuaggacucauuaguaaagacuuggggcaggagaacuguaauuugcagcuguguaccucuacaaaaugaguguuuuuuuccuucccccuccuaccuugcuccugccuuuuugugugccccacucccuucuuucuuggacauagaauauaggaaaauucuggucaagaagcaagguacaaguauuuuuaaggggcuggaaggguuguugagccauucaagagugcuuccugcuuugugaccugaguuuggauccuaaggaagcaccuguguaauagugagcacaguagcucacuguucccugugacuccagggcaucagacuccucuucuugcuuccuugugcacacauacucaaauacacaaaaauuaaaauuaaguaucauuaauauuguuguagacaaaaacauaaacucuuguauucauuggcguuucuuuguauagaguacagggagugugaagugguuaaugggguaacugagggagaugagaacucccuugagaacuacaaaagucuuagcuuggaacaguuuuuuaaaauauaaaaaaguugggacuguugagauagcuuaguucuagagcccauggguagaggggagaacugacauuggcaggcuauuuuuugaucucauguauacuguggcaucuucauucuccaaauaauauguaaaugcgugaaugaguaaguauauguauggagaauaaaaugugggaaaaccaagggucagcaaggcgaguuucuucagucagugaugguucacagaaggaccagcuucuuuucuaaaagugacuuucugugguguauagguugacuagaggaggugacuggugcagcauuuccugcuaggagccaacaucuacuuuauccuuaagaaacuugcuagcauaacuauugcguuuucuuuuuguuugccauuuaaaacaggaugucauuuauccugggcugcccuggcacuuacuaucuauccuagaauggcguugaacuaguuuucuugccuugguccugacuugggauuacagacuuguuggggagcaggcagcucugucauaaacucaagaucauccucaacuauuuagccagccugggcuacagaacauuuugucucaaaacaaagaaacuaacauacaaaguacccccccccuuggaacuaagcaaacaaacaaaaacuuagcauagcauaauagaaucuuugagcaacauguggcagcucaucucaugccuguaaucccaguucuguggagguggaagagacgggggauggagguucaggaccguuugcaaguauauaagagauggagccauucugggaucuauaguacaugcuuuuaguuuuugaaaauuuagauguguaaauguuuuugugugcaugcauaucuguguaccacuugauuuccuugaaggaguuacagauaguugugaucugacauaugggucugggaauuuaaguucagggcucagauuaaaaaagaaaaaccuacaauuuuuuuuuuuuuggcucaaaaaagaaaagaaaagaaaaacuuacucuccuuuauagucauccccccccuauuuuuuugcccauauuucuuuuccuauaacuuuauaaaguuugauugcuuugagggaauauacuuaagguaauugauucuuaagaaaggucuuggucuuaaucuuauucuaauaaagaacuagggguuuauuuccccuuuuugucuuuguuuugaaugaauagaaguucuuaacugcuacugucucugaaggagaagaaaacuuugggguugacagaucuggauucaugacagaugauguaauaguagaagguucucuuucuuguuuuuuucuuuguuuuguuuuuuugagacaggguuucucuguauagcccagguuguccuagaacucacuuuguagaccaggcuggccucaaacucagaaauccgccugccucugccuccugagugcugggauuaaaugugugcaccacuacaccuggcuucuuucuuguuuuuaaacuuacuuauuuuuuuuuuaauuuauuuauuuauuauauguaaguacacuguagcuguccucagacacuccagaagagggagucagaucucguuagggaugguugugagccaccaugugguugcugggauuugaacuccugaccuuuggaagagcagucgggugcucuuacccacuuagccaucucaccagcccuauuuuuuuguuuuuuaaagacaggguuucucuguguauucuuggcuguccugguucuugcucuguagaccagccuggccucgaacuuaaagcucuaccuaccucaacugaguucugggauuaaaugcaugugccaccacuccuggcaaccccuccccccuuuaauuuuauguguauggguguuuugacugcauguguauaugugugccaaugccuggugcccucaaaggccagaagagggugucagauccccuggaacuagaguuacagaggguuguaagcugagccaacucuccagcccuaaggguuaugaugcaggaaguaaguaguccuuaucuuacaagcacuuuaacuuccugagcuauguccccagguacaagguucucuugaguuuagucuccuuuguaucuuaguacuacacaugugguagaauugucuaggagguacugggaaacaggguuagagucugaguucuuaguggugacuauaugaucugggguaccauuuuuguuugcuucaguucccuugcaccucuuuauauaggaagaaugcuuugaucucuuaggaauguacuuuaaagacuuacugacaauuacaguuuuuauuuauuuuuuugagacagggucucacuauauaacccuugauaccuuagaacucauuaaguagaugagucuggccuugaacuuacagaaaucugcuuguguguuuuucuuuuuucuuuuuuuuuuuuaaagauuuauuuaauguauaugcauacauacagauaugugugcuccaucccugucuucagacacaucagaagagcgcaucagaucccuuuauggaugguugugagccaccaugugguugcugggaauugaacucaggaccucuggaagagcaguuggugcucuuaaccacugagccaucucuccagcccccuuguguguuuuucuaguguugagaacauagaugcaccaucacuuacuggcuugcuaauuuucuuuuuagacacagguuucauguagccgggauggguuggaacauuuuuauguauucaaaucugacuuuuuaauuuuguugccuucccaaacugugggacgguaggcaugagccauuuuuucucacuuaagaaucaaucaguuaaucaacccuuucucccucccuuccuuccuuccuuccuuccuuccuuccuuccuuccuuccuuccuuccuuccuuccuuccuuccuuccuuccuuccuuugauaggguuucacuggauagcccgggauagccuggaaugcucacguguucguucucucucucucauuuuuuuuaauuauuuguacuuauuuuauauguuaugggggaagcauguaugcauacacguggaguucauaguucaacuugugagugcugguucucuccuuccauuauguaguuuucaggaaucaaauucagcuggccagggauggugacaaguacguugaucggcugagucaucuugcugaucuuguucaaguuuugcugauugcugcugaugaucaugaugauuuccuuuuauuuuugcagauaaaaagcuuauugcaauuuuacugggcuggggagaagguuaaagugcuuguauuguaagugugggucuuggaauuuguaucuucucaaccugcauaaauguuggauggguguaguguacccauguaauuccagcauugggaaggcaaggauagaagaaagauguccagaguggacucaguggaggccaugccucagugaggaaggcuggaggugguugaggaagaugcccagucuugcuuacuuuacggucacagggagggccuuuaagcaggcucuugaacuuaggucuuuuagaaccugcuucucuaucuuuucuuucugugugugugaauucagaaauuguuuucauuguucauuuuguuuauuggauuuuuguaggugagugauaggacacuggaucugacuuuguugucugccagccuugaaccagaaagucuucuuucuucuacaguagaggccacaggcuucuacacuuacauguucagugugauuugcguauauuuuuauuuuauuuuauuacuaauaagcaccuguuaaauaggagaugaagaaguuguuaugguugaaaucuagcuagacugcauuauaauugauguaaauguuuaucugauuccuuauagucacugaguuaagggaagagguauuuuaagcccuuuuguuauauaguacccagaucucuguuauaugaagauacuuaaguaauaguacaaaccgaagagagaaaaacagaaacaaagacucuuuaaaauacacguauauaugaaauaauggagugugggcuaucuuacccuuuaaauaaaauguuaguuuuuaaugaauaaauuauuugaauuaauuucugcugguuuuguguuuucauucuguaaaauaggagauuugaugaagagcgcugcuggggaguuugcagaugauccaugcucuucugugaagcgaggcaacaugguccgggcagcucgagcuuugcucucugccgucacccggcugcugauucuggcugacauggcagaugucuacaaauuacuuguucagcugaaaguugugaguuuguaucuauauuuauaauuuguucuuuguguccuagugaagcugguguuggccauauuuuguuuaguauuaagaauuauuuuggggcuggagagauggcucagaggugaagagcacuuacugcucuuccagaggugcugaguucaauucccagcaaccacaagauggcucacaaccaucuguaaaggaaucggaugcccucuucugguaugucugaagacagcugcagugcacucacauacauaaaauaaauaaauaauucuuuaagaaugcuuuugguuuugacucagugauugcuuuguucaauuucuucucuaguucaaguauuuaugacacaggcucuucuacaggccaccuuugucucaguuuugcugaagaaauuguaacaaagguauuuuugacugccuuuuauuuuauuuuuuuuauaguacucauucuauguuucuuuguacuaauaguguuccagaauuagaaagccaaaguauaaacuaauuaggugcuccucaauaccuccaaaucacucagacaaugccaggccauaucagcuacgcauacuuguuuggguugcuuucggaauagcuguuaaagaagguagcaucuuagacuuuauuaauuuucaccuauagauuugucuguuuuagaguuguugcuuuugugguuuguuuuuuuagguggaagaugguauauugaaacugaggaaugcuggcaaugaacaagacuuagggauacaguacaaagcucugaaaccagaaguagauaagcugaacaucauggcagcaaaaagacaacagguacaaacaugacuugcagacauuuuauguuacuuccuuccuuauuucuuuguuguugagacaggaucuuacugugaagcccuagcugauuuggagcucacuauguggaccaggauggaguguauuuuaauauccaguagggauacccugauuugccuaaguuuucuaauguuaccauuacuuucaccccuguucaugugguucuaauaagugcuuaagagauaccggccuggugagauggcucagcgguuaagagcacugacugcucuuccucaggucuugaguucuaaucucagcaaccacauggugacucacaaccauccguaaugaaaucuuauacccucuucuggagugucugaagacagcuacagugcacuuacauauaauaaauaaguaaauaaauaaauaaauaaauaaauaaauaauuuaaaaaaaguuaagaaauauccuuucaacccgauggugguggcauuuaggaggcagagguagguggaucucugaguuugaggcuaaccugguuuacagaguaaguuccaggacagacaggacuacacagagauacccugucuugauacacccccacaaaaaaagagagggguggagagagagagagagagagagagagcgcuuuucaguauuauaaauaaguuucacucaucuuuccauauuguguuucuaaguaguucaaggcuugccuuaaacuugugaucuuccucccuucuguuuucuccagcaucugagugcuaaaguuaaaggcauaucccaggauguguggcuaaaaacauagcagcaguucaaaauuuaugucuaauuagagaaacuuacuagaaaguaauucugucugaauuuucauucucugugucccuaaguccaguaggaauuccuuacauaucagcaguccucaaccugugaauggcgaucccaaaauauuuauauuaggauuccuaguaguagcaaaauuagaguuaugaaguagcaacagaaauaauuuuauaguuggggggggucaccacaauaugaggaacuguauuaaagggucacugcauuaggaagguuguuagacaugauccucaguguauuaaagagaaguaucaauaaauguugaauguuuuuuaaauaagguaccaaaaagucuuguuuucucugugcccuuuuucuacccuuguuugcccuguuccugccucugaggcauaaccuguuuggauuguacccgugagcuccuuucccuuagguuccuguugagguuuggccaguggaaacaugaccagaaaaucugaaaagagaaugaagcugugugcugucuauaggccuucuuuccugcuguucaucuuacguggcgagaagucacacuguauaccuugcuucucuccucagaacauguguucagugccucuguucacccuucacuuuccaucuaucugccuuuguaacacucauccuuuuaauuacucaguauauugccuuuuuuuuauguugagauuuugauacaugcuuccauugucuuggguugucacaugucagaggucaugcuuaauauucccuaucauuuccugugcugagauugaauguagggucuuggcaagaguucugcacucggcuacaucccuaaauauaauuuacauaguuguuuaauucuuuuaucuuuagauuuuuacacuuuucauaauguuaagagggaaaugagaagaaacuuucacuuggauuuccaguuuucuuuuagaguuggauuacuuagagguuaacuaagucacaaugcaugggaugaauaaaucagauuuauggaaauuaguuuuucuucuauauguguauauguuuucuguauguccuuagucagcuugaacuguaaucagauugguaaagucaaucuaaaacacagaauuaucuuuuaaguaauuuguuaaguugcuuuauagcccacuuuucaccaaaauuuagauuauuaaucagcacuauauagcuugaaaggaauacuuuuucauugauuucuucauauuacauuaccaguacucuuaguaguguccacuugcuuauuuguacaaugcaaacaugacuuuaaagagggaaggcagaacccucagcaccuaggauaagcaagacuuaguuguuauccucaucauagaugcuuagcagaugagggcuuauucaaaaaugcucauguagaaaauauuuuccaguuauuuaaaccucuugacuagccacauugccuguuguacuucauucuugaaaugaucaccaacucucuaaagccacaggguagauaguuaugaauauuuagccuagugcagucuuuaaauaagcuuauuguacuagacuauggacuacccaguggcugaggaaaaucugaaguuuggcuacucauuggguaccuguuaacuuuaggugaucauaaauaccugcaacagccuuugauggagacugugcugaugugucuuuuaagugcuuagcaacacuaaggcuuauuguagagcauuuuauaaaacuaagcguaguauuuauacuaaaggcagauauggccuuaggagacuuaaggggccuugacauugcggcaagggcaaaauaauuagaaaaugcccgcagaguaugugugccacacguuuaagcuuaauguuagccacagccccuuaucauaacuugaguacugaaauggcucacacucuaaaucuacaggguccuguuucugaauauuuagccuaauauaguaugcuacagggcauuuggaguguuguaagcuauuacucaaaaauucagguucuaaaugagaaaaaaauucuuggugggaaaguagcugucacuguacaagauuugaauaaagaugugaacauccccaguaguguacugagaugaaguuucagaagaaagaaauggguuggugucucuaauguuuuauuaagaagucauuuugggggccuggagagcacugacugcucuuccaguggucuugaguucaauucccagcaaccacaugauggcucaugaccaucuguaauaggaucuggugcccucuucuggugugucugaagacagcaacaguguacucacauacaaaaaaauaaauaaauccuaaaauaaaaaauuaaucugggggcuagagaaaugacucaaugguuaagaacacuggcugcucuuccacaugaccuggguucaauucccugcauucacauggcaacugaaaauugucuguuaacucuaguuccaggagaucugacacccucacacuaauguacguaagauaaaaauuaaauuauauauguaugugugugcauacauauguauguauauaugucagcuauaaaaaugagucauuaaauagcuaacucagacuuuuugaauaauuggcuuuucuacauuauuuaaauuuucuuauaguuuauauugcaauacuaaucuuauuuaaaucuguauucuaacauuaaguuagugauauuaauacuggaauuuuauguucacauguaaguacugcuggagcagacuuugaguuuaggguaauucuuccucuccaguagugauccacauauaucaaagacuccugugucuuuaaguuucagugaugaccagaugccagcaguguuuccuuuugucuuuuguguacuuaauacuuaccacauccauccuucuuuguguucucuaugucacuaguuaaaaugacgucagcagccucauauucuuguaauugugggguagaagaaaugauaaaagauauuuuugcuugagaccacauuucagaauuuuauaaucaugaauugcagucaaguagcacguguuccuucauuuugugacuuaaugaccaguaaaaugaguaaucuuacuuugugagaagaguguaguuuuauaaucuggaauggucuuugggguccgaaaauggggaggaagugguguauagcugaucguauacuuaccuaguugguuugcaaaguucauauacacguggaauuguguucccaauuucauaaaauucuuguaauaaacuacgacaacuuaaauucucauguuuuuccauuuaaauaugucuauauggacuuucuauuugauauauauauauauauauauauauauacauacauauauauauauauguggauauauauguguguguguguguguauucuauuucuauggaucugaugaagguguuaagcaguuuuauauaguaacauuuauuuuaugccuuauuuagugcuagguacuauguauguauuaucccauuuuauuccucaaaauguuaaaaguuuuauaguauuguuucuguuuugcaaaaggagaaacuggacauuaaguuuacaguuaggauacaacaaauggccaggaaaaaguaggcuaggagauucaagucaaggcugugacugcauagcuccguccuugcuuacuuugccauguaaccuccuuugugaucacuuuuuaggcuacguuaaugcaguugugucuugauaugaauagaacccuucaauauuuuauuuuauuucauuuuuaggaacuaaaagaugugggcaaucgugaucagauggcugcagcuagaggaauccugcagaaaaauguuccaauccucuauacugcaucccaggcaugucuacaacacccugauguugcagccuauaaggccaaccgggacuugauauacaagcagcugcagcaggccgucacaggaauuucuaaugcagcccaggcuacugcaucagaugaugcugcccagcaccaggguggcaguggcggagagcuggcauacgcucucaacaacuuugauguaaguuauauuugggaggaaaguuugggcucuucaccaacugccaaaagauaacugguucuuggggaaauaggaucaaggcuugugaugaaagcccauuuuccaauuaaaucuguuauccaaguggaaagaaauuguuaugacucauaaguuuacuuuauuguaacuuggcuuaaagcguuuuuucccucuucuugugugguuaaacuucaggauucuuuuaugcaauuuguguuuccuugcgugguucuuuuucuuuuuuaauaugguucuuauugagacuaugagucugguucauuccaacuaggaauuugaccaucuggcaaauguggaccugugauagguacagaagcaaagugcauuguaggcuuugucucuggggagcucauggucuagugagugguggagauaaaucaugcugcugucaucuuaaccuuaccugacugccuagacagauuucugcuuuuugugauuuccuuugagccaugaacauaggaguuuaaacacauugaaacagauuugaaauuaauuugaauuuuuuuaucauaaugcuuuuauagaugguaccuagaucucuccgguguauaugaugcguaucuauuauccucuguccucacauuaauuaauguguuggauggacuuuguucuaaauuuuaacccaaagugaguuguggccaccaguagauggcagcaguuuaaguugguuuuuauuugaaauugggucugaucauguagcuuaggcuaccuuccagcccauuaucuugcccuaggcucuucaucucuccaugugucaucaugacugucuuugguugugugugugagugaguguguuugugugugugugugagaggugggaggggggaaagaguuggaggaggucgauugagauuuccuuuguguagcuuuggcuggccaucuguguuggccucuccaguguugggauuaaaggcauaugccaucaagcccuaugauucuuuguuuuagguguguuagagagaauuuauaggaaguuauugucuuucauaguugaaauuuuugaaauauggcaucaauguguuggaauguauuuuguuuucagcagggguuuuuguuuuuguuuuuuuuuuuuuuuuguuuuuuguuuuugaugcuuguaucuugagcuuggguagugguucuugcugauagucacugauucaggcuuuucauaaaacaagggaaaagaagcuaguguuuugcuuaaagaccuuaguguugaaauuuaguguuuucccaggaguucuacuuuugaauugcagaaaauugaacuuaaggacucauccaugcuaggcaaguuaccaccgaacuuguccucuaguucuucuccuauagaauuaagcguaagauagccuuuaugguuguuaggacaugucuuguaauguauugguaccguuguuuucuucugcuucaaguuugguaacauuagguauuugguuuuuuuuuuuuuugaguuaguaaggagcguguuugcccugaauugaauuguagacuagggucaugguuuuguuauuuguaaggugaggagccugcacuaacugaucucuaacaguucucaucuauuguccagagguauuuuguugucuccuccuccgugacuaggcaguguuggagagugacugcagggccuacacaugcuuaggccgaugcgcuacugaucagcuacaucuccagcccuguauucaaccuugaucagagaaauccuuuaauaaccaaaucuagcaagaaaaauggucagcuaaaauguagucuaauaauuaacugaaggugguacaugaucacuuucaaaaugaagcuuccuuggaaagaaagggcgaaauguuuacucacugaaaaauaccaaguuuuuggcagaaaaaaauuggcauuuaaguugaaauuauuaaggaagaaaauuaaaaguuaaugcccaaauauuugcauagacauuuauugguaugaaagucaguuguauuuaaugaacaugugucuagucgauuauaaguucauuauaaauacauuuuuuaaagaggaaaaguuaguacuuuaguuguuuaaauugucuauggucaaacaguucugucuuguagcagcuauauaccucacauagagguauuuuuucuuacgauuaacaugugauaauuuuaauaaccaauauucuacagggugaccuuuagauguauaggaaaaguagugugaacauggcagcacuguuugcauuugugauaucauacuuaauuccggcuuugcgaaguaaucacugauguggggugacagcuuacaugggauggccuuugcuguuaggauuacaucuugauauuccugaucaauacuuuccuugcaguuugaauaacugaggggacagaaaugaggauuaacucuaguaacccuuucucuguagaaacaaaucauuguggaccccuugagcuucagcgaggagcgcuuuaggccgucccuggaggagcgccuggaaagcauuauuaguggggcugcccugauggcugacucauccugcacacgugaugaccgucgggagcgcauuguggcagaguguaaugcuguccgccaggcucuacaggaccugcucucagaauacaugggcaacguaagugccaaaaccucucuuggaacuaagauggcugaggaauuuguuuuuaugacugaugguacccccucauauauccauccauccauccauccauccauucauucauucauucauucauucauugugugggugcuuuaucugcauuggguacuggggagaaguuuugguugguaaagucuugccauacaagcaugaugacuuggauucagguuuuuagcuucguuuuuaagaagcuaagcaauauggugcuuauaaucccagagcuauaaucccagagccgguggaggcagguggacagguaccugggucuuggccagugagucuagucaagucuuugaguuccuggcucaguaagagacuugucuaaaaagauaauauggagaacaacugaggaagacacuagaggcuuccucacacacacgugcacauguguacacauguacauaagaaaaaauaucagaacaaaaaaaaaagaaagaaaaaauaucacaaagaaaccaguauuauaaaauuugcugucugguuccuuuuaaccauagaaaacaccaugucuguugguuucucucuuuaugugccuuguucuccuuccuuuauacucugccacucaaugauuuaguucuagcuuaaguuuacuguaauuuagacuggguacccaguauuucgcuguucuaaagaagggaugaauaaauagaaguaucuuaaaggauucuguuccucacacugugcuggcugccccaugcugacacuacuuugcuuuguguaaauaacaguagaucugaaucuuggcugugcugugcugaguaugaaugacuucauccuucagcacuuuguauagugaagauauuguuacuguguacaauagagaacugucucauuaacuauuaauacauuuuaauauuuuuaaaaauaaaaauauuuuaaagggugaaacaaugaaacaaaugaguuuuuccuaaugguuuuauuucacuuuuuuguuuugcuuauauaauuaauacuuuuccacauaaagauacugauuuuuuugguuuuuugguuuuauuuuuuucuucucauauguucauugcuacacaucuuguuuuguucacuuacaugucuuuauaagugaaaggguaauggugagccaugaugguguuucuagggugaaagaugaauguuuuuacuuaauucaaccauauugugauguuagcgaauuauguaauuuuaagucauuggcauguuuugauuauaggugaucuaccuaagaaaaaugagauuagaauuaaauagaaagugguugauaagucacaguggaaauaugagaucuauuaaaaaugcuuaucuaugcuuaaacauuaaaaaauaugaaaguguauagguuaaggaguauuugauagugucggaaucaugaaccaguguguauauauagaucaucugcucuuauguguagcacugaaagucauauagaaguauguagugugguugucauuaggaagccacuuugaguauauuccagugcaauuaugacaaucauagagcuuucuaaacagucuagaaaauagcucuugaauuauggaauugcuuggacucuacagcuagucacccuggucacgaguaaucugauuucuuccuugguugacauguaaguaauauuacuuuuucuucauguuaugaauguaggaaacugugugaacauuuauacugaauguauaugcuaagucucuaauguaauaucuacucuuauguggauacuaggauaauacuugauauauagaccaaaauuuuaaguauuguagaggucaugaaagaacuuuucuugagauucaaauugggaaaugauccuuggguauguuucuuuugaagguaaaacuuuuuauguauuucuuuucaucaauucacauaacaaggaagggaucaaucuuguacagaauuaguagaaauccaggaguggcaguucacaugcucuacaggcaguugaaucuccauaaguuccacacuagcuagggauacauagggagacccugucucaaaauuaauggagguaggguugaagagaaaguguuuaagaguauuuccuacucuuccugaagacccaaguucaguuuccaauacuuacauuggguagcucaugaccacauguaacuccaaucugaugcccucuucuuacauuugagggcauugcacaaacccacauacagauauuuuaagaucgcucuaucugucuauccauccauccaucuaccuaccuaucaucuaucuuaauuuuaaaugguggagaugaguuaguggcauguaccuuuaauccuggcauugggaugaggagacaaguggaucucauauguagcccaggagagccagggcuacacaguaagaccuucaaacaaacaaauaaguaaaaucuuuaaaaaucagaaauuaauagagucaggcuaaaagggaaggcauuggaacacaucagaagaauggggaaaaaaaguccaaagaaucauaagugaccagacaaaggcuucugcuuauaaaacaucuggaaacauuucagaccaccaauaauaaucaauuuaacuggccaguuuuguauuaacauaugucucaugaaaagcaaugucuugagcgucauauaaggggaaauaugagacucugauuucuccuuuuuggaacagaaugguugucuacaaggaguugauaugaauguuguuagagguacauuaaaaauuuuguaggaauaggggucuggagaaaugacucauugguuaaaauggaaugggcugcucuuacugaggauccagauuugauucccagcacacacgugguagcuaauaaucaucuauaacuccaguuccagaagaucugacaccuucuggccucugggacaccuggcauacauggugcacagacaaacgugcaagaagaauucauacauagacgcacauacacauaaaauagaaaaagaacgaauuaaccucagcacucucauaagaaaacuucauaggaauugcaugagguugagaguccugccucucaagcacugugcaguucagagcucuuucugcucuugcagagaacacaggauuuguccaucauuucucucuauuucuucacuaauuuuaugcuugcuugauuuuucuccauuucuuucuuuagcuugcuacauuagacuaagccaagccugugucuuuaguaguauauugcucauuuuguuacugaaguuuccaccaauuguauacuuccuugaauuguuccuuguguuucuuuuauucauacagguuuuaaacuuuuggaagacuagcuaggccgcagacuagccagcauggaggcucaugccuuuaucccagcacucaggaggcagaggcagguggaucucugagacuagccugaucuacaaagcuaguuccaggacagcgagggcuguuagacagagaaccugucucaaaacauuaaaacuaaaccaaaccaaaccaaccaacaaacaaacaaauaacucagacaaacaacaacaaaaaacuuuggaagacuaaaccauuuaaaaaaaaaaaccuuuuauggucuguauaaugcuagaaguacucagcaugcuuaaggaauccaugauggcaugggggaaugauuaaagccagcaauuuuggauauucaugauacuaagaauaguuaguaaggggaaaacccccucaaucucgcccuuacagauuuugcguucaaugugugugucuguguguaucuacuuucugaaugucaguauucucaaguagguaauuaguaaaagugguaucuuguagcagaacgagcuuaaauuuaauuacuuaggugaaaaccaaauuucccaauuaaaggcucuaagggcaaggaggccagcagcuuuaaugcuccuguuuacuucauaguuugaaggaauggaagguuagguggucuugccuuuaguucaaucacucuauaggccaacagugauacugaugauguaaaaguaauaccgcugacucuacuuaacagugaaaugccacaaaugcaugacaacaaaagggucuagaauguauccuuguggcuuuacaaaugucugcuuaguuauauugaaaugaaaucuggcgauugugguuugguuuauuuugccucucgucuuucagucuaaaguggcacuggguauggagguucuagagaaagaaaaacagcuuuggaugagugucauaaucuuugaggguuucaaaguaaguggauugaaaguaauuaagccugguauggcucugcaugcuuguaaucaaucuuagcagucaggaggcgguaggaagacugaguuugagacccaucuaagcuauauuguaaaacccuguaucaaaggaacaaaacaaauuuuuauaccguaauucuugguucuguauauaaguacaaaauacauguuuaaguaggaguuacaguuuguugugagguuagcuuaacauaaugaauguuuggaauauaaaggauccucaguuuuugaaaggacauccauuugguuuugucuugagcagucuuaugacuggccauaugacugcagugagggcuuguaaaauuggugagaacaaagcuuuaugcugucagcuuacauagcuuuagguuugugguuuuucuucucuuagccauucauaauauuuccauagagaacuuaaaaauaugacaggugauauuuuagauagcuauaauguauauauaaacugaauacuacauuucaaauaguuugcaaaaaagaauguaaaguagcucauugauaagcaucaaaauaaaaucucuuaaguuuuauuuuuacaaaacugcagaugaaauguaaugugugagaguagaauaaaaacaaguuuuauuuuuauuugugcuuuauugaacuugagagauagaaaguuuaaaagccuaugcauagaauauguuucugacuugcauauuguuucuguugcauaguucuaauugaauaaccaaccagcuaaggugggugaauggccagaaugauacaguaaucauacauauagccauuguacuuuguauuuacuucuuugugcuuagaacuguaguuuuagguuacagggcuguguuaggcuaaagauaguaaggguauauuuauuugcauuugugucugccugucuuucuucuuccuucuccuuuguguuuaguuucacaguauguugcccacaacuacagcaucuuggagcaguauuggaauuguagauaugagcuaccacugugcccagcuaagauguuucuuaaggauuugaacgugugugugugugugugugugugugugugugugugugugugugugugacaaauuuuuguuuucauguauguuuauaccauguauguaccuuguaccuucagguuagaggagggcucaagaccccccuugaacuggaguuaagaaugguuguaagccaugauguaggugcugggaaaugaaccucuguuagaacaagugcuuuuggcucugagccaucuuucuagcucccuuaaggauacauauuaacuuuguguuuguguuugucugugugugugugagaaauauguauuauuuauaugucuuuguguuguuccugcauguauuucuuuguacuacaugugucucugguacuguggaggucagcaagaaggcaucaagaucuuauggaacuagaguuauaagccacaaugugagugaugggaauuaauuccaaauucucuacaagagaaacaaguguuuuaaacuggugagcuccaaacucuccagucuuuauuugcuuauuuucuaaaacauugaacgugguuaguuguaagaucucaaaacaagaacacaguaacuggccauguuuuuuaauugaacuguacauguauuaugccuucauuaugcguaucaggcagaacauuauucaauuuguuguuagcuugguuuggaaugcaugaauauaaugcaguuaauauuuauauuguaguaaagggaaacacucaguguggauaucagucccuuugaaauuuugcaaauauuuuuccuggaaucacuuucgauuucuccccuucaguugugugugugugugugugugugugugugugugugcgcgcgcgcauucagaguugaccauuugguauaaccaccuuguguucucuuuccuagguaagccuuuccccagcucucagaguuccuuaguucccuguaauucuuuguguggguugaagccuuuaucugguuuagcuccucuauuguaauugucauguuggugaugcuuuauggguguagcuucuaacauuccuaggagacacaagcucacagcaaacuucuauuucucugucucuuccaagauuucugaucgcccugaccugcagugauccuuagguguuggauuuguguuauagauguauccuuuuuuggcuggauucauguucuuucucauucuuuuugguucaagguagcuuuagccuuugcccagagcugucauauauugcuaaugauuuauuuaaaauaaugugauuguuugaauaucacaaauuugugguuuugggaggcuaccaauuuauuuuauccaugaugcccauauaugacaaauaucuaaaaccugauauuuauuuaacccuugaugguuacuguaauucacauuugguauccuagcacccuagagauggagacagaggggucacaaauuugagacccacuugggcaaccuaguaaguucugggccagccugacuacauagugagucccaguaacaacacacaaauaugcauuguguauacauuugcacauauaaaugauaacuauacuaguauuauaauacuaguuauauauaacuaauauaguuaacuauauuaguuuagcuauacuaaucuuuuuugguuucuucauuuaaaauuuguuuugaauagugagguaucuuagaggcuuaaggaucuuuuuuuuuuuuuuuuuuuuuaaagauuuauuuauuuauuuauuauauguaaguacacuguagcugucuucagacauuccagaagagggagucagaucucauuauggaugguugugagccaccaugugguugcugggauuugaacuccggaccuucggaagagcagucgggugcucuuacccacugagccaucucaccagcccgaggcuuaaggaucuuaagguaguaaauauauguuaagauuauggguuuuguuuuguuuuguuuuguuuuuucuuuucuuaaauagaguuugauguagguaaggaugaccuugcaccuugaacuucugauccuccugccucuacuuucaaagugguguuaaaggaugauggggcugggaugggugguuuuugccuccaauccuguguauuuguuccuuuugcuuuagggcagcaugucucucccccauuccgaaaauauauuuauuuagagaugccuguuuagacgcuuugugacaggcaguuacaguucuccugugagcacuguuucaacuuccccaggacugacugaguccugcgugucugcauguuccaacucugacuuuaggcuuauucucuugaaaauggacuugguugacacauuuuuaucauguugcaaaauuagaggagcaaaaguuugcagaguauauuauuuucccuuucugaggguacauccucauuuucguugguuuugggauaucuguggucaccucugaugguugcuagugagcacugcuugccaaucacuagauagcugauuucuuuaaaagugcaacauuugcuguauuaaaacaaagagugauuauuuuucuuugaucauucucaagaaauggauguaaggccuuuuuauaauggggugauuugaaagcauauaaggaaaagguucuuuugaaguuugcuuuaugcuaaagugucaucugaccaguaaguugucuugcaaguuuuauuuuccgauauguuagaacaacuagcuucugcugugacuuuauaguuacacauauucuaauuucugguuuuguuauugcaguuuauauuagucagugaaguauaauccagugugucaucacaugccaugacuuccuugcuaauuacucuuuaaauuuaacucugaauucacgguuggaguacuuuuuccuguuuugaauuacauuuuaucucagaguuugggaggcagaggcaagugguucacugagauugaggcuagcugguuuauauagugaguaccuguacagggaguggaagguggagaggaaaaaaaaaaugcuauauugcugguuuaaaaaacaaaaaggcauguaagcugaaauaacccuuuccuccccagguuacuuuuggucaugauguuuugucacagcacuaggaacccugacuaggauauauuugggaagaguuaagaaaaggugucacuuaccaucauuguagcugagugucacuguaguagauguuaaggaugcaguccuuagcaucauuuucuuccugcaacaaccagcaguuuuuauuuuaucccacuuagcucccuauuccucacuuggcagacuugauaguaccugagauguuucugguaauucuccuaggauuuguguguaaauaauuguacaguguuucaguuaacacugggaacuaaaggagggagauaacagagcacagccaggccaggagcaguacuggugagcagcagugugaaugagaagauuccagaagucuuccuaauccuccuucccgccucuccucaaggcuaaucuugaucuccugaucuucugacuccaccuuccaaguauugagaucacagggcauaugccaccauauucucccugccacagcuagccuuagucauauuuuuaaagaucuaguaugguagcaaaacaccauuuauuugacuauaauaauuugguaguuauuacuuuuauugugguuuagauuuugaauggaauauaauaaaugacagugauggaguuuuuuuguucuuguuugggccagcuuguccuauaaguuuuugauuaugaaguucuuacaguuguaggcacuuuaagcauuuuggguucauaugaugaagguuuugggauugaacccaaaaucuccacuuaugcuagaccacugaacuacauuccagacccauuuuuuuuuuuuuucaacaugauuucagagucuuugcuuuggagauuggccauuaaaaaguaacacucaaaguuaaaaggagccuuacuugauaguuauguauccaguuuacaucuacacuuacauuuuaucuaauuuuugcuuuuugguguucauuugggggggggguguauaaaaguaagaaugcagaccucacgcuaagcagauaauauuaguauagcaggcuguaaagcacauuaccauucuacagcacuggagcaaguaugaaacugucuguacuaagaucuguacagaagaaaggguggcuaucgggaagagaguggcaggaguaauagacucaggaguaauuggggugauuaguuaacaagucacagcaacuguguggguuaguauuuuauaagcaacuggcuaagacucuuuuucuucuucgucucaugcuacuaaguaagcuuaccaacaaauaucaagagacuuuaguaaaucucugaggugguuuuucucuuuuuuaauuugccucucugaggaagguacuuuuguaaaagcuaggacuaacucauacucuagugaaaagagggucaucgagagguauuuugaucaucauuguuauuauguuauauuaucuuuaauacauuuucugagguccaagaaaaugagcugcagaaguagaaaugaaggaaacaauuucauuuauccucuagacagugacacauuaagcacuaaugacugccaaaaggaaaugucaaacacuaaacuagucuacuuuuuuuggcagccaagaauccggugaaucaacaguuuuaggguguguguauuuaaugugggcgaaggaagagaaugucugacauuccuuaaggcccuguuaagaucacuacaguuggacuuggagcuaguuucuacuuuuuaaaacccaagcaaggcaaaugcaacaaaaauaaaguugguuauggggugugagagauggcucugugucuaagagcacguugcugugcaagcaagaggaccugagucuaggucucuggcaucacugugagugucaagcaugggcaugcuuugccuguagucagucccagcauuggaauguggagacaagugaaucccgaaaacuugauggccagccagguuagcugaaguggucaacuuuagauucagugagagacccugccucaaaaaauaagguggagagcgauggaggaaaacacucugcauucuccucuuguuuccauaugcacacaguagcacaacauccccuucccaugcacacaugcacacauacacacauaagaaaaaauauauauauauaaauagauauuuggaugagguagguggcacacgccguuaauccaaucauuuggggacaaaggcaggcagaucucuuugaguuugauaccagccugguuauacauugaguuucaggccagguaaagcuacuugaugaaacucuccucucaaaaaacaaaacaaaacacaaacaaagccaaaaaagggugaguauuuguuguuauauugggauaggagacauuguaaacuuauuuauggccuuuaauguauuuuuauuuaguuguugguagaccugaagaaauguuuuuuauauauauaugaaaacccaaguuucauaucaaaugaaaaaauauaucaaaaguugaaguacuugagaggcagaggcaggcgaugcucaguagguuugauugaauccugucuugugugaugacuaaaagguauuuucuacaggaauucaggcaauuugucuauccuguaugaaguagaaauuuuuuuuuuccauuuugaacauuaucuaugcuguuacuacagacagaauuauauggguaguguuuaaagccuauauugugugcaaaauugguuuaacuuaaguauaauaauagccuauagauuuugguagcuauuuuacuuauacaaauguugaauuagaaguugcucaaucagaaacuguucauaucagggcaaaaaugguccaagauggcucagcagguaaagguagcuacuuuuaagucuaaagaucugauuuuuggucuccagaaccuguaguguguuggccugaugcugcuuguauucuaauacuaauauugggccuccaagacuuggagucugcaugcagacucaagugauccuacccucaaguuauuucugguuaguaaauaaaguuuccgacagccacagaaacacaggugggguuacguuuccugggcuugggguugggggaaaccaugaggagaaggugcaggaggaagaagaagccacuauagguuaggugagccauaaaaacauggcucuaaagggccggccuguugaaguuaagagcugcccagaugaaacauaguaaguaauaaccugggguuaccgauaggaaaguggaauguaaugguauagaaaguaaaugucugcgcagcucuuaugcuguuuaaggcucaugguaaauauauagguuuuaugucuuuucuccggaaacuaaauggucauggcaggguagaaacucuggguaggaauuaaaaguuuucacaagaacucauauagugaaagaagagaacagacuauucccacaaguuguucucugaccuuuacaccacauuguggcaugagcauacccuacacugauacacacacacacacacacacacacacacacacuaauacauaaguaaauauaauaguucaugaauugagaacuagaagucaggcugacuaauuuuuauuuauacuuugucuccuuuuuugaaacagguauaauuuaaaaugcaaauuguuugccuuuagaauauuuuauuaacauuaggacuuuguauauaugugugugugcgcacauguacgugcucauguguauaucugcauggucaacuuuguagcauugauucucuuuuuuguagguucaagggauugaauccaaguuucuaggcuuuauaccaccuaccuacuuuuaccuguugagccaauuaccauauuuuuaaauguuagguucuuaauagaaaauuguguauauaauucaccuagagguugaguauaacauucuaagaguugugaaagggcuuacuuuaucuuagcuuccuaacuggauuugagagggcacaaagagaaugagucaaugagucuagagauuuagacugaaauacuggugcuuccuggaaccugaaggacuuguaaacaguggguagugauaaguguaaugucucuucauuguugcuguauuggaguucuuucuuuuucugaaagaaacuugcugguauuucuacugcugugguagaaaguaagaucaguuuugguagagauuugugagaggcaucucaauugacaaccagagagaaauaguauguaccaucgcugcccuaaguaagucucagugggcuauauagcaggagccagguggcuucagggccucauugcuguuuucuagggcggcaugccaccggcauuuccucauguaggaccaaggagccagggauaggacaugaagauggcaaagccugugcuggcuaggaggugugucuccaguugguuguaaagcuaucgggaaugcuuacuguugccagugcuucuuuagaucauccugguggccucagauggcucagccaggaaaaagucuugccaccaaacugacaaugugaguuagguccuuggaacccagaguagaaggauaaaaccaacucuugacaucugcaaaccagaccauggcacgcacuaaaauaaaagcauagaaaugucuaagaaauuauaugaaaaaauuguacuuugccuuggugagauugguuuguuuuguaguaggauaaacaugcucuuauuuugaagcuuuauuuucagguauguuugaauggcuugcuuacuaauacauguguauuauguaacuguaggaauugucugcgaagagacuuuguucugauaacuuaacaucuacauugaguaugaaaaguuaccuaaacuugcccaaguuucuguggcuaccucugggcacagggugugaugauggugcccaugcagauagcaugguugugaggcuagagagcugcaucaaaggcaugccacuccuuuauaacaucgcugggauuacugaaacugaucauuugcuuuaucaccaauggaucaaacaucaaauccuccuuuguuuuuaaacuuagguuuccagggguuuugucaggugauugcauuuagcacucucuugguaaagagcuuauucuuuuugauccacuuccuucucucugcuuucugcuauggucauuauguggacccugguaauaauggccaaagacuagauuaauuuuuuagcgagcauguccccacugacuguugcagagcuuauuuuauuguguccuguuaucuugagugaaguugguggccucguucccagauucauauuauggucuccuuacuauuaaaauguacauuuugcuggagucuggcauacuccauaguuaauucugaguuauuuggcauagggaagcgagacugaucaucaauguucauucucugaauggaguuuugaauaggcuucucuguauaaaaaucucuucauuauucauuccuacuccuuuucgauuuauuugaugauugaauuugaaauagacuugcuauuugaauauuauauauguuucucuucuuauucauuuuuauaggcuguauuuguauuuuucucuaguuuauuuaagaaaaauagaaugcuagugggaaagcuaguaugaagcugcuccccacccccucugauuaaaacagcucucuagcucaucguuucagggacucaauagcugcuuggguaauuagccaagugaguuuaaauguugucuauauguuccuaaaaaugacugugggacagguagugugaagucuagaaggucuuuuucccuuucauguuauaaucgguuuuucuauugaagguuuucaaaagacugaguggaagauucuuauuaagagaaagucuuuauaguuaagguggacugacuuugaagugaggcucaugggaugucugguaucaucgcucugcuuuugaaauaugaacaguugccaucagauguuaucaguggaauuauucaucgguuacuugcuuuaguaauaauauccaaaacuaagaauaguggaguguauuuaauauuuugacaaggaucucaguguuuaacugagauuuuuauuauuuuaucuucuaccucccuccauuucucucugagacaaggucucucucuguagcccuggcuggucugcaacuaacagagauauucucugcuucuaggacuaaagaaauacacaccccauuuuauuuuuuuuauacuugcuaaaagcauuuuaaaaaagaaaaccaccuuaaaauuaucuuuguauuuauaugauccaaauguaaagaguauaaaauuaaaagacuuuguaaaaagaaauccuuucacaucacucuuauaaccauauauagguuuucuauuuaauuucuuguaucuuucaaaacaauuucauauagauauaguaaaccacaugcguaaguuaaccuaaagauauuuuuaagagggaaguauuauuuccuuaaaagguuaagguuuuucuguuuauguauuuauagagaugggauucaccauguggucaugcuugccuugagcuugcagcuguccuccauguccucuggagugccugaauugcauucaugcagcccacacccaguuccuaaagauccuuuuuaaaaaauacuuucuagccuuauaaugagucacugauugugaaacaggugcuauuauaauuugaagcaguguuuuaugguucacuuugcuucuaggccacuaaauuuuguucuucauacuucuugucuuuccuuuucugucucucccaaggacgcuaauucccaucucugcgugucugcuccuguaguagguguuuagucccuaugcuucccuuccuuucucugucuguuguggcauuaguguguagugccacaacacagugaccuguggaggucauguguagaguauuaccauuuugucuuguuucucaugucauagugaguggccuuagcuaggugauuuuuauauauuguuccauauaguauugcuauucuuuuuaaacaauaauuaguaauaauccaucuuagugcugucuuuauugcuuuaggcauuuaguucauucauucagaugcuuuuguugagaugucaggacucuuugcacuuuauuaacuucguauccuuuugucaucauagguuguugaaagucuuuaacaacuggagaacuuuuacuuuauuuucuguuguuuacuugcuuaucugcuauagucuuuaauuccuaacccugguucuuguacagaaaugcaugaguuuacucuuuauuaauauuugguugcuauuauuacaucaucaucauaacucaaacaagcucccauuccuaucuaauaaugugagaggucgcagaguucuaauauuggaacuucccucuaaccaugcaaaagagcuuuauauuuguucuaagggauucugaaaaaaaaaaucaucauagaauuugggugcuaugcucuaaggagaaagaaguuuauaucaacagaagguacuuuaugccaugugccagcugcuaucaguauaaaaacaugcaguauaaaucucacuggugaugucugggaagucaagauuuaggaggauuucaaaaaacauguuuuguuaugaacacggcauaggcaaacugagagaaaggaaagacuacauuaacccucuccccuuucuuuaucuuuuuguguugcuagauaccaaaucuagggcuuuguguguguuagccagaacugcuugacuacugagcugcauucuagccugccgucuucagucuucauuuggggaucuuguucuucccugcuguauauuacugccaugucugguuucccaccaagagucuucuggaauccuuccauucucuucccuuaaccuacaucucucuuacauucuuuccccgcucagacacuguuguuagcaaucuggcaugaguacuuuccauacuuuuuuccauuuacaugauaaguccuuaguuuucccagaauguaaaacuauaaucauuucccccauuugacauaaauguucucuuaauuaagaugaaugauaucauugcuuacaauccugcauguuauuauuuaaaagcacuucauagaaaagguagguuuuguuuguuuuuaaagauuugccuauuuuacuuuauaugcaugaguguuuuuccuauauuuuguauaugcaucaugugugcaucuggugcccauggagguuagaagaggcagucggaucccugauugcugucaguuaugaaugguuguaaaccaccugugggugcugggaaccaaauuuggguccucagcaagaaugacaagugcccuugaccuccaagccagcucuccggucuugagaagacuuuaaagccucauucuuauugcugaguuuggguuuacuuauaauugauuaaaaguguauuauuuuaauucagagugugguuuugucauacauuauuuaacgaucaccuuuuuuaaugaacauuugcuuuuuaaauuguuuuaaagcauuguguaugcuguagcagugaucaaccuugaaagauauacccuuauauuuuguuccuuuacuuuuacauauaagauucucaauuuuauuuuuauggagauguuugaguuggggagggaggggaagaaaggauauuuuccacaaagugcuaagcucaguggcuauuguaccaccagcauaagaaaauaaccuucaugcucucucuaacaggagggguuguuucaauuuuguuugugugccaugugaucuuucuguucugucaaguacuuacuuguaguuagcuccauuuuucuaauaguacaagggcuuuuuuuauuagaagcuguugaauauuacagcuguuacucuaauagcugccauuuauuuuauauuuuuucacuguuuuuguugguagauuuuaaaccaacacguugaacuuuuguauaucuuuugucuuauggauaauggaguuccugcuugugaugaaagcaucuuucucaucuuugauuacuuguauguacacauucgagucuguccuaguuagauuacaagagucagagcuacuuagagagagacacagacacacagagagaaacagauugauuguagagauuaacaauauauaaucauggaaguaguuaaauucugaaguagauuaaaaguauaugugaggcuguugcuuucauacaucuuuuauaaaagaaaaaggacuuuaagcuugguguuucuaggaaagaauugucacauuaaauggguuucauauaaauugacauauuccaaauauagauuucuuugaaaaaugucaugguugaauacaagguaguaauuaauugccucacuuugaguacuuagauuuuuaaauuuuuuuaaaguucuuuuacauagaccauuuuaauuggaucaaaauuauuugaccuggauggcuggaagaagcagcccaguuauagauguuuuaaugaugcuuuuagacuuuauuucugugagauaaaucuuccuuuuguaauucucauugguaccacauuugcaggauucuguuuauguaaauaguguuuucuuuugugugugcaugcguauguauguguguguuuguaugugugugugugucuguguauaagaacccugagacaucucauugucuuggccuguaaauaguuuuauuauuuaauuuuuuucuauuuguauuggcagaauuugucugcucauuauuuaugguuauacaaguacuaguuggaaauauugagugugacuacacacauacauucaacuuagugguucucugucugucucaucaaauauaagcagccaguacuagaauaaaauggagauaaugaaauggguuaaaaaaaaggaaaaaaugacuggaagugagcuaaguaguggcuuucucuuugauaugaccuggguuucaucuugaucauuuugugccccuacucucuaccaccuuagauuuauacauuuggguaugugcacuuguguucucuuccccuuccccaaguauaaguagaaaguguaaauucuugcguuuucaaggaaagacugaaugaaaugcugaaugaguagacugccaggcaucaccgaagaaaaacugcuguaggggaggagaggaaagaacaauuugguaacuucucagacugcaguuaacuaaaauccggaacuuauuuaugugggcauuggaaguaggauauagagaggguuguuagagcacaacugauuugacccauuagggcuuucuaauagaagaaaaaugccauuaggucuccaucauuuuucaguuuccuucucuuuagcgagggguuuccuuauucucugucacuacuguucaguggaaaggguacuaagggcuuacauaauaaugccauucugcauaagaguaagaaauacucuaugaggcauacucuuggauggcuuucccucaguacugcuaauguauauugaucuccuuauaguuuucagaaucaauuaugaucauuuacaaguauugaucauuucagagaaaaacgaagcagacaaaugcaaaauaaauauugggguuuagaaugugaagagcaagacugguccacacaaagaccaaucucauggcuugucuuuuaaccuagaugcaugagcuugacagggcaggggcccagcuccucuguuucuuaaacacagguaccauuguggcuguagggaacugcaauuaaccauuaaaaucccuugaauaguaaaugaaagaaaaugcaguucauacuggacuaaacuaagaggaucccccucuccccuaaaacuugcuccuuggugagccaucuacccgagaugaagaggguuugguuggaccauagagcaaugguucucaaccucuuaggucaaaugaccauuucauagggguugccuaagaccauuggaaaaacacauguuuacauuauguucauaacaguaggaaaaucacaaaaagucacagugaaaauaauuucaugguugagggucaccacaauaugaggcacuguacuaaagggucgaaacauuaggagguugagaagcacugccuuagaguaucuauuaccuguucuaaguugcuuguuccagguugccugggguauugggaccuuuugucccucagugauuauaagugaggcaaguucucaacaaccuguuacuuccagguugcgcacaaagcaucuuuuaccuaguucugaaagggggcaaaagcaguaagaagcgguuucuguuggguguuccucauuuggauugauuaaauucaaauuagaauagaauuuuacugucugcccaucuaagaauuuuuacuuugccuaaauagagaaauuagaguugugagcuaguacugacuuuuaagaaaaaugaggaaacuauucuuugaguuguuaaagaggcacuacaaugacaaugacuucuaaauacauauuuuguaaagaaaaagaaggcauuugauaaugacaguaacuagagccaccagaguuaaauuucaguaaggaauaaagugauuuuaaauucugaaacuuguagcuauuaugaaguguagcauguagaugcaauuguuuagucucaguuucuguuuaguugggagguagauaaaggcuuuuauuaaaauuuauacuggcaggcacacacaugauuguauuuuauaugugugagaguuuugccuguauguaugucuccaccacauagauacaguagucauggaggucacaagagaacguuugauucuccuagaccuggaguuacagacgagcuguuacguaggugcugcaaauugaacuccaguccguuggaagaacagccaauaaagccauuaguuucgccgggagguggcggcggcacaggccuuuaaucccugcacucgggaggcagaggcagguggauuucugaguucaaggcaagccuggucuacaaagugaguuccaggacagccagggcuacacagagaaacccugucucgaaaagacaaacaaacaaacaaacaaaacaauaguaguuucacuguauuuuauaacagugaugccauuaauaucucuuauauauuagaauaacacuuuaagccuuacagcaaaauuuucuaguuguagaaagagcaaaauuaguacguuaucuuuacuuuguaguguuguguucauacugaauauuuauaucacacuggggagccagaaagguauuguucuaagaauuugaugcuuuauuuggaaauaguauaaaaacacauggguaagaaauagaaaucaauagauuuuacuagacgaaaagaauggaagguagagcuuuaccuuugucccagcacauauuuuacaaaguagacauuuauucugcuuuuccaugugggauauccuuaugagagcuguaaaagaaagcuggaaauauggaaauaucuuagagcuuaugugucuuuucuggaagcaguuuuaaacuggauaaucaacaugcaguuaauuuaggggugggugugguggcucauccccauaagcucaguauuuaggaaguggaggcagaagcaccagaaaugaagaccacccuugagcuacaugccaaguucucuuaaaaaauuaacaaacagggacaggaaagauggcuuaacaauuaagcuguucuucagaggaccuagguuugaagccguguucacuuacaacugucuguaguaacucuaauuucaggggguccauuauccucuucuggccucauugggcacuguaugcaugugguauaaagacauacaugcagagccaugcauacaaaauuuaagaaaaaauuaaauacuaaacaauaaagauuggaaaaagguugaaguuaagagcacuugcugcucuuguagaggaccuuguuuuaguucccagcaccuacacgguagcucacuccagugucagggggucugaugcccugcuggucuccaugcauaucaggcuguacauacaugugagcuaaacauucauacauaaaauaauuagaauguccuagauacaucuugauaagugaaugguuucuuaaauauuuuaccccaguaccucaacauccuguucguuucucuuguauaaaaauguucuuccuuccuuuuguuauuuaucacauuaauuccuucugucugucuucucacaguauguuguuaacauggguguguaugucuguguggauacagcuuugucugugaacacauuuauguggagaccagagaguuaguucuaucugguaucuuugcucaguugcucuccagauuuauuuauuuaagauuuaauuuuuuuacaugaguguauauguguguacuaucuguuuaucuggucccuaaaggugucagagcuccuggaacugcaaggagacaguugggaggcugucacauggauacugggaaccaaaccuggguccucugugagaguaccaggugcucguaacugcugagccaucucuccagcaccuucgaguuuuacuuuuugauacaguaucuaguuuuaucuaaacuuaaucaguuuggcuagucuggcuggccagagagauucagugaugagggauucaccaccucccauauuuuccagguuuauucucuuauauuauuuguuaaguguuacuaguuuuauuuuugaguagcuauaaauucuggaggggaggugaccuagaccugugaauuuuauauacuaaucauagaguagaaauugaggaagcacucguugaauuaguuguaaauauuuaauaacauuaguguaaacauaauaaaggaaccuucuguacccacugugugccaggacuaaguagcuauauccuguuugaucuuauuugaaaguaugaacuugguacuguugaagcaugucaguccagucagaucccacaacuagaaacuggaagugcuucauugugaaccaaaugauucuagaauucugucuuuaacuaucaugcaacauuguauggcuuguugagauguucuauuagguugcuaauauuaugaauuacaauaguaucauuuucugcccucaauaguuuauuauaaaagcaccaacauuuagagagaagcugaaagaauacaaugaauagccuuauauauauccauuuucuugagucuguuaagguuugguacauuuaccuaaucacauacuuaaauaccuucauccaccuuuugcuacauuucagucauuugacaacauacaacuuuauucuuaacacuauagcuuaggucauuauugaaauuguguuuccuuuuuuuuuuuuuuuuuuuuuuucuauaaaacugacuugguucccagcugguggugcuuugugagguauuagaucaugaauacugacccaucugauggauucgugauuggcugacauuuuugguaggugguagaaacuaggagaugggauagcuguaggaaguaggucaguaggagugcucuggaauaauaauuguucucugucccugucucuggaguccagccgcccucucuacugcaugcucuugugauguucugcucaucucaccacaggcccauagcaaugaagccagcgcagcacgcugugaaguccuuuaaaccgugaggcaaaauaaauaguuuccccucuuaaguuguuuucuccaguauuuuaaacuagguuuguagcucagcguuagaaugcuugcccagcgugcuugaggcccuagguuugauauuaguacagaaacggguaggaaucggaaagaguucuugccuacagcaacauaacacaugucggaagacagacuaaguuugaaguuaaagucucuggcuggucagcugguaguaguuuuauaguuuuaaacuuguucuuucugggaaaaugagucaagauuuuacagauucuuugucaaggagaauacuaagauuguaauuggcacaacuagguaugaugcacaaaacaagcuucucuuuggguuuucauaaguauucagacacagacccagaguuuuggauaugcuaggcaaacauucaaccacugagcuaugggacauauuuuuacuuuaaaaucauauggacacaugucuuuacucucaguacuugagaggcagaagcagguagauggaucucugugaguuggaggcuagccuacuuuacauagaguuacauaauauguaacuguuucuaaauaaauaaauaaauaaauaaauaauaaaauagcuaaaugaaaauaauauagaaguguaaauuuauuuaaauauuuacuggguauccuguauauguguagggaacacauaauuugagauguacuaaggaagaaauaaagaaauauuuccuuauucuuauagacuuuauguaacuguuucuaaaugaauaaauaauaaaauagcuaaaugaaaauaauauagaaguuuaaauuuauuuaaauauuuacuggguauccuguauauguguagggaacacauaauuugagauguacuaaggaagaaauaaagaaauauuuccuuauucuuguagacuuucugggcuccggcauuggcuaguuacaaagcauggagcaugaacuaauaggcugcuuaucaagaacugaccugaggaacaggucuguugauuuccuaaaaccuccuggaacauuuuuccuuauuguuucuacaucugauuccauuuauccagacuuuuguauguaagucuuuccucuauauaaaccaguauuucuuuucuuuuuuugauugcuugcucugaguuaagaucuugucaugcugcccagagcggccucucauuuguaauccuuuuacuugggcauucaaacugcugguuuacccucuaccuggcugcaccucucucuaccagaugaaagcuugguuuguuuuuguugcuuuauucccugggaagaucaaggccaaguacuguuucauuguucugacagugcugccuaauccuuaauuauggauuauuaaaaacacucuaggacuugguguaauccuuguaaccauacauacuauuguauuaauuucuaaagguucuugaagacuaugaaauguuuucugguccuuuuggauuaagaaucuuugcuuuuuaauuauuguacagcuaauuuagcuauucugcacauagaaauuuauucaaccuuuuugauccuauagaauuaaucucuguaaauuaugcuucccccgccuuuuuuuaaguacugggcaccaaccaguuggucuucauuuauuugacagcuaagacuuuggggauggagaggcagcccccugacaugcuagacaagugcuguaucacuuaacuguauccugaugggaauuacuuauuugguaguggugguggugguugguuuuucugagacagaguuucccuguguaacaguccuauuguccugaaacucacuguguagaccagccuagucucaaacuugcagacauccgccuaucccugcuuccugaguacugagauuuaaggccacuaccaccugacaguaauccccgcucccccccccccccaagaguguuuuggcccucaaaauaauaaaacagauuggcuaauauagauggcuauugauucuuauuugaucauuuuuagaagagcaacuuggagcuuugguaaccuuacuuuaucuauaaauaccacagucaaagaauggaauuaugcuccaagcacaauuguaaugacugugcaguguaguucauccuuaaccgugauucguuuuguacauucucccuguucuucuagguaaaggcucuugaaauuuguaaaaaaggcauugagaauuguuucugcaguuuuaaaauaugguuccuaugaaaacgaugagucacuaggcuuugccauuaaaguuguucacaggugcuccuaaaugcugauuucuugcagauuccuuugaggccguaggcuuuguuggcagacuggguuggggccauagagggcauaauucaugggcuucccagguuaagauucuucauacuugccuucgagauguuuugcugucuuagauagugaagggagguuaaagauuugcauacacauuuuucuaaaacaacuggggagaggaaggucacacuugaauggggaaagcuguuuagaauaguuacacgcugcauccuuuucuccucuuccucuguaaagauaauuugugguauauuuuguccaaggagagacuuccaccugguuggucagacacauuuuuauaaaagggugggaaccacuuuaaauacccuugauagaaauaccuucucuguauugcaaugggaacuugaaaauucuguaguuaugucuuaaaacaacugauagagaagucagguauaacuacauggggauuuuaagauuauaagagaauuauauuuauaaacuguauuuuuuagcuccauaaaguauggagauuugcuccuuuuguaaaauguaaaaucaccauuacugaugguagcuagugucagcacaguuauucuucgcaguuauucuugauauaaaagugugugugcguuguguuuccuuccucuacccucaguaauuacugaguuucugccaugagaacucauagccucugauggggaagaaucacugacuguuggaaaggagagguguguacacauauguggagggguccauacuucaguagugguauacaaggugaugcagaggcacgcgcacaugugcgcgcaaacacacacacacacacacacacacacacacacacacacacacacacacacacacacaccagaagaggcugugguuguccuuuucugucacucugccuuuaacuucuuugggggacguggggcgguuauuccugaaccuaaugguuuguggcuaggacagccagcaagccccagugauccuaucucuucccacuucuggguuggaguuacagguguuuaagauacuuauugcaugcauauaacaugcuuggcuuguuuuguggaugcugggauccaaacuccucaaguccuaguggaugucaucucugucagccuuagggcuggagaagcaggagguucacacaagaacugugaucauucauggcaguugguaccuagaaggcaagguaguuucugccuuacagagccuaggcauagcauucugucugaguagguauucaagccaaacagaauacaccaguaaaacaaucuuuccuuuccucauccguaccuauugagccaguaucugggguacagugagccuuacaguccuaacaugguuaguaccuacagacuucaggagugauaaugcaagaugauccuggcaucuguccacugaaguagaggccaagugccuguuuauuaaguccagguuucaucuguuucagguugggguaauguauuguacgugaagaauugagaguagcaaccaaccccagggcuuaugagcccuacuuucuacccaguuguuaaggcuuggcugcuggcuuuagugugguuuguuguguguguugugcguacccccuuccccuuccuucauagauaggaugauuagcugcccuuuugucagcaaacacauuugacacugaaaagcagcauggucaugacagcuguucauuugacuucugucacaaaugccuauuuggguuucuccugucagcacuugcagguuucaggagaaaauuauaaacaaaggagacauucggguuuuuuuuacaguauacacaauuuuaauaacaaaacuuuucuguacacuguacuauagucccaccaacccaauuccuuguauaauaguauuuucuuccuaucccccaacaacccuccccccauggcucuaaaagguaauugaacaaauguguuuggacuguucuuugaguuugcagucucaguguucacagguucaccaaauauuccauguaucauacugauuuuaaaacugaaggaagaaaagauuaguucaagaaguuggagauguuuccaaaugucugcaauggcagaaugaaagggugaauggucguuuucugguuuuggccuuauucgggcgcuaugaguuugccccaggauagccaaagaaaugcuuaucuauagauggcccauauuaucauuuuaaaaacaucuuuucugauucaagcauuuuaacugagaauauaugaaaauuauguccaaaacauacuugagauagugcuguuacuggauugcuguauuaggaaaauuaucauguaauuuaacuguuaaaauaguccuaaaaauuaucuauuuauuuauauauauauauauaauagagagaggggaaauuuuuagcuccacccuuacauagcuauguguagaaaguaugacuuaagaaaauaauaaaacuuugauaucucagaauucagacuagugcuacauagagcuugcuuuuacuggaaagauggaguuuagcuuuuggugacuagcauuauaauaagcagauggguuuuaauaauuaguguggaauuaggaaguuuagucaauuccauucauugaauuaguacagaaauuaacuuugacucauuaagaaauuacaugugguaauacaauuuuuuuuggcuuaaaaauaguguuuguuuuuugaugccaguaauaugaguuuugugugauuuuuuuuuuuuuauuuaaagauuuaccagcccacucuuuuuagaaagguaagcuugaauucccuguaggcuacaaaaauaaguaacuguaguugcaaacuaauuuuaaauuccuagcuacauuucauuuuucugagaaauuauuuucugauuuuucacuagauuuuaaaaugggggagagggaaaguugagugguaaugcuuaagagauaaaaccccacccaaagcccucacuuuuaugacuaggaaccauauaugguuuugcuacucuggccaguugguagcacagauacugcaauacaaauacauaucaacuaaaugcagccuuguuuucuguaggcaguuagaaauggcaaucugugcuuuaacugagaaaggaaaauaccugguuggcacuaccauuaccaaaaauguaggaggaaaaaauaugccccuccccccucccuaguaguuugccuugauggcucuuggcacuguucucccucggaugcuaaguggcuugcucugcuacuuacaguccacuuuacuaauucuuuaggauuaauuggagcuccuaguuacuauuucuuacuuuuuaauucacaguuuaaauuaauuuugcuugugauuugaaaugaugaaaaccacucaucguuuagggccgauggagucuucuugcaugcucaaaacugaauugugaacaagcuguccaucaccuggcaaacggcaguggucaccaugauaaaugaguuguuaaauccuagaccacggagcucauuuguaauagggcuucugaugcagcuccucgguggggaagcagugugcugugcucugugcuggaaagccagcaucugucucagcucagacgaaccgagcuucugcuguaucaggagagggaaugcuugccacucaagaucagccgaaccgggaugcucugaggcuuugcuagacugaucacccagcauaagaaauacaaagagcauauuucacugaagccugacuauuaucuucuuuuuguuaagagauuugaaauguggguauauuuuucagugcuaaaggaaaacaauuaugauugaaucuaggucuauaguaacguuuucaguccaaucauggggagagaauaagucuugaaugcaggauacuguguuagaguagugacuuucguuauggacuuacauauuuuuccacauaaaaaugcuucuuuucuuuuccuuucugaaaucaaaguaaugauuuucuguuuucuccuauauguggagccaucuuuguagaaaaaaaauucuaugugaauugguaacuugagucuaauuccccaguaugccaucauuugccuuaaagaagucagaauugaacacuugugguucuucaugaaaaauguggcaucauuaucaauuguuacugugauuagaguguucguauuuacacuguagagucuccuuccacaccauacagaucccugagcaucacuuauuuggugcaaauuguacaugaucacguuugcugccuaguuacuuccacuaaccugagagccacacucaaagucuuucccugggcuuaaccccucacacucacucugccuucacuugcugcugugugacggcagggcaaugccaggaguucugccuuaagguuugccucggaaauugguccugucucagaaggagcuacucauauaaaugcguaucuuuauuaaagggcaagcuuuaccaucauauuuugaaaguaauuuuuuuguguuuuuuauaauauaacaagaaucaggguuaggcaccuuuaguagccaauuauuuuuaauuuggaucuuugaaguuuaaagaucagaaaaaggcagaaggaagaggcuuaaacaguuugucaaggcaucuuuaaucaugagaggggauguauuuucaaacuggauggaguauaucaggauuguuaaguugacucaguuuuucucuuucccaaaugcaaauuuuuacauaauagaggauuuaguaaguuaauuaguaaaauggaauuuaauacuaguuuaaaauaauaggcuaaaugccacaaaaaucagcauguccauuauaagucaaacuagaguuguauaagaagucagcauaguuauuuaguauugauuuauuauaaugagaucuuuuuauaauugcuuggauuuauuguugaaauauauuaaagagucacccaguuuuauuagaguuauauaaaaggugcugguuucaugauguaacuuagauaauguuuauuaagccaagccaaacugaaagaauaacguuuaauauuuaccagucuuaagcacacauguaagucuacuucuuauacuggcaguaaauuauaauuugaguaaauaccacauuaucuuacaagagaacuuugcugucuccuucuuaaguaggaagccaguugugguccauaggauggagaauaauaaucaaacagguuuuugucccuaccuauauuuguuuaguagcaucuuuuggaacuguuuucaguaaaaaaaaaaaccaaaaaacauauggagaccuuagcgcaaauguuuacauacaguuguauauaauuacauacaugaaauguuuuauauugaaguaagcauuuagacuuuccaacaagagugcaaauuaaugugagcauugcuucacuuaacacuuaaaauauguuuucauuaaaaaauuaaaaauacuuuaacacuucaaaaacucaagucuccacuugguuuggaaaauuaggcuuaaugucaccauugguaaaaauuagauauguauuuagccccuacuauguaaaauagguuacuuaucugaugugauuuuugaugauggguagauauuauacuucacauucuuuguauggcagcugcugacacuugcacuguccauaaccauuaaugaugaugaaagguccuucauggguggguucauacucauuauacgguccuuggucugacauguuugacauauggagucguguuugggaucggagcugccugugguucugaaucauugagcacugccuaauucuucucaaagugggagggcagcacuuccuggaaaugaacacuauaaaaauaauaaaaaagaaagaaaacaauaaagccauuguuccuguaauuacucucugaguaaagauggcauugucagguucaggaaaguguuccucuguagugacugcuaugccugcaguaguuggaauuucuuugucuccuacaugguaacucgacgagcuuauuuuuguauauucagugguuggaucucuauaaguuguagccauggcagugacagugguugauaaauuccagcagagcugaaacccguggacugcaucuagaauauccucuccuuggguguggucagggcuguggcauaggauggagugcucccaccgaccuuggaaacugcccagccaggaggcaagagcacacacucuggggcugcauucccacagauugccagagaggccaacggucgugagggauuucagggaguuuaagauuuuggaaucaagacuguuuaacuuguuguuauccaugagaaguauuuuaagauuaggcauggucucgaacacugucaagucgauggcuuugauuucauuuccaguuaggucuagcuuuucuaaagugcuccagguccaguccaucccacacgucaaguugcugauuuuguuccauuguaagaagagugugugcagacugcuuagccggaggaagugagcaaaauuaaucuucgucagcugauugugcucuagaugaagcucucucaguuugauuaauccugcaaauccauuucgagccaaacuucgcaaacgguuugugcucagauccagaaacucuagacuacgacagucccagaacaggcguacugggauaguccgcagggaguuggaacguaaaugcaaggucugcagcuuccgaaggccauagaagagcucaggaugcagagaugacagcugauuaaaagacagguccaaauuuugcagauuaaucaguuggguaaaaguuguguuuggcaaguagaauauuuuguuggaacuuaagauuaacuccuuuaguuuauacaguccuuggaaagcgucuucuuuuacuguggaaauuugauugugaucuaaguggagccaggugaguugacugaagcuggcaaauugaucucuuucaagcgcugugaugugauugugccucagggacagacccaaagaacccuugucuguggcguuuggcacugaguggaagcccugagagucgcaguagaauagcagcuucucacagcggcauuuagguggacacgccauacccagggcaggcagcauuuuuaauaccacacucauugcauauauugcugccagcauaggggccccuaauggccacuugaaauguaagccugcagaauauaauuuaagaaaaacaagaagauaggauauguuucagcaggacacaggggcuauauuaaaaacaacaacaaaauguaacaucauaaugaaagauuucacugcauauaacauuuuucauuuacugcagaaaauuaaccuuguuuguagacuggaacacaacuuaaaccauguauaagagagauuaaaacaugucccuuuuaaaaauguuauaugcauuuacauaaaucuuaaaaucccgaaccaagugauuugcaucauaagaugggaauucacuggcuuauuuuuauaaaagcgugauuccucuuugauugaacaagccauagaaaugcauggacuuacccauucuucugagcacauuggaggcugcauucagucgagguugucagacucaacgcagugagucuguaaaaggcucuaacaugcaggagccuuugaccaguuuccuguuuucugugccccaggcuuuucaaguaaaauucaagucuaucagggugaauuguuuuuucccuuaggauauuccucuggaaagcacuggugucauuuucccugugcucugauccccuaaaccggcuuugauuauaaguuaauaauuuccuccuccugauuacugccgaucgucagagcucccggcuuuccuucccgcagcuguuaguucucucagccuuaacuuguugauggcagaugggcggcuuguugcagagaagagcuucuggagcagcaugagugcauuuacugaaaagcuuuuccgagaaacggcacaagaauggauuugcuuaugugcugcgaccacacagcacuguauauaggcugacgucaccgggugacgugucuuuuguuuggguuuuccagaagcuuuacuguuaaaagcacugugcuuuguaacagugucaggggcguuacaagacccccuguuuacaagagaugagaaagaagaacuccugauuugagaauuugguauuccuucaguguaggaagcaacaaugagguuguaauaaaugcugcauucaagaagacccaucugaacagugaguuggacuagcagagugaugauuucuaaugcgugugagagcuaguguuagacugccgauucugcauagagaucaucuaaaugggcacgauugauuuaugaagugcugauuuaaugccagccuauacaagguacgccucugcucugguaguuuggaaagcuacucaauugccuuguugucaugcuugguaaaaagcaaagugugacugacuguguugguaaacucagugggcuuaguuacuuugucauuaagaacuuaacauuauaaaacacaacaaagaugaauagcuuccaaaagaaacaauuuuggcuuuuuuuccccccuccauugagaauuucaagggaccucgaauccuuuucugcuuauuauauaacaaugcuuuauuaccacacugauuggaaaacggugcuagaucuuuggauguccuaccagaggagaggagcagacugacagaaaccgugauguuuauacacgugacccagaugguaacagugggacagagacaauucuggacaaguauugcagugugccuggauuuugacagucuucaggauuucuacuucagcaucucaccuacuccuuggcuaaaagccacaguuacuguugagauuggggugucguaacaucaaaauagcauuugcacacuaucucuuacuggcacauuuaugaacugacugacucucauaucagcucuuguugaauucucaugaauaugaaaggacauuaauauuggaguaggauuuuguuuugguuguuuuugcuugacaacucuugcuucccuguuagauaacuuuucagacaugaauguuuaugguuaguguuauauaaaugcaugugucuagcaugaaucagggcuauauuuucaggccagccuaaggaauugccuuuuauaaacauauuugucucgugaacugacuacaugaacuuauuuuccccguacuauuaccacuuacucuuagugagccugguuucaaaucugagagcagaaaucucaaagcuauugaugagaucugugagacaagcacagcacuggccugugaucuucugaggaguccaucccacaggugaauuuuaagaagucauuauacaaagagauauaauuucugcauuggaauauggcuacucugauaaugacuagaagucucuaagguccuuuagagucaaguguaaaaauuuucuggaaaaucuaguaauguaaauaugcauuucuuuaguucuucuaaagugaccccaagauguguucaaaguguaagggguuuguugaaggcaaugaaugccuagacaggaugguagagaagccagcagcgaugcuuugaugggucagcacagucuucggaucacacugcacacgugauaccuucgaaggguggagagagggaaggcuguacagacuuugucagacuacagugcgcuuccauucgccagccaaguuaaaguuacgccuacucucaggaaugagcucucaauugaucuuaaguuuuagaaaaaucuuuuguuuuucuuacuagcaaacaugauugauuaaaacagaaagaaauacugguuacacuaaguagugucagcauucuguuauuuuauaacuucuaguucgggacauguauacuuuggaauuuguucuuggguggcaggaucaugugacacccuacuuuucuucaugcuagaguuauuuucugcccugagccauaauuuagcgauaaauuuuggcuugaugcaccugaaucuuccauagauuuuuggggcagaaggauacuuaaacuuagcaugaggggcuuuucuuucuguacuacaaaggucaaaacaaaaauagugaaaacuguccuuaagucucauugacacacagacugaaaguuauguggccuacauuuuuaaauuuuuucccucugcugauggcuguucccuaguaccacccuaguacacucauuccuuuucuguauagcagaccuuguuucuuuugacacagccaucuuugggguugcccuuacuguuuucucccuuucuauuuugaauaacauuugauuuaaacacauuuuucucuuaugugggcuauacagagccauuuuacacagacuagaauuagggauagauacucacuaaucucauaguuagcaucucuuuuaguuuuaguggagucugacccaguuggcuaaauuuaaaggggcuagcauguauugguuucagaagcuuagaaacaacauucucugggaauuuuuuuuaaguuaaauuaaguaauuuacuuaacuuuuguaguaccaaggaucaaaacagagcaaaugaguguaccuagugcccacugugguuagaagagggugucuaauccucuaaaauuguacagaugguuauuauccacuauguggaugcuaagaacuaaaccuggguucucgucuggaacagcaaguaacagaugguugugagccaccaagugguugcugggaaucaaacucaggaccucuggaagagcaguccaugcucuuaacugcugagccaccuuuccagccccagcaaguacucuuuaacuccuuaaucucuaacuuucaucaagcuuaguguucagauaguaagugguagagaugaauguguguuauauucucauuacauuuuacaugaugacuggaacccuaaacuugcuuguuauaccaaaaaugaacaaacaaacaaaaacaacaacaaagaaacacugacuuaagcacucugucuagaacuuucuagaagagucagauaggguauuuguuuguuugguuuugguuuuguugcuguagcucuggcagcccuggaacucugucucucuguagaccaggcuggcuucuaucucacagaggucuuucugccucugccuccugagugcugaguggcaaugccacccccgcccgccccguccuggccugaccaacccuccuugacugaggcauacauagacuuuguuccuacaggaacaagacaaauugguuuuggggauagauuagcaaagagagaauugacaaaguguguggugcuauuguaccuuagaauggguguccugugucagcguaaucucggaaaucacgucacgggugcaauuuuacacagcauugugguaaaucuuucuacccaauuugagaacauucuuggguacugagguuugauuaaacugucaugaggucaaugagcccaaccuuugaguuucagcuuggggaaaaaauucugaaagaaauguauaugaacaccucccaguuguggcuagaaacaaugauggauuuuuaggucauuuacuuuaaagagacuuuuuuuuuuuuaaaagagucaguacuugaauaucugaggaguauucugagacugaaauuauuaggucaguuugauuuggauguaauuuuuggacaucugucuuaguuacuguuucuguugcugugaugaaacaucaugaccaaaaagcaaguugaggaggaaaggguuuaguuaaggguuuaguuacugacuuaaauuucuauaucacuguucaucauugaaggaagucaggacagaaacucuuuaaaaacagggcaggaauaugaaggcaagagcuaaugcagaggccaugaggagugcugcuuacgguuugcuacuuaacagcuugcucagucugcuuucuuaaagaacccaggaccgccaggcuaaggauggccccacuuacagucacuaauuaagaaaguuucuucugggccugucuaugaucugaucuuaaggaggcauuuuuaaaauuagguucccuccucucagauggcuuuagcuuguguugagucaaaauaaaacuaucuagcacagcaccuuugucuuagauccuggugguuucucuuaagguuaccagugaguaauuaggcuuaagcggaggucuuuucugauugauagcucugagcaaaccuacacaauaauucucauaucugcauccauguuguuaaugguucccccacucuggcguuaauguuaguagacugcuuaauguuauuagagguacaggaggacuuggggauugggcaagaaugagaccccgggccuucagggugguucaucugcuugaaaguccuugcuguguaagcccagcagcccaaguuuaaucacuggaucucaagaugaaaggagagaaccaaguuguaaaaguuggccucugaccucuacauaugauauggcuuaugagugcuuguucauaaguaauguacauaauaaauaaaauaaauaauaaaacucuaauaacccauagaaauaagaugaauacagaaaggugacagcauucucauuuaacaggugauaagagcagaauaugaaauuacauaaaugggaugucauauacacacagcuagauguucgucugccugcuggcuugugugcugacgucacacccauacccgaguguuuucagagcacucagaaagauaauguugggcuaaaguccuucuucauuuguuucucuccagcuauuaguagcauguuacagaaagaggcacauuugucuugugaaaaaacuuuuaauauauuuccuauuaauaguuuaauacacagaugucuucucguauuuccagugauacagcuggcuaugcuuagggccuuuauuccuuugcuuuugauugaucucuuuguuucugguuaguucuuacuacuuggucaaauuccaaccccugaucugaagagaugcugauguagucauuucuaagugucaaaugugugugugugugugugugugugugugugugugugugugugugugugguuuuuuuuuucuuuccuauucaguacaauuauauuaagcuuagcauagaaggucuaaaaaacauuuuacaaaccauucucauuugagccauauaauguuauuaacaauacaucuuacuuuaaaacuugaaauuuuuuauuuucugugaauggguguuuugccuacauauaccucuguacuacuuguauacucggugcccuuguagaccagaaaaugguguggaacuagaauuacauaaagccacgaaguggguucugggauuugaacuaggguccucuggaagagcagcuagugcucuuauuuaucuauugagccaucucuccaaacccacaucucacuuuucaaauguauuguuuuagagcuugggaaacggccuaaggaccuggaucucaggcugauucccagaaugcaugaauaaacccagaugugaugguacacuuucauugucuuagaacugaggagauggagacaggagaaucccugaggcuggcuuuucuaaaucuagccagccuggauaaaucagugaugacucaguggugaagagcacuugcugcucagguuaguucccagcacccacauuacaauugacaaccaccauuaacuucaguucuagauaaucugaugccuccucuggccuuuguggguaccagacacucauauugcauacagcaugcauucagacaaaacacucauauagauaaaauaaaaauaaguaaaaucuuaaaaaagaaucuuagaagcaaacaaaccaagguggcuggcuugugaagauuggcccccuugucccaugucuauguguuccucaccucccuccucugccuucucucaucuuuuuuuuuuuuuuuuuuuuuuuuugcuuugagcguguuucacuguguagcuauaaguggaccacucacagagaucugccugcuucuguccugagaguaaaggcauaugcucucauaacuuguucuaauuuuuuuuuuuaauucaagaaauaaaaccuguuugccauuuaguaucaagagccaucuuuugcuucuuuacauuucacuuuuuacuuaaauuuugaauguguaacauacgugugucuguuuguacauguacauauaacagcaagaggucagccucaggagucacccaccauguuuugggggacaaaauuucucaugggaaccuaccugugcuuaccaguuaggcuaggcuggcuggucauaaagacccagaucuaccucuccguaccucuucagugcugggauuaccggggugccacugcuacgcuagauuauuuguuucugaagauuguaugcaagcacuguauauacuuagcuauuuccucagcagcuuuguucugaaagcaucuaguuacugucagcaucagguguaacguauucuuguuugugcacuagaagaacugguacugguuguaugcugaacuuugaauugagauguuuauuggagaugggaucucacuaugaauuccaaacuugcuaaacccuuccaugcuccucaaguaucuuuugucucuuuuagaaaaacuuguagauucagugaucagccagaugaaugagucuaagugguacaagaucacauuuuaggugaagucacauauaaacacucccauuguauguuuuccaacuuugaauuaaaaauuguuuuggggguuggggauuuagcucagugguagaguguuugccuagcaagagcaaggcccuggguucgguccucagcucugggggggggggggggguuguuuuguuuguguuugccaaggggggcuagagagauggcucagcggugaggagcaguggcugcucuauaggaccuggcuuuaguuccuaacacccacaaggaggcucaaaauccaguuccaggagacucaacucucucuucugauauccaugggcagcagcgcacacaggaugcacagucauauucagacacccuauauauagaaaucaaauaauaaaaaaaaaauuaacgcccauuuuacuuguuuuuucuuuuauucaacauaguuuuaacacuaaauauagacugucauuagguuccuuguaaaguacucacaugagcaucuguuucuucaggcuggacguaaagaaagaagugaugcacucaacucugcaauagauaaaaugaccaagaagaccagggacuugcguagacagguaagcugaaaaauagggggcggggguuaauuguauuuccuaaguucucagcuuuaguuuugauuaaaaaucuaauaaacauaggcuuauauuuuuaauuaagggagaggguaaaucuucacagaaaagugacucuuucuguucuauugcuaauaagcuuauuaaugucuaaaaaaaaaaucucagagggauguagacuauuacauucccuuggggguggacugaaugaauuagcuccagugagaaaaggauguauaggcaggaaaaucaauuuaagaugacuuggggcucuguggaaguaaccucaaaggaucuugucuugacuuccauacacuagauuccagcuccucaugggucugcccauucuguuacauguugucaguuuguuuccacugguagaagugucuuuuuaucuaagugcaguaaugauggagauacugaauuuuucagguuacuaaauuuaaaaaucuguuccuuuaaugauauauaaucucauuaacauuuuaaaauuauauuuuguuaaagguccuuuuuuuuuuuucuuuuuuucuuuuuuuuugguuuuucgagacaggguuucucuguguagcccuggcuguccuggaucucacucuguagaccaggcuggccucgaacucagaaaucugccugccucugccucccaagugcugggacuaaaggcgugcgcuaccacugcccagcuuguuaaaguuuuuaaaguaauauagaguugacuaaauauguacuuuaauacauaacauauuaagauuuaaguuauggugagaauuuagauaguuuucaagaauuaguagaaauguuuauugcucauagcagauauaaaaaucuauggugggucaaaugucaacagugauuggaaagauaaaauuuaaacguuuauagugugguaacuuuuauagauaaaccagaaacuugcuccuuuuuuucauugaauuuuaacuaauuaggccaauuacauguauuccaaagcuaugugccaacucaauugagaauaguauuauaauccuguuuaauuuuguaagauccaaggaaagaaauagguaaugucuugaaaacuggacuucugcugcugaagugcugacuguggugugaagcauggucuugcaguccuguguugaagcuugucucacuggagugcucacauggggcgcuuggcugucuaaguucugccugucuuucacaggcuuucacuaaauauauuauaucacaccuuaacuucuuaguagaaauaaaaucaaauuaugcaauuucauuauuagcuucgcaaagcugucauggaccacguaucagauucuuuccuggagaccaaugucccucuauuaguacugauugaagcugcaaagaauggaaaugagaaagaaguuaaggaauaugcccaaguuuuucgugaacaugccaacaaacugauugagguaaguguauuaguggucuaauuaacagagguaacuugugagucgucacuuuuaaucacgugauugaauaggcuguaggucuucaagggcucaucagugcacagcauuuauaaauagucauucucacgggggcucuagcauaacugcuguucugucaguuuauguugaccacauggauagcuuuugucuuagaaacucaauaccaucauuuacugguaguguagcuaaagcuagaccaugauauuagaacaggauugguacaguguaccaaguggaagcaucuacaaaccagucaucuucugacaagaugccuggaagugcaucucagcaaguuaccuaauucuugccaguucuuauguccuaccuguaaaaugaggucacuaaugagagucauguucugaggaccaaaggagugacagauaugguagguguuuuaccugaugguuaggcagacucggccuaggacuguuuuaagagugaacaagcccaacauccacuaaauuauacuugagcuuacacuagaaaucugugugaaaaugguuggcuugucaaauaauaauuagaaaggaugaauuaacauuuaauuuccagauaaguuagguuucuucuucauuuguuaaaugaauuuacauuguuuagaaaugagacacauacacacaaaacauaaccuuaguacagaaacauaauaauugauaaauaguucauaaacccauuaguaaguugucauuauguaaaagcagaaacugaccugaaauguaaaaugcaauuuauaauaacacagaccaaguuaauacuaaaauuauuucaaggcaaauaccaguaaucacauuaaacaccuuacuaauuuuauaccucauuuuguuugaauauugauugaaguauuuuucugaccagaauuaugcacagaaugcauaggucagccuguuauucaaguuaaugauucugaaguuuggagcuaaaauugggguguuucauuuguaucuccauuaagcauaaucugguucucaacagucacaugacaguguaagaugucauuucuaaguggacagaaauuguguucaggaaaccagucccuuauaaguggccuacuuacuaaaaaguuccuuugagugauaggcaucaaggccucauguaucaacagcuaaagagaggucaguuuuuaucugaacccucaugagacagccguuugggucauccucagccucucuaaccagcaccuacaguauacagcacuguguacucugauuccccccccccccccccccccagacaggguuucucuguguagcccuggcuguccuggaacucacuuuguagacuaggcuggccucgaacucagaaauccaccugccucugccucucaagugcugggauuaaaggcgagcaccaccacugcccagcacucuaauccuucuuaagugaacucaggcuugaagagcuucucccagcuuauguacugcaaaccuccaguagugaggcucacugagcucauggguucaguggacugacaccacugagaaacagugacugggcauaguggugcgugccuuuaaucccugcucuuaggaggcagaggaaguggaucucucugaguucaaggccagccuauucucuauaaugaguuauaggacaccgagcaguacauaguaagacccugucuugaaagaaaacccgacagacagacagacagacagaauuuaagucaaucucggacuaacgacuugagucauugaaaacuuuguuccagacuuacacaucucauuucauucugaacaucgaguccuuggagaugagaggaugaugcuccccaucuuagcucaguucuaacccuuuucucaccuuuccccucugcgugcccucuacaccuauugccuucuccuacggcuuacacagcuguauauuaaaguguaugggauucucaucucuugaggcauaaccccaagcugugcagugccauucuccaaaguuauauuuaugauaacugagacaguaagauguauaauuacuauguccaugaaaaggaaauuaauuucuaagugcuucagaagccuuagagauuccugacucaagguagaacuuuuccugucaugacaagacuucuccucuccguacagccuuuguauuauaguggcacaccuuggacuaaucagagauuugguuuuagcaaagauaaacugccucaccauguuuugugaauccccugacgucauuucuugccauuagcugccuucuagcugaaguaaaugucuacaggccagcuuuaauaugagggccuauuuucccuuggugggucagcagaacuaagaacaguacauaaaauauaugcaugacugguaggacaugaguauaaauggaaaggagagagucagauucuacaaccacuaagaauauuugcagguauguucggaaggagugaucuuucugaaacucugcugcagaguucuaaugcuauaugucaggaauuagcguagaccuaagauaagguuguaagcccaacaagaucuacauuucaaaugccaccuuagcgcugugaucagucaaaaauaaaaccagccgauuauguaguacacaguacuuuauagugcaguguacugugacgguauccgauauguaugaauuuuagaagguaucuugaguauacaaucugccuagguugcuacagauacagaccauacgacagguuaaggcgagugcuccauuuuaugauccuccuugaucacuuauuacuuuucuucccugguaagacuggcuuugagauuugcuuuuuccuuggaguuccuacuguuuuguuguugcucuguuguuuuuugguuuuugauuuuucaagguagggguucucuauguagccuuggauguaccagaauuugcucuauagaccuugaacucacagagauccaccugccucuuccucucaaaggugugugccuacuacugacuggcuaaguuccugccuuuuaacagucagauuuacucuucucuguaggaaucaacagaguauucaguuauuucuuuuaaagucauagguuuuuacuuaauggcgugaaucccuuucuguguagcuuuaugaagcaucauguauucuuagcguuguggcacgugccuuuaauucuagcacuugggaggcaaggucuaggaauccuaggucagccaggccuauguagugcauuccaggguagcuuggggcuacauagugagaaccuaaccauguaggguuucugggacuccuccagucuuuuagucauagaaaacucagucuucaaagacaguguaugccacguugcuguuaggagaaagaagccaucaucuacucugaaaccucuguccguauucuuguugcuacguacuuguaaguugggagugcuuccaguauaaacuauguccuuucaauauauaguauggaaaaaauaaaaauuuaguuuuuucauuuauuaaauguucaaaugguaacaguuuuaaaugaaauguuuuaccuuuuuaguuuuuaaaugucacaaaaaucuuguguaguucauguuauaucuguugggcagugcuagaugguuccuaggcuuugagaagcuuucuuuauuguagcucuucucuguguguccuccauuuaagugcagaucucagugagcaccagcuccaggggcagcaggcaggguagugcagcagccaaggccuucaucuucagggacugacucaucauuauuucucaggaggauuuuggggugggcaacagcaagauucugagauuuccauugaucucacagucagucagagcucagguuuucccuauagaggaccugcuucuuagugacaucagauccauuucuaccagugggcgcaaguggguauuuuguucuaugugugguuuagauaugcugucaauguaaacuuaggucugguauucuuuaucaacuuuucuuuccaaaguugucauuucuucuuauacuuuuuuuuuuaauauaucuuuucccccuuccauauaaucugauguuuuuacaaugcuaagauaaaacauaaaauagaaccuuuuaguuugccucuggaaauguccuguggaaugggugucguauguaacuggccuuacagccagucaaggauacuuuuauuuuuaucuugcuaagacauuuacauaggacagaucuaugcuaguacccucgucucccuuucaauaucaagcaugagauaauuauuuaaaaagaaagaaagaaagcauaguauguucuggcaguuuuucuuccuagaguagguuccccuacaguccuguccaguuuucgugucauuaaaaaucauuguagaaaaugagaaggagauuuguaauaaugguggagagcaacugcucugugaaaugcuagccugugauuggaauauuaucccucaguguugcucagaggcgaugauuccgguucuccuucauguuuagcaucauugguaugcugcacaaauguccugaccuauguuuaaaguuuaagcucuuugcuuugcuuucucaugaauacuugggugcuguuguuauauacaugcagucaacuguuccuggagucagaugauaacaccucauaccuaauuccugaggguuauagccugauuucuuagguuuuuaaagaaaugugccccagaccugacucaaugucucgauagguguguuaggguuucuauggcugugguaaaacaccaugaccaaauagcaacuugaagaggaaagacuuuauuucagcuuauaguuccaucucauagcccaccacugagggaggucaggacaggaaccugaaggcaggaacugaugaaugccaugaaggaauccugcuuacuggcacuagcccaggugucaccucccacaaugagcugugucuucucacaucaaucaaacaaaaugcaccauaggccaaucugaucgguccaucugaagauuuucuucccaagaaagacucuaaacuuuggucacguugacaugaaacuagucagcacaucuggaguucacuuuccagguacuauacugaaaggagggaaucaacuccugaaaguuguccucugaucucugaguggacaaaugucuuacuacugcacaacugcuuugugauuacugagcuguggggcccaggucaccaaccaggcaccuacacuuggcuguggcagucaguguucucagacauaucuucccugccccacaacguuuuguguuugaaaaaguacaagucucugucugaaagcuuguugauaaagccuugggauugaaagugccacuuuagauaaggugcaguuguaggacacuaauguuuuaaaauacaguuuuuauaaguuuguuuuuaggaacuggggaugagauuuugaagcaauguauuagaaagauucaaaccugauuaucuccaguauuuucuuuuuauuguuaaguauacaaaauugauaccaaaguuaguuguuugcuaaggcagaugaaaccaugcugugcugaaauguagcuugguuaccucguuucuguucuagcuguugcacauguucaggugcacauagcguacugguuuuuaacaauuaguaaugagacgucuguauaaccagacccugccaugaugcuuucuugugugcugcuguuugguuuguuuggugcucucacccacucggcuucucaaacccauccuccuucuuccccaagaucggaccaguaaacucccaucauuucuuuguauuuauuucugugauggaggccauaggauagccauuaucauacugguuuucugcagcagcuccuaauggcugucuagcuugcacuuugaauccugucuagcuucuucccuuccacggaagucagugugaucuccuuaagucagcucauaucauuccuuugcuucagaauuuuucucaccuacccuugcgugguuucaagggacagaugugauacagucugaaacuguaguugaccauauuaugaaguauccuguuugcauuuccagcugcuuuuagucccgugccuccaugcugacuggccccugucauccuucucucucauuuuccaggcccaaauguuacuuccacagaaaggccucccuugauccccucagcucucguacaacccucuagugguuauauuuguuuaucccuccucacucucugaaauuaguagauuugcuuaauaaucguauuuaucuagcccuacucacugaaauaaaauguucuuuugaauauaugcauagaaugauuccucgugcauacuggguucucagcagcuauuagccuagugacuguccucauucucagugcuaaauaaaugucuugcagaugcucauucuucagauucagcauccaaacccugauucaguuguguauagacgguugacaaacagaacuuugcauuguguguuauuuugaaguaaucuuuauauagaagguaccaugcacacuuguauguauguauguauauuuguguugugcacacacagaauuuauaggcauuccaggauggaugacuuauccguaguuccugagucugggucuuaugauuaugcaacaagcacugaucaucucuucagccugaucagaucuuuugggaugugaaguugagaaaaauacaguuuuuuuuuuugggggggggaauguuuagaugacagauuugagcaguauuucauucuacuuagcuagaauuaaucuuucaaaaaccuaagcaacuuuuuuuauagauuggaagagauaaaaauauauagaaagauuauaucagcaaacauuugugaacuccuaaacuaggagugguggcucacaccuuuaaucccaguacuugggguacagaggcagaguucaacacuacccuggucuacagaguaaguuucaggacagccagagcuacauagucagacccugucucaaacaaaacaaaacaaaacaaaacaaaacaaacgaaaucuagagaugaaguaauaaauaauaaauccucauuuguguggauauuaucuucuguuagagaauggggggaagaugaaaguaaauacagauuuuaugagagguguguauaagguucauauaaugaaauggaaugaaggaauauuugaaaauuuuuuuauccauuucauuaguguuugaaaugaauacaaaacuauuacuucaguacuuuuaauaaaugaccaacauaaauuugggacauagcagauguaccaaauugguuuuuaggaagugugugugcgcgcgcgcgcgcgcguguguguguguguguguugcuuuaauagaaauaauuucucuuuauagcauauaaaggauauaaaauagaguacaaaauucuuuagugugagagcgcccuguaaaaguugaccaaguaauaucaguccugauauuauggcugcauucacucaaaggugggaagguccuacagugccuacagaggaugaauuacguaugaacauaaaagaccaaguaugugugcaguguuggugacugugagugccugauggaucacauucaagcgcuuuugugacuuaaaguaguaguaaagaguuuuucugugaggucucuccacuguuauuucugagggucugcuuaggcucuaagacugacucuuggauuaugguugucauuaauaggacuuguugacuccccacaggacagucuguuugucugucuuaaauaaaaugugcauagauguuagauauccucgaggucauugauaggagggaggaggagcaggaacugcuguacugagugcuuuguguuuucucucaucugcuuauaaauagugagggaggcuucuaggcaaaaguaccuuguguaccuuacuuuuuccucucauaucaacuucaugaugucuuuauguuagucuuugauugaaaguauguuaagguggaaauuuguuugcugucggaaaccuuucugucacuaauguaauaucuguguguccuuuuggaugauuuccuuaccuuuguuccugcuuugcugugugcaucguaagagccaaggaacaaucaguguucuuuuuuacuuacccaggucucuucagacuuacagcucauaagaguaagacaaggaagauaacacguaucacuuaguauccuccucccuucauccucggguagugcauuaacauagccuuaagaugggaauuugcugcacucagguugcaucucauucgcugccuugugaauuaagaauuacaaagcggaagaaauccuuuaacuguugggcucucucccccaguuuccucauuaucuggaacuucaugggguaugacuuuauuaguuugaaauguguauuuugacuacaaauugaauguucugcauuguauauuuuauuuuugucaugaauuuguauguaauaacauguagcaaaguggccuugaaggcuccaugaagaacauuugaauuaaacacugaucuuauuacuggcuguguauuuucaguggguccaugugacuuggcaggcugaagcucuagcaaauaacaaucaguguacaugaggcuaaggagucgucuuuguucccagacuagucuuucuccucugccaacuuaucacuuugucaaauugacaaagcaaacccucccuuccuuccaccacaugggccccuuagcucaaacucccuuggguucggaggcagcaagugccuccacccacagagccaucuuacuacuccagaaacacuuuucuuaaggggccucagcagcaucuuuucucuuggauccugguaggaaggauugaggaacccucuacccagucuuggcuguguuagauuauaggccugccaggcaugguuauacgggccuuuaaucccaguacuuggaggcagaggcaggcagaucucuguuuaauaugacuuaaagaacuguaggagaggggcuggagagauggcucagugguuaagaacauuggcugcucuuccagagguccugaguucaauucccagcaaccguaggguggcucacaaccauaucuguaaugagaucugaugcccucuucugguguguaugaagacagcuacaguguacucauauacauaaaguaaauaaauaauuccuuuuuaaaaacaaaacaaaacuguaggagcuuccauuuucucaccaggaaaugggacugaggacugaugauaucucauguuuagugaggcacgauuucuagguuuacuuguaagauuaggcagcuagguagauuuagaaauagggaacuucuuuaaucccagcauuugagagguagaggcagguggauuuuggaguuugaggccagccuggucuacagagugaguuccaggacagccaggacuacacagagaaacccugucuuggggggagggggggugaauauauauauauauaauuuaaauaaauuaauuauuauaaauccuguuuuguauuuguuacuaguuaugcuuauuuauaccuugcuuuuuccuaaaauuagauuaucaugacuuauuuugaacaaaaauauauaugauaaugucauaugugaauagcuaggaccaagugaagaauagcaggcagugugaguuuguuauauggaguuuguauuacugaaguauugggauggaagugcuaaacagacauguaggcugaggaauucaugauuuuuccccaccuggggaauaagccccuccuaagaauaauuucagaaagaauucuucccugagauuuacauaugaggcauuugagugauuuuucaacacuuuaaaaauaaacguaggacaauuauuauucuuuaauggcaaggucauuugcuaccaccuaugaugugaggauuuauccaguacacgccuuuaugugaaagaagugaaagcacucaucacucguuucuccucucugcccuguuugucagccccucaccccauucccuguucuugacugugccauuaacugugucgguugaguucucuauuucccucuuguuuggcugucacauccuugcuguuuuaguagucugccucagguuuucugugggggcaggggugguggugauaaaugcuucuguccuuuuuguuuguuuuuauucagacuucagauucucuugcaacauacucauuauauacacacuccucaacauacucuauuggguguuagugcuacuacagagcugcugcccuccuccgcacacacacuuuguuucacuuuguaaaggguuaaaaccagggucuuacuaauuggccaagcuacuuuugagcuuaccuuccugccgaaaugggacugaaagcugcaucuucaggcacagugacuugaguccagguuuuauuguauagccuaggcuggccuagaaucacuaucuuccuacuuuagcgccccuuguugcuggagucacaagauaugcacuacugugccugucaagcuaaagacuucacacugauuuuauuauuuaaucgcaugucaggugugugcccacugcccguggaagccggaggaggaugucacauccucuagaacugaagauacagaccauuguaagcucccauguaggugcugggaaucaaauugagaccuugaagaacagccugcugaguugaacgauuucccccacagacuaauuuuuuuuuuuuaagucguauugacugcuguuccaaaucuaaaggugcagguuuuccucaguaagaggugugaagguuuuccuucccugucuucccuuucaagguagccaggucuggcacuaguauaugaggcuggccucucggagcuauagucuagaucuugcauuugcacauuugucaucgugagaagugaguagucucgucccuggaggguguguugaagcuuauucauccagaaaagacuguuagugacaagcaucgcuuccuccuccuuccaggccuaagacaagcagcauccucuucuagaguuaucagaaacaguuaggguaauguuuuaaaacaaagaauuuaagucuucuguagccuuuuucauaagauuuguaucaaggaaacaaaugacuuaaagaauguagccguuuuaccauacccacaccacccuguaucugaacaguauucuuuacuucuugauuuugaaaauauuuguaagguuuaagauucacagaauugagauaguauaaauaggaauaaauugaaauaaaauuguugggugguuagaaagcaaaaucccagugucuuuucguggucuuugucuuucguggucccugucugaaagcagcuuauagaggcaguaggcggggcuuguguugcuguuucaccucaccaggagcuuugugauguugucuaguuuuuuauuuguuuuccagaaugccccucccuuuuugugagguagcguuuuuaugguauagcuaauccuaaagagcaacauuuuuaggacagccagaacacuagcaagcuaaaacuaugguauaaccuguaaaaaucauuucuucuuaugucagcuguggcguggucaccugggagggaaggugaagguugacauugaaguagacucugccagacaaggaaguccaaccagcgcugccauucugagagccccugugggaguuucucauugcuuccauugucgucaccucccuucauugaugaggaggguggcauugucuguuguguuuuguuuaagacacaaucucacuccguagaccaggcuggcuuuacauucacagacuucacuggccucugcuucccaaguacugggauuaaaagcgcaugccacuacaccuggcucauuugguucacuucaguguuaccuuuaucaugucuuaaaaaucuuaauuuaccuguguucaaauaaacuuaacuugaauuuauacauaugacaaggagagcagcaguuuagaguuuugauuuccuccccucaagaacaacugcaaauuuuacuauuuguggguacugacaguuccuuccuugguguuccuuggguuuucuuauaauugccuuauugugacuguucaggcagauuagagcucucgaagccugugagccaccucuucugauaccagccuacaauguaacauugugaaguccuugcaggcugagaagugacgcuccuuccugcguuguaucuucuguuuucugggaaggccagagugaggcaugguuacugcccuguuuuccaggcaaaagaggaaaaugcucauaggcguuguuauguuccucccucgugcagguugccaaccuggccuguucaaucuccaacaaugaagaaggcgugaagcuuguccgaaugucugcaagccaguuagaagcgcuguguccucagguaaaguauacacugucuccaacauuggauuuaguaggguagauauaaauuuauuuugcuuucccuuccuucuuuccucccuccccucccuccaucccucccuuucuuccuuuuuuuuuucccuaaguauauauauuuuuuauuagguauuuuccucguuuauauuuucaaugcuaucccaaaggucccccauacccccccccccaauccccuacccacccacucccccuuuuuggcccugguguuccccuguacuggggcauauaaaguuugcaaguccaaugggccccuuucuuccuuuaaaaaagggggggggguuuaaauagaaguccugauacaaauaaaccauagauugggaaaauuuaaguauccuuuuuuuuuuuuuuuuuuuaaucauaugcuacugccuccuugccuuuaauuuaaaaugcauaggagagagucaucagauggcucaguucugccaagacugauggucuugguccacccccaggaccuacguggugguuaggagagagcugacuucaacaaguuccucuguucuccauguaugcauuguugugugcauguguuaugugugugguacacaggugucugaccaaucuaugcaguugugacgcucuugucacaaaguacuagucuuauacaaauaauaguaaccugguugaaccagccacugaagugaaggcugagaguuucuguuuuaauagugagugacacuuggaaagauggagaauugggcugggcuaaguguaugggaugcuagaaagacuagacuauaaguguauaaaacaacuaauucuuucuuucuuccuuccuuccuuucuuucuuucuuucuuucuuucuuucuuucuuucuuucuuucuuucuuucuuucuuucuccuacuuuauugguuugugcuuacacauguugcauguucucauggugugaggauagaggacagcuuguaagagagaauugugucugaucuaccccuaaaugggucgcagggacugaauucagauuaucaggcuuaucagcaagcaaccauuaucugcugagccaucucacuggccccggcuagugccuuugaauauucaguguauuugucuccugugugauauucucucugucacucagaucucuaagcaggcuuaagucaugcuuucuacuuucccugauagagaaugcuuacagcacagucugagaguuagguuaaccucucuguguguccugccaaccaggcuguagacauagaccagagggagcaagcagaggaacuguggggauugacucaggaugggcuuucuauguaaagucugaaccuuaagugccccgcccgugacaacuguccccuggcucuuuaaugugaaagcacucgagccuucuaugauggaccaaucacaaggcccugccaugugauaaacaucuugccaacuuuauaccaucauaagauuuuccagugacugauugcuaugagauaauacagugaauuggaugaccaaauuguaugaaauaaauuuagaguugauaucuaaagauuggacuuucuuccccucaaguuugccauuuuauccuuccagcacuuuaauaucuuugguucuccguuucauuuuaaaaugcuugaaaagcgacaaugcuuccacauaucugcagaaacagaugguaacauacgcugaucacaccuaccaagaguauuuauauaaaugaucuuaaagccuggggaaaggaaucacagggagaaucuagucgaugcuaaugaaaaugcuggagcugaugagccuccugaguuggccaugucguagcauggagcccaccacacaaagccucaguucucagcuucacaguuucacauaagauggaccucaggacugaguuuaagacacaggacccagaccauacuuggcauugggguugugcccugaguaaaagaucuuuucugggagugauucuucuuuauacgugcagagcugggcaucuucaguauuggaaaugcagacuggaccaugugggcuguucaucuuuguuuuccuaaguuaguucuguuaccuagauaaaagagaagaggccccauugccauguccacaugcggcuaagggugguaagguuuuuuuuuuuucauguacuuccucuccaugucugagcaucuuuuggagaaagaacucuucagauccuuuuacauccucacugauuacagugaacagugaauaguaugaaaacgaauguggagacagacaggagaaaacagugacgagaggugguuaaaaugcuuuauaaaggggaugggauggggcuaggaagauggcucagcaguuaagagcauggacuauacucaaaaggggacuggguuuguuucacagcacccauguuaacaaacuauuggcaauuguagaagagaagcaccucuugucucccuaggccauguuuagaaaaacucacucagugcgugugggcugucuguguagagugaaaguggguaguguguacgccauggcucacggcuagacuagugcuuucccuggagacaggaggagggcagugcucugcacccuugccgcguguuauuuuuggaguagggggaacagcuuagugguuacuaggagaugggauaaggagagaagaggaagauggggagugcugacuccucauuacuaauacauuuggagcuucuuaaaaaaugauugaauugaaugcauucucauugucacuauaguaauucuuauugaauuuacacaugauuuauaaauuguaucucaagaaaacguugggguguguguaugcugugcugcagcuggaauuuugagcccugcacauacuggucaagcuuucuaccaggggcuguguccccaguccuagguucuuacuuauauguagcagacuagauacuuuucuguggaauuuuauaugucagagauaccucuguuaaaaugacaaagggaaacgaguccuuggaauugaaauacaguaccuuuaucaugaaugaauuccgauaaguuuggcauuugguaccaggcauuaugcauuauugcuacuucuguaaugauguauaacugagaugagucaaaauauccccacaguaggagaguaauguaagauaccuguaaaauggaaauaauaauguuuuaauauauacuuaaugauguugaauauuuaaaagaaggaagcaggaugauuauauguggcauauaauuuuaauuauguaauuuuugaugguacauuucuaugaauguuuaaaaaaccuggaauuuaaugucaaaacuauagaauugggggcuggagagaugguucagugguuaauuaagagcacuggcugcucuuccagagguccuaaguucaauacccagcaacuacaugguggcucacaaccaucuguaauggaauucaaugcccucuucuggugugucagccacagaguacucauauacauaaaauaaauaagucuaagaagaaaaaaauuauagaauugccuuuacaaauuggcugaaauagagagagccuucacuuauuuuauaauugucuguuguuuucaaauaauauuuauagcuuugguguuaaaguuuaaggccugcuauucaguauuuccucuguacgaccugugguggagcacaugaugucauguuugaccaaagcaccccgugugauugguuugcaauggcugugauaggaugagcuaugugcauuuuuuuacugucuucugcagguuaucaaugcugcauuggcguuggcagcaaagccgcagaguaaacuggcccaagagaacauggaucuuuuuaaagagcaaugggaaaagcaaguccguguucucacagaugcuguugaugacauuacuuccaucgaugacuucuuggcugucucagguaaugaucugguucccuaaaguggcauguagaauuguuguccaggucauaguuacagacaaaacacucucacaucuggucaaggaaacucuuaucaguaacaugcugguucccacacuuguguccugagcagggggaguggaccuggagcucuuucccuccugguggggcugguguccacccugcaucauuaguuacugggcuagcagaacuuuucccugcuggugugaucugugugucauauaacaguccaccagucuugauacuucaguuuagaccuauguccuggugccacuggucacugguaacaagccugugaagcucaggggaggagccucucagcucucucagcuuuuauuguagagaauucccuuuaccuucuuggaaugcuucugucucaggagugaucauaguuuaacuacuuuuuuaaagacuaugucggcaugaugcacagauagaaaacagagaggaaauauuuaagugccauuuaauuaugaacuugcaaaaaauaaaucuggguaauucaccucacaaaaacaguugauuucauuauauaaauauaaacugguaauggcauaguaaauugcauucauauagaacaugucugucaaaugcaauucaguguuuagcucacagaaauaaauuuuaauccuaucuccuuagaguugaguaacacuaaaugcauuuuccauuuaacauggacuuuggugccccuggcuguguugucuucuuggaaaugccaggcuuccugaggcuaguggcugugggcagauuuagugacuggguucuuguagagcugaaacuaccugucaccccagggaaccacgggcuggaauguggaagaugugaguggcaauggggcuugaaagagaagcagacuuaaguacaugcacagcacaguccuccagcagugaccuauauaaaggggacacugugcucugcauaccaaugucccuggcauugcacguccucccugagaugguagcuuuggcuuaacuugagaaagccuggugcaggcuguuuagcugcaggaagaggugguaaacggugugguugcaggacugccaaauugcagaugcugcuacuuuaaaacaagaaaauucauuugcaagcacauuguugcaagugccaaaaaugcagcaaugggccuuuuugggaaucuuggccuucuguuguuuuucccaaugaaguauggaauuauucuuuuucauaggccuagggaaaaacauucuaccuucauagcacauuuuuaagcaaacaacaaauuuggaaaucuaaaugcaaaguucccucuggauaaauacuauauucuuacaguuuuguguuuuuucaaauuaaaguggguauguuuauugagcuuagacucaagggauuuucauuuuuucuuacaguaaaguaaaauauaaaguaaaaguguuccucauauaauauuuuuucaaaucagacaacaaaagggauuaaguaacagcauuuagugggaugcagacaggauuuuaaaagguuauuuaauauaaaauggaagaccaguaaagagaaauuaaauucuuuaguagauccacuuuuauuuagugaauggguccagcauuguuguaaguaaaugaguuuaagagagggcugacucagugcaaacagucgagccaguuucuauucagugaacucaaacguagacuuguucuccugaagagagcaccugaacgguguuaugucugccucuucugaguguuugauuguucugucauaagauugcuuaggaauacaagggauuagugaugcaggugaggauggugaagggccaagcaggugccuggguaaguccugguagacuaagcaguuaguuuguagugcucagaaauacaggacuucccuucuucuuaucaguagcugauaaugagccugugagccccuccccaccaugauugacuccugauaggcccagugcaggcaguugcuaccauugaguuccuguugaaaugacugucauaaccagaagauuucacaggcccuuuucuuuaucuucuggcuagugcauucuuugagccccuucuucaauccccaagcccuagaggaguuguaugaaugucccguuuagggcugagcacagaaccaucucuuauucucaccgucuugaaaaggccucugagguugaguaccguucuucugugaguauaaacaagugucaggggccacagugguaccuaccaguuuaacuaaaccuuagugaguuccucuaagguccagacguccccagcaguggcucugacuggguuagcauugccguuuccccuucugauuccgucuaagacccagccuguguguuggugcugcccaguuaggaugggucuucccaccucaguucaucuaaacuaaguaguuucucaaaggugugcccauaggcuagucugccuagaucccuuggugagucuagaucccuucaaguuggcagucaguauucacccucauuaaaauguuuauucccugcccugucugguuuucauacaaagggauuguuuucugccuuuuuaaaaaaaaaaguauaauaaaauuagcaaaacuguagaugagaauuuccuuuaaaggaaacuaaauuuaaaggaaggaaacaggacuugagagcuguuuggugacuagaaagaauaguggugguuugguuuuuguuguuguuuuucuguuuuguauuguauuuuuucuugcugauguaagaaguaacuuaggagugaaaggguucacaguugaauaguacagucugcuaugucagaaaagucguggcacuauauguguaaucaggaaacagggagaguaauuguacuugaccgccaucuacccacaacagguuuuuguguuuucauguaauccugaguguccuggaacucauauuguagaccagauccaucugccuccugaaugcugggguaaaaggcgugugccaccacugccuggcuccuuucuccaacccaggcaguggugcugcucacaguggguagacuuaccaccucaccggcaugcccagaggcucaucucacaugucagacuuccugagauaagucacagucagcuucuuuaaguggacuuccuuuguggcuucauaccuucuuuggaugugaccacagauggggaaagaguauguaugaauuuaauaaaauuggaguuuguuuuugaaaacagguaucuagaugcuguuuuuuauagaguacaucacugagucugauguauugacccccuccaaagugugaaccacccuaaaacagggaugagaucuaaaucauauaaaaaagaggguuguaggguuuuuauuuguuuuuaaaucagaaucguuucuucccuuuugacuuucccaccuuugggaaaauaugggguucaaaaaaaguaguuucaacauuaagaccuugaaugauggcaggcuuaguauacauuuguuuaguuaguauguagggaauuuggaugcuuaugaugauguugaagucuuccuucuuucucucccuucuucccucccuccuuucuccuccucuuccuucuuuguuuuguauacuccuggccgccauuccuagaacuccguguagacaaggcuagccuugaacuuccagagaccugccuaccucugccuccugaaugcugggauuaaaggugugcacucccaccuggccccagugugcuucuuaaaacagauugcauuugcucuguuuguucuagcucuucucuaagaacuagaccuucugcacuugcuaugccacauucuguuguuggcagaaguuaugucuuuaagugacauaacuucugagagcugucaugccuuccagaaaagaaguugauguugccaccuacugcagcccuucuugugcgcugucucucugcuucucgcccccugcugggucugcccuacugccauggugccugugugcaccuagcagcuugcuccucuuagcacgguuuccuuggcccuuugccuuguuucccuuucacgauuacagaugagauugggagaacuugcucugggguuucugaaaacagugucaggcuuugaaaggaaaugguuuggaguuuucaaauccagcugugugccuaguaggaguuuuuggucaauuuagcuggauucacugacagucaaugaaggaggaguucuugaagguagcguguguguuuguauuacauuauguauuugcuuauugaaggcgguguguuaguuuguauuacauuaugcauuuggcauuauagacugcucaugccaugagguaugucuggagggcagaggacacgcguaagaguugguucauacucuagauucacgccccacccuucugagugcuagcaugccaaugugugccacugugccuagcuccuucauguaaaacuuggaacaugcuguguuaccaugccaccuuccaguagaccugauucuucauucaucuuuuuguccucagagaaccacauuuuagaagaugugaacaaguguguuauugcucuccaagagaaagacguggaugggcuggaucgcacugccggugccauccgaggccgggcagcccgagucauucauguagucaccucagagauggacaacuacgagccaggaguuuacacagagaagguucuggaagccaccaagcuccucuccaacacaggucugaggacuguuucccacccacccacccccacaggcaccuaggguuucucugguccccaccauggcuggcucugacaggcuguccuuucauuccaaauacuggggauugcacacacacaacuuuugcacacauggauuggcucagugugcuaggaggaaguuggcucuugggcagcucaccagcacauuccuuuuauguaugugagauaaacuugugcguugucuccugcuaguggggucaaaccccuccuccgcaguguuagggauugaaccuagagccucuuacaugguagggaagcacuucaccaguaaacuacuaccccagccugcuguaguucccauucguaaggccucaaagucaucagcaucauuccaaguucucagccccacaguccuaguucacagagucugccgagaagaugcuuggguccuugagaagcagaggcucuuugucaugaccgugacuguccguccaaggauucagggaagguugguggagugcaucugugcagugcgaccuguccuccuugucucugcagucaugccgcgcuucacugagcagguggaagcagcuguggaagcccucagcucggacccggcccagcccauggaugagaaugaguucaucgacgccucccgucugguguacgacggcauccgggacauccggaaagcagugcugaugaucagggugaagaaccauguucugcacauuuuauguuuuauauauuuauauauaugaguccacuguugcugucuucagacacaccagaagaggacaucagaucccauuacagaugcuugugagccaccaugugguugcugggaaucgaacucaggacucuggaagagcagucaguguucuggacugcugagccaucuccccagcccuuccagacauuuuaacagcuucuuuuuuuaucauuugcuaacuuaaucauuguguuauucuggaacucaguagauacaguggcaguauauuaaauccaugaaucuaagagcuuuuagaaugagaacccaaacauggaccaaagaaaggaaucuaacaugaguugggcuugaugaauuaauuuagggaauuuaguuggauaaucauagaauaguuagaguuacagggaaacuacagaaaaugaugucuuaaguuucagagaacuuuuucuuuuuuuuuuuuuuccauuuuuuauuagguauuuagcucauuuacauuuccaaugcuauaccaaaagucccccauagccacccauccccacuccccuacccacccacuccccuuuuuuuuggcccuggcguuccccuguacuggggcauauaaaguuugcguguccaaugggccucucuuuccagugauggccgccuaggccaucuuuugauacauaugcagcuagagucaagagcuccgggguacugguuaguucauaauguuguuccaccuauaggguugcagaucccuuuagcuucuuggguacuuucucuagcuccuucauugggggccaugugauccauccaauagccgacugugagcauccacuucuauguuugcuaggcccaggcauaacucugacaagagacagcuauaucaggguccuuucagcauaaucuugcuaguguaugcaauggugucagcauuuggaagcugauuaugggauggauccccggauauggcagucucuacaugguccaucuuuuuaucucagcuccaaacuuugucucuguaccuccuuccaaggguguuuuguucccacuucuaaggaggggcauaguguccacacuucagucuucauuuuucuugaguuucauguguuuaggaaauuguaucuuauaucuuggauauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugccccagagaacuuuuucuuaagguagguaaaguuacagugcuucugccaaaaggaacgcuccccuccuagaagggaaacccaggcagguuagaaucucugcucaggauaaagaguccggcaauuggcagcccucaggaugucccacggcucauggccaaguggaaguucuaccacuagggcuuaugugacccaccccagagaaagcagcacaaagugcuugaccuccaugugaacaaggggguucugagucugcagguuccuccaucaaacagguccugagccugagucucacaaacugccauuuuagcccuaucuaucuagccagcagaagcuaaccacguugucauuugggaacauguugcuccacagauauaagacauggccuaccugaguccuacgccaccccuucccccauucauugcaggccccucagaacaggcauuuggaauacgauucccaccuccuacauugcuugaguuuugcccgcuguugugugguuuggucagucaauugaguuucauuuauaccuucuuuguuuucuagucaaaccuccaaggugguaggcagggacuccaucccauuuuuuuaacccugucuaccuagccagcaaaaguguuaguuagaaacguguuaaaggccuauugcuuccacuuuguaugaggcauuggaaacucaggaaagaccaccauucucugggugaggcaggaaagcugcccaucugccuaagcacacuggaaagaggaauaguugugggugugguuggaggauagcaaagacuuccaggcuuuccagggcuagcuaaugaagaacccuaguggaccaaagauccuuuaguggguaaaggugucugcuauccaacuuugugaccugaaugaucccuaggacccacauggcuagagaagacuaaguccuacaaguuguccucagaguuccaagcuacagcagaaguacuuuaucucuaauaaagucugguuagcaguaucaauggcagcuaguggcuauaauaugguauuaaugggugccaaggcuacauauacuccagcgaugcacauaguucuacuucucuggcugggugccauugggagcagagcuguauaguuuuuucuaggaggugaucaggcuaagagcaccauucugaagaagcagucugggcacuaucucucugauguguguccccaccgcccccccaauggcguuacuggggagcuggagugaaggcucagugacuaaaagcgcuggcuguuuuuugagcgguugaacacucaccuggugucucagaaccgucuguaacucagucccgggcaucccaaggcucuucuagccuucagggauaccaaccaugcaggaaagcagaacucccauacacagaaaguaaauguuuaaaacauuaauggcuucauuggaugaaauaaauaaacaggcaguguuuccagcacaggccugacacauaaauggcugcuacuuacuauauuuaguucugugcuggaaugaagaauggcaggccuuuccucuccuccugggccuccagguuguguauagugauagacucucagggaaggcagccuucagugcucaagugggcuuggcagggaaccggcagaagugaagcuuugaagauggugguguaguuuagcacgugcauagggcucacugacgaugaugguggugguuagcauuagguuagcguuagcauguacgcacgccaucacugacccaucacagucaucuugguuuucuugggaaaugagucucagugauaaagccaaguauucauuaaccugagccaggaauccauccucagcaugcacaugugugcacagggcacauguacguauguguacaugguacaugcauacagaguucuucucacuaguccucuaggcugccaugucuuugauuggccccacaugcuacuuuucacucagccccucaggucuugguuuucuuuuuaaaguacauuauuuucaugugcacauguauggagaccagaggacaccuuguggaagucaguccucuccuucuaccaugugggccccagggauugaacucagguucucgggcuuggcaacacaugccuugaccuacucaggcaucccgcccugguguaaggcucggcauaucaucccucugccugaagucucuuagcccagggcauccacaccagccccagccucagucacugaacagcucuuccacacucucuuagcucagccagcaagcuaaguuguucuuuuaccucaguuuacccacacucuccaccugcauguucccacugucucacaaaaccguugccuguuuccagucacuaugacggcuguuuauugugcugaccacuuuguaguaagccauauaguuuacucguucuuugcccauuacuucuguucacuguuagaauaggugagugagugagugagugagugagugagugagugagugagugagugagugaguggagaaaagagaagagcucccuuucuuggcaagaacgauucuuaggacccagcuaggcucugggaaggaagcaauguuggcugcugcucuggaaagcuccuuggaccuagcacacagcagucuguggcugagcucagagucacacacugacaggaucucugugacucuguaguaccugugaucuuccccaguaccaggcucacuucucucgggcagacccaaccuucacccgucagacccaugccauuuccucagugcuucucauaagaccccagagaugaggccucgcugccccgugacacaggccagccaucugggccaacgccaaccccagcuguucuucaugccugccgguucuuccugauaacuguuucaagucagaggcuaagcaggaggcuggucaccugugccaaauaggauuuuuaccuaauaacugcugcaggggacuacagcugccagccccuuuggucuuugauauguacugaagucuccucugcuauauucucuuguccuuugauaaaaauaaaauuagacuuuagggauaacacauuguuuuuuuauuccucaaaauagccuuuggcacccaaagagaaagcccagcauuaauuuaugucauguucuuguugucauaaaguaagcauuuauggaauugcuugauguuggguaaaaacaucucuucuuuaaaaacuuuuguccaaggaugguuuuuaccuucaugugcauuuguagauucguuggggaauuguauuaaaacugaaaucuucguuaugauugauucagaggucagccugaacccuaaguccuaugugaagagcuuucuuuacagagagggugaggaggcugacacacugcucuggugaccagaggcugcacccuggccucuguacugcaggcuaagggcucucccucagccggaagcgugggcugacugauucauggucuuuguuuggcugcagacccccgaggaguuggacgacucugacuucgagacugaagacuuugaugucagaagcaggaccaguguccagacagaagaugaccagcugauagcuggccagagcgcccggguaaggacauggcccuugguccucugacuuguuugggaaaggcucuguggcacuuaggccuggcucuuuucuaggguguucagaaugccauuuucugauccuuuuuuuccuguggaguacagcuaaaauccucagucauggcagcugcuaguaacuuguggcuuccuacaaaacagcccucagcuaggccuaggugagagcccagguccacagcuguacgcugggcugcgguuuauggugcccccugagucaggaaagagugagggucuagucaggguuacguuugcuaaaaaugauuuugcaaugcuucugcuuguugcccugauaacuguaggaaugugcucuuaaauucaugggccuuuaaaccuacaacaacaacagacccacaagugcauccaagaagaccauucaccacugucacauuguggucauuacaucuucaauucaccaauucaauccgugcuggaaggaugccgagaugucucuagggagucuauuuucucacuccauggagaucuaucucagagcguguuccugcuguagaccuuccuggguccugagcacugggagaguuaggauggagccugugggcuugaauugcugcugucuccagugugcugcuugguaguuagaggaggugauggccucagcagaugcucugaccaccuuugcuggacauuccaaacuuggaaaugucuguugagggccccaacaggaaucccacccauucauccucuccuguugucacagacagcagcaaacuugaaacuuuuaaaggagugggucagacccacacagcuguggcaaugaagcugcaaguuagccuccauacuguucccgccacauucagacaugauuuugaaaaugggucuggaauucaggcugcaguaaacuccuacaaaaugagaaaauagcccuuugggcaaaaugaagccauuaaaguauuauccaccuguguuguagaucgcugcuagaaggcuuccuggcuaaugcacugugagaaccucauaguugguguggcuugugauuguaggcgaucauggcucagcuuccucaggagcaaaaagcaaagauugcagaacagguggccaguuuccaggaagagaagagcaagcuggaugcugaaguguccaagugggaugacaguggcaaugacaucauugugcuggccaagcagaugugcaugaucaugauggagaugaccgacuucacccggugagcagagcccaccccugcagccugcagagagaggcugaggacuugcccagggcccugaugcuuuguaguccucuuuucuccacuuaccuccaaccaagaaaggauucauagacagggacccuguucucuuuucagaggcaaagguccacucaaaaacaccucugacgugaucagugcugccaagaaaauugcggaggcgggauccaggauggacaagcucggccggaccaucgcagaccaugugagugacacucuguguggccuguggcugaggaagcuguucaugagcauucucacgggcuguggcucacuuugaaaacugcucuaaccuacuugauuaaucccagcauaacguuccuaaggauuucucaacuccuauuugacaagucucuggaguugggucuguuuauccuaaacuuuacaucauuucauccuuaagaccaaccccuucuggguuuguuuguaguuuugggcagaagcagacucugucgucccugccccucgggaacggauguaucagagccucuugcuggggcuucugugggauugggagcucugggcgagguuacacgcaaaugcgucuagcuggggacagcuucucucuuccuaccuccaggaagccucgcagcacuuuccuguggcuuuuuucuggaguuguguguuuugcaaguuauccaagcuuacugugucauccaggcugcaggaugggugacaucugucccucauuacucaaaccaacauuuggcagucauucuugaccacccaguaaaaagccauguggacaguguauuuugacaacaccuguucuuccugucugaaauuaguagcuccauugaucucuuaccugcuuggaccucuguggccuauucuuuccucuauucugcacacagccaucaguacugucaucaucaaaugcaaaucagacuggaaucuguccugcuucagugccagcuuagaaaaaaugcaaagccuucagcacggaguaucuaggcccuauuuuauaccagggugcuucucccuccccuccaccucauuggaagcaaguaucuguuguaaacacuggagaguaggagccugaacacccggccacagagcagucuugggaaucacaugugaccaaagcgagcgucuguuauccagguuuauccugugugugcaccugccugagcagacagcgccuuaggcgaugaauuacuggcuuaguuuacauagcucagagcauugucuuucuguaugaccaggcccuugcucacugaugcuuucucuuacacuauggggccacgagcuucuccccugggguggaaaccuaggccuuagugcaguaguugcugaguggcccugaguuacugaguggaaggcucagaaauuguucgcugcauacgccaugcagugcugcaggagggggcucuaugaggccugggguauaguaaccuagaaaauggacaucuccccgcucucugccugcugcuccugggggguggggggagcaugcucuacccagagggagccuuugagaaacaacccugggagcagggauugucucuggggcugggaguacucagugcugagcuuccugucccaucagugcccagacucggcaugcaagcaggaccugcuggccuaccuucagcgcaucgcucucuacugccaccagcucaacaucugcagcaaagucaaggcugaaguacagaaccuugguggagagcuggucgucucugggguaagugucaguaaugaggcgcacuggccagucggggugugcugagccaugucuguagcagaaguagacuuuugucccuacacauuguccacuuucuccagacgugggaaguguuggaagcagaagcuacaaggcccgucuugguuccuggagcccaccagccacacaccaucucugcuaaacuaugccucuuuagcauggcaugguugaugugguccggugacagcuggaacuauuaccaagccuaaucucuuucuuuugcuagcuguucuuuggaaaaggguguuuuuauaccaccccuaccccacaaagaguaauuaacucuacucagcaauuaccaacuagagcuaugcccgcugcuuucucgguuucugcccacagagcuggguuggagcagaucaucaggucguaguuccugaggaggagacauuucucuaggucuguggagaguaugucuccauacuucccaaugggaccaagaccucaaaccugaaguccacagaguugggaguucuuucuguauugccaggaagugaccugaugucaagucuucccugccacuguccacggugccagugcuacccagccuuagcugcucggccccaucaagaaaucucccacucugaggacauggggguggugaggggauuuuauguguugucaccaugucuuuucaaaagcaaguauuuucagcuacauggauaagaguugcccuugucugagcaguacggggcuccacccagugcuauggcaaccccuugcucuuaaggagaugaggcucugguugguggggccaggccugcaugcaugcaggggucuaacccagcuugucacuacucaucuguuccuuguagguggacagcgccaugucccugauccaggcggccaagaacuugaugaaugcuguugugcagacagugaaggcguccuacguggcuuccaccaaauaccagaagucacaggggauggcuuccuugaaccuuccugcugugucauggaagaugaaggccccugagaagaagccguuggugaagagagagaagcaggaugagacgcagaccaagauuaaacgagcuucucagaagaaacacgugaacccagugcaggcccugagcgaguucaaagccauggacagcaucugagccugcacagcccaugggguucugaaaaaaaccagucacaugcuucacucaaauguauuugcuaaguagagaacacugucuuauuccacagggagguagcagauuucagacucaaccagguggugaauuuugcaaggacauguuuguguuaaagcugguuagaaaaaaaaagcuuuuagaauucaaaaauauauuucuagcuauauuuuuauaaguuuaaugaaaauaacaguucuguaaccaaagaguaccacauuaacuucuuggucacauuucugaguaggcugaagugccugcuuucuagguaggggugagcgccugaggggagagguugcuuuuuagcccuacuguugggcagauggaauuaaaugaccaaggguggcccaguguaaaucacagggcaccuuagacggucuggagaaggaagguaccagaaaccucuucugaggaauaaacuauaggagacaauaaaauauaacacaguacccaggaaguugauugcuuucuuuaugaagcagaaggggaauuaugacgcauggcuacaguuacuaauggacucugcugcagaacauuaauggaguugcuuuauucgggcucguguguugugaugcuguaaucagaacaugcuucccuguuauuccagcuugaaaugcaaauucaccaucgggcucauuucuaaucgucgcaguguuuccugcuuugggccagcaaagaagccugaugacugcauaggguuugcuuaggcaauacuuagacgcaccguguuugugacuacuacagcaaucaccauagcuacgagaugagauuuuacugucuuauuuaaauuuuaugaaucugucuguuuuuuacacuaauuuucccaauaaaguccauuaagaaccaa

SEQ ID NO: 12571 - RNA, 18019 nt, Mus musculus
guacugagugaaugguaacaauuuuauuauacacaucaucaucuguuuccuuuucacaucauacaucgguaacuagcaagaauuaaaaucccagaaagguacaaaaaaaaaaaaaaaaccaauugguuuauuagauccaaaacaguaaaauggacauaaagccaguuagagcuucacacccucuccuccuugccacuguacuucaucugcaguuaagguuucagagagccacgccuuccuccccucagguucaccuugcauggaagcaagaacuguaguaggggaacccagaaggaagucagaggugacuuuaguaccguccaaacuuucaucucuaacagucucuguguuggaaggacagaaggaacaaaugaggggaagaggggcugaggacaguugcuggggcucauuacccauaacguuccagagaccuguccaugucucaucccugagagggacaaucaucaggccgugagaguuugagggaaaggggaguuaauucuagaaccacauaugguuuccaaacccuucaccagaguuaguaaacacccuggggguacccaguucagaccuggggaaaccauacuuuccuucccaccacagaggugacaaggaacucuuggggacacagcauccaugcugcucuaaaucuccacaucacuuuccuugucguugucauggucgccaucauagaacucauugggugcuucuggccuguaaaacaaggaacaagagauuagaaacccacucuucaaguuccagacuccucccagcacccuccucagagccacuuuucuaugggagucuucuccaaagccaguuccucuccucuugcuggcagggacuuacugcaauccauguacucaauaaauggagacuccugugugccaggcacugccguaggccuuaccaaaacagcagagaaucagcuagacuagauuuccauacaaucucucaaagcuuacaucaugagaccagcaauaacaaagcucaugaaugaauacaauaacuucaaaugguggaguguucuacaugagaaaacugagucuggugugaacaagaggguaacaauggaccuacaaaaugagagaccguucugacaaugaaagaccuaaauucugugaagaggcuggccaggcaaagaucucaggaaagucccaccaagccccaagaaaaccaaguacagaagucacaagguccaaggaaacugagccauucgagaaugacaaggaggccagcaaugcugggaugcaugugggcagacaaaaguagucucagaagacgagucuguaugcagaucuguaugcagggcauguucaaacuguugcuucuaaguacgaggagaaggaaagguguaagcugagacugaugcagggaagagugucuuaguuaggguuuuaccgcugugaacagacaccaugaccaaggcaacucuuaugaggacaacauuuaacuggggcuggcuuacagguucagagauucaguccauuaucaucaaggugggaacauggcagcauccaggcaggcauggugcaggaggaaccgaguaggagccuucuacuucuucaucugaaggcugcuagcagaauacugacuuccaggaagcuagaaugagggucuuauagcccacacccagugacacaccuacuccaacagggccacaccuucuaauagugccacuccuugggccgagcauauacaaaccaucacagaaaggaaaggcugcaagacuggccggaagguaugagcagaagaccaacaugagguaugaguagaagacuggcaggaagggaugcacaaguggaagacugacaugucauuaaacuaccaggggagggaagugacagcaacacagggcucagaaaguacucaauacugguuuccaucucuuugaaaaccuuuucuaaaacaggccauuauaaagucacagaagaggagcaagagacuaaggcaggcaaacaaggccaucucuaucaccucuaagagcccaggguaaaaagugagaagucggucucucaggguaacuacagaaccuaagaaaguuacuugcucucucugagcccuggguucuuccucucgucaucugaggauaagacccaucucuuggguuaugcagagaguagagccagaugugaacacacaacuauagaagaaaaagccaaacccagacaaaaggagaacuuaaaaacagguguugcugaaccaacuaagacaauggcaaucaguuucuagaagucagguuuuagaggcuuguagacaacugcuaaagaaaagaugauuagauagagccugaaccagauauuuagauacuuccucacccacgccagggaauggggagguauccaugaaagagggggacuggaaggucccaaggauuaagaccaaguccagaggacagaaauggaggccagaauucuaugacccagaauagacucuggaggaacugagaagucacccacagcagcagcagagccagcuccaaccucaugcacagaagcucacagcaacucgaguggucucagucuuguaaauguaucuggucccuacuaaauauaucucuuuccaucuugauuucuuuugacucuuuuggguucuguuguccuuucucaucauuuucuagaaauuucuucaaggauuaacaacaaaaagaucuauacuaaucaguccuuauuucauucuagcuauaaauauuucaacauagauccaagaaagauaaagauuauuuacacacacacacacacauacaccucacucaauacagcucagaaaucuggaaaagugaacuaaacaaauguagagacccuauaaaagagaauguaggcaguggucuacugguucacugcucaggacagaguaaaaugcuggcaaauggagagacagcucagcaguuagguacacuugcugccauagcagaggaccugggaucucuuuccaguauccaaagagcagcucacaaccauccuugacuccaguuccaggagaucugacacccuaucaaguacauaaugauguacauaaauacaugcaaaguuaaacaccaugcacauaaaauaaaugaaucuaaaaauaaacaaaagauuuuuuauuuaaaaaaaaaaagauguaaguaaaccacuaaguucuuucuggaaaauaauuuggcagcaaauaugaaaaguucuacugcaugcauaucucauuugcccuaauggcaacagcuaugaaaacuggacccacucaaacaagcauacagagaaacauacauagagacauacauacauagagggauucagugccagucuucacuauuuuuguagccacaaaagaaagggaggggacggugcagugggguaaauauccacaagugguaacugauuacccucgcaaucaugugaccaccacacaauggaauuauacaacugagaaaacacugaucuacacacacugacacaggcaaguguaacuccaaacaacauauagaaaauauccucccacggauuaacaaaaaaauguauaaacaagcuggguagagcaagcaguccaugccuauaaucccagcauuuagaaacccgaggcaggaggguaucugauuuaaagaccagcuugguccacacagaggaaaccaugugucacccccccccccaaaaaaaaaccagcaacaaaucaagaaaaaaaaaagcuguauaaauaaaauucuggauaugcacaugugcauguaguauucuuauaaucuauagaaaauuaucuauucaaauaauacauaaaucaagccauaaauaacagcuacuuccauggaauaauucuggaacuacgugaacacaacauauuuugauguuuauaauauuuucauauuauuguuguuuuguucuuaaaagugucaaaaagaguagaaggcucgcagucuaaaggaaaccagccagggccagaugaacuugugccuucucacuuggaagccuucucugcaagccuaaggaagcaccugcccuccagccccugccccagaccugcuguaguucuccucgggaccucucucuucagcgucggccucgucaguccugucauacgucaggaggucugccgggacaucaugaaucuggacacugggugcaugguucagcaucuucaaguuuucaaagauugucuggcggaucugguccagauacuaguuuagaagaaagaaagucagcgguguuggggugauuccuauaguacaggaaauccuacccaccuucgucccugaccguccugaucuaagguaguauuucaaggucagauccucaguuggcaacugucccuccccaacaaccccacgauaagaucgacagugacagcccagaaauucuuucucuugcucucuccacuuccccccuccuggaccucuccugaacccccccccccauugcuguguccagccucuccaagcugcuaaccuggcgugaguucugauucucgaugcgggugcugacaucuggauggagugugaaaucuggggcaaaguacucgaaguauucuuagagaugagaagcaauugggagaggggaugaacaagaguauggcugagacaccagagugaaucccauggcuuucugaucuccucuccgaggccugguccccauguguaagaguauuugcucugcucugagcacagggauuuagucugcagagcuaccagaaggugcaauuucccuccaaacaaggucauucugaggacuggugagaauggugucccccugugguggcaucaugaaguggaucuuaccacuauagggaaguuccucacuaauggccucuucuaccagcagagauguuucauauguccugaaaccagcaagcagagggguuuggguugauggcgugggcugaaaggaccaccccuccaauuuuagggagucugucgugaaccacagaguaguagaacagaacacucaccaacaccgggcaacauuucggacaguguagccaccaccucccaguaccaggagagggauauugaaacucuugacauauucaacacauucccuguuagaaacaagaggacuagguaaaucuaagacaugugaccccagacaugacuggaaauauuguacaaagacuugaccaacaauauuucucugucauauuguguaguauaacucaaaguugcauucuuugugugugacuacuuguauaaacggguuugucuucacaugugugccagugcaugugugucugaggaugugugcauguauguucacacauguauacaagggcuagaagacauuuucauguguuggccuaaagauacuagccaccuuuuuuuuuuuaaccuggcacuugccaaguaggcuaagcuggcuggcuaccaagcccuaugaaucuucuggucucugcuucaccagggcugggauuacagaucauaaaugggugccaccgggccuaguguuuuuacaugaguucugggaucaaacucaagucuucauucuguauagcaagcacuuuuacugagugugcuagucacccuguccccaccuggcucugagcuauaugcuacacacacacacacacacacacacacacacacacacacacacacacacacaaacacacaaaugaacaaauaaaaauacuagcguacuuuacuguguugugucucagugaacauuuuaaaauaaagcacacccucacggccuugcuuacuacucuccgccacaccuggccugcuacccaacuacucccaucggugucgccaccagaaugucuguucuaagcuucaggacauaccuucauaccucguacuucucuccaucaacacaugcccugcccaaauaaugugauuggcuuccuaacuggcugcccacuacccacccugaccccaacucccacaccaacccuuucuucauuuagcagucagaacaguaacucucaaacucauuggacccugucacuucccuguuuaagauccuucaacgguuuucuaucacccauggaagacagggucuaauagcucugcacacucucagccuggccagcuuauagcaccugccuauguucuggccucauaggcuguacugucucuugucaagacaguaauucuuuuuuacuucggucuuagggcuuugcacuggcccuucacacugcuuggaguaggauucucuguucuccuuuuacggcucacuccuuagucuccaggucucccauuucaccuucucagaaaaccuuucccaaagcaugcugucuacuauacauucccaagccagguguggugaccugagcuuguaaucccagaauuucagaggcucaagcaggagggucacaaguucaaagccagccuaugccacacagugagcccuuaaauaaaacuguaccauuaaaaaguagauucccuguuguuacccugucuuauuuuuucccucauuagauuuuugauuguauguauguguaucauauacacauauauaugcaauaauuaauaauaauaacaacaacaaauuacaacuuuaaauaacaacaagaaggaaggcaacgcacccauguccucgaaugcugagauugaagcagccuaaucgaucacagcccagggagucagcgccacacugcaaaaaggaaaaucccaaauggcuacaguagcacgaaugcucagaacaucaguguccucuagcguccuuccucaccaacuuagggagcuuacgcuuccugaucuccuuccuguagcccaggcaaguccucuuagggaggugcuaagggaguuaccuggagcacgaugcacgucggcugguagaaguccaccaccuggcugaugacuggcuggaaaaggugcuuguaaccugggagagggccaaaggugggcaaccuggcaccccaaggggauggggagacagggaacaaaaggaaaaaggggguugagagagcauguagcccaggaaaggggcgacccacagaaccaaccacugguucugaacuucuggaggguguuacaacugccaaguuaaacacuagcaaccuuccucccagaagaauaaaugaacaaaacguauacacacauaauauaugucauacaaauuccaaggguucauggucccucugaaggccauucguccuuaaggaaaccuggcccaacaauagacaauaccaggcagaagagguuaauugaaagagaagaaaaggggagacgagugagcagagagaagucaucagaacuuacucuggucaucaaugccaucucguaagggcacauugagacaauaguagcggccacucucugcuccaacuucauacaugucaccuacagaaaagagagcgcagugaccgugcacaggaaguucccucaacacagccguuccucugugccuucuaccaccaaggcuccagcaaccugcauucacucaauacagggucacagcuauguaacucaggauggccaggaacuuguugcauuacccagguuagcuuugaacucuuaauucgccugucucggccaucugauuauugguauuauagguauguaccuccuugucugguucaaaaaauuuuacuuagccgggcaugguggcucaugccuuuaaucccagcacucaagaggcagaagccagccuggucuguagcaauagacaaagaaugaacauaaaaacuagaauaaauacaacuagcagugaggacucuaagaaaaagagaaggugagguaccuguuugacuuaauggaguggucagaaagguuucucugcagaaaggacauaauacuuaagaccagaaggcuaaggagucagucauggcagagagcugaaggacagccaggggcaauggcacaucccuggucucccuaauucagcaugcugauuauggaggauucuguacagacacacacacacacacacacacacacacacacacacacacacacacacaaagagcuaagggguacaaaaaaaaaacaaaaaacaaaaaaccacaguaauucuauucccuaccuguuccaggaaagaaguaauuuccguauuuguggaaggacacagucaugacccggucagugagguagaaggcuuccugaaccccgucaccaugguggaugucgauaucaauguagagcacccgagggugguaccuggugugaggacagagccauguucugaggaagaggcuuaucacccaguccucuccuccccaacacaaucucuggaauuauuuagagucugccucuggccaagucacuugaaaccucaucccaccagcuuccuccaggcuagagccuggggagaaagggaacaugcagcggggcugaaaugugagcaggcagcagggccaagcaggaagaagcaucaagaacuuaggagaagccaguggggaaggaggucagggcugggccacggccugaggaccugcaucccaaagucucucaucuccucuggcgauacuuacuuaagcagcuccaggauaccaauuacuaugucauugacauagcagaagccagaggccuguggggagaugguucuauaaacagaggaacaauucuucuauccagcuaccccagcacugucauucagccgaccucaccuaggguagccacaguuuuccccauugcaaccuuaccucaaauuucuuggcaugauguagaccaccggcccaguugauggcaauaucacagaucugaaagauaaacacccauucagucuuuuucuugcccaccacugaagcuggguuccagaucaaggcucuaugguccugaaucuggaaacccacaggaaaaaggaccaagacucaggguuacaucaccuuguuguuuagcuguguugcuccuugcagagaugcgccuguguaacgggagcagaacucgaaaaguccuggaaacacugggcugcagggcaaaaagugggugggguuaacaccccucuugucacuuucccccaccuuccccacccaaacuccaauuaccacugucuaaaacacccccuaccccuucuccagaccugagccauucacagaccuauccaacaaagguuuuagaccaaaucuuguaccaagcuuuguugcaaagcauaguacaggaagcagaaaaaugucuaagugccagggaguuuguacucaaccugggaagcaaaguaaacagcuucuuggguauacaagaaaugggagggagcuagcugaaggaggaggcuggcucaucacagaggugucugugugugucacacuuugucaugauguguaaugauauucuuuucaguuacaccuuuuuucuuuucuugagacaggguguauccuuggauguccuagaacucacuucuuacucuguagaccaggauggccucaaaccugccucugccccugcugggauuaaagccauucaccaccacugccuggcuuacaguugcacauuuuaaagaaagaacugcauuccuguuuauguggaacacuaacaaugacauaacuaacugaaagcuguccucucacugucagcacaguaagccacaugucaacuguaucaauuaccacuuccauacuguacgaucccacugauguaacagucgagaaaagaaaaaauacaaggauagagaucagaucaacagcugcuuggggcuaaggugaagagaagggauugaccagauuuguagaguaaaggaaauagucaguacccuaguauacugcaucaaaacucacagaagcaugacaccacggagcugggaagacagccuggucaguuaaagugcuuguguuacaagcagcuggaccggagucggucccaaggacccauguaaaaaggucaagucugguuuaugcuucuaaucccagccguggggaggcaguucuaagggguggcugacuaguuccaagccacugaaagaccuuguuuaaaaaaccaagguggcagccaggugguggcggcaaaugcuuuuaaucccagcauucaaggagacagaggcaugcagaucucugugaguucgaggucagccuggucuacagagagaguuccaggauagugagaacacagagaaacucugucucagaaacaaaaacaaaauggaacaaaaaaauaaaaaaaauaaaaaaaucaaggugccuaggugugguagaacaugacuuuaaucccagcacucugaagcagguagaucucuauagguucaaggcuagccagccaaccuagucuacauagcaaguccgagaacagcgagagcuacagaaauacugucaaacaacaucaaaaaaaaagcaacaagugcuguuaauggcaagucagcucuccaguuccuaguuaaaauauaauuuauauauaguaauuuugcuuuaaaaaagauuuauuuuuauuuaagaauuuguguuugauaaggagaaaacuaagcaaauugagaaaaauaagaauguaaucauaaauucuaagaaaaaaacaaaaaguuauacagaaaaauagguuaaguaauaguuguacuauugggcagcuuagcuauaaugauguaagcacagaugggcagugguugcauauccucuuaauuccagcacuuggaagguagaggcaggcagaucucugugaguucgagaccagccuggucuacagaaacccugucucacaaaacccauuaaaaaaaauuaauuaacuaauuaauuaauaguguaaacauagaagacugauuaauuuuaaaauguaaagauugggcaugguggcagacaacuucaauuccagaauucagggccagaggcaggaaaaucugugaguuuguagcuaggaugucucuagagaguuccaggccagucaaggcuacccaggaacuccaugucucaaaaauaaaauaaaagguugaggcuaaauggaguagcucacaccuacagucucacacaaaggaagaucaggaguuuaaggccauccuuggcuacauaaccuagguuccagaaacccugacucuaaauaaauaaauacgcaaacauaaaaccaagggggugucaagauguccuagcagauggggacacuccccauaaagacccaugaccuggacuuaaucuguggaacucauagggagaucuguucccacagacugucccucugaccuccagccauguaccacucuucaaaagauaagugaauaaauaaaugagaaaauaaacuucccaguaaauaaauacguuaauaauauaaacugugauaucaccgcauugugaacugggacaaaagcggagcacacuggggugguaugggaaaaugaguggcucauaccaccacaccaauggcuuaucagacaacccgaguacuuauaaaagaaacagcaguaagagauaauacaguagagaaguaugauugauuauaaacccagagugagaaggcagacaaccuguguucacccauguaguuggugguugugagguugggcagugagcuaugccccagaguucuuaucuguacaaaggagacuauaguaaguccugcuuaauaaggggcugagaaaauggcuuuaaggcauuuaaaacaguaccuaaagcauaguagguauuaucuaaauaguacagauuguagaaggaguugcaacaguaaaguaauuuuauuauuuugaaauguaaagauaaacaccacagcaaggcaugguggugcacaacuuuaauccuagcacauggaaggcagaggcagaugaaucuuuaaguuugaggccagccuggucuacagagcuaauugcaggacaacuacggcuacauacaaaaacccuaacucagaaaauaaacaaacaaauaacugaaauaaauaaauaaacaccagagaaauagguaaaaguaaaaugggaagagagauugauagauggaauagaucugaaauuguuuuuucccccaaauuauaauuuggcuaugaauaucagauuacuuauuuuuaaauuacaauuuaccuaggcugguguggaaccuacuauagcagaccagacuagccucaaauuauggcaagcuuccugccccaggcuucucagcugggauuaauaggugcuagccaucacaucgggaaacuauuugaaauuaauuuuaaaacaggagaaaggaagaaaaaaaaucccugauucuccucugaaacacagaacccauauaagcacagcuauaguuuacaucugcuggacuggcugagggaucucaaaugcccagagggaguguucccuuacuucccaagaauguuuauaggacuccagcugcaaccuaagagaugacucugcauucucagaccuggaaaccaaacugggaagaaaaacaacagaaaugaauuuuuaaaaaagaagaggaggaggaggaggagagacugggcaguggugccacacaccuuugauccaagcacucaggagacagaggcagacagaucucugugaguuagaggccaaccuugacuacagaguaaguuccaggacagacagagcuacccagaaaaacucuugucucaaaaaaccaagacaaaagaaaaaaaagaaaagaaacuguccaagacaguacgugacucaacaccaaaugugcagcacaccgaguauacggcagaacucuucaggccaaaaucaucaugaaaagcucuaugcaaagccaagcagugagacacaccuggaauuccagcacugagaggcugaggugggaaaaccagcaguucacugauaacacuggcuacauaaaaagauccugucucggaaaacaaaagaaaccaggaaacaaggugggaggggacaucuaucgagaugacucagcuguuaagguacagguuacucuccuagagggucugcacucagugccagcacccccauuaggagacacacaaccaccuguaaccccaccacuggggauuccagugaccucuucuggccuccauaaguaucaacacauguggcauacacacauauacauacauacacauauaguaaaauuguuuucaaagaaaagggaauuggggaacugcauggaaguggugugugggagcggagaaggcuuuaaagaggcugugaggagagccgagagcacucccucugugggagugagguaucaggaaggaaggugcucaggacagcuuauagagccugccuuuauccuacagccaggaccacgccaucagucggcucucucaguaaaacuaauuaggaaauccgcuuacaaaccugggcucugagccagaugugguggaggaagaccaaaacucagaggcuguggcagauucuguucuagucugcuuucaggacuacaaguucaaggccagccuggggccauguggcaugacuuuaucucaaaacaaacaagaaaccuagguuccggaucugaguccuacuacauccacucaucagcuaggugacucaagcuacacuagcaaauuuccccagaccuccauuuacuuagguguaacaccaggaaaaaggcgauugcaguccaguguugcuaugagaauugacuaaaugcaacccucagcgucaugcauaauaggguugggacucaacaaacaggacuguaggaaacaacauggaggaugaacaaccucauuucuucaagaaauaaauucaaaggagagagagaaaagacagaguaagucucaggagaccauauaaauccaaaccuuguuuggauccugauuuaaauaaaaugcaucaugcacacacacacacacacacacacacacagagggagagagagagaaauggacauauuuaaacacugauuacauuuuucauuaaagaaaaacguuuaauuucugaagucuaauacugauauuuuuaaaaguaucacuuagagauacauaauaaaauauuuauagauaaacguauguggcaucugggauugguuuuaaaaucaugugacacaaggggauacaaaugacuuaagacugcccagguauggaagaaugugccagaaucacagcacuugggaggcuaagacaggaggauuccaaguucaaggacagcauuacuaacuagugaggcccugucucaccagucauuuacacuaaguguugaagcugggcaaggagugcacucagauucacucuucuacucugcuuucagaaauguuugacuuccccaaugauaacuuuaaacaauguccacucugcuggggcaggccuguaaucauguaacugaagaggcagguggaucucugcuaaguuugaagccagcccggucuacauaaggauuuccagacaugccagggcuggauagugaggucccugucucacagguaaauaaauaagaaaauaaaacaaacaguacugaguuuuccauagcuauuaugcuuacuaguuuuggauuuuuuuaauuaaaugaauggauuuauuuauguauauaagucucuauuuguauguuugccugcaugccaaacgagggcaucagaucccauuacagaagauugugagcuaccauguggguccugggaauugaacucagauccucuggcaaaucagccaguguucuuaaccgcugagccaucccucuaggccaauacauuuauuauuuuucacuaauguaccguggaguguuaacaaggcucauggcucauuuuguugcccauucuccagcauccuaacccugagucuucugccuacaauaaacacaagcuccguguuaaccuggucugauuaggggugauguagcuuauaaacaaaaagcugaguaucaugcacaaaggacuggauucaauucuuaguauuauuuaaaaaaaaaaaaauuuaaucaaaagcuagucaugucaaaucauucccuggcuuuaaugaccuuaaucaacuauaggaacaaaaccauuaauuuaauacauagcuguuuacuuuaaauacaaacaaacagaacaaaaacagggucucacuaaauaguguaggcuggcccugaacuagcagcuuucuugcaucugccucuaagugccaggauuacagaugggaggcaccucaggccuugugcuuuaaaaaggccccagccaucuccuuagccuccucucagcucacucuccuauucauuuucuggacagcuuuucugauacucagagaaguccuauuccacccuaccacagcccuuuagcacacgcugccccuccuacccacauuucuccccucucccucagccaucuuucaaaccugaacucaaccucuaccauuucaucucagaccagcccugcucugaggcuagauaacugacucuuccaaguccacacgcucagucaugggccuccucacagggcuuagcaaagagagaauauuaaaacuuugucggggcuggugagauggcucaguggguaagagcacccgauugcucuuccgaaggucuggaguucaaaucccagcaaccacaugguggcucacaaccaucuguaacaagaucugacgcccucuucuggagugucugaagacagcuacaguguacuuacauauaauaaauaaauaaaucuuuaaaaaaaaaaaaaaaaaaaaaaaacuuugucauuuucccucaccaucguaucccucauacuuagcccagcuaagagagagcaaaugacuagcaggcauucacggagcaaaugaaugaaugaaugaaugaauucacugacuccuccaugaagaccccggccucccagugauugacagccccauccugcccucaccagucaucacccacguugaaggcauuaaggcucuuggugaaacccugcauauugguggggcugacucucugcaggaagucgauguaguccucagaauggaagcggcacaugucaugcugggaggccugguaaggcuugaagaccugggagugggcacaaaagggaagcuguuaccugaguacugccuaggugcuagcccuaaucuugcaggauaccuagagaccagaaguuccacuccggugagcuagccaaaacaggaucagccccagaagggugccagugggugaccaacuagacaagaccuuacuuaauuauaaucccaccuaaaugcugaaagacauucccaauaccacggcagguaacaacugccauggaaacaaguggaaaccaaaaaaggagagaaagggguugguuucugaauucccagaauuuuucugcuuagucucaggaaaaaacaaauguggcuuuucuuuaucagcagucucuuucucucuuccucucccuucauuuuuuacucuguaucuacaaauucuuuuguaauuaaaacauuuuaucacauuauuuacuuauucuuuguguguguguguguguguguguguguguguguguguguguauggugaagucagggugucagaucucuccuuucaucacugggguucagaguucggacuugagccaucaucagacucagaggcaggcaccuucacccagugaaccaucucugcaaccugcugaauaucuuauaaccuguugauccaugugaauugagauguuaucucaggagaacaaaagucccuuucacuguuccuuugacacauggucuuauuacuggcuccucacaaugccaggaaggggaagaaaaaaaaaaaaagacucaguuuggaaguuuggacaaaaaaaccuggaaacgaucaggcagugcucugccagucaccaggcugaaaccacacagagugaucccagcccuggacacuguccaaagcaaucuucuuacccccuauuccuuguuauucuacagcaacuggaagagggaagaagaaaggcgaccugcuaggcaagcuacuuuuaucaagaccccugaagaucacuucgucucccuccucccuuuggcccagucucuucuccccugucagccuugacuccuggccaugugcccugucccuagucccugcccucccaggcccgguuccuccugcacuuaucuccucuccuaaacucagacucugcucccuucucugggguuuucaccuugggguaaaauaugugagcuauaugacaaccuaacugaaacucaaaguaauaaaccaaagauuuauuauccuugguugggggacaaguggagguucaaacaaugcuuugaaaacugggcaaacaaacaaaagacacuuuuuuuuuuccucuucuagaaaaugcauaaaagaucacacagacaaucucaggggagucacagccuugcacuaagcucaccucagucuuuucuacucccaaaccacugccugugccucaacacacugauuacagguuaacuaucuucauagugaacaagggucagacucacuauguucccauuucacggcuauacauuccgaguaccugcauaacugaacugcaccauaaagacagagacguucuauguuaaaaagcaaauucccaggacaucuucucuacacacauacaccacaaagggugcagagcuguccccaagaguuguucuagcuccuagcagguaaaugggcagaggagaaggagcaggaacuauggggagaauauauucccagucuuccuccucaguccugaaccaccauccaccuuacagggcagaggggcuagaggcgcacuacaguagcagaacacucaccuagcgugugugccgcucuggauucgacccaccaacacguaaauaaaauaaaaugaugcggugaaggaacauaccugucuucaaaguguccccuaaugcuaggccaaaggcugaucuguccucaaguuaaaagggagucccaucuaaggucaaaaaccuaucucccuuuaagucgggggguguuucacuaccaccaccaccacugcccugcacauagggaauguuuccggugcccucuauccuucuccccucuccucuagagguagguugcaccuggcaaguccagcccaccuaaucuaaggccucagcucgcuuccaggcccaaaccccuacagaagugccaacacucacgaucaucuucuuauagagaccauaaugcaggacuaggcuaugagucaaugccaggcgaugagguuucauuggguguccagcuccugagggugggaagaaaagaguuggucaguccuuaccccuagaguugcagcccuugccgcagaaccucuccucccgcacaacccugagcccuaccauaguggaaguugcccacaucggggucguagaaauacgccacggucuuggccauggugcuggggggaccaggccccgagccucagcugcccgcccgcccgccaccggacgacagccccacccccgccgu

SEQ ID NO: 12572 - RNA, 12472 nt, Mus musculus
uccaauggguagcagguaagugcauggcuuuuacugucccuaacauaauguucaauaaagagauaagggucucauugaaauuaguauccuauaugucuaaaagccauauuauuuuuauacaguuaagaaucuuaguaggacaagauguuaaaucuauauaugccagucuggcucaguauucauacugacaguaguuuuuuguuuuguuuuuaaaagcauguauauuaaaauaccucuaucagaaugauuauaauuugaaaggaucguucuacaguaucaaaacugaaaugcuagcuagggcaaagagguacaucgaagaagcaauccuguggaucagaaaccagcucaaucagaguucugccugcauuugcuuauggguaagugugcuuucaggcagaugagaauuauguguaccgcgcuauccaccccuggcgacugcccaucucuggccccucccacuugcucugcagcaaugagucuacagcgagaugauuagagacugcugcucuuacaagucuaugacacgugagucaggaucccagcucacuuagaaagcucuaccugacacguucuaccacaggaggagaugccuuacuugagauuuuaacgcugguaaaugaaguacgacuucggcacaagcaccaggaauuuaaaagucuaacuugauuucuuucugcaccuucugaauguaagagucuccaaaucccacugcuacacacaguuucacaguuuuacguaaggucacagcggucucguuguggugcgugcuccuugguuuuugcaggaaggcucugcuucccucuuguucgccaaccucucaaguauacaaugcuaugugcuucgcuaauuuggguuguauuuuguaaauacacaaaaacguauauacccaacuccugaagagucuaagaugauggugcugcauugcacacaguaggucaucuauuacggaugguuuuauauauauauaaauucaacauucuccuuaauagcugaacauuucagaaguguaguagaguugaaaaaaaaaucuaaaagguuuuccaguauuuucuuuugacaguauuugaaagaugauugugauguuagagauuccuuguauaauugcugugucagcagugacuuaauucuggcuaacaguaaaauaugcugcagggcauguuagcucuccacugaucacagcuguuggucaucggaaugauuucccuaugccgugaaaccucacaauggggaugugcugauugucacauuagacauuucugcccacagaaaagcuaagcagcgugggaucgaauagcaacaaguaucaaacaggaucuuggaauuuuccaauucauuccaaaacaaguugacucaagucagagugaaauuaagcaauuaagagaaaggaaauugucuaguaacucuaaaauguaaacauaauuuuauauagggauguaacuaucugaauacauauaucgccaucuuucugauuauacuucaugacaacaauaguuagauguuuggcccuuccucagcaccaaguguauccauuucuguuuacacaauagggacaccuuuuuaaaaaaucaaucuaagucgaggcaaauauaggcucaucaucauuguuucacugguuucagcacuuuagaaaagaauccguucaaauuguggcucacucauuaaaauaucaauuucucauuugcacuauaauuucaaaagaacauaagaaauucagaguucuuugaaagagcccacuaugcacccacagaauugaaacacugcuaauucacaaaauaacaugaguaaggauuuaaaauuugccaaauauuguugguuuaaacacucaaaauccaguuaugucauuuguugcgaaagaguccaaacaaaaccuccuuuguuguuuacuguuugucuuuuaaaauauguaaguccuuccuacuuaagcuaaucuauaguuuccauauguccaaacaccagguacggcuuuauccacugggaacugggcuucuuucuaauaccuagguugagaaaacacaaugggacagguuaucagcaggauaauaucaugagugcgcacaacaaauaacauuuuagucagccuuuucaaaacuugauggagcaaugucucucugcccuagcaacuaucaccuuguaaaauuacuauuagaacaugaucucacagugaucagagggaaggaauaugacaauaauaugaagaacauugccugauguccacagccugaauguuuaaaaggcaaaacaaccaaauaaguaaguaaauaaauaaaaauaaaauugaaacgagaaaaagucaagcaggacucagggauccagcaaccaagccggcaagcucauucuacggaacaagagugauacaucugccaggaggcacagucauggccucugcaccaucuugcauuuucccuucucugucuccaugguuuuuugggcccagaaugacacauuaaugggcagagauaggaacagagacagaaguagguaucuuuauguugaaauauuggucaucaugcaaggaagaauccauuugggugcaaaucauuaacuagaaaggucugugaggagaaagcuuugcagagguggaaaaggccugacacaucugggaagacugagggcagagacuccaggaauggaacacaccaaauuauuggguagauuuuacaucacaccagaaugguuucaaguaucuaacuggcaugcaaaacaaucgguacuaaacuaacagugacaugucauuagagguggggagggggggccuguaaugacagcaugaggucacacacagguggccaucagacuguucacauagcuucagaugcacuacacuccugcucaaaaaaaaaaaaugucagauuuuucauggucuuuggagagaaacucaaaauucuuaguuugcuuuucaguuguucuguugaucagagcacagcugacaaacccaacuggaagcagccuuugcaaacacugccugcaacucacuccugcccugcaguugcccacgaaucugaccccuacaaugcaagcuccuugucaacucugcuuuuguacuuuuuguacuugagagcccucaaggcuaaacucacaugcuguccuaaaggcacucuccagucguguucuaaggaacacuuucuauggaacuuggaggugaaagucagaguaagaggcaaguaugauugcccuccagguaagggcuuuuccucuucugagcauuucuuauuucucacucauagauuaaguaggauauuuauuuuauuaagaauaauuaacuuugcuuaacguuauauuuccaucugaucaauacugcuuguuaaaaaucaaguacgaaccuccuuguaagaaagaaaggaggaaagaaagaaagaaagaaagaaagaaagaaagaaagaaagaaagaaagaaaggaaggaaggaaggaaggaaggaaggaaggaaggaaggaagaaagaaagaaagaaagaaagaaagaaagaaagaaagaaagaaagaaagaaaaagaaagaaggaaagaaagaaagaaacgaaggaagaaaagaauaucauuuggcuugccaaauaauacucacggugaaauugugcagccugaggcauaggcaugauguccuguguagcgaaugucacagcguacaacauuguuaguguagucugauucaggcaccagguagcugggguuuacacugaccugaacaagaaaaauagcaccgugugaaagauuuuauacuuaauggauacuguucuucccuccuauuucuauaaugcuacagugaaauuacuaacaagggacucaucuacaucaagcaagaaaaggaguuuaggugaagaagguaguuaaacauacuggagauauuacaaaaggaaguuguguagaucuccccaaguucuuuaaaaaaucauaacguagauugcuuaacaauuguucugaaaguugucuaaguacuuucaaacagaugguuauuuaauauuugaauccagaaaaagagaguggugguaaauuacacaucuucaaagccccuaccuuuagaauguaguuuccagguuguacaucuguaauaucaauccacuggcagucuaugucugccgcauaggugucauaacauccaggacucaaucccugaaaucagaaaacacuucaaaauuaaacuauaggaugugaccagacugauuauaugauauuaucuaucaaugaaaccuugaguuaguacccacaagaauuggacacaaaaaccagaacacacuuuagcccaucuuauaauaucuaguuauucaacagcugcaaguuugcaacaugaagaaaugugcccuacuucuaaagucaccaguagaaauaguccuaagcaacaaauuaggccuccagcaccauucaaaaguagcaaacauaucaggaagaaaugucucacaguaauucauuugcaguguccuauuagcgagauucccugcagugaccuuccuauguucuggaugacaacgauauuuugucuuguguagcuuuguagcaucuauucucuucugcuuuauauuaaaaucauauuauauaaaccccuuaaggauagguacagucuaauugcauucuugaauagcuaacauuuauuauuuaaccaaaaccauauauagucaguucucacaacuccagaacucagguguguuucugucuccauuuuaugguugagaaacccaaggcaugcuaagaccaaaugacugauucagggguaaaagcugagcagugacugagcuuguuucaggauuauauaaacaagguccagaauaccuuuucuuaacuaucacauucccucucucaaauaaucagugagaucuuuguggagucagaaggacggauuuuugcccaaacuggucaaagccauauccguccacuugcuaagacauuuccaccagcaagucaaugggugucucacaaggcugccaggagaaaaaugccaagaacauacauaugcuucuugcuaucaagagucugcagaaauuuccuucgguuggggcaugggcauuuucuuauuuccacaugagaacuuuuaacuguagcauuuccauucugauaauccaaaauugauuaagaagcguauugcauacccuagcaagauuuuaucgaaaggacccagauguagcuauaucuugugagacuaugccggggccuagcaaacacagaaguggaugcucacagucagcuaauggauggaucacagggcucccaauggaggagcuagagaaagaacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacaccagggccaaaaagggggaguggguggguaggggaguggggguggguggguaugggggacuuuugguuuagcauuggaaauguaaaugagcuaaauaccuaauaaaaaauggaaaaaaaaaagaagcguaugugacaaucguucgaacuuagcagugucauuuaaaacugucucuugaguuugcuuugaugcuuaaggucaucuuggucaacaaagauaacaaaaacaaaaaucucgaugugcuuuacugauguggguuuggcugcagcuggauuugggaagaguaagagaugcugcuguccauagcacaggacaacauagacaggccaacccaacauuacuuaaccacaggagcaagagccauaaucgccuagauuuccagcuugaccagcucucauuuuauguguugaacaggaaauacaaaggaaagaacuuuaagguucuaccacauccuucucugauugugucaccuuaggcacucgguaaguaaguaguaccugcuggugucacaaucauuacugcuaucucacauaggacucuaaauugugcacuggauuagauaaccauugcagacagguauaaguaauaccacuggcaauuaaaguguuugcaaaacgcuguuguuggccuauaccuauugucccaaaugcuagaugacgagugugugugugugugugugugugugagcgcauaugcacgagccugugugugcgugggcacacauacacaaacuucuagcugacacuauuacuuuaugauucaccagcuggcagaaaaugugaauuuugagcuuugcuuauuugaacuaacaagcaaaugccugaagcugccaaggccauuaagcaaauagacuuuucauguauuugaaguccauugugaaaauaaauugaaaauagaacuucauugaagauuaucuaaauguguucuuugguuucaauaaaaaauacuugucugcaacauuuggucauugagugugauguaacuauuuuuaaauugugcauauauucuguauguaaauuuaugaucuuaaaacacgugguuagauauacaauauauucauaaguuauaccuaguuagaugcuuauauacauuuaaggaagacggcacuaguauaacaaaacuaauaaaagucaauauuaggggccuaugugaauguuuuuucuauaaaugaagucuguucaaaggacuauuaaaaaacacaaauacguaaaucacuuacaaugcaagaccuagugaagaauuuuuaaggcaugcacaggaaaggauaaacaagaaggcuaccacauuuuuuuaaaaaagugagauuacacaagugaauaggggugccucugccucuguggcugaaguauacacccuuccccucccccaaugcaaguguucuagcuuagagaugauuaacaugugucauuuuaagaauagggaaaugcaugcuccagguccucuuggggugaucacugaaugcgaaggcaaucucugcaaggguauaugcuuaauauauggguguguuagauuuuucacuuaaagcauauguccugccccucccaacguauguuaaauauaacuguuuccccgucuaaccacuuugaugagcuaagcccagaggaaagaagaauggucaccacauguaggucaccaaaaagcuucuggccacaguacuggaaucugcuucccaagaugacagccgcugaggucugugugcccuggguaauguauauucaggaacuacuugccaagagcagggcuggaguaaaauuauaauguccuuuuacaaauuaggguuguggauggaaauacugacauaguuuuuaacugacccacauuuuccaauucuaagacauacaauagcgcucaacucagcacuauuaaaaacaaaucuauccaaaggacaucugacauuaauuacaccggagguuuaaauauacauguguggaauaagaaacgugucuuucugcucugacuugcauuauuaaaagugaugcuguuuaaaguauuuuuaauaaccugccuucaaaucuuuguucuaacuuuaggcacuauuccauauuaagcaugaaaauggaaaacaaaauggauuugcaggugagaaaacagacguauauugccaacaguuauuauagcugauugaagaacacaggaugaaggcagauguuguaagucacucauguguauucagaaacuuaacuacuuuucauuguguuaugaagcaaggauccacauugcccuccugugaucuccagcagggguuacauguacagcuggaaacacuuuaaaagcaaucugcaccacccagucaucucccuucucccaaucugaaguaucccauguugauaagguaaccuuaaaaugaaacaaaauauuuuuuaaaaaagaagagaggaaagaaagaaaacagcaacugacuugcugucacuuuccuggaggucugugggcuccagaugucaggggaccugccuaccugugugugugcagugcacgcaaagcgccugugguacccauagucacaggacguguccuccagacagaagcuugcuuuguggccuucagccacucuccucuguguguuggcaucaagcaggucauaguggcugaauucguccaugcugugguaaugucuaaugucccacacaacaaagaaacagcagucaguggcacauagacaaagcaaugaggaugcuaaauaacuuccuugacucauaaauuaaauggugcugugcucacaaauuaaaacaggauaaauucaucuucuuguuuuuauuuuuuuagauugauuuauuuuauguguaugaauguuuugucuauaaguaguauguaugugcaccaguuuccugccuagugccagaggaaguuagaagagggcuucuaaucccuuggaacuggacauuugugaaccaucauguggauacagggaauugaaccuggguccucuccaagugcucuuguagagccaucauuccaacccagauauauauauauauauauauauauauauauauauauauauauauauauauauacaugugugugugucuuuccucuugaaacuuuguccacuccauauauauguguguguauauauauauauauauauauauauauauauauauauauauguauaauuauaaauuuccucuugaaacuuuguagcucuggcuguccugcaacuuacucuguagacucuugaacucagagaucugccugccucugccacccaagugauggaacuaaaggcauaugccaccaugccuggcucccaaauuuaucuucuuaaagagauauucaugccacacacuuuuaaaagaacauugugagguuuuuaacuuuacuaggugguaaagacacugugguaucgauuccuuuauauaggcuuuauguuugaacauuaaauauaaacaauugauuauauguccuuguaaccugugcaguuucuaguguauuucucuggcugccacugcugauauuggugaugugcugaugauuucaaacaaaaacuauacucuggagggguugcuaugagauacuaaaaacuggaguugcaacauucauaaaaccucuuuggaaacgugaaggacaagcaacagcaugaccaucuaucacuauuauuuaacuagcacaggcuuuuauuucaaaauaagauauuucuauuuuaauauguaaauauguggccacaguucacuuuucucuauuccuuaaauagaaggcucugagcucuuccccuucucuugugggggaggagcuacaaugagaaugggcuugaauuucuguaagugggagaccacacaucaugauuuccuggcauuggcuacuugaccacauuaccuaagcaagugauggcauaaccacauguaauuuaaaaauuaaaaccguuacauuuagaaaggguagggcgaccacucuggggcugacaggggccuugcaaaagauacaagugaauuggguccugaagucuaucuuucacugagaauggucucuaaauccuuuggguaaaagaugucgugcucuuaucaaaugccuuucaagguuaacugacugcagaucgucuugccuacagcagagacuuuaaccuaagaguaaauucuauuggcagccacccucucuccuuucacucauuuuuuaguggggaagaggcuaucuuaggguuuaacauccugugauggcaccaaacugcauaggaaaaguucuaaauauaaauaagaucaaaucucuagcauuagguaagacauaugaauagccaucugaagaaugggcaccccagaugagaggcccauucacuuacuggugacagcugugccacucccaggaguaccgagggcggcuugguaagaaguccgaugucccuugguucuucacucuuugcggaaaucguagcaguacccuguggucauagucucugacauccgcccuauaugcugaacugugaguuuagaaaagaaacguuagauccucugaacauggauggaaaacacgauaggaagaacagcucaccaucacaagguccuagcagcccccucccucgacuagccucuccgcucaagggaucaugaguuccuguccaaucccggaggaauaaacccauugcaacucucuggcgaaugagugaaugauggauaacaguaaaaucccagagagauugagauuaagauuuauacucucuuuauuauagagaagagacuaugaaucuaaaaaacuauaaaauugccauaguaaaugaucccacgccaaaaauuucauagguaucuauuaauaacgauauaucuaagauagaacguggagaaauacucuaaaacuagauaccuagauuuagauagauaacuuuauacuugacaucuaccaaacugagggcgcuucuuuaauaucuuucagcacucagugguauggaucaugccauaaagaacacaaaccagcuugaaguucuucccuuagcgcgacuguuguaaaaagucaacacggaauaaagguucauauaaacgccccuggaacgcuacuauauauauauacacauauacauacauauaugucuaucuguguuagaguauguuagugacccauuuuacuuagcauacuaccagaaccacgcaaacaucuugugcucccucuacugguggccagcugcagaaucaaagaauuccaagaccagaauagcuauuuuauuuuaggacugacggaaaacaaaacucuugcuuguggucuuauaccaaaacaacccaguuaaucacggccugaaagaaauguggaauguacucuuuaccaaugggggugggggaggacaccgugacgaauacaccccuagaccauuagaaaauaauaagugcuuccuuuauucccacacccuccccaccguguuguugguuguugaacuucuguuuuauauaaaguuauuggaagaaguuggcguuaaugccuaagagguaucuugggaaagaaccugagaccuagucaccagaauaaggguuuucuuuucccuccccggguaugcgacuuucacugaagcagcacgcauaaaaacauuccaaauuaacucucucuccaagucagcaugcccaggaggucaugucccacuucccagcccuugucccacuuccuaccccuugucugcgcugaauagcagucaaaacuaggaucaaaaccuaagaccgggcuguggaaauccauaccuggccaggcaguuuucuuccgcagcgcaucucagguuguacauagacaucuucuggacguacguggaagccuggauguaguaggggucgggcaccagguccgggagaccuaaagauaagacaagcugaugaccucugacuccuaaaccuguuugucaccuuucgcccaccaagucugcaggguggggcugaguguguggaagaacagggaaagucgggguuaggaaggaaagggaaaaggaaacugcuggugccaggagcgcgguuuccaucagauuccagagcuggcgggacaggcugggguuggggguuggggagggggggcguuguugagucugcgggaccggaucccgccgccgcgcccaggccgccacgucuagacagcacugaccggcggccaggguggccgguaccuacgguggaucuaggggugcuuaccguacuggaaguaaccggugccguauccaggucgguuccugcucccgggccggggccucucauacgugucauaguaguuauaauagggguugucgucggaguacuuguagggauuguaggggucgucgcccaccaugcgaucuauguggcuggguggccucagauuacugagcugcggaggcuguggcgaugcaguccgguucgccgcgcgccgugaggcuccaucgcgagcccccgacggcgagaaaccagcuuggaaccaguggcgggcggcgggccggggacgacccgcggcgaccccagacgggcuuggcguccucgcacggguagaggcggugcgguugucacgcagcagaagaaugggcgugcgcggcugcgaggcugcgucgccgucgggucuccgggcaguggcacuggggucgcggcgucgcugaggcugguacugcgccccgaggcucagcagacugaacaccugcccguuguucucccauuggauugucuggcgccaggcaccaggggcggcgggcggcucgcgcggggucugcggggcgcagcggagaaggggacaaagcugcaguggccccagaaggagcacagcccaggcgaaacgcauggugcucccggcucgucccuucucggggaggacguggcuaggagaaaaaggaagaccgggacucagaucccacgaaggagggagaccucuccgagcagggaggagaagggcgaggcgcggggaugggucgcagggagucgugccagggcgaacagcagacccugcccccagcccaggcugccgucggacguggcacgguccuccucuccccuuucccagcccuggaaggcgacggggagcugcgcacgaaggucugggaaagcgcacagagucuggaguagaaggaggaggagagauuuuaaacuuucugaccaguuugcaguuacacaagccguucuggccccgcugccccuccgcuauuuguucacguaaugugauu

SEQ ID NO: 12573 - RNA, 1668 nt, Mus musculus
agagaaugacuccaaagcaucuuuuauuuauacaaaaaggacauauuuaguaaaagacacaccaaaaaaagagucggcuguggccccagagaugaggcaggaaggucuucugcacuccuguugaagaggcaggagguggccugggcuaagaguuaaggaguaagugcugugugguggggccacagagaggagcaagcucccgucagaucagcacugugagcaggucauggaagggacucccaguggccucccagcacucccacagagggaggagaccaguuuguacagccaacuggacgaagaucugcuaccugguuccuggagggugcccacuaagggacacaggacaggaagcccaggauaggaagcaacuuggggcgcgaaggccagggagaagcaggcgcucugcaguggccagaaaggucccggcgaggaggucaaggugcuuccuguuacgugcgggcauugcguucugucucugccaagcacucucugacuagugcccgagcguggaugaugccuggggugcggugaggauggggaaguaauaaacagggccccagaaacaguccacagccacccuucagagcagacacucccccaccgcuccaugguucagcaagagcaccucuaaucuaaugaggauggaugggauuaaggguuggcuaauccgaguucccaggcaccuucuuggaaacagacucauuugaaaauggaaaaguucauuuaaaaccccuccuuagguacacguucuguuccaaucgaggcuggcccaaauguccuguccugacucuagauauccuccauccuuacugaacugucuuaaaguucagugucuguguccugggcagagcaagggcaggccuguggcuucacuuaccucucuucaggcgcuccauggcacucuugcuaccagcauaggugggccggaucucuuugcccaucuccucuaugacagacagcagguccguguaggugcucugagagcccugggaaccagguggcuucaucgccugugucaaaagaaaauacagacgugaucucagaccccgaggggaucuccuguccucagccauaagcaagcucuuggccacacucaccuguacauaccccauggagggcggaccaaagucguuaaacagcggucugaaaggugcggcagcuccuggcacugagcccgauggcgaugggacacucccggcugcaacgacaccagcaagaggucagagugugacaagggccucgucacagauuuccaagcccaggacuguucccuugacuaaccuccaacggcaugcuucuucauuccacucugaacaacuucggagacacacuccuccccccugcgcuccaccuacaagcucuacgugaccacgcccacuucucaggccagcaaacugaggcugagccaggcucgucuagcaggccccggauugcaaaacucgagcgguuucucuccaagaccucgacugcccggacaaggcgaacaaggauggaguuggagccucaccuguagggaccggggugccuggcccgggggugcuggagcccgggguacugcugggggcgggcgcgauagguuuguaggacaucccaacuccucagugcggcggccgccagccggccgcuccucugggguuggcuguccggcagcucagccgcacucug

SEQ ID NO: 12574 - RNA, 10711 nt, Mus musculus
uccaaaccacgaaucgccccaaguuuuauuuguaguccauacaaaagaagggaaaagaauuaagauuucuaacaccaccuacuuggagagauagggaauugggacuaugccagucaccaucagcuaaaacaucagugguaagcggggauuuggacacggaccaacugacugucccacaggaucucagucucaacagccucuacagaaggacaggcagggccccuggacugcuggcauagcugggcacagaggaaauagcuaaaguaacccuuuccuggccucccucgcaucuaaaaagaaaaacgcgccgccugacaucagcugucgguuguaucaccuccaaacaaccuuaaguaucgcgcacaaaaauaaaagggagccaggaaaaaaauuaaaauauaaaagaaauucccauucuggggagauggcuggguagagggaaaaccacagaucuaaagccaguagcaagaugugcugcugaggcaaagaaacaaagcagguuacugccaaacacaaaaggguccucuccuggggaaggcccacaugauagagggagggaaugaaaagccaccauugggagagguaugagagaggguggugauaaccugggucugcacccuacccuaccucuuccucucucucccuuccuguggugccccauccccaggauggcccuacaugcggcgcugguagccagagugcaucugagcugcccgcagguaaucauuauaggagcccgaauagcgugcguaaucggaaugggcaucgggcaggcgacgguaauccagcgaggacuuugucggcgagcggcggaacgaaagcugcgacucugauaaacggcgguaaucagagagcucggcuaaacgccggucggaaccauaccuagucgagagaagaagacaguuggugaaugagacaguugagggcagggcuccagguaggccuaggggagaugccauuggggacagggaggguauaccagauuugucucaaacaguuggugucccugucagaaggcucaucauacuauccaggucaaggaaccaaccuggguucuucaggucagugggaaaccaagcccucugcugaagcucccuuccaaaccagccaaggugagucuggucuacauucccaaacaagcuauucccacucaugggcccugcacaaaaagaccuugguuuaucaacagaacgacggacgaaaguaggguccccaacuucccaggguggacgcaccucauaagcuugccuucagccagugagugccaaaaggacuacuuucuuucacauccaucccaccaaaaccagaacaaaggagugaguuuaaggauccuucagacagugggaaaaaucuaugagccaauccugcaaaauguggcuccaucgguucauaggggccuccuagaaugaggacccuaaguuuguugguaucaccccaggcugagcacuaugccccaccuaaaucccaauggccagaacuguucagacacucacccucaugacuuuuggacaucccauagaaguaagaucaagggaggggccaauggcuccuguuucccucccaugccaaccucagccccuugcccuaagccccagcuaggggcugaggcggggggggcauacaguaccuuuuugacauggcgacagccuuuuuguagggaucgucguagcuggcccgggguggggagaggcggguacgcucauagggcggcggggugcuguuggcguuggcaacggcccccugggacauagacagguaggcugcugauggcuggccugucccaucguaggcacugcccggcuggccacgguaggaggcagcagccuggggaugcugcugggcagcauaggaagcagccaaugaggcugaugacugagugcgguaaggagcugccaggguggcagaaggcugagccccguaagcagcugccgccccauaggagccaguggccgcagcagcagacugagcuccauaugagccugacaggccaauagaugcuugagccccauagcuauucagcugggucugaacaacugguugagccccauaggaaccagccauugggguaguggcuugugcagcauaggcagcuggcuggcuagcauaggcagcagcuguggcugguugugccacauaagcagcaggcugggaagaauaagaagcagccuguugugcagcauauggggcagacugggcacuguaagaggcugagggcugggcacuguaagacgcugccugggcuccauaagcuagugaggaggcugcagacugggcaccauaggaggcugcuugagccccauaggaaccuagggaagaagcugcuccuuguguguuauaggaagaagcagccgcacgaaccccauacgaagaggcagccugggcgccauaagaggauggcugguuaccauaggaagcaagggaggagcccugagccccauaggaauuaagcgaagaagcugcagcugccugacccccauaaguggaaagggcugaggcugagggcuggacuccaccauaugggccaagcgaggaagcugcagcagacugggaacuagggcuagccagcugaccccuguauggggccccaagggagacagagggcugagcacgguaagaagcugccugagcugccaugggcugaguccgauagccaacacccaaagaggcggaaggcugggcccuauaugcagcucccagagacacugaggguugggcccgguagguggcuggcugggccgucagaggcgccacauaagaggcucgaggaggugaacggcgcagggggcugcggucgcgaccaaagaaugguggugugggcugacgggcuugcccaucaaagccaccagugcuguugccaaaagccugcugguagucgaagguggcagagaagccaccaguuccagggaaugcuguguccccagccccugguuucuuggucuuguccccagacuggauagccagggcaggccccuucuucugccccuugguugagaguuccacguugaugcgcuugcccuucacuucuuugccguugagcugcgcgauggcggcuuuggcaucugcuuccuucuccaugugaacaaacgcguagucugauaaagcagcagacagaggguuagcaauuaggggggcagggcaugcuaccuagugggucccaaacuggacacacaacagcacccagcuguugccagcuacauccaggucucucuaagcccuccucuauguaugccaugaaauguggccgaugugucaccaaacguuugacuguuucaagcagucagccaccuuuaacuuuggccuucuguuccccugccaccucaaccaacuaacuuucuggugagaaaaggaaaaagcaaagacgaauucaggauaaaaaucuucacagcggcuauaaauaaaaccagcaagcaaacagaaagcauuccuagaugacucaauuacuccauuuucucaauucaagcacaucuaauacugcuuacugcucaccucuaaaucuaagagcauaaaacacuaggaaccacucacauuuuggcaugacucacuucucagucuaggugcauuuagaaaaaagagugacuacgagaagcagucacaaaucccuccaguguaaccuuccccuuucacauuacuuuccaguuuucacggucacuucauacacaagaagucucaacaauccuguaaggaaaagaccauugucuucucuuucaggcaaguaugaucaauguuuuuauguagcuugcuguaaaucaaucaaugccaacguccagcuaacucuuccauggcccuuuguuucaucggucuuuauccugagaagucucuguaauauuucuaaaaaugcuaccuugcacagaagcuagaagauaugagaauagauauaaucccacauuauucccucuauuuccucuuuuagggacagaagaauaccuucgccuuagaagacuauuuacugcuuuuucagguuuaccuuuguggcaugcuugggggaggggaggggggaggauuagcauaggaagggucucacacgugcugggcaugacugaguaauaccaccagccaccuaccuaggcucucucauuaaagaccugaguaaguuguguugggagaaagucaaagacaugauacugaucugagaacucuaaucacuuacaacauaggaaaaaaacuuuaaaggggaagaaauucuugguaccauccauaccacaaacuacaauagucccauaagcagugucugaggagcaaugaucaggaccuaucugagaaagaagguucugcacucaacuccacucgggaccuguggcuacuuuaagggauucaacagcuaggauccaaucucugucacaucaauuuaagaaguaaaaaaauuauccggauggacuaagguuccauuuuuauaaaacagauuauuagagaugacacccaaacgccuccaaacaaauacccuccuuuuagggcccuuauucugagaugccuuaucuaaacuguucacuuacaacaagucaucuccuaaguugaagacaaugaaaccuccaaagaaauaaaagacaaaagccaagugcaguauaaugugaaugaugcuggacuaaaaauucaaaggccaagcuguauuagauccacccaucacugacuauuuaggugaccuuagagaacuuccauuuauuucccuacaggaaaaguuuauccugccaaccucaaguuaaaaguucaaguaagaagacagaaaugccuugugagguuuaaauugaugaaggaugauaauggagucgugacaguucuucaaaccuaaacuaaccagagguuuauuucccuagaaaauauuauuuuuaaucucuaauaaagcauaaugcuacauuauaaccuaaaagcugcuuaccaugacaaaaggacaaaaugaggcaggagaguugggucaaagguaguaaagagcacugguucucucacacaggguccaggcuggguucucagcacccauagagaggcugacaaccacuuacauauauauaauuccaguucccaaaaaucccacacucacuuaugaccuguguagguacauauacaugcaggcaaaaauauucauacacaagaaauaaucuauuuuuugugggaaggaaggauuugagacaggcucucacuauguaguucugguugcccuauaaaucgguauguagaccagcuggucuccaaaucagauuccuccugccugucuuccaaguaaauaguggauuaaagguguggagcacuaugccuggcuuaauuuaauuuaaaaaaaaagugaauaccaaguuugaugugccuaguucaacaaaugauagucuucaauguccccaaauuugaaagguaaaccguucaucuagccacuggauauuucguuuguuuuauuuuuuguuuuucgagacaggguuucucuguguaucccuggcuguccuggaacucacucuguagaccaggcuggccuugaacucagaaauacuccugccucugccucccaacugcuaggauugaaggcaugcgccaccacacccggcuuuuuuguuuguuuuguuuugccacuggacauuucaauuguccuuugauuacugaucuccacuugggaugaaucagcuaaaaauagcaguuguggucuaagauuucuauaauaaagacagagagaucaggaaucguaaagcuugccuacaagcccaacauuuaggaggugagguagacagaagaugaguuagagaccagcaagagcuacaaagugaggaggcacugccucaaaauaaauacauagacaaauaagcaaauguuuuuaaaaggcugaacuaacuugcccucaaccaggacaauguaauaacaggaacacccagucaacaauuaagagaaagcaucaagauagcuagagcuuaaagacagaugggaagaaauccgccugccucugccucccgagugcugggauuaaaggugugcaccaccaccgcccggcuggugguuaagagcauguucugcauguucacaacucccuauaauuccaggggaucuaaugcccucuaguucuagauuacacauauaaacauaguaagaaaaauaauaauaaauucuguguaccaccaugaacacccaccuguuuaucauucuauucaaaaaugagcuaggaaaaccaucuaacaaaaauuucaauggauuuacaagagaaauuagauaucccaucuacaccucauaccugguuuugaguuuaaaaggccaagugcuacccagcauaugguagcaaucaggaggaaagacaaggaggaccagagauuggaugccaaccuaaauuacucagcaaggcccuguuuaaaauaagucgugagcuggugagauggcucaaagaacacuggcugcucuuccagagguccagaguuuaauucccagcaacuacaugguggcacacaucugucuauaaaaggaugaguccucuucugacauauaguuuguacaugcagagcauuccuacauuuucaaaagcauauagccgggugugguggcgcaugccuuuaaucccagcacuagggaggcagaagcagacggauuucugaguucaaggccagccuggucuacagagugaguuccaggacagccagggcuauacaggggaacccugucuuggaaaaccccccccccaaaaaaaaaaagaaaaaguauauaaauaaaauuuaaaaauaaaaauaaaacacaugacaaaucagaaaacuaagauuuaagaauuggcugaucauaguggcauauacaccuuuaauuccagcacuuguggaucucugaguucaagaccagcaaguuauacacaaugaauuccaagacaaccagugcugcacagugagaccacagggggaggcagggggagggggagcccacugcaacaaugaaaagaaauucaagaacuggauaguguauauaugacaaguaugaggcccuugguuugacugcaccacuacaccacaaaaaaauaaauaaaagcaagaaggaggggagaaaauaagagagaggggaaagaggaacaauacuuucaaaugaguuaguucaaauggcuacccaaaugagcucucaugagggagggccucugauacaaauagucauuuucuaucaggaaguuaaguuucuaagccugauauuagaagggagugugagguggguauggagguacacaccugaaauaccagcuccuaagagguagaggcaauugagaucaggacuucaagaccauccucagcuacacagcaaguucagccuggacuguguaagacacuguuucaaaaaaggaagggagacuggaaagaugcagccuuugagaacaccugcaacuguuguagagaauccagaaucaguuccccgaacuccaccaucccuccugaccauccugaccucugugggcaucaagcauacacgcaauacacauacauaaauacuggcacucauacgcauaaaauagaauagaucuaaaagggguguguguguguacagaagauguagcucagaacaaggccagggagucuaaguuaccuaguugaugagaccuaagacucauugcaguaagucaaacucagaccugucaaagacacucaaaagacuaaugggacaaugaagagccagacuuugaagaaccugcauggagaacuacuucagagaaaccacuacauuaagaauaguaagcugggcccagcaauauugcacuccuguaaucucaaugcuagggaggcagaggcaggcaaucuccaauuuccagggcagccagagcugcacagauaaacacugucucauaaauaaauaaacaaacaagcaaacagacugacuuucuaugguguuuugacucuagcaacaagacuaagagaguaccaaaaguuuucccaaauaaaacuaaauacuuucaacuuaaauuaacaaaagauauauauauauauauauauauauauauauauauauacauauauacacacacacacacacacacacacacacacacauauacauacauacacacaggaagaauggcuguauuuuucuuaucugauauucaaaccucccuugacaccuguaugauuccugaaacuguucaucuuugaauaucuaguaguauauagcuguggagaauaguuaucauugcugcuauggagauuuuguucuacaaaucauaccaaagcccaaguaaccaaccaaacuacuaugauuguuuguuccugugaaauauuccagagcuggccaucgauuuaagaucaagcuucugcacuuuucaagcccuggaagccucagccccucccacgaggagcaagcuacugauagcaucagagcugcucuucuacuccaccuccauccugaaagccugucaccccaacugagguaccggcaucaguagaaguacguucaaaucucaccaaaucucuuacagcaaaggauagagucugugucauaucagccuagaguguaguucugcuauaaauauguuuucaaaaggaaagaaaugcacaaaccuucucucacagagaaucuaguucuacaucccaaccaccacagucacugacugccagucccaaacaaauucaagcaaauuucuggccuaccaucagagaaaaagcuuauugaaccauacaaauuccaaaggagucugucccccucagguacugaauucuacucccacucuaccauccagacuaccuaagaacuacaaaaaaaaaacuagauaggucaauugagacucucauaaaaacucauacaucccaugcauuugcugaccaaguacccaaacugagaccuuucccacucguuuacacuaaacagaagcaaaaacccauaaaucacacagccugcuuaaaguuugcaguaaagucagauuccagauauaaccugaauugaaggaaacagaaugcaguauuagacagaacaaacauuucguuccuauaaaugcacauccuaugacccuucaccccccucuuugaaaagacaaggaauggcccaaaguugugacuuuccagaacagcaaaugaacccuugaugagaaugagcaagcaccuauacccacauguaguuccuguccucaaaauuccuuacaaggcacaagcagauaugaauccaacaacagcacaacuagggaauaaacaaggccucacucccagggugcacuguugaaaaugacagggcaaaguuaacucucaucagugaaacccacaucggucugggugucucauaaaaucuugccaacauaaaaaaagcagguauuugaaagauaaagagauaaaaccccaacauaugaaaaucaacagggucugaaaaagacauuuccucaaaggaaauagcaaacuagcaagcuguccuaagaauuauucaagcaauaaaaaguacuaacuaaauaaaugguguuaaaaccaaguuuaauagaaaucucacacgccccucucaacaccccccccccccccagccagaguauuccccuuugcaaucucaccaagcuaauaaacaucugugcccggaggcaccagcuuagcaaguaaaaggcuaacgagggagaggcuuaauagcccccuuucacaugcaaaaauaacgcagaaaaccggggcuuccacuuguuaaguuguaaaacccaacacaaaguggaggguggaggaaaagaauuaaaaagcacaaaaccgccaaggcuaacccaucgaauacugaaaggucaaagggguuccgaaaaggccccucccaugcccacaagcagauucauuccagacaauacuaaaaaagcccgaacccgagaaaccaagggcccgcuaccuuccgggaagcaucgggaaggaacgccagagcggccuuggggcuucaacccaaccuuuucccuuuucccucgaucugaccaaauucuggagaggaaguggggaaguggcgaacucuuuucaccgcuccauaauccgguuggugcccuucccuuuccauuucauuuuggugccaggcucaugcaaccaggaaaaggcgccuccucccaaccccgcacacucgcaaaucucuggcgcguccccagccccgaggcuucggcuugcaguggccacugcacccgcccggaaccgacuccucccacuugaugaauguugcugggaccgcaggggagaaggguggcucuacccaacucgcccccagcaccuuaggccccgcuccugcacacuuccccaucauucccaacccugaggaccaaccccagagugaggggcguggcuaagaggcagagagcaccgcgcguguccccucccgagcgcgcucccgcguuaccuuuuaccacgucacacucgaugacgcguccacggcgcucgaagaggcugcgcaauuccugacuuguacaugcagccgauacauugcccacgaaaaucuuccaaguguucaggggccucgggcgcgacaucuccaccacgagcgcgcgaccuggacgcagcucguggccaugcagggccucgauggcgcgcaccgcgccagcguucucgcgcaugugcacgaaggcaaacuguuucaugacggcgcagcucaugaccgugccauagggcgcgaagagagcugccaacuccuccggugucguauccgccccaucgacauugcccacaaaaaucuucauuuugccgccgcaaccgccuucucggagagacaggaccucuccuacagcgacaggcaaaacguccgaacgacccgcaguccuccacaggaauggcuggcgaccgagaaccccgccgcgcaggcgcuc

SEQ ID NO: 12575 - RNA, 10711 nt, Mus musculus
gagcgccugcgcggcgggguucucggucgccagccauuccuguggaggacugcgggucguucggacguuuugccugucgcuguaggagagguccugucucuccgagaaggcgguugcggcggcaaaaugaagauuuuugugggcaaugucgauggggcggauacgacaccggaggaguuggcagcucucuucgcgcccuauggcacggucaugagcugcgccgucaugaaacaguuugccuucgugcacaugcgcgagaacgcuggcgcggugcgcgccaucgaggcccugcauggccacgagcugcguccaggucgcgcgcucgugguggagaugucgcgcccgaggccccugaacacuuggaagauuuucgugggcaauguaucggcugcauguacaagucaggaauugcgcagccucuucgagcgccguggacgcgucaucgagugugacgugguaaaagguaacgcgggagcgcgcucgggaggggacacgcgcggugcucucugccucuuagccacgccccucacucugggguugguccucaggguugggaaugauggggaagugugcaggagcggggccuaaggugcugggggcgaguuggguagagccacccuucuccccugcggucccagcaacauucaucaagugggaggagucgguuccgggcgggugcaguggccacugcaagccgaagccucggggcuggggacgcgccagagauuugcgagugugcgggguugggaggaggcgccuuuuccugguugcaugagccuggcaccaaaaugaaauggaaagggaagggcaccaaccggauuauggagcggugaaaagaguucgccacuuccccacuuccucuccagaauuuggucagaucgagggaaaagggaaaagguuggguugaagccccaaggccgcucuggcguuccuucccgaugcuucccggaagguagcgggcccuugguuucucggguucgggcuuuuuuaguauugucuggaaugaaucugcuugugggcaugggaggggccuuuucggaaccccuuugaccuuucaguauucgauggguuagccuuggcgguuuugugcuuuuuaauucuuuuccuccacccuccacuuuguguuggguuuuacaacuuaacaaguggaagccccgguuuucugcguuauuuuugcaugugaaagggggcuauuaagccucucccucguuagccuuuuacuugcuaagcuggugccuccgggcacagauguuuauuagcuuggugagauugcaaaggggaauacucuggcugggggggggggggguguugagaggggcgugugagauuucuauuaaacuugguuuuaacaccauuuauuuaguuaguacuuuuuauugcuugaauaauucuuaggacagcuugcuaguuugcuauuuccuuugaggaaaugucuuuuucagacccuguugauuuucauauguugggguuuuaucucuuuaucuuucaaauaccugcuuuuuuuauguuggcaagauuuuaugagacacccagaccgauguggguuucacugaugagaguuaacuuugcccugucauuuucaacagugcacccugggagugaggccuuguuuauucccuaguugugcuguuguuggauucauaucugcuugugccuuguaaggaauuuugaggacaggaacuacauguggguauaggugcuugcucauucucaucaaggguucauuugcuguucuggaaagucacaacuuugggccauuccuugucuuuucaaagaggggggugaagggucauaggaugugcauuuauaggaacgaaauguuuguucugucuaauacugcauucuguuuccuucaauucagguuauaucuggaaucugacuuuacugcaaacuuuaagcaggcugugugauuuauggguuuuugcuucuguuuaguguaaacgagugggaaaggucucaguuuggguacuuggucagcaaaugcaugggauguaugaguuuuuaugagagucucaauugaccuaucuaguuuuuuuuuuguaguucuuagguagucuggaugguagagugggaguagaauucaguaccugagggggacagacuccuuuggaauuuguaugguucaauaagcuuuuucucugaugguaggccagaaauuugcuugaauuuguuugggacuggcagucagugacuguggugguugggauguagaacuagauucucugugagagaagguuugugcauuucuuuccuuuugaaaacauauuuauagcagaacuacacucuaggcugauaugacacagacucuauccuuugcuguaagagauuuggugagauuugaacguacuucuacugaugccgguaccucaguuggggugacaggcuuucaggauggagguggaguagaagagcagcucugaugcuaucaguagcuugcuccucgugggaggggcugaggcuuccagggcuugaaaagugcagaagcuugaucuuaaaucgauggccagcucuggaauauuucacaggaacaaacaaucauaguaguuugguugguuacuugggcuuugguaugauuuguagaacaaaaucuccauagcagcaaugauaacuauucuccacagcuauauacuacuagauauucaaagaugaacaguuucaggaaucauacaggugucaagggagguuugaauaucagauaagaaaaauacagccauucuuccuguguguauguauguauauguguguguguguguguguguguguguguguguauauauguauauauauauauauauauauauauauauauauauaucuuuuguuaauuuaaguugaaaguauuuaguuuuauuugggaaaacuuuugguacucucuuagucuuguugcuagagucaaaacaccauagaaagucagucuguuugcuuguuuguuuauuuauuuaugagacaguguuuaucugugcagcucuggcugcccuggaaauuggagauugccugccucugccucccuagcauugagauuacaggagugcaauauugcugggcccagcuuacuauucuuaauguagugguuucucugaaguaguucuccaugcagguucuucaaagucuggcucuucauugucccauuagucuuuugagugucuuugacaggucugaguuugacuuacugcaaugagucuuaggucucaucaacuagguaacuuagacucccuggccuuguucugagcuacaucuucuguacacacacacaccccuuuuagaucuauucuauuuuaugcguaugagugccaguauuuauguauguguauugcguguaugcuugaugcccacagaggucaggauggucaggagggaugguggaguucggggaacugauucuggauucucuacaacaguugcagguguucucaaaggcugcaucuuuccagucucccuuccuuuuuugaaacagugucuuacacaguccaggcugaacuugcuguguagcugaggauggucuugaaguccugaucucaauugccucuaccucuuaggagcugguauuucagguguguaccuccauacccaccucacacucccuucuaauaucaggcuuagaaacuuaacuuccugauagaaaaugacuauuuguaucagaggcccucccucaugagagcucauuuggguagccauuugaacuaacucauuugaaaguauuguuccucuuuccccucucucuuauuuucuccccuccuucuugcuuuuauuuauuuuuuugugguguaguggugcagucaaaccaagggccucauacuugucauauauacacuauccaguucuugaauuucuuuucauuguugcagugggcucccccucccccugccucccccuguggucucacugugcagcacugguugucuuggaauucauuguguauaacuugcuggucuugaacucagagauccacaagugcuggaauuaaagguguauaugccacuaugaucagccaauucuuaaaucuuaguuuucugauuugucauguguuuuauuuuuauuuuuaaauuuuauuuauauacuuuuucuuuuuuuuuuugggggggggguuuuccaagacaggguuccccuguauagcccuggcuguccuggaacucacucuguagaccaggcuggccuugaacucagaaauccgucugcuucugccucccuagugcugggauuaaaggcaugcgccaccacacccggcuauaugcuuuugaaaauguaggaaugcucugcauguacaaacuauaugucagaagaggacucauccuuuuauagacagaugugugccaccauguaguugcugggaauuaaacucuggaccucuggaagagcagccaguguucuuugagccaucucaccagcucacgacuuauuuuaaacagggccuugcugaguaauuuagguuggcauccaaucucugguccuccuugucuuuccuccugauugcuaccauaugcuggguagcacuuggccuuuuaaacucaaaaccagguaugagguguagaugggauaucuaauuucucuuguaaauccauugaaauuuuuguuagaugguuuuccuagcucauuuuugaauagaaugauaaacagguggguguucauggugguacacagaauuuauuauuauuuuucuuacuauguuuauauguguaaucuagaacuagagggcauuagauccccuggaauuauagggaguugugaacaugcagaacaugcucuuaaccaccagccgggcggugguggugcacaccuuuaaucccagcacucgggaggcagaggcaggcggauuucuucccaucugucuuuaagcucuagcuaucuugaugcuuucucuuaauuguugacuggguguuccuguuauuacauuguccugguugagggcaaguuaguucagccuuuuaaaaacauuugcuuauuugucuauguauuuauuuugaggcagugccuccucacuuuguagcucuugcuggucucuaacucaucuucugucuaccucaccuccuaaauguugggcuuguaggcaagcuuuacgauuccugaucucucugucuuuauuauagaaaucuuagaccacaacugcuauuuuuagcugauucaucccaaguggagaucaguaaucaaaggacaauugaaauguccaguggcaaaacaaaacaaacaaaaaagccgggugugguggcgcaugccuucaauccuagcaguugggaggcagaggcaggaguauuucugaguucaaggccagccuggucuacagagugaguuccaggacagccagggauacacagagaaacccugucucgaaaaacaaaaaauaaaacaaacgaaauauccaguggcuagaugaacgguuuaccuuucaaauuuggggacauugaagacuaucauuuguugaacuaggcacaucaaacuugguauucacuuuuuuuuuaaauuaaauuaagccaggcauagugcuccacaccuuuaauccacuauuuacuuggaagacaggcaggaggaaucugauuuggagaccagcuggucuacauaccgauuuauagggcaaccagaacuacauagugagagccugucucaaauccuuccuucccacaaaaaauagauuauuucuuguguaugaauauuuuugccugcauguauauguaccuacacaggucauaagugagugugggauuuuugggaacuggaauuauauauauguaagugguugucagccucucuaugggugcugagaacccagccuggacccugugugagagaaccagugcucuuuacuaccuuugacccaacucuccugccucauuuuguccuuuugucaugguaagcagcuuuuagguuauaauguagcauuaugcuuuauuagagauuaaaaauaauauuuucuagggaaauaaaccucugguuaguuuagguuugaagaacugucacgacuccauuaucauccuucaucaauuuaaaccucacaaggcauuucugucuucuuacuugaacuuuuaacuugagguuggcaggauaaacuuuuccuguagggaaauaaauggaaguucucuaaggucaccuaaauagucagugauggguggaucuaauacagcuuggccuuugaauuuuuaguccagcaucauucacauuauacugcacuuggcuuuugucuuuuauuucuuuggagguuucauugucuucaacuuaggagaugacuuguuguaagugaacaguuuagauaaggcaucucagaauaagggcccuaaaaggaggguauuuguuuggaggcguuugggugucaucucuaauaaucuguuuuauaaaaauggaaccuuaguccauccggauaauuuuuuuacuucuuaaauugaugugacagagauuggauccuagcuguugaaucccuuaaaguagccacaggucccgaguggaguugagugcagaaccuucuuucucagauagguccugaucauugcuccucagacacugcuuaugggacuauuguaguuugugguauggaugguaccaagaauuucuuccccuuuaaaguuuuuuuccuauguuguaagugauuagaguucucagaucaguaucaugucuuugacuuucucccaacacaacuuacucaggucuuuaaugagagagccuagguagguggcuggugguauuacucagucaugcccagcacgugugagacccuuccuaugcuaauccuccccccuccccucccccaagcaugccacaaagguaaaccugaaaaagcaguaaauagucuucuaaggcgaagguauucuucugucccuaaaagaggaaauagagggaauaaugugggauuauaucuauucucauaucuucuagcuucugugcaagguagcauuuuuagaaauauuacagagacuucucaggauaaagaccgaugaaacaaagggccauggaagaguuagcuggacguuggcauugauugauuuacagcaagcuacauaaaaacauugaucauacuugccugaaagagaagacaauggucuuuuccuuacaggauuguugagacuucuuguguaugaagugaccgugaaaacuggaaaguaaugugaaaggggaagguuacacuggagggauuugugacugcuucucguagucacucuuuuuucuaaaugcaccuagacugagaagugagucaugccaaaaugugagugguuccuaguguuuuaugcucuuagauuuagaggugagcaguaagcaguauuagaugugcuugaauugagaaaauggaguaauugagucaucuaggaaugcuuucuguuugcuugcugguuuuauuuauagccgcugugaagauuuuuauccugaauucgucuuugcuuuuuccuuuucucaccagaaaguuaguugguugagguggcaggggaacagaaggccaaaguuaaagguggcugacugcuugaaacagucaaacguuuggugacacaucggccacauuucauggcauacauagaggagggcuuagagagaccuggauguagcuggcaacagcugggugcuguuguguguccaguuugggacccacuagguagcaugcccugccccccuaauugcuaacccucugucugcugcuuuaucagacuacgcguuuguucacauggagaaggaagcagaugccaaagccgccaucgcgcagcucaacggcaaagaagugaagggcaagcgcaucaacguggaacucucaaccaaggggcagaagaaggggccugcccuggcuauccagucuggggacaagaccaagaaaccaggggcuggggacacagcauucccuggaacugguggcuucucugccaccuucgacuaccagcaggcuuuuggcaacagcacugguggcuuugaugggcaagcccgucagcccacaccaccauucuuuggucgcgaccgcagcccccugcgccguucaccuccucgagccucuuauguggcgccucugacggcccagccagccaccuaccgggcccaacccucagugucucugggagcugcauauagggcccagccuuccgccucuuuggguguuggcuaucggacucagcccauggcagcucaggcagcuucuuaccgugcucagcccucugucucccuuggggccccauacaggggucagcuggcuagcccuaguucccagucugcugcagcuuccucgcuuggcccauaugguggaguccagcccucagccucagcccuuuccacuuaugggggucaggcagcugcagcuucuucgcuuaauuccuauggggcucagggcuccucccuugcuuccuaugguaaccagccauccucuuauggcgcccaggcugccucuucguaugggguucgugcggcugcuucuuccuauaacacacaaggagcagcuucuucccuagguuccuauggggcucaagcagccuccuauggugcccagucugcagccuccucacuagcuuauggagcccaggcagcgucuuacagugcccagcccucagccucuuacagugcccagucugccccauaugcugcacaacaggcugcuucuuauucuucccagccugcugcuuauguggcacaaccagccacagcugcugccuaugcuagccagccagcugccuaugcugcacaagccacuaccccaauggcugguuccuauggggcucaaccaguuguucagacccagcugaauagcuauggggcucaagcaucuauuggccugucaggcucauauggagcucagucugcugcugcggccacuggcuccuauggggcggcagcugcuuacggggcucagccuucugccacccuggcagcuccuuaccgcacucagucaucagccucauuggcugcuuccuaugcugcccagcagcauccccaggcugcugccuccuaccguggccagccgggcagugccuacgaugggacaggccagccaucagcagccuaccugucuaugucccagggggccguugccaacgccaacagcaccccgccgcccuaugagcguacccgccucuccccaccccgggccagcuacgacgaucccuacaaaaaggcugucgccaugucaaaaagguacuguaugccccccccgccucagccccuagcuggggcuuagggcaaggggcugagguuggcaugggagggaaacaggagccauuggccccucccuugaucuuacuucuaugggauguccaaaagucaugagggugagugucugaacaguucuggccauugggauuuagguggggcauagugcucagccuggggugauaccaacaaacuuaggguccucauucuaggaggccccuaugaaccgauggagccacauuuugcaggauuggcucauagauuuuucccacugucugaaggauccuuaaacucacuccuuuguucugguuuuggugggauggaugugaaagaaaguaguccuuuuggcacucacuggcugaaggcaagcuuaugaggugcguccacccugggaaguuggggacccuacuuucguccgucguucuguugauaaaccaaggucuuuuugugcagggcccaugagugggaauagcuuguuugggaauguagaccagacucaccuuggcugguuuggaagggagcuucagcagagggcuugguuucccacugaccugaagaacccagguugguuccuugaccuggauaguaugaugagccuucugacagggacaccaacuguuugagacaaaucugguauacccucccuguccccaauggcaucuccccuaggccuaccuggagcccugcccucaacugucucauucaccaacugucuucuucucucgacuagguaugguuccgaccggcguuuagccgagcucucugauuaccgccguuuaucagagucgcagcuuucguuccgccgcucgccgacaaaguccucgcuggauuaccgucgccugcccgaugcccauuccgauuacgcacgcuauucgggcuccuauaaugauuaccugcgggcagcucagaugcacucuggcuaccagcgccgcauguagggccauccuggggauggggcaccacaggaagggagagagaggaagagguaggguagggugcagacccagguuaucaccacccucucucauaccucucccaaugguggcuuuucauucccucccucuaucaugugggccuuccccaggagaggacccuuuuguguuuggcaguaaccugcuuuguuucuuugccucagcagcacaucuugcuacuggcuuuagaucugugguuuucccucuacccagccaucuccccagaaugggaauuucuuuuauauuuuaauuuuuuuccuggcucccuuuuauuuuugugcgcgauacuuaagguuguuuggaggugauacaaccgacagcugaugucaggcggcgcguuuuucuuuuuagaugcgagggaggccaggaaaggguuacuuuagcuauuuccucugugcccagcuaugccagcaguccaggggcccugccuguccuucuguagaggcuguugagacugagauccugugggacagucaguugguccguguccaaauccccgcuuaccacugauguuuuagcugauggugacuggcauagucccaauucccuaucucuccaaguaggugguguuagaaaucuuaauucuuuucccuucuuuuguauggacuacaaauaaaacuuggggcgauucgugguuugga

SEQ ID NO: 12576 - RNA, 3578 nt, Mus musculus
uuguuaauuagccuuuuuauuguuuuuuuguuuuguuuuguuuuaaauugaaggucccuuacugguccugcuuccaugaguggucaagaucaaaggaaaggggagggcagccagcuggggcagggagggucauuuccacauuucauuuacacacagaacuaaacagacaagcacagagucacuauugugguuagaaguuggcagcaugggauggggagggauacggaguaggggugucguuaaaaaaaaaaauacaggcuccccccaaacugggugccuaggacgggacuuggucugcgucaacccaagaggaaucagaagaucaaaagcaguuugggaaggccagaaccgucagggauggagggagaaggacgguccagggggugggagggauguuuggcaacuggggugaagggauagcccucccccugcugggauccccccagccccuccggucuggcaggaaaggggcagccugcaacacccaagagcaggucuggggcuguuaagaugcuccaggcagggggcuggagguggcucacaaaggcuugcccuccagggaaaugacggcgcugccaccuaguuucucugccagggugcagcgguccuugaccuccucguagcaguuagcuuguaauucaugcuugauuccuacagggugaaaagagagcagugagcaggaagcacuggggugggguggaguucuaucugggaaggagccggcggagcagaugagaggaggaagguagcagcuagcaggagacugcgcccaugacuuuugcagaaggagggauccuuaccugucagcuucuucuugauggcauccuuggagcuggcauagaucauuuugcucuugaggggugcauucucgggggcccuaaagacaaagcaaagaaaaggcugcagcuacauccagggaauaaugacucaagaaaagaaacuuuuaggauacucuaacagcagggauuuucuuuuccccaaguuccucacuaguuuuuguuuuugaaacacagggucuuucuguagaccagguuaggcucaaacucacaggcaucugccugccuuugccucccucaagcugggacuaaagguguggguaccaccacaccuagcuccucacuggaaggguuguuacaacccuggcaccccccacaccuggaauaauuuccguuaagcucugagaaagggaaccagaggcaggcagaagagccugaauacggagcucaccagaagaugaacaccagguccuccuucuugcucuccuuggucucauagguugcaucauagagugcauagcggcaguccuugucuggcagcaucuugacaaaagugguguaggggucguccacagucugccccacaucuccuaccaggaucuccuugcccuccuccaggaugauguucuucuuguccucacucaggcaaaagagcaccgccuucuugcguuucuucacuucuucugguguugaagacuugcgaaccuucaugucauugaacaccuugaugacaccaucagagacagccacaccagaggccugagggacaaaucaaaaauacgccuuguaagggaaaggauucugggguauucuuugcaguuacaggaaaccucagucagaguaacaaacacacuucucagccccacacagauuaguaaugucccugcagacuuuuuucccuauccaauucaucaucuaagaacuaguuaggacaaaccuccugcaagggagagauccaauuaucuaguucaacauccccauaaauguuagaacaguacuuauuaaaaagaagaccuuagccaagagugguagaacacgccuuucucuuagucugaaaccagucuuagaucuauagaaugaguuccaggacagcaggggcaaugcagagaaauccugucucuuaaaaaaaagccaaaaagaaaacaaaaacuugcugaguugugaacaccagauucaaagaacccgaaagauacugauuaaaaugccagcauaggauagauacaaaacaccaaacuccugggccauagucucaucuccaggaaagagaaucagaacaccagaaauucacagacaccaagagcugcucgguaguuuauugcucauuagaaaugcagucauuguauaaaugacacucuuuccugccgagaucucccauacacaagaauuacaacccuuaauuaaggcccugcuggacaacucccugucauccaagaauggugaguccuuuaaaaaaaaaaaaagacugacaaauuaauaggucaaacugugaugccccaaaucgccgaaaacuuucugcuuuguacggcccugggggacgacccaaucagaaaucuacaaccaacccuccccaccaccaccauggaacugcagaggaagcuagccacgugauucacccgcuuccggaguaggcggagaaagauuggacuagguucagggccuccccaagagacacucguagcccagaggcagcgaggcggccggaccucagaugucucaacgccuaaggcucgccuuuaggaauaggcguaaacgcagucagcuggagagguagcucuggccagucucacuccaaaaaacaguuucccgugcccucaggcuaagcauaaaagcugguggcuuccgggcgguacccgccucggucacuucccuaaacgcggcuccacccucggccccauccggcagagcagcaaaaggccuagcucggcuagagcugcagccgggauggcagggcccaagcaugugcgcacgcgcuguucuagcucuagcccgagguacagugacuacagaauggaguguguaaucgcucuuucuagaaguggggcgauagccuguacaggaacccacuccgugacucguguugcaagaaggcuccagaaccagcgucucaaucagguuccccgaugccucagcaucucccagagccacaccgcggccgcccccgccccgcccugacggcggaaucccugccaccugcuguggagaccaaccuagccgcagagggaggaugaugcggggaagggaacagcccuuggguggggcgcgcgccgacaccucgcgcgcuuuucccuagcggccccgggccaggguuuggaugccgcgugcucugguccagcgcgcgccaucgagaaccagcgagcguugcccgaggccccgcacacuggaccccucccccacggccaguggccgcgcuggcgcaaaggcaggaugggggaggggagaggagccagggggcgcgcgagcgacguccgaaucggcccuucccagcgcccggaggcgcgcacgcgcggccugcccuucaaugagacccuuaaucucgcucggggugcugggggaugggauaccaagaccgcuucucugccgcccccaccccgcccggcgcgcaagcgacggaucacgaacccacuucccucgggcgcaguggccuaaugcucaccauguuuccggaaacgaaagggagacagaaagagcaacugaagaccugagccgccgcagcugcugccgggauccgacugaacgcggccucucccggccccuuccguuuaguaggagccgcacaaugaggggcggggcggccuuccggcg

SEQ ID NO: 12577 - RNA, 6613 nt, Mus musculus
auggcggagguggugaguccggugcccggggcggggcggagggagccaggggagguggguagagcccgaggccccccaguagccgacccuggcgccgcgcugucuccccagggggagauaaucgagggcugccgccugcccgugcugcggcgcaaccaggacaacgaagaugaguggcgugagugacgucggggggcggguccaaggaaccugagggcgaggggcgggagggagucaacgaucgcacgggagggggaggggcuucugcaaucccggggcggucgcagauacucgggaggaggggcguggcuuuuggacguacggagaugauccgggcggggcuuggagagaggugucacuuggugacuaaaggggucuugaaccagccccucugagugcugggacacaggccuccagccuggaggugggauucaggucgaaggguggagucuccugaccugcccuggcuaagacucccugucugugugguucucauagcccuggcugagauccugagcgugaaggacaucaguggccgaaagcuuuucuauguccauuacauugacugugaguccugggccuggauggagugggguugcuggagaggguugagggcagccucuggcauucccuccugagccguuuucacugcugcagucaacaaacgucuggaugaaugggugacucacgagcggcuggacuuaaagaagauccaauuucccaagaaagaggccaagacaccuaccaagaacggacuuccugggucccgccccggcucucccgaaagagagguggugaguaggucccccauuucaucuuuucucuccugccucuuccuucuugcaucucuuggccucagggguuccugaaugggcaggaggcagcauucuucugccauggcuucagcuugcaaaggauggggaccaaguugcaggcguagcuuccagaguccagcacugccuugcuuuagagaaggcagagggugggauuccaugcugaggggcccaucccccccuucgccaucccaccaccauccccaccccagaggaagacccuggaccuaucucugcagccggccuccgcccaggccagcgggaagaccuugccaaucccgguccagaucacacuccgcuucaaccugcccaaggagcgggaggccaucccagguggcgagccugaccagccgcucuccuccagcuccugccugcaacccaaccaccgcucaacgguacccucagcaauuccagggaccuugcuuucuucucaggucccaccuucucuaccuucugacccaccuuuccugguuucucucugcagaaacggaagguggaggugguuucaccagcaaccccagugcccagcgagacagccccagccucgguuuucccucaggugagucuuccagucuuuuuucaugugucugaauguuuugucuguguuuugcauguguucuacuugcaugccuggugcaggugggcagaagagggcauuggagccacugaaacuggaguuagagaugguugugagccacucuguggguccugggaaaagaacccaggaaguccucuggaagaucagggcucuuaaccacugagccaucccaacagccugccuggucuuuccccucuuauuccuugcugucuagcauccuccuccaggaucaucucacggucgcucuuucucuugugucuuguccacagaaugggucagcccguagggcaguggcagcccagccuggacggaagcggaaaucuaauugcuugggcacugaugaggugggucuugaggagcagagggagagggaagccgggaaagggggagugggcuugggcaugguguucacucggugaggccuuaggcagggagggugguggcugggagccaagcagaugaaccccugggccucuucuacucucaguuucucagccucgcuuuauuuuggaaguggagguuggugcuuugcccuuagcugauguuagacuugcaggaagaagccaauggcagugucgugcgccacgcucugcuuaacugcuaccaucuaguauuugccaucugccuugggcaggauucucaggacagcucagauggaauaccgucagcaccacgaaugacuggcagucuggugucugaccggagccacgacgacauugucacccggaugaagaacauugaguguauugagcuuggccggcaccgccucaagccgugguacuucuccccguacccacaagagcuuaccacgcuacccguccucuaccugugcgaauuuugccucaaauauggccguagccucaagugucugcaacgccacuugguaugaggggucuugggaggcugccuauccagaguacccucaccaguccccaccugauccuccuuuuguccuuagaccaaaugugaucuucggcacccuccaggcaaugaaauuuaccgcaagggcaccaucuccuuuuuugagauugauggacggaaaaacaagguuaguggcuugggcacggcugggcuggagugagucacaugaacaaccuuuuccugcucagaacaguugaccauucugccuaugagcaggucacuguuuuuauugaauucuugacacggagcagggaauguacagaaaacugggauuuagagaaauuuucuuuccugagaggucacugucacggcagagcagacaugacagcuacucagguuccaguaacagaggggguucagcacaguucacaggaagcugucaucagagcuuggaggugugugugccuauaaucccagcacucagaaaacucccgaguucaagaguagucaggggacuaaugaguugcaagccaaccugagcuauaaaguaagaaagaccuauccggaaccaaaacaaaaaacaaaaagaagugaggcagcaaagguuaaauauaaaacuagaggcauuuaaagaacaguuuggcccagcauggugguacauuuauaaucacagcauccaggaagcugaugcuagaggaguugacauucaaggauagucugaacagcauaguaaggucuuuucucagaaccaaauaaaaaaaggaucuuugguugugugugcugguacauccuuuauucccagcauucaggaagcggaagcaggugggucucugcugguuuauagggaguuccaggccagccagggcuaauacagucagaucugcuuugaaauaguuugcagguuaaccugugagccuggagauagcugagagaacauacuuagauaguucuaagcaguuggguucagacaugcaggcacugauguaccaggaaguacaugcaaaaagaaaauggagaagaauaggugaugagagaaggucaaaggucagaugauaggcacaagaucagcggggaggagcagguuuggguuucucuaggugacaaguguggagguccuugagaugcacacuuuuuaaggccuccggggugcagagggagagaggcagcuaccuggaguggguugggagcugccuugaagaggagcuucuucaagaggaagaaacaaagcuccacgucguucugcauuaagugcgguguuugaguggaagaccagcaguugcaaagcugucaaauuccucuaggagucaugugugaugagggagccaguccagaguacuguagggaaaaugccugaggcuggcagucccucacaucuccacuggagaccagcagagcagccccggaaggaucacuguggcuguggcuggagcauuagggcucugacacccagccgcgaagaccagccacgugggucucacuauguaucccuagcugacugauuucacacuuguaccugccucugccuccuaagugcugaggucauagguauauacuaccauuccuggcuuggaaauauugacuauuguuaaguugaacagaaggcaauguagguccagggcaggcuuugcugaguauguggaagcuauauagcucacgggggucgggugggguggcggcagacgguuggacauuaggauguagguuccuggcgacuuaagaaguaguacugaucuaagcaguggugacaaucugacugcuggggugggucagggucaggguccugggggggggagcucgacccucucaacuggaacagcacaaagaaugcuccugagagcccuugagauggcucaguggguagcagugauugucacacagccuggccaccugaguucccucuguagaaccuguaguggaaggacaauggacucccaagagguuccugccuugggugugcauguuguguacaggcacaucugcagccacacgcggcauaauacacguuaacucaacaguaccccagaggauugacgggcagguuuuuuccuuuacagaguuacucacaaaaccugugucuucuggccaaguguuuccuggaccacaaaacacuguacuaugacacugaccccuuccucuucuacguaaugacggaguaugacugcaaagguuuccacaucgugggcuacuucuccaaggucagcacucauccaggcugucccucagccuugccccgagccuggcacucuuuaaaacccaccuacucuuacuccaggaaaaggaauccacagaagauuacaauguggccugcaucuugacucugccucccuaccagcgccggggcuauggcaagcugcuuauugaguucagugaguaugugcugccugaccaggagcuggcaggccaagccuguguggguguacccucaucugugcuucacaugcagacaacccagucaccaggagagccgccagaaauaaaggagacucuaccaagguccuuuccucaguugacugcccuguuuccuggaguagguuccagcaucuacuuugccuuuggcuaaaggccugugagccaccccgcuuuucccaucuggcgcugagcagcguggguagcccccaugcucaccuuugaugugcacucugaaccacuggcugugccugagcugugcgggcaguaggcauucaaaaaggcacacgagcacuacaagacagaauuguauccugguucuuuguaaggcuagucucugagaaccgacgcaggcuuuggccucuuuugaggccacggacucuuagcucugacacccagcccagcccauucacuuagcccaggaccagggagacgcuuuagcuuuuuugcuggugagaacauggaugucugacugcucgaagucaugaucuguuuggaguaucuucccgauuagagcaggagaaaggaaacucagggcaaaccgugaggaugugccugcuuugcccaguaggacacacaaaugccaacagacugauaaaaggaagggaggcaauccuuguacacaguuccuaacuagaggcaaauauggcugccaguagacuuguggggcuauuaacuguguggacccugacaccagccucucccgcccuucuuguccaagggugcuugagcaaagagggugagacuacaaauagagauucagccaggagccgagagugcuuggaucaucacgaggccaguagagcugaggggaaggaagggucuccaaacuaauggggacauaaagagcugucggcucacuggggccuaacggucucagagacugucuggcagcgccuuguggucaacacagguaagggaaagggccaccaagggucagguaccuggcucugaggagcccccuguccuuuccuauuauguccuuaaccacccagcccauucugcugagagcagcuggcguucccaggaucgcagcuaaacugaugacacugaaaagguucccauguccucagaccacaaagggcucccucauuacugccauacacccagacacaggcuggcagggcagcgacccauccuggcagccuucacuggcugacaaguacccaaccagagcugcucuucuagccuuuggcccccaacacugcagacagggaagcugcugguccacaccaagaguaagugagaggcaggcaggcagcccagcuccacagcccuucuuccucauaagcugcuguguacaugugacgcuuacuccgccuccugugcucuauugcuuuaggcuaugaacucucgaaaguagaagggaagaccggaacuccugagaaaccccugucagaucuuggccuccuauccuaccgaaguuacuggucccaaaccaucuuggagauccugauggggcugaagucggagagcggggagaggccacagaucaccaucaagugagcccaaaugcccaccuggggguugugguuuggucugucuguuccugggguuucuggggacagaugaauaucuucaggggacugaacuuucccccacuuccacccccacagugagaucagugaaaucacuaguaucaagaaagaagaugucaucuccacacugcaguaucucaaccucaucaauuacuacaagguuaggaggcaugcucaggggauagaugagauauggaugcaggcucugagcugacaugagcuggcucuaucucuugcucagggccaguauauccuaacucugucagaagacaucguggaugggcaugagcgggcuaugcucaagcggcuccuucggauugacuccaagugucugcacuucacucccaaagacuggagcaagagaggaaaguggugac

SEQ ID NO: 12578 - RNA, 7050 nt, Mus musculus
ugucguagcuaucccuggaaugaggcgcuuacacauuuuauuucuuucaugccugacauaaagucuggcccuugcucgcuccugccccccguccaaauggcucggcccgcggaacgccccaucuuccaggcacauugagagccggagucuuggaggaguuuaggguggugauucuacaacggcgacuagcaaguggcgggcuucagcccuuucccgcugcucuccuggucgcgaccacacgucacagcucucgcucguuccgguugcucgcgcacgggccccagaagcgcaggcgagaucggagcgcgcaaagagaacuugguacgguccacuccgccgcgccccgcgccgccggaagugaggugucuuacccccgaaguuccgguucgcaggggguggggaguguuguuaaccggagcggcugccgcagucgcggugauugagcgugcucgcggcgcugggcuccuggugagugggccugguccugauugggguuggggggucggcgucuaggaccuuguccuuuggggucacugcgaucagcccgccccgcugcguucggccgccaguuuucggccugucagauggcuggagaccuuaggcggcggcgcggccaccguuccagaggccgggccccgccugcgagguucgcaacuccuagcguucacaggugcgcgacugugaggcgaccugacugguucucagccccgccgccgcacccuggcggucggccguuucuccgguucucagaguggacacugcugggggcgggggggggggcaggguuccagacugacguaccccgaugggcgcgcgucugcgcugaccacccuggcacagcugucacugguugugucgccuucucaagcugugcccucugcaccuugccuccuccaccccuggcgggcccagcgaaccugccucuaaagccuaucaucccagcuccuucagagggucagcgguggcagccccccuccuccuaacuuugccucagugacucccuagaggaggcgccuuggcagacagcguggaagagcccuagauuugaaacgagauugauccaaguucuaggccuugcaucagugugagccucuaaccccuuugaguccuaguuucucguuugugaaacagggaguauaugcuguuuugaaucuaauggcugucaaggugaaaugaguguuugcccuuacacucugccagggacugugcuagguuuacauaguguggauaucacaaaugucauuuuccuugugcaggucucugggccagggcgauguuccgcaccgcagugaugauggcggccagccuggcgcuaaccggggcagugguggcucaugccuacuaccucaaacaccaguucuaccccacuguaguguauuugaccaaguccagccccagcauggcagugaguucagggcucagggaagaaggaaugcccggggagggaaggaggggcagaaguggggcuacaugucauagaaguaggagagaaauagcccugggccgccugacuuggaauuaucuaugacagucuuggggaccugucagaaugauuagccccaggcaggggaaagcagaaaauaaccucaaaccacgaccuuuccucacccccagguccuguacauccaggccuuuguccuugucuuccucuugggcaaggugaugggcaagguguucuucgggcagcugagggcagcagagauggagguaauauguugguggccccaaaggacaggguucagaggaggguacccaaaugauugguuuucauaucauccacuucucaccccacagcaccuucuggaacgguccugguacgcuguuacugagacuuguuuggccuucaccguuuuucgggaugacuucagcccucgcuuuguggcgcucuuuacgcugcuccucuuccucaaauguuuccauugguuggcugaagaccguguggacuuugugaguugggaguggcugaugggcaugccaguggauugggguauggggcaaccccaaccaucuugauggugucccucucugccucagauggaacgcagccccaacaucuccuggcucuuccacugccgcaucgucuguaagugagacucauugaagaggugggggugacuugagggaaaagaggccacugaggaguagacugaaaagucaaaaccuaugagccacuacccagagcccuggcugccccuccauccacagcugcacaggaaagauaauuuaagaaguuaauuugcauagucucuacucuguuccacuccagggcuucuuaacugccugggcacucagcucucugccuucuccccugggccuggguugccccaacacccugccugggcaaaaguaguucccagaggauucggcuuagguguacacauuuaaguagaugguggggccaaucgccauggggugggauugucguggagcaggaagugauugucaggccucugcugaccucgauucccucccuuugggggucuccacagcucucauguuucuccuggguauccuggacuuccucuucgucagccacgcuuaucacagcauccugacccguggggcuucugugcagcugguauuuggcuuugagguaaaacuggcuugggggaagaagcugagcugguccugcgugugcugugagcaaccccacaagugcuucugagggccugccaugucucuacccacuuacuggccaccagggagccucugccaucuuguccuggccacccucauagacuucuaggcuauugcagaaggacacaaaggaaggcuggugucguguagaagauucuugaccaaguaccuuagcaagccuuccuggaggcugaugucaugaauggaaaagagaaaacuguuggguagaucacccaggagacgugucccagcucacaucugcugagugcuuaccacaugcugggcccugugcuguguucauaggugacaguuaaugcuuuggagguagagucaguugcuuucgucccagacugggaggaccccagcugugucugcagccuguguugguaucacugcaccucugucuugaagccuagcuuggcuagagcaaggggaagcugguacucacauccaucuccugucccucccuccaguacgccauucugaugaccauggugcuuaccaucuucaucaaguaugugcugcacuccguggaccuccagagcgagaaccccugggacaacaaggcuguauacaugcucuacacggagcuguuuacagguaacggauuccuaggccucuuccgguccacagcagcauccgucggugugucugccagcccuauggccagcugcgcucucccuuuccuccucaggcuucaucaagguccugcuguacauggccuucaugaccaucaugaucaaggugcacacauucccacucuuugccauuaggcccauguaccuggccaugaggugaguccagccuugucccuuacuuccucagacuggucucucccaugucuucuuucacucacugacuugucucuucaggcaguucaagaaagcugugacagaugccaucaugucucgccgagccauccgcaacaugaacacacuguaagugggcuuguucuggcuacucccaaacuccgagguccccgugcuuccaguucuggucuugacauggacucugccaucuuaaccagguacccagaugccacccccgaggagcuccaggcaauggauaaugucugcaucaucugcagagaagaaauggugacuggugcuaagagauugccuugcaaccacaucuuucacacgaggugggagaaggucugggagaccugcaucgugggcacaggcucauggggaccugcugaccgcugccugaucuuacucccagcugccugcgcuccugguuccagagacagcagaccugcccgacaugccgcauggauguccugcgggcaucguugccagcccagucaccaccaccuccugagccugcugaccaaggaccaccccccgccccucauccccaaccgcugcugccacagcccccuaauuguaaguggcccuucauuugcccacagaggaccuucuuuguccucagguacuugcccucggcuggguaccgacagugcuggggaauccccgagaagcucauucuggguaggaaggggugagaagaugagaaauagacaaaugaugagugguaagcagggccugccagaguggaggagaucuccuaguagccaagcgcacugccuggggugagacugucagcccagccucuucucacuacuguuuguuucucugcagucccccagggccuccugccuccuuuuccuccaggcauguucccacuguggcccccaaugggucccuuuccaccugucccgccucccccaagcucaggagaggcugcggccccuccacccaccaguacaggugagccuugugcaugccaaggcagcugggggguggcagucggaucuggagaccaggagacugacuuccauuuugcauuugccagccguuucucggccuaguggagcagccaccaccacagcugcuggcaccaguacuucugccccagcaccugggucuguaccuggcccagaggcugguccugcccccggcuucccuuucccuccuccuuggauggguaugccucugccuccaccuuuugguaaguuggccacucucugggauaucugggguggagagcugaggcccagguagcucagccugaccucuguaucuccugccagccuuccccccaaugccugugcccccugcgggcuuugcuggccuaaccccagaggagcugcgagcacuagagggccaugagcggcagcaccuggaggcccggcugcagagucugcgcaacauacacacacuacuggaugcugccaugcuucaaaucaaccaguaccucacugugcuggcuucccugggguacgcaugccacauucaguagcgcuccaaaaaggucccaugugguuuugacaucuuucccaugcgacauguuucccaugcacccuguauucaggccaccugucuacaggcgugcacaggagcucuuggccacucuaccugcuuucauccuucauucaggaagugcaucugcacagccauggaggaucaauuuauuagugagcuggcugugaaauuuacuuguuuuuuucuaagcucaaauuauuuuugacauucgcugcuacaacucaucaccucacggcugccagggcugacacgcugagggagcagaucacagucaccugaagccagcuugacccaugcuuaagugcuagucucaucacuugccugaagacuuguauauuagaauagaaaucaaaucccuagucacgugacaugugcagaggccugguaggaagccggaguccaaggcuuuagccuucugaccugcucagugccuacccuaucacuggagacugaagacuaauaggaaagugucagcugucugccugcaagugauucagaauccucggggacgaauuacucgacccuuucauugcucuaccugauaauccaauccgccuauucacuuauacuuacucgucacaaggacucaaggauagcuugccuuagagcuuguccugcaaggcucaugguggugggugggucguaggagaaucugugcagcccagaaggccaaggucaggccucuugucccuucucuuggcaggccccccaggccagcuacuucagugaaccccacugaagagacugccucuacagugguaucugcugccccuuccaccagcgcccccagcucugaggcuccuaccccgucuccgggagcuuccccaccaauuccugaagcagaaaagccuccugguaagugaggaaccucuaggggugggaugaaggguucucugggcuucaccucugaccucuccuucuagcuccugagucagugggcauuguagaggagcuucccgaggauggagagccugaugcugcagaacuccgccggcgucgccugcagaagcuggaguccccuguugcccacugacacugcccagaccuggcccuguucucuugaguggcccucacuggaacacguccugccaucaagugccagcucccucucugcuugcaccagggaguaauagccccaguugagaaagacuuggcaggaucucugaggaucaaggagaagugucugggcuuccagucgauccauccccagugccccuggcagccauggagauacuggucagcucuaaccucccuccacuucugccauguucaacuggggccuucaaaguagaagcugaaucucugguaagccuucucuuccaugcuuucugggagaaggugaagccccuccaagcccugcuugugaguaugggaccaugcugcagugccgaacaguauuagcuucuguucccaacuguggaaacccagaggggcugaagacagaccaggaccuugccccacccuccugccaagacugguaccagucucuuuccucuagcccagucuucccagaaccccuuugugaugguggcugugccccccgaagcccuguggcauuuccaugucuuacuggcaaccacacaacucagggaaaggagugccuggggguggggcacaggcgggcagcaccgagggacccugcccugccccuccccagcucuuuccccauaucacccagcagccacugccuggugggccuggcuaagggugugugcugcuccuuaaaccacugcuccccagaacccaaggcaggccaccuccaaccugugggaugucgucaggauuggaacuauucuguaccuacuggcuuugggcuuaaauuuugucuucugaauuugaaugcuugaccccaggaaggaggagcagguguggggcuagguaccuggacuucgcaguuuagaacaagcucugggccgggccgggccaggccaggccuagggagccaaggccuagcugcugcuuccuucuuuugguuuuguguuacaggaguuucuggagaguuucagaugauuauuuaauuuguaaauauuguauaaauuuuaauagcuuaaauuguauauacagcucaauaaaaacuugcauuaau

SEQ ID NO: 12579 - RNA, 7050 nt, Mus musculus
auuaaugcaaguuuuuauugagcuguauauacaauuuaagcuauuaaaauuuauacaauauuuacaaauuaaauaaucaucugaaacucuccagaaacuccuguaacacaaaaccaaaagaaggaagcagcagcuaggccuuggcucccuaggccuggccuggcccggcccggcccagagcuuguucuaaacugcgaaguccagguaccuagccccacaccugcuccuccuuccuggggucaagcauucaaauucagaagacaaaauuuaagcccaaagccaguagguacagaauaguuccaauccugacgacaucccacagguuggagguggccugccuuggguucuggggagcagugguuuaaggagcagcacacacccuuagccaggcccaccaggcaguggcugcugggugauauggggaaagagcuggggaggggcagggcagggucccucggugcugcccgccugugccccacccccaggcacuccuuucccugaguugugugguugccaguaagacauggaaaugccacagggcuucggggggcacagccaccaucacaaagggguucugggaagacugggcuagaggaaagagacugguaccagucuuggcaggaggguggggcaagguccuggucugucuucagccccucuggguuuccacaguugggaacagaagcuaauacuguucggcacugcagcauggucccauacucacaagcagggcuuggaggggcuucaccuucucccagaaagcauggaagagaaggcuuaccagagauucagcuucuacuuugaaggccccaguugaacauggcagaaguggagggagguuagagcugaccaguaucuccauggcugccaggggcacuggggauggaucgacuggaagcccagacacuucuccuugauccucagagauccugccaagucuuucucaacuggggcuauuacucccuggugcaagcagagagggagcuggcacuugauggcaggacguguuccagugagggccacucaagagaacagggccaggucugggcagugucagugggcaacaggggacuccagcuucugcaggcgacgccggcggaguucugcagcaucaggcucuccauccucgggaagcuccucuacaaugcccacugacucaggagcuagaaggagaggucagaggugaagcccagagaacccuucaucccaccccuagagguuccucacuuaccaggaggcuuuucugcuucaggaauugguggggaagcucccggagacgggguaggagccucagagcugggggcgcugguggaaggggcagcagauaccacuguagaggcagucucuucagugggguucacugaaguagcuggccuggggggccugccaagagaagggacaagaggccugaccuuggccuucugggcugcacagauucuccuacgacccacccaccaccaugagccuugcaggacaagcucuaaggcaagcuauccuugaguccuugugacgaguaaguauaagugaauaggcggauuggauuaucagguagagcaaugaaagggucgaguaauucguccccgaggauucugaaucacuugcaggcagacagcugacacuuuccuauuagucuucagucuccagugauaggguaggcacugagcaggucagaaggcuaaagccuuggacuccggcuuccuaccaggccucugcacaugucacgugacuagggauuugauuucuauucuaauauacaagucuucaggcaagugaugagacuagcacuuaagcaugggucaagcuggcuucaggugacugugaucugcucccucagcgugucagcccuggcagccgugaggugaugaguuguagcagcgaaugucaaaaauaauuugagcuuagaaaaaaacaaguaaauuucacagccagcucacuaauaaauugauccuccauggcugugcagaugcacuuccugaaugaaggaugaaagcagguagaguggccaagagcuccugugcacgccuguagacagguggccugaauacagggugcaugggaaacaugucgcaugggaaagaugucaaaaccacaugggaccuuuuuggagcgcuacugaauguggcaugcguaccccagggaagccagcacagugagguacugguugauuugaagcauggcagcauccaguaguguguguauguugcgcagacucugcagccgggccuccaggugcugccgcucauggcccucuagugcucgcagcuccucugggguuaggccagcaaagcccgcagggggcacaggcauuggggggaaggcuggcaggagauacagaggucaggcugagcuaccugggccucagcucuccaccccagauaucccagagaguggccaacuuaccaaaagguggaggcagaggcauacccauccaaggaggagggaaagggaagccgggggcaggaccagccucugggccagguacagacccaggugcuggggcagaaguacuggugccagcagcuguggugguggcugcuccacuaggccgagaaacggcuggcaaaugcaaaauggaagucagucuccuggucuccagauccgacugccaccccccagcugccuuggcaugcacaaggcucaccuguacugguggguggaggggccgcagccucuccugagcuugggggaggcgggacagguggaaagggacccauugggggccacagugggaacaugccuggaggaaaaggaggcaggaggcccugggggacugcagagaaacaaacaguagugagaagaggcugggcugacagucucaccccaggcagugcgcuuggcuacuaggagaucuccuccacucuggcaggcccugcuuaccacucaucauuugucuauuucucaucuucucaccccuuccuacccagaaugagcuucucggggauuccccagcacugucgguacccagccgagggcaaguaccugaggacaaagaagguccucugugggcaaaugaagggccacuuacaauuagggggcuguggcagcagcgguuggggaugaggggcggggggugguccuuggucagcaggcucaggaggugguggugacugggcuggcaacgaugcccgcaggacauccaugcggcaugucgggcaggucugcugucucuggaaccaggagcgcaggcagcugggaguaagaucaggcagcggucagcagguccccaugagccugugcccacgaugcaggucucccagaccuucucccaccucgugugaaagaugugguugcaaggcaaucucuuagcaccagucaccauuucuucucugcagaugaugcagacauuauccauugccuggagcuccucggggguggcaucuggguaccugguuaagauggcagaguccaugucaagaccagaacuggaagcacggggaccucggaguuugggaguagccagaacaagcccacuuacaguguguucauguugcggauggcucggcgagacaugauggcaucugucacagcuuucuugaacugccugaagagacaagucagugagugaaagaagacaugggagagaccagucugaggaaguaagggacaaggcuggacucaccucauggccagguacaugggccuaauggcaaagagugggaaugugugcaccuugaucaugauggucaugaaggccauguacagcaggaccuugaugaagccugaggaggaaagggagagcgcagcuggccauagggcuggcagacacaccgacggaugcugcuguggaccggaagaggccuaggaauccguuaccuguaaacagcuccguguagagcauguauacagccuuguugucccagggguucucgcucuggagguccacggagugcagcacauacuugaugaagaugguaagcaccauggucaucagaauggcguacuggagggagggacaggagauggaugugaguaccagcuuccccuugcucuagccaagcuaggcuucaagacagaggugcagugauaccaacacaggcugcagacacagcugggguccucccagucugggacgaaagcaacugacucuaccuccaaagcauuaacugucaccuaugaacacagcacagggcccagcaugugguaagcacucagcagaugugagcugggacacgucuccugggugaucuacccaacaguuuucucuuuuccauucaugacaucagccuccaggaaggcuugcuaagguacuuggucaagaaucuucuacacgacaccagccuuccuuuguguccuucugcaauagccuagaagucuaugaggguggccaggacaagauggcagaggcucccugguggccaguaaguggguagagacauggcaggcccucagaagcacuugugggguugcucacagcacacgcaggaccagcucagcuucuucccccaagccaguuuuaccucaaagccaaauaccagcugcacagaagccccacgggucaggaugcugugauaagcguggcugacgaagaggaaguccaggauacccaggagaaacaugagagcuguggagacccccaaagggagggaaucgaggucagcagaggccugacaaucacuuccugcuccacgacaaucccaccccauggcgauuggccccaccaucuacuuaaauguguacaccuaagccgaauccucugggaacuacuuuugcccaggcaggguguuggggcaacccaggcccaggggagaaggcagagagcugagugcccaggcaguuaagaagcccuggaguggaacagaguagagacuaugcaaauuaacuucuuaaauuaucuuuccugugcagcuguggauggaggggcagccagggcucuggguaguggcucauagguuuugacuuuucagucuacuccucaguggccucuuuucccucaagucacccccaccucuucaaugagucucacuuacagacgaugcggcaguggaagagccaggagauguuggggcugcguuccaucugaggcagagagggacaccaucaagaugguugggguugccccauaccccaauccacuggcaugcccaucagccacucccaacucacaaaguccacacggucuucagccaaccaauggaaacauuugaggaagaggagcagcguaaagagcgccacaaagcgagggcugaagucaucccgaaaaacggugaaggccaaacaagucucaguaacagcguaccaggaccguuccagaaggugcuguggggugagaaguggaugauaugaaaaccaaucauuuggguacccuccucugaacccuguccuuuggggccaccaacauauuaccuccaucucugcugcccucagcugcccgaagaacaccuugcccaucaccuugcccaagaggaagacaaggacaaaggccuggauguacaggaccugggggugaggaaaggucgugguuugagguuauuuucugcuuuccccugccuggggcuaaucauucugacagguccccaagacugucauagauaauuccaagucaggcggcccagggcuauuucucuccuacuucuaugacauguagccccacuucugccccuccuucccuccccgggcauuccuucuucccugagcccugaacucacugccaugcuggggcuggacuuggucaaauacacuacagugggguagaacugguguuugagguaguaggcaugagccaccacugccccgguuagcgccaggcuggccgccaucaucacugcggugcggaacaucgcccuggcccagagaccugcacaaggaaaaugacauuugugauauccacacuauguaaaccuagcacagucccuggcagaguguaagggcaaacacucauuucaccuugacagccauuagauucaaaacagcauauacucccuguuucacaaacgagaaacuaggacucaaagggguuagaggcucacacugaugcaaggccuagaacuuggaucaaucucguuucaaaucuagggcucuuccacgcugucugccaaggcgccuccucuagggagucacugaggcaaaguuaggaggaggggggcugccaccgcugacccucugaaggagcugggaugauaggcuuuagaggcagguucgcugggcccgccagggguggaggaggcaaggugcagagggcacagcuugagaaggcgacacaaccagugacagcugugccaggguggucagcgcagacgcgcgcccaucgggguacgucagucuggaacccugcccccccccccgcccccagcaguguccacucugagaaccggagaaacggccgaccgccagggugcggcggcggggcugagaaccagucaggucgccucacagucgcgcaccugugaacgcuaggaguugcgaaccucgcaggcggggcccggccucuggaacgguggccgcgccgccgccuaaggucuccagccaucugacaggccgaaaacuggcggccgaacgcagcggggcgggcugaucgcagugaccccaaaggacaagguccuagacgccgaccccccaaccccaaucaggaccaggcccacucaccaggagcccagcgccgcgagcacgcucaaucaccgcgacugcggcagccgcuccgguuaacaacacuccccacccccugcgaaccggaacuucggggguaagacaccucacuuccggcggcgcggggcgcggcggaguggaccguaccaaguucucuuugcgcgcuccgaucucgccugcgcuucuggggcccgugcgcgagcaaccggaacgagcgagagcugugacguguggucgcgaccaggagagcagcgggaaagggcugaagcccgccacuugcuagucgccguuguagaaucaccacccuaaacuccuccaagacuccggcucucaaugugccuggaagauggggcguuccgcgggccgagccauuuggacggggggcaggagcgagcaagggccagacuuuaugucaggcaugaaagaaauaaaauguguaagcgccucauuccagggauagcuacgaca

SEQ ID NO: 12580 - RNA, 1573 nt, Mus musculus
gucuggacacaguggcuuuauuagcauggcaggguggcaauaggacuuaggaauuggcauuggggcccuucuucuucccaaaggugggcacaacauugacaaagcgccgguuguacugcauucgccucuuggcccggccugucuucuucuucuucuuuuccuguuuggccaccugaggaaaggaaggacugaucagacccugggugaccucucccaugccugcccaccagcuucucuccauaagagaacacagacgggaaauccaaaggccuucacuuggcugugauagaaagaaacaaaguccaaacaccaaucacucaccuugggagucugaccucucacuuuuccagcccgagccagggaaccgugaacuuuaccuguguuagggguggggaaagggaucagguuaaguagcaaggucacgcccagagcaacucuuccucccucaacucuugagcuuuuuaaugacaaguugggcccaacaaagaaugaaaguugcacaggcuuagagacagggucacaacauagcuguccacgucuugucuuccacuucaagucacaaccaguuugugcagugcugagagcugacagauacuaaggcaaggacucuaaaaaccaauccauacucuuagcuaacauucuacacacagagcaaagacaggaggagcacacugagaaccuaauaacaagacuuuaauuauuauuacuuuccuuuugcuuuuuuccuagacagagcuccucuguguagcccugguuggccuggaauucacagugauccgauugcgucacugccucccuaccaccagguuuuaguggggauacugaaaaccagacuuaacuaucacuacgaucuaaagucccuagaaggcacaaguauacuaucagagaaaggaccuaucacaugguuuaccuacagacauuccauuagcucugaaaaaaagcacucaccucccagcaugcggccugcuacuuccagaguggucagggccucuacgccacacuggccuaggguggccucauccuccagcggcgagccugccagaagcacgacuugaucuucgggggcaaugccuuccagggaggccacaugauccuuaaggaaaaaaaggagcaauguuuauaaguagacaaacuuuccccgugggccuggagguaaaggagugcaguuaggaaucagggaucaguacauacuuacuuugaucugggcgaccgucuccuggccggucaccucgaggguguguaguuccugggcgcggacaaagagcugcauguuggcuacugaaggaagaaaggcuugugagugaugauagggagcagcccaggagaaaggucgcgguacgguaaucaaggcgggggauugcgcggucucccaugcggaaggccaggcucgccggggacccggauggagacggagcgaaggccgcagaaccgcccuuguacuuugccuuccccgcacccucugagcccguagaccgcuggcuaccgagcgcuccuggcccagcagucccccgugucucaccuagcccgcggacgccgcugcugcuaccgcgaagauggagucaagaaagaggaa

SEQ ID NO: 12581 - RNA, 3614 nt, Mus musculus
uuuuaauaaagccauucucauuccaaucaauggaguacaggugaagcaaaaaaugaaauaauuucuuggcaagagaaguguuacauucuagaauuuaugauuguuuaguaauuauuuuuuaaaucaaagugauugaaacaauucuucagcaugucagaggaucuaaaauauucagaauuaauuauuuggcuuaaguuggcaggcuuccuucugcauaaucucuucugaauucugcccaucaucuggaaucacuugcuugggcauucccucccuuccaauaacuguuggucacuuaggugaauauuaauugguuguuaacuacuuuugguugauguuuuuuuugaaacugaacauuguucuauagaaagaguuggccagaauggaccugaguucaugggcaucccucugccucagccuccaaaauccugggauuauaggcaaaagcaccaaccacacuuguuagaaguuuugaagguaguuauaccaaauucaagcccauauuaccaaagccauuugaguuuuaucaauguagauacauucucuuuaaacuaacucacacacagacaauauaucuuaucauuuuaacccccccucucucucacacacacacagagccccaaauguaucuauacuucuaacuuaaugauuauuaaauguuaaauuuuauuucaaggacuaccagcugagagagacagaacuagagaggagagaugugugugugugugugugugugugugugugugugugugagagagagagagagagagagagagagagagagggagagagagagagagagaaucuaagcagagagcacaucucaggaaauaaacugauacuuucauguuaaauuuuagaugccuaucaccgacuauuccauuucuccuuacauucgacccccuagacauugaagcagaaaggguuacacauuuaagaacuguaaaccaaaauuacuucaauauagaauauuuaugagucaagacaaucaaccguguacaaaaaaaauuuacaugcaagagaaacaaggcaauguagcacaccucuagaaaaauaauuaaaaguuuugcugcauuuacagguaagugccacacugaggauuuacaacacaguaauuuacugcaaucacaggggaguuccaucaagaaacaaaguccuuacacuccagagcuuuuggaagguauugucggaaugcuuaauuacacacugaagauuccuacauccuugggauugagcugacaaaucauaaaggauuuucguagcauauauuagauaaaaagaguccaucauauuuagacugucgguuuagugucucuggcagguguggagccuagaagaauugcuggcuugauggugaucuuucuguauccugcaagccaggccuuccccgcaguaacagcgcuggaauaucuccagcccgugggagccuuuccguuugugcuuggugcacaccugaccuucuuuaaggacagguuuacagaucuuggaccagaagugucuugcacaacacagcccugcggcacagucugaugaucggaggcagacggagccuucuuguccugugaaggagacagaaggaaaauuacaguuacugcgaggccuguaccaucccacugagacaauucuaaaugcacuucugauauauuaaaugggaaaggcugagccugaaagccccuuuacuaccuuuggugugauauauuuuugaagucagugugguucuucugggauauccaucccccgcggcggcguuguggucauuaccaagguuuucaaugaugcuuuccucaauuuccccucgaggaaaauggcuguggucagagggcaugcauauuccuaagaaaaccagaaauagugauuaauccucaggcuguaguuuguugcugcuaauagccaagacaggagcaguggguuauacagacaccacugugaguuaccucacugcuguugcugccuuucuauuuaccaaaacuccccagagaaagcaguaucaaugaguguacugucgaaucguauggaacgccucagguauagccauuuuaaaugcuuuccuacuaauuguaguggaggcaguagagacuuuucugucuauuuuaauauuacccuuugggcuaggaaaaagaaauccagucacuuaaaagaaauuaaucuuaaaaaauaacuucucugcucugggugcuagcugcgcaaugcaguuccggcugccuggaagacugcgaucucacccgcuaguuacuuuacuguauaauuuugauauuacggagauuuuagugaguugacucuggaaugcugcuguaaccuaggaaguuagccaccccucaaguuuauuucuggagacuucuuugagacauuaacauuuuguggaucugugguugugugugugugugugugggggcaguacuucuuugaagguaguugaggguggagggaaaggggagaagggauggagagcuagggguguaagcgguacagagaucucuuuuaaaagcuggccagcagagauuaaucauucuagcuccccguugacaacaguuguaauagccuuagaggaaagagagacuggcaaagccacgcagaguccaccuuaagaaaaaaacgucuggcuccccuuucagaacgaccucucccccuuucucaagugccccaaggcucccugaagauaauuguuugauggaaggguccacuuucaggucuuguuguuagaucacagagggaggcaaggaaagauaaacuuucaagugcucaaacacaagccagugacgaugugucaggagaacccuugcaugagcacgcguuugcagguggcgccaccuuagcuuugacagaaccagagcauuucauuugauuccuggguccucaaaggcaaggugguucuaauuuaaaaaggaguccaagacucaccauuuuugcaguaguucccggggcagcacauagcgugccucaugcagcgcuuccugcgcuuucggcaagccagacagaucuguacaccuccgacgccggcugccccgcggcuggggcuggagcaguacucgucagagccgcacuccucaucuucagcgcaaggguagggcugugggaagggagcggacuggugagcaacucaagcauccugguacccacaccuucaagguccccaucugccucuucaaaagccccuuaagcgcgcugcucuuaaugcagugauuccaaacacaccccaaaucucacacaccuagaucuuucugagacccccgucgggaucacagcaccccucuuaccugguaguugucaagagucugguacuuguucccgcccucauagagaacucccggcgccacacugacagcagagcccggcugccccccagcaccacccagcggugggggcagguucuugaucgcguuggaauugaugagaacugaguucaagguggcacuggcuccuagcagagggaggcugcagagagccaucauuguaaacacggccaagaaccggacagcugccgcugcacacacaaccaucaucuccgaaggacgcaaacaggcaaaggucaggaaaagagaggucacuuugcacggcggcuggcugcagagucuggacugcggaaccucaacuucgggaccuccgcugguggagucucu

SEQ ID NO: 12582 - RNA, 44159 nt, Mus musculus
uccauuuaaaacaaccacuuuauuauucucauagaguccgggucacaaauuugggcagggauauuguggauggcuugcugcucuuuaauggcugccccuuaggugggaaggucugaugucugguaggaacuugaccacacggucuggagcuguaggcuuuacaggacuggugguugaugauggcuguuggcugcaacaccagcugggccuguugaccagagcaccaggaggugguugcucccgaggggauugguuuucaacaaagaagaauggccucugguuagaaagacuucuuaugcagauguucugggcucugcaggcaaguguuccaauuugcaaggcaagaaggaguucaugguuuuuaugacuuagcguggaagccaaacuaucacuuucaccaaauucaacguauuaacagcaagucaccaaccauucaggugaguucgaugcuaccucuuagugaauuuuggacaaggucucacaggcguggggguucaaggugcgguaggggauguauuuggaaaaaauaccaucugcuguucacggguuuucucauuuaucccucuucucagaaguagguuuuguuauccaucuuuacgaaugaagaagugggcucagguugguuaagaucuuuccuguuacaaagccugugcauggcagagcuagauuucaacuccgacuguacagugcaggcguccuccagcagcauaugaugauguugcuuauuagaacaaaggaaaaggcauuccaaggccagcgaaugaucaggaguuaagcuuuccucuuccuuaucacucugaagccaaaucuacuaucuuuucuagaugaguaaugaaauucugucuuugugcguggugacccaggguguugcuucuuuggagacugugugauuauuguggagaccccugaugcuccaggcaaccagacuuauccugggcagaggguacugcugucugccuaccuccauccagugggaacauagcaagcucaaaagcucuccauagaggcagcacacauaaccaguuugugcccgcaaugucuucccuacacacuuucuuuugccucuucccuuuaagucagacgaagagcauagcuuccccaaaguugcucugguuguucccaugauacucaaaaucuagaauuuucaggucauucuuuguacacauugcuuaaucuauagauguuuuuguauauuuagcccgcugccaaucuuuuucaagacuacagagggugagcauugcacccuccuccuguauuaguuacccacaaccacaccauauucugaacaaguagccaguaaguacucgauaggucagagggacccguggaguuuauuauaagagaaggagucacucguucccccuccacccccgcaaacucuuuuguuuuaugcugggaauugaacuccagguuuuacacaggccacauugaguacuuuuccgugaaacuauauccucagccuuugaaaagcaauguuugagagccuacauguacauaacaggcauugugcuagcuacuaaugacucaagugauccagaagcaggaaucuagaaaaucaaacaugagccucacaggcacuguguggcaggucagucacagcaaauccagugucuagaagcaaaauguccucugccagauagagaggccuccagggccagcauguugggaggcaagugcucuccauaauuuacaaucuaccagcugucaggagacucuagaguuagauauucagaaggucccagaucaggagcuuuucaauccuaaaucugaaauuucuucuauaaaauggcugagugguauuuaacccaggcuaucagauagaacaggguggucuuccuucucauuacagguuagccuuaucauaauaggcaaacucccucucauugaaggguguuacccuuucaccuuuaagugucccuaaacgucgugacuucugaguauucaaaacccacggauagaacccggauaaaggugcuuauaaauuaugggaaauuauuuucauuuguuaucuuuacucaauauucauacaauaaauccuugauccaaauauaauccuaguguauaaaacuauuuccucaacauacaaucaacaggaaucaaacagcucuuguaaauaauuaccuuugggauaugaaagaaaauguaaacauuuuauuuggcaguuguuucugaacacgugaauaaauaaauggaaaaguacauaugaauauuucuuuucggaguaacagaugccauuaaacgcuuauuuacacaucuucacugcaaagaacaguuacauaaggaaacuuuugucuuauaaaagguaacuucccacaccacuggaccggacaguuaaggauggugauacugguaguauuggcuuuagcagucucaguguugaaagguauucaucugcaagugugauaagaagagucaucaugcauugaguucauccaggucacgcacuguagaaaguuuccgauggcagccguggaguuuggugucucaugcgcuuaagucaacuaugacauguuuguaaaucugcguguuucccuuaaaacuggaagcaaagagaaaauuacgcuuauuaauggauacgugugugaaugaucugggugccugaacguuuaacuccugaaacuucacaaauuuggcuuucucugcaucccaguuauacacuugaguaaaggaguaaucgcuuccgagaauugcauauugguaauuauuuaucugaagagguuggaacaccauggauccucgagauggcauccucuggauguccuggaaggaggagccgccccacuucaugacuuuagagucgccaaugaaucuggucaagcagauguacacaucaccuuucacagagaagugcuucaccgcguauacguccuccauguuaggaaugucgguuugguuagugaauagcuguguugcuuugcuccacugguaaauaacagggcgcugagaacuacuggacaggauuaaaugagguguucugagggccaaugguggucuggcuauuucaagguauuccacaucaguaucccuguaccaggcauguaaggauuggugggaguagaauccguuuccauuccacuuguaaaugguaguaaacccagcuuuggaacugucagcgacaacgaaguaccaguugucuucaaucuugaauguuucgaugucauuggguuuucgaauuuugagaacuucaauaucuuggauuuuuaugaauuuguuugcaaaaccaucucgcuuauagauaugagagccaccaaacagcugggccacaaugacauagagcugagugucaauaacuaugggcuugcacaccacaguggacgugccugaggaaaaaaacaaaugagauguuagauguguagccacacucuguggaacauguaaacccaugguucucaaccuauggauuaugaaagggaggccaaaccaaccuuucacagggggucacuuaagaccaccagaaaauacagauauauaaauuaugauucauagcaaaagcaaaauugcaguuaugaaguagcaaagaaaauuuuaugucuggggggggugucauacaacaugaggaacuguauucaaggaucacagcauugggaaggcugagaaccacugauguaaaugcacaggcuggaguuggaaacuuccacagaaaucagccuagaaugagagauucccuggguuuaucaggcgggaccaaucuccaaggcuaaagcagcagugcccucagguucuggaccuuuauacccauggggccuuguuaugaacaaugacauugucauguuacauccaaccugcucuugacaauuaggauguacauaaaugaucagaacucuuuccucucacuccuugcagaaagucuuguuuuccuugacauacugauuuaauuucucccacuguaauuaacugccauuucugaacauaugcuuuaucaaaauauuacauuauuccaauaaccuuggaguuaaugcucuuaauggugucuguuagcuaagaguaugacauuuacgaauauaguguuaacuccuagaaggaguuuaacauuuggaaauccaaagaucuacagagcaaaucuaccccagacuuuuuugacuuuagcuuugagggaaggagucccacaagaaaucuuucuaccaauugaaaaaagaaauugagacuucugugugugucccccaccccauguacauguguguacaugugugugugugcacugcguucgugcaugugcauacagaugcaccugugugcacagauacauuugaguacauggagcucagagguaaaccucagaugucauuccuugagugcugccaucuugguuuuggaaguaaggucucugacucggauaucaaacuccuugauugggauaaguugacuggcucauagucacagagauccuugugucucugccucaucaaugccgggauuacagguggacguuaccacacccaguuuuuucauggguucuggggaucagacucagauuauaauacugaaauaacaaacacgucaccaucuaaacuaucucuccugccccuacuugcgacuucuuacagagcuaaaguuacuguauaacuuacagaggaugacaacaucuauggggucaguuuucuuuucuacacaguaaggguuagaguauauuagggaauccaucagauuucaucucagggucccauauugacugaccgagugaucgugacugcuuggugagcucguguugagaagaauuccuuggcuacauauguauucugcaagaaauaaugucacaggcaggcagugacaccgguccacgguggagagacuagugaccauaucacauuuuauuugugaucugcaugguuugaauaugugcguaucuccaaacuuguuuugaaauguaauccucaguggaacaacaauauggagaccugaggccucagggaagugauuaaaucaugacaauggaguccucauaaaagggcuugagagaguuccuuuaauguuuuaguccuugcuguugcccugugcauccauagaaaagaggcugucuuugaaguagaaagcaaguucucacaagauacggaaucuguugcacuucccaacucccggaucugugagaaauacauuucugauguuuauaaauaacccagccugaggcauuucauuacaguaccgggagcagacuaaacuaucaucuaaagcaagccuucugaaaauccgcaagcagaugacucguuccuuucaaguucuagucuacagugccauccagagcaagcugagcaugguaacauaugcaugugacccuaaugcugggacugaagcaggagcguuguggguucaaggccagccuugaugacacagcaagauccugaaacaguguugugugcacacauccaaagaccucacguuagacagcauuagaaccuggcugcuacacacuggagauuccaggaagaaagagaagcaucaccaugcuuggaaaacaaaaaacaaaaaaaaaacaaaacuauuaggauaccugauaaugggugggcuuaugaccacuggcaaaaucuaauuaauaauuauaaccuuauaauuguaucuugcuuggugcugucuucaaagugcagagucucacuauauaucccaagcuggucuuaaauucacaaucuuuuugcuucagccuccugaguucugagauuacaaagguguggcacccugcccagcuaaugguggcuuuuuaugaggacauugggcuguucuuaggagcagauuucaagauguuagaaaacggcugcuuucagaacuguuuugauugauauuuuacaacuuuaaaaaccguugaaaugggaacaagacuuaagagcucucccacgugggaacaaauggaaucuaugaacaaauuaagaaaaaaacguugaccacaggcuuacacacugcaggauuucucauaaucucugguauauuuauaauuaaucuccaagagagagagagauuuuuguuucaaggaaagcauuaacaucuuauuuaaaauguuaaaucaagaguuugagaguugacccaaaauaguuuucuuauuuaauucacuuacuuucaauucaagcagauguaguuauaaugauaacuauauuuuuguaccauguauucucauuuauguauuuguguccuuucuuagggcuagaaucggcaaacgacuuauuuccacuuuccuuuuauucuuuuaaaaaagcuuccacccucucccaugugugugugugugugugugugugugugugugugugugugugugauguuauuuguacauaaaugcauugaggaugcacucaucugugugugcauaugugaaggucagaggucaguguugggcauccuucucaaaugcuucuccacugauucgagacagggucucucacucaaccaggagcucacugaguuguccagacuggcuagcuagugagcucucaggcuccaccugucugagaaucuacagagagaugccugcuacuaugucuuuuuacaagggugcuagagauccaaacucaguuuuccauguuuaugcagugacuucuguacccagagagccaucucccuagccauacucccucugcuuugggaaaacacacagcacaguucauuguuuguuugaaauagggucuuauuauguagcugagcucagccuucugaucccaucugucuugcucagcuuuccaagagaugggaucucauaugaguaccaccaggcucggcuuauuuuaucuucuuauuuuagaguuaagaacaaugaggauacagugaaggugauggguuugucuagccaaauaguagcagaaccuagauuagaguuaaucacugagaucuagcacuuuacucugaagaaaaauaaucguccuucuagaguauauuuuauauacucaguacuaugccaaguuucuuuucuuuucuuuucuuuucuuuucuuuucuuuucuuuucuuuucuuugcuuugcuuugcuuugccuuuucuuuucuuucucucuuucucucuuucucucuuucuuucucucucucuuucuuucuuucuuuccuucuuuuuuuuuuguuuuuuuugagacaggauuucucuguguagcccuggcuguccuggaacucacucuguagaccaggcuggccuugaacucagaaauccgccugccucugccucccgagugcugggauuaaaggcgugugccaccaacgcccggcuucuuuucuauuuuuaauauuuauuuauuuuauguauaugagugcucuauccgcauguacaccugcaugccagaagaggacaccagaacuccguagagaugguugcaagucaccaugugguugcugggaauugaacucaagaccucugaaagagcaaccaguccucuuagccacugaggcaucucuccagucccucugcuaagugucuuaacuauaggaucacauuuccuuacugugaguuagauacuauucuuauuuacaagaagaggaauuaaagguuaguuaaaguuuagcaggcaaucucaagucacuuaguaaaaaguuugggguuaacacaacuaagaccagucagagcauuucuucauaaacuccucuguuucugcugcccuugggcaaagcaguuuaauguucuaguuaguauuguuagguuuuuuuuuuauauaccuguaauguugucauaauuccggaaggucuucucuacguggucccauuccaggaaaaugcauuuuccaguaaaaggcugagcaaugacuacauauucaucauucaaauaagaaaaagugucuauggacagcgacugauaagguaggucuugggacuuugcaaauucugcaaaaauaggaaaagaagaugaauaaauguaagcuaauacuacaccucgcacuucuuggcuagaucccaaauacccguacaucauauauuuauuucagagauauaauaaaaugacaauucugcaauuuuuuaagcauguagaguuuuaaagguucauaauauuucacacauuaaaucgcucagaugguucuuaacaaauuuuaaaaaaucaauuuuuauacgugcaaaaaagcaaccuuucaaauaauuuucugcuguaaaaugguuuucaauacauuaccuguaaugauacagucaaaauccuugggggagaggcuauugauuuuccguuucuuauauuccggugggccuucacaguagaugucuuccacaguugcauugguauggccgagccauuccaccagccacuucaacuuacagucacaauuaaaugcguucccucuuaggucccugaaacagaaaccucugcugcauuugcagugcauggguccugucgugacccacgcgugaccagcauuaaccugcacaugcuccguuaucugugucgaacuugacugccuauucagcuugggcucagaaggugaucacagagcaccccuaaagccacccagauccuaguaaccuauuuuugucuggauucaaugcugucuuagacuagaagaguagcuagagucaauggaaauagugcaugagccauauacauaaguugcauuuuuuuaaaaacaggggcacuaaggaaauguaaaaaugaacagguauuaauaauuuuaaaguuuuauuuauucuaauacauucaaaaugucauccucuagauguauaaucaauauaaacguuaugagauagccuacugauuaaucaauacucuguucucucucucacucuuucucucuguauuaucuuugagauucucugauuaguuuaugcuuacaucucaauugugaugcuaaauucgcaucagaaauauauuaucuguguuuagaguucauaaaguuuauagcucaaaaauagauuuauauuccuuaaguuguuccaaauguaauuauuuucuaauauaauaaaaugagaaaaaaacugcaaucuaaaccuuaaaaaaauuaaggaucuugaguguagccaugcaugcuuagccuguucaaagaucaaggcucagccucuuggacauaaauuaauaaauagauaaauaaauguaaaacguaaaaugcagugccucauuuguucuagcagcacaccaucccccauagcuaagaguguccagcagguaccuuacugggucuaaaggacagaauucggugauugcuguaugauuauuuaauuaaauccagugagccacuggcuuuucuucuucauagacauaguuaauccugacccuguucuguggucuacaaauuccacuuuaauaagaaaugacuucagcauagcugaguuaaggcagacauaauuccuacagcagccugugccuguaacaagcucuauggcagaguuuaaguuuccacucauggccuugggucaccaagcucucgguuuauucugcuucuguguugguuuuccacuucuuuccugggcacacagaguucauaagauuggugcugcccauucuuuaugcagcacauaaauaauuuuaaacacaagaguaucuagcuauuucuuaaagucuauauucauuuaaaaaaaaucaauagaaaaauccucuaagagacaaguuaucacgaauccuuguacuuccaaaaugucucuugauuugucuuaaacucauucugggauucucugggggagucugagcuaaauuuuaaguguuacauugacacaggaugggaaagaagccccaucaugaacuauauuccaaguaagucacagggcaucaucuaacuuucaaaaaacguucccagaagugaccucaucccaagaguaucagccuuuuugggcuaugguagaccagaguagauaacugaucugucagcucucucaaggcgguuucuugauucuggcacuugcuuggaaauaaaccauuuuucaggaauugggaaagcaggcaugauagaggagcuggggaugacugcgaagaacaaagaaagguuuucaucagcuucuugauuugaagcuaaauucugggcuuagaaggaaauuugaauuuguuguuauuugaaaaagcuguuuuggaaacaugaauauagauauaaguauagauauagauauauauauccccucucucuguacauguauuguuauauuuacuuucucuauugguuccaucaaaacacauuuauauuuauuuaauuuccucuuucuauauucuaucgcaaaguaaaugauaguaaaaaauguucucagaauuauucucaaaaauaaaguaaagucugaauugcugggaaaaaaaaguucucacacaucuucccauuuguuccuauuuucuacuuuauuuauauucuacucuaugacauuuaaaugcccugcuaauguucuggaagacauuuaaagagacuaaauugcuuuugggaggacugggcauauagaaguugcuuugcuuacagcaaaauauacaaauuccuugcaacagaucuuucacucugaggcuuaaaagucaaaguuugaaagcucuuuuguuugaaaaggggucaaaaguaauuaaguucauucccuucccgggguuuaagccaaauuccuagggauuaagccuagaguuguuguucaggcuaaugagagaaaaggcaaacuccccuccccucccccacuuccugcuccauuucugcagccugaccaacccauggguguaaccuuucaucuuacucugucaguuucucagacuccuuuauguuuuuucuuuguagcccuauuuccuggacuucaugagaaaaagagagagagagagagagagagaucuugcaguagcgguggcgagcucuccucucuaggcucccccaguggcccuuuugaucaccccuaaagauaggcacauacuuugccagaguaaugccuggguacuguguauucacaguuucccaugcuaaaucacaaaggagucuaauguagucuguguagguucaagugaugucagugaaagcauucuaauuuuaaagccaauuuaaaauacuaaucaucaauaucagaucucauuaauuauuuucaauuaaucagucagugauuucuuaaguccucuuacacauuuguuaaggaauccaggccuuugaaaaugucuuuugggagugucuggagauuguuguuugcaagacuccuaggaaaagaaaaagaaaaagaaaggugauacaaaaaaaauguagugaaaaauucaauaaauguauuuaugaaaaagcuuacuuauaaauuacuuuuaaaaaucauuuucaaucuguuaaauugcugggguucaaacccaggacaagaggcugagguuccuauuuaacauaccuggccuccaaguucucccagcauccuucagucccuuccugguauaccccacccucuacuucccagccaacaggcugggcuucuccuccccaagagacucuuuccuauauacuggucccacuucucucucuggucaccuuuucucuuuuccuucucccucuccucauggugacuucucugaucuuguuccuugggaccagugaacuggccugagagcgguuucccaauagaccuaccuuuguauaauauggcuugaacuggcucauuucacacaaggagaaauaacauaucaaugaucuauguaguacuuuuauuuuucccaagacacuacucaaauuucuguuguugaauuuucaauuucugaccucuuugcuucaagauccacuuagcauugacguaacacuugauacgucuugauauugacuugaggcaauagcaacaaugaaccaucagcagaauagugcgugggugucacucuuagaauucauaaccugagacuccuacucagagguccaaccuagaggaugcuucccaaccgaugaccgacuacacuggaugauaauauccaauuccaaugcucuuccucuuuuggcugagacuuugacuuccuuccuuccccagucggaucccuugcuucagagggcagcuaaacucccaaucccuuugccuucgugugcuuucuucuuuccagaguaaguucccuuguuucugguuuuccaucuuggcacaaagcuuucucacuaauauccauccauccucuuuaauuauucccuucuccugacucuuacccugucaucacagaaucauuuucuuucccuuccuaaucgcugcucugcaaaugacuagaaugacucugaagauggcuaccaaccagaaaguaguucagauagcaacaagguaagagaaauguauacacauuacagaaaaaugaacaggaacaaucaagcucuggagagggcacaugguacugacacuuuugggguuuugucagcacgcaugauuuauuucucacaauaacauuuaagucuagaacagaagagccucuuguuggccucaaaaguccuugaaaaguucucuuaacuuucuuuuaagauauucuuugagguucuaucucucuucuacuuccucuacuuaaauaugggauuuuucacauucgagcaguccugauuuuuuagaaaguauuauaaaguucauuauguuguuuguugguuuuagaaauuacuacuagaugucaaaacuuuuuuuuuacugaaccauggaauguaagaaugggaaagaauguaaauaauuagaagguuuaggucuccacgacaauggguuuggugaugaagggccuagcauugcagucagucugagcuggguggaaaucaggucuccaccacuuuguagcuggcugacuucugguuuacaucuucucuaacacuccugcuacaccuguguagaacaccugcuacaggcccaugugcuaaaggcuuggcucucagccucuguuguguuauuggaaaugguagaaauuuuaagaaguggagccuagugggagaucauuugggcuguguccuugaaagaagacugugacucugguccugaccuaugcugguuaaguuuuguuaauuugacaugagccagagucaucugagaggagggaacucaguugagaaaaugguuccauccuauuggcuuguagacaggccugugggacaucuucuugauggaugauugauguggaaagcuucagcccacugugggcagugccaucccugggcaggugguccuggguguguaagaaagcuguggaacaagccaauaagcagcauggcuggcuucugcuucaguucuugccuuccgguuccugcuuuggcuucccucaagagacuaugauucaggauauguaagccaaauaaacccuuuccuccccacauugcuuuugguagugguguuuaucacagcaauagaaaaauaaccaacacacuuccuguuucuccauguuuucugauuguuaagacuuuaauuccuccauacauucccaccaugcuaugcuaccauaggcucaaaacaagcacgaacugaaacuucuauagguggaagcaacaauaucucaucucaaacauuguuagaaaaagaaaaaugaacaagaaaggaagaacaagauagccuaggauaauauuuaguaucgagauugcgcuuuaaaaugguagguggggggaaugagaagauggagggggaggggcaagagaaaggguaaaggcuccugugugcuauuguccagaaacaauauugggaaaauggauugcaugaauggacugucauggcuguccacguauacagcaauaacgaacaaugugaagguuaguuauagaagauaggauggcacuuccuaggauugaugaacaguaagacugagaaagcuggacuaaaaggaaauaagacugggucaugccaaaggcuuuccuguccacucagccuuggacuggauuucagauagcuucucugggucucugggaagccccagagacaucugaucgauuuagauggacagacacaggcagaggggugugagcagacucaccaaggaaccaaagcuggcagagucugggaauaacucaauggaaagcugaauggauucugagaacgaucaggcuucuagugcagguugaaugugguaaguggagaaaaauguaucacaggcucggagggaucagcaaaccuguaaaugccgagguggguuagagaacugcccgagggccaguuaagaguguucaacaauucccaaaugaggagagaguggaaauauuaguauuccauugcauaagcaagggaagaucuuucaucugccuuugucuguagcugugaagaauuggaaacaacgggcaucucugcuaagaagggauuauguaaauaaacaaugguucauaauuaacacacacuaccucauagaucuacaaaaugaauuauaacaugccuaagagaaaauaaauauggagaacagucugaagaguguagucuccaggcagagagagaggucuguauauauaggucuguagauauacaaaggaagcucuauggagagaucuacacacuuuguugauugagagucuugugcccugauagagccagcagagaagaggacucagggccuccuggauccaccacaggcaccugugggcuucagagagacucuccagagaguagagacaccuagggcaucaggccugggcuaccagaggaaaaacacucuuugcaguuuguucaauauuaguuuuuuauccaaaagggugaagagaaugagaucuugggggcuauuagguagcugggacagcuguagagccugagagagcacuguuugcuuuaagauuaggcuuccacuaggguuguuaggauuauucuaccucagccucaaguucuccagccuguguuacauuuucucagagcuccccacuccccgcagccugcccuccagccagcuucauagagaacaauuucacauuacccucuuucuuggucucuucacugggacacucugguaagaacaaggguuaaaucagagccagacuuucauacaaaucacaagaauucuuagaaauaagaguaagaaaaauuuggaguguaaaagagaaaggggucuggggacagagguggccuucaaaggugucaguugacuuucagcugggaugagcagaggaacaguagguccuugccuugacccaagccugccuugaucagucucauuaggagauucuccaaaucagcuccagagugcagugcaaaguggugugagcagggaauggggggcaggcuugaguucuggcaguuuucuaugaagccgguuccucuuggguuagaaugaucuccaagucccaaccuugcuacugaaucacaucuccauaccuuccccugugaaaggcuuguggcuucaucuuuaacaagagucagaugauucuggaagcagugcuguaagccacacgcuuaagaaucauugccucugacagggguuuuucuaggaugucccagagacacagaguauuagguggggcuaauagauggcagaagacaggacagugagaggcugaggaaagcauuuccucacuguuaaccacuccuccgauugcucugcuuugagagcuugaagaaugcgcuagugccaucaguauacaccuccaaaugaguaaaguuagugccaucaguauacaccuccaaaugaguaaaguuagugccaucaguauacaucuccaaaugaaucaagaucauggaaagggaggcagggagggagagucagggagggaggggaugaggagcauugagggagggagagaggcaggcagggggagagggagagagucagagagggaggaagaggggcagggaugaagggaaaggggcaggcaggggagggggcagguuggcagagagggagaggggcaugggggaagggagggagggaggaagggagggagaggagcagugaagaagagaaagaauagggaaggaggcagggagagcggcagggagucuggagugggugagaggaagcucacuuaucuaggcauaggaaagaacagaugauacuucuccaggauucagucaugugggcuuauccccaaagacaggauuuaaauuaaaccauuuccuagagauacugccacuaaauguuaaacaccaaacccaggcuaauuccccacccuuaauaccauuagcauaggauuuggggagauuaaauuccuucaugagcuuaaaagugcaaaucuuacucaaaccaaagcaggauauuuaacuuuuaagaucugaauaguugguauagauuucaaaugggcaaguauuauuauuauuauuauuauuauuauuauuauuauuauuauuauuauuuggaagaaaagaauagcuaugggcaaagacaaucaguuuguuaaauacuaauacuccaugacccuuucccccuucaguaacacauaacugucaccaugacuguggaccaaaggcaccaagacuguuagcacagguauaaggaaguaucagagggaaaguguccacagucugccuguuguggaauagcugcugggugcugagcacugccggggauaggaaggaugucuacaauagcucaaagcaaggauaccccugaguuccaaaucaguaaagaagccuuccuuuuagccuuaguguugacagguuugugaggauguaguauaugguauaguggauaaaggggaauuucugcuaccagccugccgagguucaaagccuggagcaggucauuagcccuccuguuucuagauuacucauaguuaaaaugaugauguugguaaucugugaacugauggugagggcugggggugcagcuuggaaaguagagagcuugccuaggguguagauccauuacuaggaugcuugacuaacauaugcaaguuccugaguucaagccccagcacugcauuaaccagacauggugacauauaccugcaauccccucauuugggagguaaaagaaggaagaugagaaggucuaaggucauucuuggcuacauagugaauuuaagcccagcuacaggcacauaagcccccuugucuugaaaagaaagaaaagagaagcaaaaaaauaaaaauaaagacuuggaacucaauuaaucugaguaucacuggugaucuuggccagaguugcuccaguggaaaagacagaguaagacucgcuagaguggagacuaggggucaauuagcgcuucucugguaugagugauuaagagaaaagaagucuccaauguccagugaugagggcuauuaaauuccaguuaauuuagcuauaacuguuaaaaaugaguucaucuucacugacagugaggcuagcaagguacgugggaacaccuagcucucaagcuuguuuggagauuuaaaugaauggccagcugcacgguggugagcaugcauccacagggagaagaugaugugugucacgcacagggggaagcuaaugugucugcuuggauuuggggccgcaggugccucagugcccuggugccuucucgaauuuuguaugaaacuagaauaccagcaugugaagcugcaggccccuagagacacaagcucaagcuaaggaugguugcaggggggugggagcaccccagauggcuguggguguugcuuucuuagcagcacagcuccguggcacugaaacaaaugugcugucugauccagucuaguuugccauagcagcgauuuuccaguagguuccauugcuacaaucaaagguuuucucaggcaagccaugagagcaccgaggcagauggaaugaugggaugucugccuuccagaaugccugacccuggccagugggggcaauaucccaguugaucugagagcuggguuguaggugcauucugaagugaagcuggacuuucaaggaccccuauuggcuuuggaacuguugcuauggagaaacuggggaaugaggagggcacuuguaaaagcaggcucacaggauggggagguggcgguccagccaugggcauucacagcgcugcgugcuuuuucccuaacucggugucuugggacacacacaugcacacacacacacacacacacacacacacacacacacacacacacacacacacgaucccuugccacaagaugccaauuaaaaaggccaucaucagaagugacccacucccagugcccuagccucgaaccuccccaaacugugagcugaauccuucaauguuuaauuaguauuauuaaaaaaaguaugccuauauaguauuaggacacucagaauaaagcaauucagagagggucucaauacuuuuauaggggcugaauuacaagaguaugcuauuauuaugccuggcuguuuuuuuuguuuuuuguuuguuuguuuguuuguuuuaaagugcuuuccuggggcuagaacucaggaugccaggcacauaaggcaagcauuuuuguuuguuuguuuuguuuuuguuuuuuguuuguuuguuuuuugaaguaggguuucucuguauagcccuggcuguucuggaacucacucuguagaccaggcuggccuuaaacucagaaaucugccugccucugccucccaagugcugggaucaaaggcaugugccaccacuguccagcuauaaggcaagcaucuuacuuaguuaucuagagugguuuucuuauuuauuuauuuauuuauuuauuuaucauuuauauguagcuguguucagacacuccagaaaagggcaucggauuucguuaaggaugguugguugugagccaccaugugguugcugggauuugaacucaggaccuuuggaagagcagucggagcucuuaaccgcugagccaucucaccagcccuagaguguuuuucaaguugucuguaaaugcccuuugggaaguaagccuagccagacaaacacacaaugggguaaaagcucacuguuucuuuaggaauggacccagucuuugcagcugauguaauaucaggccagagcggaaugaguuuguucauccaguucuaccucuguaaguuugggaauaaggguggggcucuugucuucaggaucucuuucauuguuuucuuuucaaauauucauuacaauaauuuauuuguguguauguauacaggcaugagggugcacguguguguguguguguguguguguguguguguguguguguguguguaaacaccacaauauaugcaugaagguuggaggacaauuuauaaagaguuagcucucuccuuucaccacgugguccuaagauccaacucaggucaucuuggcagcaagcaccuucaucuacugaggcaucuugcugaccccaagaucccucucuugucuagucauuaucugaagugaguaccaggagccaucagggagaagcuaaaaacuagcagguaaucuuccugagaugguuccaccauggacuguuaaaguuaacgacagaaugacuuauuuaggcaaggccaagaagaauuucauuuuaggaaauauuacugcuauuaauaugcuuuuccuguuauuauuaauauauaauaggccgcuagguguuagcccacccuuuugagcagaucucugcagaacaacaaaaauguacuuucuuguagugaugcuauauagacaaacagaugauuuuuuaguucuuaaugaugaucuuauaaggauuaccaaaauuauauuaguaauuauuaagcacuuuuauaauagaauugcuauuaaguccucucugaucacaaacuucaaccccucugcaacgagaacucugccagucuuagugucaugaguuaauugcuccugagacagcaagcaggcauccacaacuuaaagcguguuccaaaagguuguaaagcaauucaccaaaggucauaaaaaggaaacuaaggauuuacuauaagugcaaggacagaagaaaaaauauugacuggguuuaacuauauaaaacuucacuaauaacuuagucguaaaaguuaugguguagcacacuguugaguuugugacagaugaugaauguuuagccagauaauuacucuuaauguuauggauguaaacagucucugcuguaaacuucuuaucugauuuauuauuuuaauuuauguguaaacuuguugccauuuggucauguauucugaaagauguauaagugcugaggacauaggaagaagacagaacaggacucaagaagaacuuugaagaaaagacauaacauugggaguaaaggcauugagagcaagggcaucguugugacaucagagaaggaggaaagggcaagauuagaagaagagagcagagagaaauuuuuagagcaaacuuuuuggaggagauauuuuguagaaacuuuuuggagaacuuagaaauaaagacuaaaaucacuuuucaaagugucccucuuugcuuccugugacuucaacuagcaggcuggaaguuagagccagcucaguuccugcagagauagaacaaaggcuccauuacuuaucccccaccccaccccccauguuaagcuguuaaucaccuaaacccgcugcuuuuaacucucaaaaagagcaagaaaguuuuuaggacuuuucagaagcuaucagcaagcacucagaauaguuagugggcuagaagguccggagagacgauuagccuuuaaaucuacacuugcauccgauucuguguccagguggcuccgggcaagggagaguuucgguuucuuaaaaacaaaaaaaugaaacacaaaaacaaaauaaaacaaaaaacuaguuauguugugucgacauguuuuuguuuuaaucuuagaugugggauaagaagcuguuuuacagcaggugacuaugauuugucuccugcauuagcgggggugugaucauugcuagcugcauauaguuuggaauucuggggacucuggagaggggauaaaugucagaaccccaagaggggcaggagguguucauucugcauuuagcuuucucuuguucucuaaauuuuuaaagcugcuuuucuucucuguauuuuuggaggagcuguuugcauuggucucuuaaaaccauguucauuaacccauuagcaacucuugugacuggcuuucuuauaguagagacugugggagcaaucugcuuuguccucuaaguagcagcugauccagucauuuuuccugauguggacaccaugagcugcacaacuuuuuccucuuuguccacuauuuucuuuucagaaguuugucuuuagccagauuggguugcuugaagaauauuccugcuagcaaucuuaguccauuccacauugucuuuggcuucugaacuugucaucugccuaguguacagggaagccuuuccuggcucagcuuucacaucucuacaccacaaaugauggacuagaauuauugugucagcuaguugagagagcucuaacugacauggcggaugccuugcugagaaccuagguaacuucuggcuuuguugcuggugagaaggugagcagcguccacucaggcauaauucacacuuucauuuucacacauccaggagagcaacugucacugccuaugccucccaaaaggucaccuggagacuacaaugagguaagacuaugaaacaccuuuauaaaugcuuccugugguguacacaggcuagccagcgcacugauaauuccucacugcuugaauguuuugccuuucaaucagaaagaauuggucaaagguggagaaagugcccuugauagccucacaccuuaaaaauuaaaaaaaagagagaaagagagagagacagacagacagcaggaaggaaggaaggaaggaaggaaggaaggaaggaaggaaggaaggaaggaaggaacuccaggcuuacuuauaagcaauaagcugucgauaaugaacucaauguguggagcaggcagagggacauuugauuuucaaaggaugccagcuccaucuccuuaaaggaaagcaagagaagcaggaaacauaccuucaagaacagcagaaguagaaaggagaaaaacuugaagacaaagccacguagugagaaaauauccaucuacccaguugcucuuccuguuacagaaggagguccuccaaggugggacugcaucacacucauuuuuaugaguccuacauacuucuugaaaagcucaaauugcauccuaugugguuaugacuuagaaugaccaauaugguguugccacuuuuauagauccaaauaauaguaucauagauuaaguaaagaugccaaagaccuacaggaccuguuugucugaucagccauaaccccucucucuccccacuccugguccucauuacaaacaccaucuuuacauugcagguuuguguaaucuuaagaugcaugucuuucucuugaaagacucacuuucacuuuuccuuaaccgugaaagguucuagagauaacucucuacagguuguagaggucuccuguccugauagucucucuaccacuaaagcucuaaacuuaaauucccauuuuauuugaugggcaaaaugagcugcagucaagcaaagcagguauucuucagcauggugaucuacagaucuuuuuuuuuuuuccuuucuuuccuccuuccugguuuguccccuucuuuccccuuaucccuucuucuuuccuucccuccucccuucuuccauccuuuucuggugagauagacagaacauuuucuccuauucuaugcaaggagucugagagaagccacaugcuuuuuaagauuggaacacccuagcaaguugagcacaacauacuugucuuucaaguuccuagggagaccauggaucccacagccucugaguagcaagcugaugcugaccauaaggcagaggcccuguugggugauauguauauacauccaagaggucucagacuaaguugucuuaguuauucuucuauggcugcaaagagauuaaccaugaccaagguaacuuauaacagaaagaguuuaucggggcuuacaguuacagaagguuugaauucaugaccauuguggccuggaacaugguggcaagcuuagcuuuaaaguauagcugagugcuuauaccacagcaugaggaagaaauagcuaucuggaaauaaugugggcuuuuuugaaacuucaaagccugucccuagauaguaacacacaaucuucaauaaggccacaccuccuaauccuucccaaacaguuccaccaacuagggaccaaguauucaaauacaugagccuaugaggguuauucucauucaaaccaccacaugagguaaugaauauucauuucaucuuuugugugcuuauuuauuuuauuucauuuuauuuuaucugauaaacauucugcaaaacuagacuccaugaucaaaaauuacauaauguucauccuguuacacagccauggucacaucauauuauaucacugacagggagggcauuguaaauuguguucauauuuuaaugaccauauacaagucuuagaagacagaauuguaguuuauaaaauaagcuuagcuaucauuucucucuuguugcaauccaaacgcaagagacaguggggccuggcagguauagcaggguaaccacauggguacacuagaaaauagguucaaaggguaaguguugcucuguuucaucauggcuuagagcagaguggugcugaggaaguguggagauaggucaagguuaacagagugacuaugacacauggauucauuacaucagcagcacggauagacucauauuagguguuuaagaaauugccuuugaaugauuugaauucauugaaugaaugaaugaaugaaugaaugaaugaaugaugaagauaauaaagcugcaauucagcaauggaaucgauguuuuuauaguucuauaaggaaccaguucuguaaucauaucuccccuucaagauucugucucugagcuggaccagguugugcaggucuggaaucccaguuucuaggauauuugaggcaagaggaucauaaaaucaagacauguauagucuauagagcaaguucaaggcuauccugggcaacuuagugagaugaugucucgaaauaaauauuacuccuaauaaaugggggucugggggugcaacgcagugguaggacacuuacuucuaaugcaugaggcuccagauuuagaaucuaguaucacaaacuguuucuucaucucuaacauggguagacauuuuaucuuuaauguguauuuccuuuaaaaauaauucccugcccccugucuuaaugagguggaagaagcuagaagaagaaauucaugugguuucaugugaugagauguuucccuuccccucugugccauuucaggugggggucauccuuggcuguacagauugcccuccacauuagauauuaacuaggagcagcucuuccccuccacccacuaggugcugguaacagucccaucuugugacaagcagguacagcuuguauuucuucacauuuccugggaaacaaaauugucccuuguuaagacugacagcuguaucucuaaccacccauuggauaauugaguauuucagcuauaaaauagguugucccugcacuauacagagacugccuauggcuacaucagguuuaaaggcauauagagucaggauuuaaacagugaaaaugagcagugaauaucaaauuaaaggauauuagucaccccauaauucugggacuuaugaagugagagaugaugaggauaauaaaaguuauuucaguuauguuauuucccuacauagauugcuuuucuaauuauauuccaucuaggcuaaaaauaguaaucauaauccauuucccgaguucaugcugauauaugacaggggagauggcaaaugugcaugaagagaaagaauucgagcucuuacauuuucauagguacucauaaaaugggugccguaaccuuagaugccaaacugaauuugugagcucaaaaauacaggcugggaccauagcucagugguagagcguucaccuagcaagcacaaagccucuagguuugauuucaguacugcaaaaaccucaaaaacaacaacaacaacaacaacaacaaaaaccaauucagccaaacaaagaagcuuaaaaaaaaauaauagcaucaccuauacuuacaagugaaucaaagacuugaguccccggaaaguaugucuugaaauggacuugauauuguuguuuucuaugaaucugcaagagguaacaacauucucauuuggucagacaacuauaggcacugaagagaaccuguccugaaucaagguuaagcggggagaguuuucuuacuuacaaauauucuagauguggaagaccaauaaaagcaucaucacugaucacaucaaaggaguucgacguaaauaaccugcccagagagaggugcacacagugagaagaguuacacugucagccgcccaucuccccugccuuggucucucagagaaccagguggaggcugacacagguaagucugcguuucucuacagaaaaccuuggcagcuuuucucacuccugaaugucuccuccugacgugcucacugagggcgugcuugcaggcuucucucuuugggugaggugccauccguccugggaagcauuuugagagagacacaagcagaggaggugggcagcuggugugaccaaaucaacauuuucguggucccauuaacgaagacgcuggcagucaucuucaugggaaaacaugcucuagaaacuucuggaauuuauuuugacaggccaaaauaaugaucuuuaaucauuacuuaaugauuaauaccaggaguuuaauacuaggaaauguagggaaaaaauggaccuccaccuuuauuguguaauagcucauagcagguguaguggacaguggucauaaacagugaacaccaacuuuuuggcugcuuaaaaaaaaaucaauaaucugagaacaggacaggcugaagauaggaacugaugacauuugcacaucugaggccauuuuguuacuaaauaauuaagauaaacacuuuuacuugggcaaauuuauuggcauuuucaaaauccacaggaaccuggcuucaaaauccccaaggaaaagggcaugaggcaaucugucaccaaaccccauuggacccuuuggagaacuugccagauuucuuuaaagcauauauauacacauauauacacauuuggcuaaauaauaaguuugugugucagacaguuuaauaauaauauagaaaugcuguuaguaaaucuugugauauuuuuacuuugggaggguagugguuaaauauaauugcuaguaacuagccaagugacuucuccccugagccuguuaacagaggagauuaagccuggagauuuuuacuuucugaaguaguuugaaaugaguaauuuauuggauacaguaaucaagggaggguucaacaugagcugaggaguaggagccuguaagcgaagccaaaggaugggaacacagguguguggauuuuccuaucagcucuauuuuuccagggacuugagacuuuccugucaaggaauggaggcagaggaggagccagccaaaugaagugaagugaccuuuucuguuccuucccaagcuaucaauccuggaaugguguugaguucacuucuaaucccucuucccucuuacgucauggcucuuuuuacucaaguaauucacugggccccgaagagcccagagcaacuaaucaaacacacauuacagccugugcuuauuaaaaugaaguccaagguucaugacuuccaucacuucucugguaauugucucuucucauuuuaugguuuuggaaagcaaccugaugcucagccuuacuccuugguaagcugacacccaaaggcuugagcaggcuucaggguuuuguuucucuccuuaagggcagcaaacagggauggagagaguagaauccaguggcugcagauagcuucuccaauggucugcaaaaugcccugcggcgcagcugggaauucagcaucccauagucccaaguugccggaagaaauagcuuccaucccuuacguuaagucaaaaguaagacaggcuggaaaguggauaccagugagcaucccuugccuaugccugucacagagaugaaagauaggauuucuaaaauuuuuguuggccuuuucaguacuuacuuuuagaacuugugcuaguaaccauuccauuguaaauuuuaaacaaauauuuguugaacaaagagacauuugcuuuacauugcauucuagucacugcuagguuaggauauugaauauaaucuuaaagcaaggaccugccuuuauuugcuuuugcauccccaacucuaucccaauuccuguuuuuuuuuuuuucauguuugcugaacuacauuucaaagacuaaaaucucuggcuaaaacuauaacuacaaagcaacauuuucuaaggaaagaagucaaaauucggcagagugcauucugcaugacuaacagaaaaaacaaacaaacaaacaaacaaacaacaacaaaaaacccagcugggggcuggcgagauggcuuaguggguaagagcacugacugcucuuccaaagguccugaguucaaaucccagcaaccacaugguggcucacaaccacccauaaugagaucugacggccucuucuggugugucuaaagacagcuacaguguacuuauuuauaacaauaaauaaaucuuaaaaaaaaaaaacccaguugaacaaaucuaugcaggcagauaucgacacaguggcuuuucugggaggguaguaguucuaacugaaagugaacacaaagauugucucugggggaauaacgguugguuccuuaaccugggugcuggacacaaggaugcuuauuuguaaaccaacaccacugagaaggacuauacuugugaugguguccuucucuuuaugaauaauuacaccucaauuaauuuuuuuucuuauagggcuggagaggugguucagcaguuagggcugcucuuccagaggaucccaguucaaaucccagcauccacauggcagcucacagcagucuguaacuccaguucuggggauuccagcacccccauacagacguacacgcagccaaaacaacaaagacauaaaauaaaaauaaauacauucuuuaaaauuuuuuguuauaaaagcuaaaaaauauuucccugggugagcuaauaaugacuaucauagcuuuuugauucuaaauuugauagugguuucuaugaacaugggauuguaaaaugauacauaaauauuuuaaauauaucuggauggcuuuaaguauuuuaguauucaauauaacaauuucaguauucaauauaaacuugaaaacacucaugaaucggucacauucuauaaagaaaaaaaaucucaaaucuuuaauuuuuaucgucucagcaauacauuuuauuucaauauuauuauuugugauuaaaucgauguagcaaguauucuacagugucuaucaagggaaaugguacccacccuagcacauguucauacaguccugugucagagcagaaugguucucuuauuuuguauaaccucugugguccuuuccauggauuuuaagggcaagaaagacuugguuuucccucaguguagcuaauuccuagauuggauagcagucagugauccaaauggccgggcucaguaagguaguauuggguaggcaauaguacucuuccucgguuuguggaacugacaacuuaaacacuaagccugccgaguaggggaaggagagcucuuggaucaaugacaauuaagacggguguucgaggaccacguauggacugaccaugcacggagcccucgcagaggggagaauguugaaggcgcguggggagaugccugcaucuguguuggcuccuaccagugcuuuucuaucucggaugcacuuggaaucacccaaggagccuaaaaauacuaacaacuccuucccacucucaaggauucugguuaaauucuacacuuggauuguggcccaagcuauuuuaaagcugccgggguggaugcaugcagucagggugcacagggagaaacuucugggucaguugagauacccccuguacuaauggucaccaagaguccucugauccuugcagugguugcuaugaggcauagaagggcuauggguuucccuguccccaaaaguacgcauaaugagagucugcaguaauaugaggcagaugggacaaacgucacauuagcagugucgugucaugguagcauuugugggaaccagugugucguccggauggccugguuucccugagcagagaucagaggucugagcaaaccaacuugccaggagauaucccaguuuguagaggucauguaugguuugccucugccuaagucccauaagaccucugaagucucugcuacuuccucucuuccugaggaaggaagaaacuaggcauuuucccacuaguuucgguggacguucaucagggauaugccuugaccucucuaagucuccucaagggauaagcauuuuuuaauaugucaugaacaagcugugggagggaggaguggggagguuuuuguuuuuauuuuuuuaaggaaccaagggaguguauauuuccuuaccaagaggaagauuuagaaaaacugcauagaucaacuaucaaucaauuccaggcaggcacuggcucguuuuaaaauggcaauuguugccuucaaaauacucuauacuuccuagucccugucagagcaucucacgugggcuuuagaacagcguugugaaggugguagguccaguauugcuaucuguuugacagcaggaaagcaagguccaaagaaauacuuuuggcuuugcuaaaaaucacgagucccaagacccuuuuguccaacccccuuuccucagacuggguggcuucucaguaugauguaauaaccucaccccucaguguucugacaaauagccaccacgcagcaugugcaagacaugauuaagugauugauguaaguaguuucaaaguuacaucaagauguuguaucaaucuguaauuuuuaaaguacaacauuuaaaaauguugagugcaguuugcauauuauauacaugucucauagaaguucaggaaaauauagaaaaaauucaaaguagagaacacuguuaucauacuaugcagagauagauacugaugugcauacacauaauaugugucacauauaugauaucugcauguguauguuugucaaguugacagagcuauguauuguuauaugucuucucucucucucucucucucucucucucucucucucucucuucuguuugaggauuuggaggucuguuggggcaucucaccuugcaguucacacuggccuagaauuuacuuuguacccagacuggcuuugaacuugugauccgagcauugcagccucccaagugcuaggauuacgggugugcuaagcacccaacuugauguggguacuuugcauuucuucauuuaaucaugaacauucuuucaugauguuguuuuaauaauauaguuuagcgaaugacuguuucauauuguggcaaacuauaauguagcuaucuaguaagaauucuggguuuucuguuuguuuuuuucuaccuacuacaaccaccuuuggcuacaaacaccuuuucugucucuguuuccuaggacagacuuacauauuucuauuguuggauguuuuuaagugccuagcuuuuaugcgagcuuugcgaaucacaggucugacucagaguguggaaagaccuccuuccuuaucucuucaccaacacugaaccuaucacucuaucuccuaugaagucaggacuucuuugauucacuugggacuuagccccauaaaguaaaguaggucacuuccuugguucuucccuagacauuauucugcuuuugguuaauaauugaaggacuucuaacuugugagugcuguucuuuccaaauggcuaccauuuuauuccagguuucccccuuucaauagugaaaauuuggacuuauuugucauacccacugcuacuuaaugcauugcuuuauuuuuucauuauuccuuucuucuaauuuccuucugcuauuuauugaguuuaauacucauauuuuuauucuuucuguauaaacauaaaaccauauaaagguauggcuucuccacuguguaaaauaucaaucaaauuuugauuuguaauaagcuuuaaauuacauauuuuauuuaaguguucuuuagaauaacccuuuucuuucucuuuccuuuuucucuucuuuccuuucuuucuuccuuccuuucuuucuucuuuucuuugucucucucaagacaaggucuuacuauauaacccuggguagucuagaacucagaaagauccaugugccccugccuccuuaauauugugauuguaauuacacauaauuauaauauaauguguggcauauggcaccacauccaauauagaauauuuuugaaacuacauuuuuaaaaauaauuuuucauaagucauugacaguauacaccuuggccagaggauaugacuugacauauuauguacugacccaacccaugcuguaauucuuucuucuacuugccuuuguauggcugccuauaggugcaaggcacagcucuucauccacaaaacacuuagugccauggccauaagguuauuggacguguguguguggagguguagguggggagggguggucuugguuggaugaaagcuacgaucagcuuucaaaaggaaaacuguaggcaacacgguuaccagggaacuuggguuaaaauagaaccuggacucgcuuggcaucacagaagugaaugaggggguagagggccuaagaagaaagguuuggcuauaugaauucaaggcuaaggcugccugagguggacaagccagagacaagguccauuuagagagaugacaggucaggcacaugaacccagaaauguuuucuuccuccaaaggccaggaaaggaacauccuaggaggaucacaaagcuuaggucuugauugugucuuagccaaaaauccucugugugcacuaaugcaugccacuucuaucuuauuaaaggaaggggccacuuuuaaauccaaagacaugagucuaggcuuauggcauuguaggggugcaagcugggauggaggccugccugcagauggcaaaauaugggggugugcaauguuugcugagaaaaucuuacugucccucagucacccugcucacuuggcucuguguuaagaccccuggcccuaauaacauucacucaggcccucuguaccaccuggacaucuuuacugcggucaggaaugucacuggcccaugaaaggcccgccuccauucuuucaucuagagcagagcagguucuccuggcaacagaggagggaugguugaggaaaagggaccagcuguggcauccggcugucaccuggagacugcaucaaugagcuauggaauacggaaucuggcuucaaagcucaucccugccgcuuaggauuguauguuaaucuauuaaguaggugaagauguucacucucuguucaaacaggaauuauaauaacaaaaaggacucccuggaugagccuccagaauccuguaagaacguagacaagucuccagugcuccugucaggaauuaucuacacaaaagggaacacuagcagugggagaaccugagguccagggacgucauuuaugccagauaagacugaugaguccgguccaggccauucaacauccaacagcagugugugaaaaugcacagcccauauccagguuccuaugggucuggguauauguguacuauaucuacauuaaggagaauaaacuggacauguuacaacuguugcaagauauggcagcauaguuggggggacuugucaacauguuuagaacccugcuuaaccauuccagacccucuggcuguuaguaacguucauuauccaagagaagaggggcuggcugaagaauaauuaacaauaagcuggugauucacaucugccaagugcgcagguucugagugcaugugccaugugaauaauuuacauuugaauauuuuuaaauaugcucucaagacagaagaagcacuaaaauaggaagcauugcugaagagcgaauuauuugacgguuauuuuugacucucauccuugggaauuauugucaauguaauucagcuaauccuuaaggagucugccaccuuuucaguaaggauuggguacaaagaaccuuaauuuaguucuacauaaccgagggggaggugcucuggggaggugaaaucuaauucugcuuuuaacagaugaagaaacugaggcugguagagguuaaacaaugugacuaaggugucuucccuucccuuucacuucccuucccuucccuucccuccccuccccuucccuucccuccccucuccuccccuccccuccccuccccuccccuccccuccccuucccucuccuuucuuuauuugucacaggugggucagaauuagaauagagauuucauaucuguaagcauuccuugggcgugagccugccccuuuauuaauaauacagugucaucucgagauuaucaaaauccuuucuuucuagaaacugacacagcuagccgucagcucccacugcguucaucugaaguuauccgguaacuccccggaacaccaaggagugauuuaaacugcaucuuaagcuuggucuguacccugccucaucuuccaagguuugacauccccuuucauccuuaaaggcuacaaugugggucuuacaguuuccacuuaacacaggaagaaaacugaggugagaggagguaagaucauuugaaacuuguacgugguagagcuggcauucugggcucuggcaugauugucccacaggcacugguuaaugcucaugaucacagucagcuuuguccccuugguccugccggcucugcccaguagccacaaaccagaacagcugaccaguauuucccgggaagcauucccuuguguucagacccaagaccuuucaggguccgagagagguacaugcagaggaaaaggcagcuaaguuuaggaguggguugaagaaacuaaucaggcauuuuaggucuauguguccuuucucccuuuaaauuucgaaggggaauuaaacaugcagguuucgcaaucuaauuggucgccggaccuaucaaucacugagaucuacacaaacugagugucucauggaaagguuccagggaagugcuggcucagccacagaguaaacaacgacgagagaacucacuuuacuuaaaaaacugagaguucauucaagcucuggagcccuucgccugaugaccgaguuucaaggcguuaucuacuuccugggagagaagcaucuauauggaggucccuaaggaaaagacagacuuauaccaagcugcuugaccagauggguagccugguggugaggcacgacaaaaccauucugagucauuccuuuauggagcagaugguaucauuucuccuuuagaauaguagagaugaccuguccaccaugccuugucaucaagucucuuuagaacaaugguucucaaccugugggucacgaccccuggagaggucgaaugacccuuucgcagggguuaccuaagaccaccagaaaacacauguuuacaucauaauucauaacggcagcaaauuuucagccaugagguagcaaugagaguaauuuuacggcuggggggugggggggggggagucgccacacugugaggaacuguauuaaagggccgcagcauuaggaagguugggacccacugcuuuagaacaaagugagguauaauuaaaguaagcucauaacugaguuuugugugugggcguuuccaaacgauguuccauagaacccauacucuaggggagguugggaagaagggaggcacuuuauuguuuuuuuguuuguuuguuuuguguguguguuucgagacaggguuucucuguauagcccuggcuguccuggagcucacuuuguagaccaggcuggccucaaacucagaaauccgccugccucugccuccccagugcugggauuaaaggcgugugccaccaugcccggcuuauauauuuggggggggggcacuuuaauuucagagucuuuucuaugccaaggugcgagcgagcagccuugcagggauggagcacgucauuguccucacuggaacacccaacucuguccuugcaggaugaccguuucccugcacacagguuuggagaauacugcgcuaugacgugacucugaagaaaagaaggcccuuuuauuuuacuauuuugcuucauuauuucuuuuuuccugucagcuugucugucucucuuuucaagcaaggaggcuggggcuuacacauaccaaugagggcugaaaccuagggaaacgaggaagcccuugccagcgauguuuucacuuuuuuucagagagccuuugaaacucccuuucagucauuguccccaggauucagggcacauuuccccugaauaaccuugguaauggcagagguugaccccacgagacgggauuugauuugaggaacaaaacuaccaaacucaccaagauuauccaugucagaaggaaguaaacaggagugguuaacaguaggggcgaagguuucaacaccacucccgcuguuuaaugccuauucaacagucacugagagcgcuaccuggcucucugaggacucagcacuucuucuggacuuaguucuuaguacuuccucucuguacuuaguuuaguacuuccucuguagaaaauuguguguaccucgaaagguuacaauaaugauauaaauauugaaauauuuauacugugcaucaccaggcacuauuaaaguagccaaugccucuagccaaagcuuggcugguuuucuccuguguccuguaaaacuucgguaaggguucucaaaggagaguagagauaguuagcugcggaaggaugaauccauggcucuucuugaggaaaucucuaagauucccuuaaugguuuuaaaguguguguguguguguaugaaaauguguguguguguguguguguguguguguguguaguauaugcauauagaggacagagguugauacugggggucuuccuccauugcucccuccccuuuaauuuuuugagacugggucucucacugaaucuggggcucacagauuagcuggucagcaaguuccaacgauccuccugucccuuccuuccuagcauagguaugagccaccaugccuggaaauuuuauuggggccuugaacuaagggcguccugcuugaguggcaaauaguuuauagacugagccaccuccccagccccaguuuauugcuuuuuaauugcacuuuacauaagcaaacacccaccaucuugcuauguaagugaauccaacauuuccuuuugaaucauagaccuaugagauuguuauuaaauacugccucuuuuuagccaccacacagaagaccuaguuaggcaccauugcacucuaggagauuagaaacuguauuacuuguuuugguuuauuguugauagagaugccggggaccaaacccagggugucauaaaagcaauucauuaguauuuuuaacaauaacuauagagccaacucuauauuguggguuguuuugauuaccaaucuaguuugcuggcuuaugagaauugauauaauaauuucuaucugcuucuuuaacaaagugauuuucugucuuauaguaaaguugucauagauuagaauggaauagauuuuuuaaaauauauuuuuguaauuuuauuuuuauuagauguauuuauuuuauguguaugagugggugggucccccaugugugugcauuuuccacagaggccaggugaagguguuggauccccuggaacuggagguacagauagaggugagcaaccaugugggagcugggaccuaaaccuaggcccucugcaagaacaaguccccuuaaccacugagccaucucuccaacuccacagaauauaguagaauucuaagauuggaggaagccuuaaguauuagugugaagguccccaaaugccaacucaaugcuuugguuuguuuuuauccuguuuaaaauaaguucccagaguucugcuuccccaaagagggcaaugacugcaugcucauccaucagcaauaaucaacaggagacaaagaugucacucuuagguaagucauaucuucuuuggaugcccaucacuguugucccaacugccuucuuuauuuaucucaccacuccaacuaguacguacuugcauuucaaagccagaaccuauucuuccuuugguguuuuaugcuuauaggaucugaggcccagcaccauuuugcacucugcccaauguuacauacacaguccauuuauguucauaccagauuuuagacucuuaugucuaaguucuaguuguauacuaccauaggaacacuagucugaagacuggcccagguuaauuauuuuaaguaaaauaugacauguuuuauaaacugugguugugguuacuuauucaugagaaagaagugagagggcuaaacauuuuuuuaaggauaaauaaugcauauuuccuauuuaaaaauaccugaaagcaagauuucucagcaggucccaauacagaccugugugaagggccacagaaccuuaaagcuaggguuguagacaagcucagaucacacaagcagauacuaguguaaugcuaugacaaguucaauaauaaaaacaacaaccacugucauaaguccagcauucacucauuuaaaggaacagugucaucugugaauuuucaccugcgacccaaugcacuaggcucuauugcguauuuccccacuucauaugcauaaaugccaaagcuuggcucaauuuacccccaaaucacacaaguaaugagcaucagagaggaaacggagacucaagagaaucugaccacaaagcuauuaacacuugccacauugccagcucuccgggaggcagaggugacuuuccugcucauacggaaaagccccugcaacccuucugcugcccgaguuacccacaaccucaccaccagcaggcaucuccaucaccaccuaucagccggaacacaaauccuucugaucacaggucauuagagucaccugaugcaguagaaugcauucaggaacaauugaaauucaaugcaccugccagcaaucaccacccgccuggagcugcccuacuggggugaagugacagcaggccagucacuuuuguguccccgugaagcuagugauuguaccugcuacacaguaggaucuucaaacucauuuacugcacugaaaauaucuagcuugcuugcuugcuuucucuuuccuucuuucuuucuuucuuucuuucuuucuuucucucucucucuuucucucuuucuuucuuuucguuucucucucucucucucucucucucucucuuucucucucucucucucucucucucuuuuuuuuuacugcuugcaacuacacaauaaauaguacacaaaaaacuuaucuguuuuuuuuuuuuuuuuuuuuuuuuuugguuuugguuuuuuuuuuccucccuuggucccuaacaaacacugguuuaaaagcaaggaaaugauucguuuacccuucacagaagagagucaaacuaagaacccaggaagccaaaugugaagcaagggugggaaagggggcuaaagauaaagugggugucagauaggguuagcugugucucuuuuaagugcugacaaucuuuuuucggagaacuuugaauaucucuuuucauuugugguaugggugugugggugggugggugggugggggugggggugguggguaggucauuuucuggugacuuaccacuuuccaguacucuaccccacugauuuaugugaaauuggagugaaaggcugaaaauuugcccaagguacuauagcaaaaugcuuuacugggagucugcggcuaugguggucagcaucaacaaauauauaagcaaaguuuggcccuuuacagucccaaggcucuuccccagaccgugguucacuucugacccugcauauuagacauggaccagauaaaagcacaaguaaugaacaaaacgucaggcagucuuagcagcaucuagaauaugagauaucagacuaagacagaggcaucuccuucucacauggaugucccucguguacauggauacaccuagucccuggugggaguggcuagggucaguguugugguugacaggccaggauaaacaggaaagagccaagugcuauuagcaccagcucugguccuaugacuuucucucccuuccuaggaaccauuaagagcuuccaagcacuuggguggcaccgugacaguuacuauuucaaagaagguaccacuaaugcagagaguucuaacugaaagcuggggguuggggcgagguggggggugaccagaggcaugcugcagaagccugaaagucccucaggcaggggcaggucugugugaagaggaagagucagauucucaaguaggagaauccaggaggaggacuucccagcugagcaugagucaugggaggaagggcaggacaccaucagguuucuggcccaaauaaguggaagaauaaaacacacuuucagugaaagcacuccacauccaaagguaauucacacagauacacaaaucuguguaauuggguuggcaguguaguuuaguuggcagaacgcuuucaaaguaugcgugaagcccuagguuugguccccagaagcacauaacaggguuugguggccaggugugggggugcacgccguuaauccuagcacuugggacacgaacacaggaguauuagaaguucaagacucucccugcuagauuaaagagucuggaguauguaagacacugucucauucauaaauaaauaaauuaauuaauaaaaauucagaccuauagauuuuaggagaaaagggaaauuuugggggaggggcagggagcuucacagagcaucugcuggacauaaaccaagacauauucaucaacauauaaccaguuaagaaaguguccucacacccuugaagcugacuggucuagcuugaguaguuguucaacacugucacauuucauucuuauugcuuacaguagagaacccagugguuuuaaaggacaagaucugccauggcauuucucugaacaaauaagacagcgaagguccuaauggaguaccgugguaagaauaaccuuauuucuuaugcaaacuauuuccuuuucuauuuauuuugaguuuugauuccuuguugauuacauacuuaugugucaacugugcauucauuuugcuaaaugcuauuuucccuauaucaaagguaaauucuauguuucacucaagaccaaaucucauugaaaaaaaaaaaguggauuuuuuuuucuggcuuuauugaauuuguacaguuuuuuguuauccauuugagaguuguacuaagaacuacuucugagauucacugccagcaaauaggagugucuuaggagucaaagggccuuaauucauuaaaaugucauaaacaaguggcaauguggccacaauuuuuuucucuuaaaucugagucucccaucaugagccuguaucacugggaauuccagucuguaguugggaagaaacagggcuguaacgugugaaaacacauuucuccaaacugcguucaaugaaagaaccacucuagcacagagagcaagcaggaauacauaaccaugcucauucguuauguuucagauuggcccugugaaaaacaugaagaagaaaaaugacauuugcuugggaacuucucuuuuuuuuuuuuuuuuccuacacaaagggaauguuuuguacagcugauaugaucgauuuuuauuggcucgguuuaauuuuucucucuucucuaauagagcauggguuuuguuucucuuguucuccaguguagccugccgcacagccagccacaguccucagcaucccucuuagcuuagagaagguccgaggaagcaccugggaccagaaccagaguaccagauuguaagagugggugacagggauggagugccucauccuagauuccuccuucuuucucuuucuuugaaugaaggcuggcuucaaacucuagauccuccugucucagaccucucaagcaacacuacaaugacagggcugcaccaccacaccuaacuggaaccagccauuucauguucuagccaaacaaagaagccaacugccuucaacaaagacgcagcagaauugauccuaaaguuguucucuucacagauacacagaucuaugcucuagaauuuguugccaacaccacacaaugcuagugacaccugggacuuccuguuccaauggcagguugguagcagguaggguuucuuucugucugcagaacauucugucugcagucauagcaugccagagucacugauuuucuuacuuagugaaaaaugcuuucauuuggcuuuuuccugagcauaugaggaagcagagaacauggggcagguugcaugggaaacaaaguccuuaaaaacguggucuuggagcuuaugcacaaacuuugugguuuugcauaaaaucggaauggccaaaucuacucugcugaggucagcaauaugagguaaugaaggacauacaggacagaacuacuggcuccauuguuacuucugaaaccugaacugcuuuuagaaauaagggcuggaauguuccauaggaacucagagcaugggacagcggggcauggcacacacucagugugggcuauuuaaaaccaggcucuuggcuucccucugugauucuaaauacgugaaaucccacugcccuacagcagccggggacuauuucuaugacauugccuggcaccugugcucagaguggcugagucuacccaacagaaagaaaguagaguacaggccagguuuccagcgucuagccaauguccaccuugugucagaucgagagagcacugggggacugagaggucuugaaaguuaaggauucauuggacuaucccaguugccuuagcacauuuuuuuuaaaaagcgcauuuuaaacaagccauuuauaugaccaauaaauaguguaagcaaaacugaucguuuucucaggaucagcacagucuguagaaggagcccagauuuauagacauugccccuuucugaauuauaaaaccuguuuaaacauguuuuuuucuuugacauguuaacacuuccuguaaucaaacggauaaauaaacccuuaggaacucuguacuuaauugcaaucaaccaaaagccuuaggcaggaaaggacaguaagaaaccuuguuacauaaugucaaaacaccugaucaaguuuguaacggcaaucaaacagucaagccaguuguaggauuucugacagaccacagaauauauuaaguaacuuuuagcauuuuaucuugauguagaaaaauuaaagcuacagccuuuauaaaaacauguaagacuuugccaaggccaguacccccacaucuugggcuugaucuaaagcugcuuguagugauucacaccuuugaucuccgcaguggggaggaaaaggggagaacaucagaagcugaagaccagcagagcucuuggcaaggucagucagcgugaacuaugugagacccuuuuuuuuaaaaaaauuaauacuuaaauuuuuauuucucucugaucacaacacuucaaaaauaugucuuaucauuuccauuuuguagauaaggaagcugaggggagaagagggagagggagagcuggucugaacaagaccacauggcaacauuccagugauuagugugaugagauuaguggggugagauucgaacacaggacucuucaacuucaaaugcacaguguuugcccaugcauaaacacaauggcuaagcauggauggcaaggaaacaaauauaaaucuagaaagcaaauaaauuaaaagcuuggaucuuaaucacacaguuaaguaagauaucucaaauucagcauauggacagucgacugugucuguuuuggaagugucugucugcuaaucuaugauugaugcuggagcaccagagaccccuugacucucaugugauacccaugaagaacuaggcuccaguugccaaacauuauucaucagaacaaauuauacauauuucauuaucccuguaaagaggucugauuuccuaguccagugcuauuuuugaauauuuuucaggcauggacugaauauguggcucccuuguggccaucucaaaacauagaacaaggaguauuugcuguauuaauaucaucuuuuccuugcugugaggggacuaguuauaaauuagaaagcagccucuugagaauucguauuuuaagaaauuaccuagaaagaaccaaggguguuuuuuuuccucucucuuuuucuccccacaugguaaaucauacagagacauagucugccccagauccccaagagacaacaucuugagugcauaugugaugcugggcucugaauugacaaacccaagaacuccagcgcaaaauaaccgaaguuccccaaguuaaaaaugaaaguaagaucaucaaaauuaguauucuuguugcaucgucccaacaacuucacaaauagccauuaagcuagacagcaucacagguaauugaauuuaaagaaucaacuuuuaugguggaugugaaguuacaaauaacccaucuaucucccgcuuuacccauguucucgccccuuucagaagcaucaucacauucaacagaaacaauauuaagcucguuuuacuagaaggcuuauccgaauacaugccauauuaaaaauagucauuauauaaauguuucucacaagagcugcagcgauggugugaauaagaaacucccuucugagauuucaguaaaaccagaucucacaaaggaucugaaagaaaacaaaacacacacacacacaaaacaaacagacacacacacaaagagacacacacagagaauagaucuuauguuaauccaauuuaccauaacaguugcuauauucccccacuauuuuauaaaguacgauucugucccuuccuagaggaagcgagagagagagagagagagagagagagagagagagagagagagagagagagagagagagaaagagaagccugcuccaggugccuccggauaauguccagggugggggcuaacuaagcaugaucacuagcagcuuaucaaaaaaucacaaauuuuaaaugcaggaaaauguuagugcugucaaauggucaggcaugcaagaggaaucugucucacgagcuccaugccccucucagaauacauacaaacccccaaauccaccagcuggauuuuuucuuuuaaauuguaaauuagauaucaaaaugcuuacgggccuuacagugagauaacaucaggaggaacggugcguggaauggaucucgcauucucacauaaagcguuaucuuugcuacaaguacacacggcagggcauuuuggcuucgcugguuucuuccccucagucagcaaaaccacagaaaagaggcauaggaaauaggcaauucuuuucaggggaaugcaggcauuucccauccuucugcugcuuucugauuccaugcagucgagagaauauccccacacaugaacagggcuucuggaauucagcugcugauugucuugcucuaagaacaggucacauaggaguccacccuucucugc

SEQ ID NO: 12583 - RNA, 260905 nt, Mus musculus
ucuggacaugaucgccagggaagggaacacagaagaguagcugaaugaacgacaguggucaagaugacgucggaagaaauggccgcuucuguccucaucccugugacucaaaggaaaguggcuucugcccagucgguggcagaagagaggaguguaaaggucucagaugcggggauuccucgggcacgugcuggcaggcagggugcgcucaucccuccuaccaucucacaguggaacaaacauaaggaagagucgucuagaagugauuuguccaaggucuucucaauagcgaggggggaacuagucugcgaugagaauuccaacgaagagggcugggaggaaaacgcaccggacuccccggaaaaccacgcgaugaacggcaacaguuuagugcaaagccaccagcaccaguuuccccggagccagcuuugugaagcccgugacucugucacagaagacccguguuugcagccuggaauuccuucuccccuggaaaggaaggugcucccuggaauucaacuggagauggaggacucucccauggacgugagcccugcgggaagucagccuaggaucauggaguccagcggaccucacucugaccgcaacacggcgguauuucacuuccauuaugaagcugacaggacaaugucggaugcuuuucauacccugucagaaaaccugauuuuggaugacugugcaaauuguguuacucuuccuggggggcagcaaaauaaaaauugcauggcguaugcuugcaaacugguggaguugacaagaaccuguggaaguaagaaugggcaaguccagugugagcacuguaccucgcugcgcgaugaauaccugugcuucgaaagcuccugcucaaaggccgaugaggucugcucaggugguggcuuuugcgaggacggcuuugcucacgguccugcugccaagacuuuucugaacccucuggaggauuucucugacaauugugaagacguagacgauuuuuuuaaaagcaaaaaggagcgguccacguuguuaguccgaagguuuuguaaaaaugacagggaaguuaagaagucuguguauacugggaccagagccaucaugagaacucugccuucuggcuguauugggccagcugcuuggaauuacguugaucagaagaaagcuggucuccuauggccuugugggaauguaaugggaacucugucagcaauggacauaaggcaaagugggagccaacgucugucugaagcccaguggugccugguaagaguuuggguuucuucccaucaccuuuuuuggucuuauuuuucuuccuuuccuucacccuccuuuaggaguuuuggauagagggucauacggauauaggccuggaacuugcuaugugcauggccuagcuuguccuugaacuugcgauccuccugaauuuugagauuacagauggaccuguuuccauuaguucaguaaacaugauuuuucauuacuuauauugcuguaacuaauggacaagauaaagcaagaucugucaaaauaugauucuuacaggagucauuuguaauuauugggauuuagauauuacaauucauaggucucaagucugaguugacucugcagcaauauaggccaugcaauacacagaggccuauguagggaguggagaaauuagagauuuucugaugacagaaaaauggcuuugucuauuagcuuuggcgaggcauucccaagucuuuuuuguguuuugugguccacuguggccuuuaguuuuacuguccugaaggagcuuaaguccgucuuuccucucuucucccuuagacuuauuuauuuauuuuugggggugagugugcuguguacguaccucuucaaugaagucuacggauguaaaauaacacuuuaaaugcaccaaaugcaauggcaaacaucaguaaaggagaaaauuauguugauuugcauucaugagacacaagaugauuuugaagcugugagaugguaauuuaagugcaucuuucuuaccauacugcucauugcuaccuaggaaugugauagccucuugauuuaggaaauuccucuaaucuagucaaauagaggcaaccauucgcccuaaauaggcauaauauuguaagauauccaccaugaaugaccaugacaugaugugaaaaaucuguguuauuuuuauuggugacacaaucaguuacuucugcuucuaucuaacuuuguuguaaaaguucacaauuaaagaaaugcuaaauuucuaccuaagaugaaugagaauagucuuuuuuuuuuaauucccauccaaguuuccggguccucugaauguuuuacaugguugguuuucucucuuuaaccguuacacacccaggugaccuucucuggacugaucugcacugcugaagacaucacuauauacuucgccuuuucguuguuucuuuuucuucuuuucuuucuugugaagagucucauguaguccaggcugguccuuaauuuacuacauagccaaugauggcuuugaacuccggauuuucuguuucuaacaagugcugggauuaccggauugcaccaccagcccuaucaccuaucaccuaucuucuauccuugcuaaacauuccugcuuccuucagcgauucucucugggaaguuguuucuagaacgcucacauuucaguuuuucacacuucuuuauuaaccuaaaggaagcuuccgaggaaguuaguguuggcugagaguuuuagauugauuaucagauugacuaugcuuccuucuggcucccccaacccugaggcuguggggcagcaccuucuaaagccuucacuggucaggcccuggacugguuaauuuacaguugaaagaaaccaaacugucuccucccugcuuugucccuugaggcuaggggcggucaccacagcucagcuagaguggggcucaggaaugucucuucccuuugugucagcugcccuccuggacgcugugagcauuuuuauuggcacuuaugguauaggugggcaugggcuggcucuuuuucuuucuuucuuuuuuuuucuuuuuucuuuuuuucuuuuuugccacacugucugaaagucauggguguucccuaaaguauagccuccucuucacauuuguccuuuagagucuggugaaaugcuuagcaaaauuagcacagcugaaauauauucacuugccuugggucuugugaauuaugccuuucaucugaggaugugguaccccagcgguaucccagucauacacucccauucuguuuuucaauuucuucauguguauucugccuggcugcucagccaggcuguaagaacccugugcucuuuugucuauauaaugcaaacauaguuccaaaugcauagaaaacaaggacuaugacaugguuggaaacagacccuagagaugauccacauuuaaaucauggcuuggaauccauaagugauugacagguccuaauuaccuuucaagggaaccaggcauaaaggugccauuguaggccacucugcugugagaugcuauccucggcacagugcugaaagcagagagugcuucuguccucccgaccuugagcuucuuacuugguuguggacucauucucaccugguccuucucuuugguggccucucagggaaauuuauagcaguauaaauucuaauguucagaugacuccauaucugcagucuuugcguucauugacgucuaugugauacaaauugaaaguauuuggaaaacaaaauuucuaguacuguaguguggugauagagagcuugccuauuacacauacagcccggaguuuaaauuccaguaacuacugccucccuccuacccacaaauauuuaaacaggccugacgccauagaucuauaaucucaauuacuuaggagccugaggcagaacuauuacuuggucagggccacauugugagaccccaugucaaaauaaauacaagaaaagccugaggauauagcuuagugguguggaguuugccuagaauguuagaggccuuagguuuaguuccaaguaacacacacaagcacacacaccucuuauuagcauauacagcuguguuuucuggucauuauuccccacgcaacauagcacagcacaguaacuauuuacaaagcauuuacaucauguuaguugcauuuacauuauguuaguaaccuagcggugguuaaaaguguaugcagggguguagcaugcacauauuaaccaauuuuauauaaacgacuugaauaccugaaguuuugaguuuccguggcuguccaaagaacaacuguauuaccucggccauguugcucaaacaguucuuccgcugcauugcuggcauguguuauucauuuaauuaguucuuuggcaucauauuuuuuuguuucuggguguguuggucagaacagcccagugaauuuauauuuucacagcuguguggagagaauggguuuggaugaagacauuaacgaggauucaugcuugcugacuaaccagauuguuagccuacuccugcuuguaaaacauuaaagcccccccucccacguacauacucccucucgcucuaaaucuauuggcucgacaaaggagaguuaggcaaguggauaaagucugcagguuaaacauuugacuaaggguguuuuuccuuuuuguuguuguuguuguuuuuaaauaguauuuuaagauuuauuuauuuuaugucuguaucaucuaucugcauguacaccugcaggccagaagagagcaucugaccccacuguagaugguugugagucgccacauugggaauugaacucaagaccuuugcugagccaucucuucagccucuuuguuuugguuuuagaauucucucccuggcuaaaucuuguguucaaaagccuuguuaucuuucagguggauucaagcacagaaagcgcuaguuuuuguuuugacaaaguugccuauguuagccuagcucuacucaguagugguggaaagagaucugggcagccaagacagaaacaucaccagcucucaugcuagaaccuccaggauuucccuucuuugauccauagaggggucacucuacaugaauacauacggcaaaccagagaagauucauacugaauugaauaggggauaauuuaagaagauuuuauaaaggaaaaccacccaaguuuuaaaaucugauuagaaaaacuguaaguaaaaaggguagucacaaccaguugccccaucucuuccuaaaauguugguucuuuauugccaagcacagaaugcuaaacuuaagaggcaaugagcaauugagcaguaauacauuuguugagauaauaguguuggaggaagagagggagggaagaagagagggagagagggagggaaggagagagggaggaagugaaggaggaagggaaaaaggguguguauguauacugggaauugaacuuauggccccugcuugcuaggcaagcaguccaccacugagguauuuucaaauggagcuaaaccaaaccuuaggaaaaagcuaacuccucugaugugugacucacugcugguaaacucauguucuaagcuaaagauguaacucuuauaaaggacccgaucauuugaaccucacuguccagccuuugaaguagcaaaaaggccuuauuuucugcuuugagcauuugguuaccccggagaucagugacaauuuuuuuuuuuuuaaagauuuauuuauuauauguaaguacacuguagcugucuucagacacuccagaagagggagucagaucucauuacggaugguugugagccaccaugugguugcugggauuugaacuccggaccuucggaagagcagucgggugcucuuacccacucagccgucucaccagccccgaucagugacaauuugaucaaugaaaugauuacaauuucuucgggugcuuagaccaagcuggaagcucccugguggcuucuuccucuacugaagcuucaacagcauuuaugacaugggguuaggaggaaguuauccuuuccugcugauuguuguaugugugagaaagagccgguuccacuagccccauacaugcaguuauaguuaguacaccagugcugaguugucugaggccagccuggggaggauggaacuacucaccuugcaucuauuuccuuaucucuguaguuacucucuuuggcuagguucugauaaaagguggaguaaaaaccuuccacauggacucugcuuugagagucugguauguauuucugcuacucuuaugaugcuggggcaggaucagccuuaggacuuucccuucuuugcuacaguuguccuacauaaauggagaucucagcuucauagagccaucucuuggaauggccauuuguauguagccuggaaaugaucugagccagugggcaaggaaggacaugccaucaggugauggccuggucucauccuugcccugcacuuuguuggcugggaccuugggauaccauggauugauugccauagucaugagcagaaggaguuucccucuuggggaacauacagacagcagacagugagguucagagacaucuuagggugguggggaggcuuccguccuggugaccaaaugauucagcauucagggacuugaagcaucauugcagggcugggugugacuaucuucugcccuccaugacacacugguggcucguucuucccugaaaaacuguucucagagucagagagcugacucaugcuccagcucuucaaggcuucaagaaacccacaugaugcucucuuugguggucuggauacaugaagaccucaagaaggcaaaguccugacccuuauccuaggucccugccuaaacucuaaccccuucccuuguguaaacucuagccacucaaacccucagaaagcucagcaaaaacccuucucagccuucagcaacaccaagagcugcaggucucucaggaauaggaagugccccuucucuucugaagcacaaaaccuuaucuccuugguuggcgcaagggugcucgaugucuucucuuuuuauacagcuuuguugagauacaguuuacccacuuauauucaaagaugauugcaccuucaccagucagucuggaacacucucaugcccuaagagaaacccuaagcccuuuagcaucaccaccaccugccuuagccucuuccuuaauccuauacauccaccauucuuccugucucuauagaauacgcuauuguagauuuuuauacaccuggacuugcagaguauaugauauuuuugggguggcuuaauucacuugccucaguauuuuuugaucaaucaacacucuagcacauauuaaugcuucaugauuuuuuuuuguuacugugccauuguauuguauuguauuguauuuaucuauuuauccacucauuaguugcugaacaucgagccuuuucugcucugaggcuaugacucugaguaaugcuuuuguguacuuguuuuuucucugaaggguaaaggauugaacucauggcuuuuuccaugccagaaaggugcucuagcacugagcuguaaucucagcccugugagcauucaaacacaggcuuuugugaaaacgaacauucccgguucuugucaguguauaccuaggagugguggcacgugcguauaccuauacguuugaccuuuucaggggucagcagacaguuccuccaaguaucugccucaugcccacagugaggcaugaugcaccgaugucucuaugaccccagcaggccuugagauugucucugucuuuguuuguagccauccuacuuggauaugaagugauagucuccuuauaguuuuuauuuguguuuuugugauaguuauuccuucccagcauuuccucaugugcuuguuagccuuuugcauuuuuauggagaaauuucuagucaaauccuggaacugaacccaggaucccacacauaucagacaaguacucaacuacuaaacaacccuggucucuuuuguccauuuuaaaauugaguugucuuucauuuugaguucuuuuauauauucuagacauaaguccaugaucagugucuuagucaggguuuguauuccugcacaaacaucaugaccaagaagcaaguuggggaggaaaggguuuauucagcuuacacauucacauugcuguucaucaccaaaggaagucaggacuggaacucaagcagucaggaagcaggagcugaugcagaggccauggaaagauguuacuuacugguuugcuuucccuggcuugcucagcugucuuucuuauagaacccaagaucacuagcccagagauggcaccacccacaaggaaccuccccuccaucacuaauugagaaaauaucuuacagcuggaucucauggaggcauuuccucaagggaggcuccuuucucugugauaacuccagcuugugucaaguugacauauaaaaccagcuauaugauaauauauauggguauauauauuuauauauauauguucauauauauauucauauauauauauauagaacauggcaaagauggcucauaacguuaauacccguggaacuugauaaauauuuccuuuagacaccaguuuauuucuccuccuucuuaaucuuccucaugucgcuccacaagcagcaguuuuuauugugagucguucuccagaaucuuacuugcacccuagaugacccucaagggcaguuugcaccgcuuugcagucuccucuccccauucacccucacgaauuuuuauuacacagauuacuuuucucguuaaacaaguuguguuucccagaaggauguuugggaagucauaguuugaaugugcccuucuggcacgccaccagaagggcaucauaacagcuuggguggaggucauugcuucaugauaaaaauacucugucaugcacaggugccacauaaccuagaacuguggugaaucauguaagguguccagggugcaaaacuuaaggaggccucacauguggcaaccuuauacucuccagugacugccuccuuaaauuuugaaugcugggcuucucaagugucuuguuuguuuguuuguuuguuuguuuguuuuuuuggucccagcccuggcaacaaggguuuaagacagccuguguuuaucaucauuguuugagaauggucuccacagggucccauaaaccuuggcaaggauagucuuaaaacacaagcaagaguggcucuuacaguuuuuaaagguugaaaaaaaaacuaaagaagacuauuuuacagcaugugaaaauuauauaaaacucaagugucccugcuggcaaagauuuuaauaaagguuuuuggagugcagccacccucguuccuuuccacacugucuacagcugcuuccacgccggaacaggggagccugcgugcuguaaaggcaaaaccagccuuuguucuucggccuuacaguagaauuuuuacuuuucaggugaagagacuggucuacaccuggccacucccuaucuaccuuuucuuuggcuuucugucccacccucucagaggucuucugugcuagccugacucccacccugcacccuggucuagaauuccucugacagucagaauuccucugacagucaauuccucuacauaauucuugagugucucccuggauuacaaauagaggaauacaacuuauaccugcuuccauucucucacucugcuucauuucucugucucucugucuuucuaucucccuggcucaguuucucucucuccucuucucucucucuguuucucucugucucccugucucucugucucugucucugucucugucucugucucucucucuuucugucucacucucucuccuuuacaggcccacugcaugcaggcuuguuagccagccuuuucuugacaaagcuacaaaaggagcuuauuuugugcucugccuauaacagaauugggauuuuuccacugaaauucaaaagggaucuuuuucaggccugugaacccagacagcaugcucucaccucuucagacuuggccagagagacaaagaagggucagauaugagucucuuugucucuggcaccuuuucucaauuggcuguaaaaacucugggaggcuuuccagaaggggagacagggaaaagaauucuccuucuagaguuuuguucugcucuucagacaaacagacagacauacaggaccuccccgccaacacaaacgcuuuuaaccaggcagucuauguauggaccaggaggaauccuguuucugauuucagggcaaaggacauugcuuuacguuggaaagaucauucuugggguuuggaagguguuuggccgauuuccucaguuugucggguacucuugacaauaguccugagacuggacucuucugaagaggccaaaaggccaguuccauuucugccauuaucuugcgcgcgcucgaccagcaagaacaacgcugcaacaggauccuucugcacacguuuauugggagagcuugauugcagaggcgaaaagacuucgagcccagaacuggugcugcuuuuauaggccuaggagaggcgugucucauacccggauugguuaugcacuaagccucauuugcauguuccucaucugauuggcuacucucucucaguaccucacagagccucauuaucauaucucauuugcaugucucauauccgauuggcuacucucuuaguaccuuacagaaccucauuaucauaucucauuugcacgucucacaucccauugguuacucucuuagugccuuacagaaccucauuaucaugccugggccaggcaguguuuuugcaaaaaacuuuccugcauauguacacauugguuguuuguccaaucuuaugugugguggccagcaguagucagugccacucagcaacggcacauguggcuucccacaccauuaacugaugagugccccuaaagaaaucacuuuagcccaggacuuuguucacauugaguauaacacacaaaggcagcuguggcuucuuugucagaaacucugaauacaauuugcauguguaguuuaaccuauuauaaauuacacaugcccuccugauucuugaagcucaccagccuaugacaucugauuuaaguuccuacccucaauuuggggcugagagauaacuauucuacuucucccugaagcagcaucucgaggguugacuggaguugaaccuuaucucucccugagagcuagugaaguuccccuguucaucaugggcuaagucuccaagggcacauaugcagugagaagcacacacucauuccagaugugguggaacaagccuguaaucucauaauuuuuaggagaauugagagucugaagccaguccaggcuacauagugagacccccugucucaaacacaaagacaagcauuugcuggauaauggugcuugcucugugcuagggguggagugggcugggggagacuuuuucauuuguaauaauggcugucuauaaggcagacauaaucaccauucauacuaaauacuuaguauuuaagaagugacucuauccuggucuggcugccucugaaguuuacguccuaagccuuuucucacaaguucuagaaaguucugacacaacucaccucucuaaccuggcagggguucuguucuccuguuaaaagugcaaaugcugagcuauucaagaaccgggaccuuucuuuaaaugugagcugggugugaccuuuggacgaaaugggagaauggggaacaauaccaguucuuacuguguugguuauugaaauggcugggauuucuuuuaugauucagccagcgaggggggaaaaaaaaaaccaagcccacagucugguuuuuuuucugaauugcugucauuuagaagaacauuuaccacaguuuauaaguaaguaaguaagcaggaacaauguccaaagcaaacucuacacacaucugagucacauucuauagcuucuucauggucuugcuggaauauccacgagcgcuggcaacgcaauuuagaacuuugccauuugaaaguuuuccagggucuccuagaguucugaccaacuggccugggcacaggagcaugacuuggucgccucucuuugcaaagucaugccuuuacgacgagcuuguuacugcuuucauuuacaagguccugaggcaggaaaaggguugguccugcauguguucucccgcaucuggcaagcacuagcaaagucucucugcaaggauaacuuuguuccuuucgcuucaugcagaguguggcacaauggaagacaggaacacagaacuaccccagaggcauggaaucgaagcagcuacaggauguuugucuuucauaaugccguaagcccagagucaacccugccucccaagcccgauucugggguucucuuuucaugacacuggcaugaaugaauagcuucaauuuccguuugagauuagagaaccuuuaucaucuaugcuuauuugggucucgacccuauacuucaauaaggaaucacuuugcaagcaggccaugcugaguagcuuaagcuucagagagauuuagcaucaaauuauaaauggugacacuuuaauagugagcucaaugugccucgagagccagcauguaggagucuggcagcuggaaagccccguggcuucagauuuuccagauugugaacccuuccaucaaguaggaacuccuucgcuuugaaaauuucuccucuagagcaagggaaaaguucaucugaguccuaaaguguuucauagaaaaugcauuauucuucucuuuagugagacuuagguuuuuggcucaggguggacccuuuaguucuuuuuuuaauggccacaaacccaacgagggcgccauaaugggauuguagcuguuuugugugguguguguguguguaugugugugugugugugguguguguguguaugugugugugugugugugugugguguguguguguguguguguguguguguguaugugugugugugugugugguguguguguguguguaugugugugugugugugugugugugugugguguguguguguauguguguguguguguguguguguguguguguaugugugugaagcaaaugucauuaaggagacuauauuuuccauuuuuuuuaaaggggauggggaacuucuuauuucggaggaaaggaaaaagaauauuugaaauuaagaaugaccuaggaaauccagaauaaguaguuucagaagcuucuaaucaugacacaauggguaaaacuauuuaaguaaaacccaguugguuuaaugcacuagacacaucaguagguguagccuggccugauggaucaucccuguauuuccaguucuuggaaggcugaggcaagaagauuucuaauucugagcuaaaccugcauuacagagugagauacuguuuuaaacaagaaguuagauaccuuaggcugaaaagaggcguuaucacauaacuguccuaugugaagacgugucugcaagagucuucgugaacugguugcuugcuuguuuguuuuuaaucaguuuuguguccuuguggcauuuccaaccccauuuggcagcuacaguauuuaagaaaugugaaaauaaugaaauggguuggcuguguuggggugucuuaccaacugacuggagguacaagggggaacuuuggaaguguucucagcaaaggucaagugggaagcucuaaacacagcuugaacuucaauacaagcuugaccauggcuucccagucuugccuguuaauuuucuuugauggacaguccaaaggcagcuccaauccaauaauacaccuuugacuuggacugggaacaccuuggaauuuagucccauuucccugaccuccuuuggcuuuguacuucugcacagggcacaacacaccugaccauacauggucauucuggguagcaccgcguggaucagagguagaaaagccaccaaagccaaaggcuacagcugcauuucuucugguuucaacuuuuaggugcucagcacagaggauuccauugagaguuaagagccccaaauagaaagauauucaauuggccuuagcaccugcuuuccuaggugacuaugaacauguguuuaauaacaaugaucuguggauucuguuuuagcugaaggcuaucuuccauaaacuuaaucagccccucauuuauuuucacuuuuuauuagcauauauuuaauauccaaagugauguguuuccuuauuuuucuauaacacaaguauuguucuuuaacuguauucaacccucuauugcccuucuuucuccucucucccugucuauaucacuaagucucccauuuacuuuccuauccccuacucucccuaaauuuuauuauuuuaauuuuucauuaauuuauuuuuuaaauuaauuucuaaguugcuuaugaaaucuccccugaaauuuaucacgagagagaacaugugguaugcgucuaugucagacuggccuguuucauuuaacaugaugagguacaguuguuugcacugaccuguaaauggcacaauucuguuuuuucuuugagcugcucauuuuacggguggauaaggcccaggccagguaaaguugcaucaccaguauugggaaaagccagaauuaaaauuugggucucaacucuagaguaggauaaaauuauaauuuuuuuuuuaugucaucugccacauaggagaugcucugucugugugggcagauucugaacaccaugacuucaggacuccugggauacauagacuccuaugcacugcaccagccaaggaagaguucacugugggcuacuguggugguggcuguggcagugugugugugugagugugugugugugucccucuuccauuucuucuauuccuucccagagcaucaguaaccuugguugguacaugguuugucaaguuugucugcccuuuucugguucauucuggcuuucacaguauauccugccuucaucaauuuuuuccucaaaggauggaguaggagguugagggggagcgggugagggcaggaggagugggaggggcaggaggaggauucuuugccucuuuguuuugaguguucucguaauaggguuguaugcaucgcaggguggccuagcauuugcuuuguaggugaggaugaccuugggcuucugauccugcugccucuacuuccccagugaagggaucacaggcagaggcuaccugguuugacgugguacuggggaucaaacuggaggcuuucuuugugcaugguagguccagccucagcucccugcccucugugcuuuacacggcuggcucaucuccuugcaauagcauugucuguucaguaaguacuuggagauguccuuuuaaucugagugggagcaagcccacgugacuccucugauuucagaggccacuugccauuucugagugcagccagguuuugugaguucauuucucccccaguccaguuucuuuccagcuuucacuuggcaguuauugcucucuccuaaggacugcaguucuacaaagcauguaaaacagcuaaagggaucccucccagucucucaagaggauauuucccuuguucuuuuucucuuauuuaugagaagcagagccaaaugugagacacaacccagcaggagggacuagaagagcuaguauugucucggcugcaaagaauggagccaggacuccaggcucaugagacagcauugagcggaccacugagaccauuggcuuuaacccuucaucuuguagagagggaaaccaaggcugaaagcaagacaaauagccuuguccaggucuggaaagacaucauuuuaagagccaggacugguacccuguuugaucucaagccagcuuccuguucugugugagaauaccaaacacuauucuugacccauaguguguggaguugaagugaugcuauuuagagcuugaaguugcauaguguuuaagacuaagauugggagccaguaugcccagguucaaaucugaccugacccuaugaucauugcagcucuaugaucuaguacaaauuccuuaacuucucugugucucuauuucuccgugggggauaaucauuucacucacucuuaagguuguugaaaggaaacauauuuucauacguuaaguguuaacaucuguuugcaaagguguguuuucccuuuaauuuaagcgucuaauuguaaugccuggcacggcaugaauguuuuccucugauucuugagcucaguuugaaccacaauauuguaucaccucucaggaaacaguuuccucuaggggguuccccgauggaauaacauaaauugugggagacguucucuaaaccccuugggagacuugguauggucugaggaggguuccgggaaggugggguacuggcucuugggugaaggcagaauuuucuccuccaccaugagaaaccacugcucccccacaagaaaaccccuuggugggagcaaguccacgugacugcucugauuucagaggccacuugccauuucauauuagccauuucuuucccuccuccacuuuuuuacuacuucacauaaaauuuaagugauguaguuacugccaggagaacaggaauuuuccuguuuuguuuucaagccuauuauaaaaaccccccuuuugcacuugcagaaagcuguuuacaaguucuguugauaugaugcagagagcggcuccacuguuuauguaguuggugauuuucaguaaugacauaagcaaauguauauaagcucacagcccuaagcaaagcuggacuucagcaagcccucggccagccauaugggucuccucucuuggccacccaaacaucugccugucucucccaucccaggucccacaguguaagucuucucuuacuucuuugcaguccgauacaaggagcuuuacccacagguacucuggggaacaauacauuuguaaugaaugccacugauguauguauuucaaagggcuucauuuuuaugugaaccucuccccuaaaacuauaggcauuuuauuucaguggcuuuuaacuuuauaugaggacagagugcaugauaucuuuuaaaacuuuuuuuuuucuuuucgaugugcauuguucuauauugcuguaguuguuugugcgaauacauggguuucuucauguauuuuccagccgauaaaauuuagauauuuuaauaaauaugagcccuuuuuccgugaacauuuuuuaaauacguugcuuguuauguaguuuccagaauuucucuuucccagaggauuggaauugcugaaacacaggguauaugagugguguaauuugggagauagcugcgaccuguuuuucaacauugugucgcuuaagccucauccucuccagugauguagggaagagcaggccagcagccucucugacaggcgaugcuuuccuuuaaauaguucuucucuguggucgauuugaagagcauuaucacgucuucacguuuucauggguugugugugcuccuuuuuguaugaauugccucagcuguuugguccauuuucuguuccugcugcguuucuugcugauuuuuuuuuuuuuuuuugguuuaaauaauauacauuccuaguguugucuauuuuuguuugcaccuauuauuaauauuuuucaguuuuaaguuguguuuuucuauaaucuuuuuuugagaguuaaguauauaucauuucccucucccuucuccucccuccaaacucuccuugcucucuuucaagcuuaugacaucuuuuuuuauuaauauauguauguacaaauacauauuucuaaauauguaaauacaaucuucucagucuguaugucauuuguauguauguuuucagggaugacuguuugguauagauaaccaauuggugugcucuuauccuacacaaagaacuucaggcaacuaagaaaugcaaagggcagcaaaaaauagucuuuuguaaaauuuaguuugcuacuauucuuuuucucauuaaaauuuguuuuaugagcaaaggacaaaaacagaaaccacaaccacaaacaaacaaaagaaaggcaaguaugaacugcagcagacccgaacucagagagaugcgcuugaaaacaagcagacgagggggugaugugcauacugcagacagguguuuauggugcucacagcacaggcugccucugaaacaccaggaacacacauauucuccuaaugacagaauauaugggcuuauuugcauaguuuguuacuaguuaacaaaauuauugccacucagaaugggaaucccaucuacauauacacccuauuuuuaaauuaagacuauuugaagaaaguaccuuuagagaacugauuuguaggcacucauaaaugcucacugagcucaagucacugcugaugauugucuuagugugagcaugcucaggacgauuuucacacagaguuaacuauaaaaaaacccacaaauuggaaugucuuuuuauuauuugcccacacauaaaaauccccuuuugugugccaaaguaucaccuaaucacuacagcagcuccaaacauagacuuuguuccaucuuauuguaaaacugacagaggaaacaggggagagcuguuuagucccucacccccacccccacccccaccucuccaaccccuccaccccacccccaucucagagucugagcgcacaaguauaggaagucaacggaaauccugaaaauuggcuacuacacaugugugacuuugaaccaacaggaacuaaacuuauuuucgugccuuuucauacuagauguagaugaaaacacaauucuuaguccauugcucagaagcccuaacacuaaacacgucuauugcugugucuauaaucaagaagauagcaguagaucuuugcuuuuuucuuuaaaugaaguaaaacuuuuuuuuuaaagauuuuauuuauuuauuauauauagguacaaugucgcugucuucagacacuccagaagagggagucagauuuuguuacggaugguugugagccaccaugugguugcugggauuugaacuccggaccuucggaagagcagucgggugcucuuacccacugagccaucucaccagcccgaucuuugcuuuuuuaaaauuguuucacuuauuuacauuccaaauguugucccccuuccuggucuccccuccuccucccuuccuccaucccuaccccuucaccagccugccauuccuaagucaccaacccccuaccucccaccccuguaucuuccaucaaguaucuauaggauuaggauccucucccacugagaccagacaaggcaaucuucugcuacuuaugugccaggaaccaugaccagcccauguacgcaagcaucuucaacaaauggugcuuguugaacugguggucugcuugugggagaacaccauauuuaucaacuuguacaaagcucaagugcaaguggauagggaccucaauguaaaaccaaauauacugaaucuauuagaagaggaagugggaaauagccucaaaagcauuggcacagggaaaaauuuccugaacagaacacuaauggcucaugcucuaagaucaacaauugacaaaugggaccucaugaaacugaaaagcuucuguaaggcaaaggaugaugucaacaggacaaaacagcaaccuacagauuuggaaaagaucuucacuaauccuacaucaaauauuaaaaaaauggagcacagaacuaaaaagagaauucucaacagaggaaucuccaauggccaagaagcacuuacagaaauguucgacauccuuagucaccagagaaaugcaaaucaaaaugacccuaagauuccaccuaacaccagucagaauggcuaagaucaaaaacucaagugacagcagaugcuggcaaggauguggaggaagaggaauacuccugcauugcuggugggauugcaaacugguacaaccacucuggaaaucaauauggugguuccuuagaaaacuggaaauaguucuaucugaagacccagcuguacugcuccggggcauauauccaaaagaugcuccgccauaccacaaggacacauacuccacuauguucauagcagccuuauucguaauaggcagaagcuccgaaacaaccuagaugucucucaaccaaagaauggauacagaaaaugucauucauuuacauaauggaauacuacucagcuauuaaaaacaaggacauuauaaauuuugcagaucuuugcuuuugagccaugcacuuguccauaugcuucaauagccuggcugcuauucaaagacauggauagguuguagguacuugugagagcaaguucugaagcucagagcaugguaaccagugagaccuuucuuuaaagucauguuuucuuugauacauagcaauguaacuuaaauaucaaauaccccaauaguuaaaaugcagucuaugauaaacauguuuuuaguaagaagcuuaacacguuguuuuuugcaugcaauccucuaaccuauugggaugcuugauacuguaugugauguaaggcagagguccauuuuuguguccuuccauauuaauaucuguuuucgagcuuucaucugccaugucacucccugaauuacuccugaaucuguacaugcauggcucuucuccaagcucucagcccuagugugaugggcuuuucccaucaccaugacaguguugggaggaaggccuagcaucuuccuuucagaggcaucguuauuauucuugaagucucucucucucucucucucucucucucucucucucucucucucucucucucucucucaacuauuauugaagcccaauguaccuacagaagaauauauuaacuguaaaaaguauaaaguauuuuacaaaugaaacacaguaacuuaguaacuuaaucagcaccagacccagcaaguagaacagucacucccuagaggagugguucucaaccuucguaauguugugacccuuuaauacacauuucccauguuguagugaccccaaccauaaaauuauuuuuguugcuacuucauaacuauauggcuacuguuaugaauugucauguaaauguuuugguuuucugauggucuuaggugacccccgugaaagguucauuugacccccauggaggucacaacucguagguuaagaaccucugcccuagagucuuccuuguucucuuucuagccuuuccuuuccuuuuucucuucuugccacaaaggagccaguccugcuuucaaaacuguagacucauuugaacuuuacguggguaaaucuccauuuuguauguccucuguauuguauuugugaaauucagccauauuguugcaugcaucuucaguuuauguguucccauggcuacuuccuauuccaguucaugaauaucugacuuuuuuuuuuuuaaucuauuccucuguugagagucauuuggguuguccugauuugaggguauuuugaauagugcuggucuguuucuuagcagcccuaaaccuuuacacaugugaauuucuuuauaucacacccuauucacuccaguacuuaagaucacagucauuuaaagucuagguaugugucccucccuuuugggaagaguucuuggagugccagaaucuaccaaguucucaccggcucgacaucuacaaacuuguauccugugaauugaucucuuaaguaccauacuccaaaggcuuuuuggaaacaaaaacaaaauuaaaaaaaaaucuaaaccaacugaacaaacaaacaaacacauagaaaaacuggaggaccggagaguuggcuuaguuguuaagaauaucugccuugcaaauguaagggucugaauuuacucccagcauccaugaaagaaagcugggcuggucuugccugcagucucagugcugugggggaaaagacuggagcaucacuuggguguguugacuaccaaccucauuucagguucaacgggacaccccauuucaaaggaauaagguggagagugauagagaaggauaugugauauucuucucuggcacacacacaugugaguuuggaacacacauacacacacacagugacaauuuuagcauaauuguuuucuagcaaauaugaggcaauagacuggacugucugcagguaacagcucucgaaaucagcuaagaccacauaacaauauucuuuaucuaucuaucuaucuaucuaucuaucuaucuaucuaucuaucuaucuaucuauccauccauauguuuucucaaauauuacauccugaccacaguuuccucucccuucucuccuuccagacgacugcuacucuacacuucuccagauccacuccuccucuguuucccuucagaaaagagcaggccuaucaggccuaucagucagacuggcauagcaagauguaaggccaggcacugauccuuauaucaaggcaagauaaggcaaccccauaggagcaaaagggucccaaaagcaggcaaaagggucaaagacagccccacguccacuauuaggagucccacaagaacaccaagcuauacaaccaaaauguguaugcaggggaccuaugucugacucacacagguucccugacuguuucuucagucucugugaguccuggucacuugauucugugagccguguucuuaugguguccuugccuacuuuggcuccaacaguccuuuccuucuucuuccauauuccccaagcuccaucuaauguuuggcugugggucucugcaucugauucuaccaguugcuucaugaaucuucuccgaugacaauuauguuagguuccagucuauguucuaugaauauagcauacuaucauuucauugaauuuuuuaaaaaucaguuguguuuaguuuuacccuagaucucugggcuaucugccucugguuccuggcuauccaggcagugucugacauggguuccuucuuguggcaugggucuuaaguuagacuagucauuggcuagccacuccuacaaguucugugccaccuuuacccuagcacuuuuugcuggcuggacaaaauggaaguagaaggauuuguggcugaguugaugucucaaucccccuggaaaccuugccugauuacagaugauggccagaucagucucuguauuccccauuacuagaaguuuucaccagagccaccuuauauguucaaagaaguuuccacuacaguaguuuucugccuaauuaccuaaauacucccuaauuccaguugucucucccuccaucccugaucccuucuguucccaacccaacccacugcucccaguaaacucacaaagucuauucaaucuccccuucucaggaauaucuaucucuccugccuugagcucuccuuguaacagccucucugggucuaugguuuguagcaugauuaucuuuuacuuugcagcuaauauaugcuugcaaguaagugcauaccacacuuaccuuucuggauaugaguuaccacacucaagaugaagaaauuuuuugaaguuccaucuacuuggcugcaaauuucaugaugccagucuuuuuuguugguuuuguuuuuuuaaacaagagaauuacucuauuguguaaauguaccacauuuucuuuauccauuccuuggcuaaagacaucuaguuuguuuccaauuuuuggcuauuaugaauaaagcugccauaaacauggcugagcaagugucauugugauaggauggaaugaccguuagguauaguccaagauugguauaguuuugucgagguagaucaaguccuaguuuccugaaaaccuaccauauugacuucugaaguggcuguacaaguuuguauuucuacauccuuguuagcaugugguuuuaaucuaagccauucugacagguauaagauggaaucucaagguaauuuuaacuuaccauuuccccuaauggcuaaggauguugaacuaacuuccuuuucucucuuucucucaaugcuuucaagguuaacuaaaaaaaaaaaaucaguagcccuccuauauacaagugauaaacaggcugagaaagaaaucagggaaacaaugcccuuuccaauaaacacaaauaauaugaaauaucuugguguaacuccaaccaagcaagugaaagaucuguaugacaauaacuucaagucuuugaagaaaaaauugaagaagauaacagaagacuaaaagauuucccaugugcaugguucaguaggaauaacaguaaaaauggccaucuuaccaugagcaaucuacaaauucaacacagucuccauuaaaauuccagaacaauucuucacagaccuugagagaacaagaacuucacaugggauaagaaaaagcccgggauggcugaaacaauccuguacaauaaaagaacuucuggagguaucaccaucccugaucucaagcuauacuacagugcuauaguaacaaaacaguaugguacugguauaaaaacagacagguuggucgauggaauugaaucgaagaccuagauguaaaucugcauaccuauugacaacugaauuuugauaaagaagccagaaauacacaauggaaacaaugaaagcaucuacaacaaauggugcuggucuaacugggugucugcauguagaagaauucgaauagauccauauuuaucaccuugcccaaaacucaaguccaaguagaucaaagacuucaacauaaaaccugacacacugaaaaacaauauucuuacuuucaggacacucccugcagacaagcuguggaucaacacacuuguuccuuacacaucuucaaguagacucuuuuaaaucuccuuuaggcuucaauuauaaaaacaaacauacaaaaaaacccucaaaauaacauauauuucuuauaccaaaaucagugcauuuaauuuuaaaaugaauagcuucuuccuguucuauuugcucuguccuccugucuucccuaaauuuguugguuuagucucuacccuuugaauucuuuuucuuuaacauuuaaucaggagccguauauucuuauuuaacaagguuaccagucugaccagaaaaaugcuuugcacagagguucccugugcaagcucaucugcuugacggucucugugagagugacuguguguguuuguguagcucauuguuguucagucacuguaagcacaaaguauugauaacauccaaagaaugaugguugcuagucccuaaaucuuaaccuuugaagaugcaauaaauauuuaaaaagagauaauugugauuuuucuuuccccaacucuuccuucuuagagagugaagggaaggcugggaaggccgaugagguacaguccaccaauauguuaguuugcauugcuugacuauaaaauuggcuguggaguauuuuucauuaguaauuuauuuuacagauguuuuugaagaaaguuaaaaugcugguaaaaucacauccaggcauuacauugcaauuuaaacacacugcuauuuuauuucuuuacacacaaaggcagacaaauuucccccuuuccuuucuuccuuucucuuuuuaauuaaaaaaauaaaaauaaaaaaagguaagaacauccaaagcaucuuuucuucuugggcugcagagucaauuguugccuugggaauaaagggagugagcguaucccauuucuaguuagccaguaggugcccugaaacauaaagagcagcaaccuuugaagacugaaaauaucuagcggugaugugugacucauaguauuuccccaaggauucauuuucauuuuuauuuuauuauucuccgacuccaugacuaaagguuuauuugguacuugcaaauugaaacaggcuggacuagaaggagccacuuaccguugcccauggauuguucuggguagguuuauaaaucuuccacugaacuugaaguguacugucucaggggacaacucucgagggaaccauucuggaaggaccuucaauucuugcauacggugauggcaugcaucacaugggcugucuaacuauagcagcgcugccaucagcagcaguuuucuuguucucauucuaguuuucucaccugaaaacagaggaugaugaaaaccacgacucauucagagaaucgugaggaugggauggcugcaagaacuguaugcauggcagguagaaauugcucagcaaauucagccaccacuauuauuguuauguuuuccuccagggcuucuaguaauaaggacugugcuggacagacgggugugugcacccugagugagggagugaucuuuagcaccugagggaucacuacccugccacaugguacuuguuuauguaggucaccuuccuuacacuguaagccucuggcuagaauaaccaguucuuaacauuagcuuuuggauucccagcaugcugcagguaucaagaaagacuagacagcaguggaaaugaagagggggaaaguuggauccuggccucuccauagagagggcucugucuuagaacuguguucaaaaucacagacugaggaaggggagaggggugguguuucugccaggaauuagagguguuuuggugcuagucacagaaccagcagccacccuucuagugucugaaugaggaugaaacgcaacaauucuugguaaacagagggagucucuaccuguuugaaucagggucucuuugcuguuugugcggcuggagauuuuccaguucugccacgaaugcuaugauuagacgcguguccagguuuaccuggguucugggaauguaaauucuucauaauuggggagcaaagaccccuauucaaugauaccuuucccagguuaccucuacugcaucucccaaacucaggcaucccuaugcaccuaugguuauuucuucuaaaucacuaaagguagagugaucgauccaagggcauagguauauuuuaagauccaugauuaccucuaagaaggauuugugcaauccuuauuuuuuucaccucuaugauacacuaucugaaaggagcaacuucagggaggauagauuuauuuuggcucacaguuugagaggacacaguccaucaugggaagaaaggcaugacagcugagauucucagcauggugggaauuugacacaucugcucguuacauaguacugacuaggaaacagagaaacuggggcgggaagcagagcugggcuaugaucuccaguacuuacuccugcuucugccccagugacccacuuccuucagcugggcuccaucuccuaaggguuuugaacuuaucaccagcugcagaacaagugucuggaaauagaagccggugggggauucacauucacacaguaacaauuagcaaccagccuucuacuaaguguugcuccuggcuccuggcacauccuuucaaaggagaucuaagaaaaaauuguuaguugucuauuacuguguaacaaauaaccacaaauguaguaaccuugaaacggugugaauuaauggugucccucuguaguauauugaucuuacacauggauguauuuucugcucugguuucaccagacaaaaguggaggcaucaucaaugauugaacaucuccccugggcauugguguccucucucagacucacugaugguugguagaacgcaucuacuuucuucuccugcuuucuacccacuaacuuaauuuucuguaaauucuggaagaauggacugcuacucacuuucaguagcaacagagaaauauuuuaaagugaagauuuaacccucuuauugcuugcuacugcauguuaaaauacuugcaaaaaauugucaagcaucccacagacacuaaguguuuuaaguguaucuuuuuugggagauguggagcauggucaggucugucccugcuucuguaguugaaaucuucaccaauggagauguuaguaaccauagcaaucucucauaucaguguucuguggaauucuaguccuggaagauauuuuuugagcuaaacauuccaugauaauuaagugugggaagcaugggugucauauucgcuccacaccuuucggggacauugugggguacauagacgugccaaguucuuccuugaagaaagaguucccaucaguugucuagauucucuuugucuguggaacaagagucucuuuccuccauugauuaggauucugagugagucaucugaaggcauggccagagagccugaagcugugugcucuggugaucuagaacacacucuccaaccugccuuucaugcuaauccucuccugauaaaauaagaauggagaguugaucuuccugcagagccucaguccuaauaguagccauuucugucauuuucuauaaaaggauaagggaaaaguuucuaauaaacacaaccuugaugacuagaaauaacaauaggaacaaacaaaaaacaagugccaccccccucccccaacacagaagucuccaagguuggugacuacuugcaagggaaagaggugaaagaaauuugaauggacacacagacaugaugaagagagaaaauuagacaugagaaaaaggaagaguaaugaauuggguggagaauugcuccugagacugggacugagguccagacagccagaggugcaaacagaucaacacuacccaccccgugguaucaauagaaauguacaggaaguguuauggugucaugugacucaugagcucuguuuuuggagagagaaaaggaccaaccuucaguauuccaggauggagaucgcagaagagguagaugguauuguuuuggggugcagagguaaaaaugacaugcugcagucuagcaaaauagugagaagccugauggagcuggcugggcgaucaccaugggauguggaaaaugauauguuguuuuguguauuaaagcuauuugcauuggaugcuaauuuuauagacucuggugcuguuguucuggauggucaaacgucuuuuaacaacaagcaucauuuagcagcacuuccaucuugcucaaggguuaauuuauuauauugucaaaauguuugacuuuauauugcuuuucuagcuccacuuaauuuacucaguguguguguguguguguguguguguguguguguguguaaugaguggucccuguuugaaaucaagcacucaagugcucacuuuugcuccuuggugacuucuaugugccgucuuuauggauuucaaugaaaguaucuggguuuguuuaaacuaugccgaauuguauugcaagggcuauuugugcauuuugccugccuuuuugaaaaggcaacuaaagucaguauccuuguggucucucgcuucucuuauuuucaugcaggaaguaugucagccagggcuuugguauguguaagaggcagcauggcuuugaaauggaggcucagugugugucagccugggucaggugacaucgcuuguauagcucucagccccaugcaguggagguggccauguuauuucuuuccuaauguggcuguaaguccuaaguggugguagguauaugagcguaacacuuaucacccaguacacacucagugaagacggauuacaucauuguuaucaucaucauuuuuggaaaugcagcuagagaaaguucucaaccgauagaaguguucaggguuguggccauuuggaaaguaauaagcucaaagaauacaggagagcaucagaaauaagauucccucgcuuuaaaugucuguuucuuaguuuugugaacuuggcaagauuucauuuccuugugccuugaagaaaugaguacucuguggcuugccuuacaagaaaauuacaaggauuagugaauuuauauugaacucuuggacucucugauugcaaaguaggaaauauuuuuugcagcugggaugcauuaaugcuagcaugaaccugggcacaauuaccagauuuagucuguuuuuuuuuuucuucugccccuuuucagcuuuugugaacuucuguguuucuuugcugugugacugaagggauuguggaauacuugccuuugaaguuuugguggcgaggaagccaugggugaaggugcuagauguuuggguggcaugagauaagcaaaacccauuuuuugguuuuguuuuggggugagcaaccuuacccagucuuguuucucuccgagacaaacuggagaaaccagcugggcaggaagauuguuacagauugggcuccuguccuggagauaacacaauuguguuuucuucugucgagagaaagucauuagccaacgagaagugagcuuuuauaguuacuaacagaaauguagugcugggguuggagauacgauaugaguuaaaagcaccacuuccuccugagaaccuggguucaagucccagaaucaacaugacaguccacaaccaucucuaaccccagucccaugggaucccagggcacugaguauaucugugguacauagacacacaugcagacaaaacccauacauguaaauuaauacauaaaaaguaaaggugaugauagucuugagaguguuauuguuuugccugguucuguauaucuaucugucuuguuuguuucuuugcucauuuguuuuucuggugcuggcaauggaguugaauuggacacuaggauaacuaggagggguggccuagacauggagaccaggaagcgaggggagggagaauacuauagaagaaguaacagggagaugaagggaagugaggacaccagggaagauaguuauuuaagagaaauggugcagaucacaacagagcaaaggaggcaagggcuccauccagugagcuacgucuuuagccccuagagcuaucuaauuuguagcacauuaaaaacuaaaguauagagguuaauucuguggagggacauucaugugaaaggguuggcacaagaauuaagaguagaaccuuuuuuuuccuuugagacaggguuucucuguguagcccuggcuauccuggaacucacucugcaaaccaggcuggccucaaacucacagagauccaacugccucugcuucccagugcugggauuaaaugaguguaucacaaucacuggguuaagagcagauucuugaggcaagccauccagacuggaagucauucucagccaugugccuuugugcagauuucaggaccuuggaggaauagcucucaguuuuguaaggaauaaaauaguuaacaaauacauagaauuuguuauacuacuuaauucacaggguaagcacugagugcuuguagguuagcuuuugucauuuugagcuguggguucuggguauaagcccuggauuuagauggcuugaguuuggaucccaacucaaaaaaaaaaaaaaaguccuccuuauaagcuaaccucaaugaguauuuuuguuaauuaguuacacaucuugcauauacuuggucagacucaugggagaauuaaaugagcauauccuaauuuccagugugccugguagauaugaaauacucaauguauguuagcuauuggucucuuggcuuuucuuuagauuucagugacaucuuucuuagcccuuaaggagaaaguuggaaaaucugagugucuugggcuucugggagcugguguccaccuuccaccucuggaagauccuucccagauugugagcuggcugcugaacaacacagucagucauuucugaauccacucuccagaccacgguguucugcagcagaucuuggcaacacaucagguuccaggaaaguacaugaaucaccacaggagucccaacgcugcacuucugaaccucauaaaaacaugcagugcuguuaccagauagccuaauacccaucuucccuaguguccucgcuuccuuuccuauccuaucucccuccuucuccccccucuacauuguucuccuuucuucccuggucucuaugugcagacccuuccuccuacuaccuucagcccagaucccaaacaauuucagucccuucccaccuggacaccucuuuccucaacccccgcccccgccccugccccuccccuucaaaugcuugcuuguuggcagcgcucccugcaugucugcuucagucaucacuuucuccagcucugccucuuuccuguaaggcacuguuguuuuuaacuauagacaucuuggauccccaugucucuguguguggaaguucuaucugcucugggaaagguggacauuugguuuccugggaggagauaacugaauggcuaugucucuguggcugauacagguuaaaguccuugcuguaguauugccauaucucauugcuaucucauaucucauucuagacuaacacuuaaaauagagccugacacauaggugguacauacauuuaauuccaguacucaggcuauagagacagacaaaucucugugacuucaaagccaguuuacucuauaccgcaaguuccaggcuagccaggagcccauagagagauacuaccucaaaaacaaacaaacaaacaaacaaacaaacaaaaucccaaacaaaacaaaaacaauaaacaagcaaaugaagaaauauuaauagugagguuucuguaguauuaggaaauuagcagcggcuguuaaaucaagggggauuagaagaggaugguguguuccagacagaguaucauguaccaaggucccacgguggacaauaugaacugaacaaaacccagagauauaggauuaagaguggggaggcaggugagguaauucagaagugaacagcagaggccucugcauugauuugauuacaucacagcuauugacuuggccuguacuuugucaccuugccccuguguuucuauauaucacacauuuaugucccuauaaaauaucuuugucuugucucuaacucagaaugaugauauugaugagaucagaagcuaguuaguguggcaauugguuuucauugucaacucaacuacauagaaucuccugggaagacaagagucuccaugagugauugucuaagucacauuggucuauggagaacuaucuugaucaaguuauuugaugugaggggacccagccugcuguggguucagcauccuuucuuguuuggggucuugaacuauaccaaaguagaggugaaucgaggaagcaugcaugcauucauccucucucugcccuugacguuggaagcaguggcucuaguccuggcuucgucgucuucuugaggaauaaucuugggcaaguuacuuacccucucucugggcuucuaucugaaaaggaagcuuccauuaauuaaaaaugacaacugugguagaagugcugaguacugcccauggcugugugacuggcuugugguauacuccugcaucuugaagguggaggagcuuugaagacaucacaguagggguugaagaguuuuucaguugcaauuggaucuugauagagcccugagcauugccugaggugaggggccagugauuuucaugaucuggucuguaauuuccuugaagaaugaucugaaauuuuuuucuuauccuuguucuuugcugggaacacauggcagccaugacuacaguucccacucagccuucaucagggaagccauucaucuuuaggucuucuaguucaucucuuaaggucaugauuucauuugucucccuauuucucacucaaccugguuuuaguugacacagauucuggaacuuugucuccuuuggucacugaacuaugauuuccugcaucucauuauccacaacucuaguuccagacccuugggaugcacuggcuugcugauucauguacccuuuucugccccugugaccucuuggaacugggaucacucuucacuccugacacuugcuggcugggauaaaacaacuuuauuuucuacucccagauccacacucauuccuggccuucugcauuauaaguuggaacucaugcuguuucugcuuucauuuccuuuuggauaagaggcauggcccuugaguucccacuuccaguucuagauugacauaucaaaacaaaaucccccuccccaugccucacuauaugcuuugcuguuguugucuugaguuaagaucucacaccauagcacaggcuguuuuagaacucccauaauagccuaggucagccuggaacucguggcagccaucuugucgcagucuccugagugcugagauugcaagugugagccacuacaucuggcuuuucugugcucuggucaggcggcaggcagagagcuugcugcacuguuuguauucaccuugacacugugcauucuucaaaggcugcaaaccauccuuaauuaucucugugauucagaacuggggcagggccuuacaaaauaaaagaaggccuuuaaugaaugauuuuuaaaaccaauuaauuuaugauccuuugagaagaccagcagucugaaccacaaagagaggguguuuggcugcuauggaaacuaugggcaacuccuagagauggcuaucuauggggaggccccuucagcuguugaacucuuugaaacaaccugccuggggaugacuuucuagauaguauugugacauaaaaacuaauguguucagcuuuuccucuuccuuugaccuacuagagaaugugucuauacuucaguguccuguuuguuuuguuuuguuuuucugguacucuggcuagcugagagagaauccaaguucaucuauugcauaauaacaaacauguaaaagagaagaaaggccaaugcagauaaagugugaaccuggagacagucauuauacaaaggacauggacaaggugaacagggguuggagagagaagggaaggggugguguaugggaugcucugguguucuaucugaaagaaaauaaggaucuaccuuaucaauagauucucucugucuuuaaaauaaagucuugguccuuugcaauuagcgcagucuucagcauguggaagacuuucagagaauacuuacugauuuuaauuuucuaaguaauaguugugacuguuggaauuauauucuuacaaguacaaaugauuauaugcagcuugcaagccacgucuucagacuauuuuugguuugggagcaugaucucugaacacccucauucuggaauggugggaauauuaugggaaggcagggaaauaacucccaacacacuuccaacuucacaguccaauggucaugcucuugugugcaacugagguucaggaccaaggacagcauccucuccuggagucuccccucuccuuucccagcugcugcucccauacuccuggcacacauucaacauccuggguccuguacuuuugauuauaccuguuauguaaccuucccacaaggagucaaucaaauaaauuucuuuuucaguucuauaugaaggcugcagagcccugcuggagacaaaugaccuuagaugccacacaguuccaaagucuugcaucaguucugucaagaagacugaaaaugcccauugccaucguucuauaccuuaagcccaauggugacuacuuugaaccugugucacuuuagaccugugucacuuagcuuucuccuucaguuuuaguauguggcuuugucuucuacuucuaacagaaaacugaaguuuacacggucagaauuccuuuaauuacccuuuacucuuaugcuugguccaccugugaagaaaaguuguucuuuuggucuucuuaaaacagaauucccgggcuggagagauggcucagcgguugagagcacugacugcucuuccaaagguccugaguucaauucccagcaaccacaugguggcucacaaucauccguaaugagaucugaugcccucuucuggagugucugaagacagcuacaguguacuuacauauaauaaauaaauaaaucuuaaaaaaaaacagaauucccucucucuguauguuccuccucucacauccuucaggugcucacauauguacugucuggaauccuggcaaacauuuccaucagcauucccagacaauugugagauuccguaguccugauuuaaaagauggcuuuauuccaggccuacugaaucagucuuuggcagucaggcuuuauaauauauauauguucaauauguauauauauauauugaacaagaccccuugcuguuugggaaguguuauuuauaaagaccugccuuugauuguucuuucccuccacuguccuccaaugaugagucagaaagugcaguccaaaauguucucauaacuucuauaauuaaauguucaagguacagcacguauggaacagcaaaguggaugaucugaagaguauuuaauggaggggguaguuacagagaugugucaguauguaggacacacaugagcaucagggcaguaucccaaggcuggcaccagggggcugaagaagagcuagcugacuuguaauuagugcagagaggcaugcaucuuacagcugguagugggcaagagcagaggaaacauucuccccccacaguuuccucccucugagcuccugcccguggcaccaucuaugagggcaaaggagcuuugugaaggcuaguuugucagucuccagcucauggaacagcagaagggagauuugcaucuuggaggauggaggccauacaaacagaaguuauauuguaugguaguacgguuucuaaccagggcaucucccaccuugacccucugcuguagcuuuugugcagacuucaggggcuugugcaguccugggcuggcucuguguuuacaacuuuguuugugcagccuucucuuugcuugugcagccuucuuucuguggaaagcccaaucuggccuuauuuacccaacaacggucaaacuuucuauaaaacccaacugagaugcuaucauuugaauguugaauggcccccaaagacccauuuacuaagaggagcaugauuaaugaauaugucuuccaagguguaaaauaugaccuaaucaaagccagagcagaagacauauccagggccuaguuccauuaaagguguuaaacguuacccagauauacuggaacuaaaguucugcuuaauucagcauuccauggguaauccuaaaaugacuuggaaggaggaauuuguucuucaucauguaagacgucuucuuuaaaguaagaacuguauaaagcaugcuuaccagaacaagccaguucccuaaggauggagaaacuguguagcugcaggcuucaacccuaaucuaucaaauuguccuaugacaucagugaaaacuguuagugagcuaugaaucugaaauaugcaugguaugaugauaaucuaucuucuuaucucacugaauauuucuuuugagauaaguuuuuuuuuuuguuuuuuuuuuuaugucccaggauggccucaaagucacuauguaguagaagacaaucuugaacuucggauuuugcuguagucaccuaccaaauucugggauuacagacaugcaugccagcucuaugcgaugccagggaucaagcacagggugugugcaugcuacacaaguacucaguaaacugagcuaugucuuuaagccccucaguuuucaaacaaccaggaugccugguugaaaaauccaugacauaaaaucaaucagaagucuuuuauuuuugaacugagugugaacacaccugcaauccuagcacugaguaugguagacacacauauaauccuagcacugagugugguggacacaccuguaaucccagcacugagugugaucacacuuguaaucccagcacuuagugugauggacacaccuguaaucucagcacugagugugaacaugccuguaaacccaguacuaaguguggugggcacacaugugaucccagcacuaagugugaacacaccuguaaccccagcauugagugugguggacacaccugucauuucaccauugagugugguagacacacguuaucccagugcugagugugaacacaccuguggucucagcauugaauauaguggacacugaguguggugaacacacauguaaucccagcacggaauguggugggacacagcuggaauucuaccacuuagaaaggggagaacagaagacugaauucaaagccagucuugcauauauauacaguuugaggccagccugggcuacaugaccuucccuucagaaaaaggaaggaaggaagucaggaagggaggaggaguugcucuuauuuuuaaacacuaggugugaggugcuuauuuuguuaguggaggguuucugucuuugcuccaucaaaugcuugcuaauaauuauugcuaauaauaccagccaggugguggcagcacacgccuguaauccuagcacucaggaggcagaggcagguagaucucugaguucaaggccagccuggccuguugagugaguuccaggacagccaggucuauacagagaaacccuguccaaaaaaaaaaaaaaaaaaaaaaaaaaaaaaaacccaaaaaaacaaaaaacaaaacaaaacaaaacaacaacaacaaaauaaauaaauaaacaaagaaagaaagaaacuaagaaacaaagaaagaaugaagaauaccagugaagcaagguucugacuaugcucucugauaagccagaguccaaaagacuaggacaggaggaccacagaguuggaccacccugggcugcuuguugagacccccauuccaacaaagaagugcaucgaagcuggcauuuuucucuuuuacccccuuucagacccggcucuauugcccagcuacuagguugcuaguggugguuguuaguggugcuuccuagcaggucacaccagggcacagauaaacacuuuuuugggacaaaacuuguaagccuuucugcaaccagaaagauuuucccccacuacuccugcugcuugcuuugacugggggagacuucuuucugggucaucacagguggagaaucaggacucuauauugcugcagugccccuaagucccaucuccucauuucccguccccucucuaccuucaauuaccucucucucucucucucucucucucucucucucucucucucuccuaacuccuaccugucuuugcaaccuccucuuucuguaaagccgucuuugaucacacuggcuaacaacagucuuuuccucaugauggcgguguuguaugugcuacaugccaggcacccuacuaagcacucuacacccacucuggcacuuauguuugcccacaaacugggaggacauguuccuguguccauuccacagugaacccaguuaaaugcagagaggcugcacagcaugcccagaccugucauccugucagguguguaaaacuaacaccucugaugccauaauauggucauccaggcuggaaaaacccugugcaaucuuacuccuuucuuucucucugaacccacucaugacuccaggccccagaaugucaucuuaugguauggccacacaauugugcccuuuguuguugcuccuuggaucuugaugucauuauucaguucuugaauuuuguucuugaguuugauaggacccucagucuccacaguuuuccuucauaucccauugucuguaucacccuuccaugucugugggauuccugcagauaucaucgcccugcauucccauuuguuaccuuuugcuuaugaauaaguaagggacguuuccugcagcaucaacaaugacauucauuuguuuuuuugucauacugaauuccuagaauuccaggaagugacccucuucuuugagcucuccacaaagguaucccuuuaccugacgggaacacuggguagcaggauggacaugaugaaggcccaugagaugcuguagagagagccaauauaccuucucucacuacccagccauccugacauuuccagguacagagucucuucuguuggaugguaccaagagugcccuucucuccaaacuucccaaacuuccugcucuggggaacacaugcccuuccuggcuucauuuucuuccccccuuguccaguucuacacaugacucugagcaucuuuucucuucucuucucuucucuucucuucucuucucuucucuucucuucucuucucuucucuucucuuccuucucuccucuccccuccuccccuccccucaccuccccuccucuccucucuuccccuccccuccucucuuccccuccucucucucucucuuucuuucuuucuuucuuucuuucuuucuuucuuucuuucuuucuuucuuucuuucuuucuuucuuucuuucuuucuuucugguuuuucgagacaggguuucucuguauagcucuggcuguccuggaacucacucuguagaccaggcuugccucaaacucagaaauucaccugccucugccucccaagugcugggauuaaaggcgugcgccaccacugccuggcaugacugagcauuuucugagaggaccucccuuuacucccaagcaguucacaaugacaguuuaucuuuaaauggacgguaugcuucucucauagcauugcauuuauuucuaugcaguagcugaggaugccaaacaguauuuauauugcauuuucucugagcgaauacggucuuauuuacaaauaacugccuuguagguaugugcgugcuaugccugaagucgagcagagcucagugaggaugggugcuuauccugaguggcgucaaggaaagugggucuuguguuagcucucagacgauggacagaaggaagucagaaacggagaugugccuaggggagacagaaauacagaaagaguggauaggggacugugaagaggacaguacaugccagaaauuuccaccacucgaugaagaggagccagccaacuguuucaguucaccgacucuuucugcucacucccuugaagguuuuaagucagggguggcacuccugggcauauuugaugcuguggucugcguaccucacccacagcagauauuacucuaacaaaucauaauacuaucgucuucauccuauagcauuuuuaccauguuaaccugccuguuggggcugacaugcaacccaagaucccuuuguuuuauguccugguuuuagucaaccuggucagguuuuacuuuaaguaaaaccauuuuaugugucacuuuguugaaugaaaacuugaaaugagcguuauaacagcauaauauaauuauuugacuacaacauaagagcauccucuuagcaugucugcuucacagugaucuucuuugggagaugacauuuggcccauuuaccccaggcuaauugcuucgauucuucagaucacaauuuugcaucaaucaguucuacuuuuuucagaacuuagcauugauuuuccgaaaggaugcuuuucaaaauaccaagugaagcaauuauauuaacaauuucuaguccuuucuuaucaaguagaaaaugugucccuugagaucguggggucugcuguacacacuguuuuccuuuaggauaauaugagugcugccuuuccuggccucucuucuuguccccugugaaucucauuuuuucccuugccccuuucuccuuucuccucuuggccuaaaucuuauccuuuaagaacugggaacaauggcucuggccacauguguggcagaggauggccuuguugaacaucagugggaggagugacccuugguccugagguuauuugaugccccaguguauaggggaaugccagggcggaaaaacuagagugugugggugggugggggagcacccucauagaggcagggggagggauuggauagaggguuucugaagggaagaccuggaaaggggaaaacauuugaaacauaaauaaagaaaauauucaauaaaaaauauauuugguuucggaccagggguggcgaggggccggggagggagaauaacuggaaacaaggcugacaagauggcucaguggguacuagcaaguggcacauguucgccugagcccccacuucucucucucucucucucucucucacacacacacacacacacacacacacacacacacacacacacacacacacagaguucccaaaccccauccucauuucugaagucugccuuuccccagaaugcuguauugugugguuuugagcucacuuuugcuggaugcuaaugauuuggggaccggccaucuucuccagcuagacucagagacccuucagggcagccugagccuguucuaucauuguccaccacaguguaggagacagugacauccuuucccaaugguggaugguaaugacacacagaagcagcaaauuaucuuuacagcucugggaugcuggcguuuaucuucucuuccuaggaauugcucuucaugcugcuuuacuugagaaaauauaauugguguaaaauuagauggcaaauccauauuggggagccauucauguggaaaggugacagcuuguucugacuuuaacccuggcucuggcucuugcagugauaacagcaaugguauccagcuguuucuagcagagucuaccuucccuugaguaaagggaguacuuggggccucugacuggaaacauggcaugucaugggacaaauaugcuggcauuucuguuaggacagcaggugauauccucuuccugagggaaaugggagagaccaggcauguggaaggaccugcaucaugaccuaggaugaagggccacacugagccuguauccugcuaucaaaaguuccuuuccucugaaacaucacuuuuugccucauauuguaacugggugcaagccagugcacuuacuguguggcaagaagaguugguguccacuuccugaaucaagcuaaacucucaauuauuuagauuuuuucccccagaggcacuaugagauagaggcauuaggaccuggcucuaugggagaggaaacagcuguucagggaggguaaaugggaugcuugaugucacuggcuggucagugguaaagucugaaagcagaauccacauccuucagacccuagagccuauaguucuccaccuacaugcuaaacugcuaccauuucugcccgggagagucccauaaaagaggugcccaggggagcucuggaucugaggguccugcugccucauccgcagggcagugcacuguuuucuuuuuuccuaccaguagauggaaauagaacugaauguuucagcgaguccuagaaggauugcuggagucucucccucggagcaaaaggagggggaggagaagcaacagaaaauccuuaggaaaagcuacagugagaggauggcugucaaaccugagcaaacucccuccccccaccccccacaccccuggcgucaugcucugaugaugguuuuaaccucuuagaggccagggagccgggagcagccuuuggcagcuguagaaucuugugagcguugcuggacacugccaaguaggggcuuucuuugugcuaaccaaggucauuuucuaaagacuuuguccuccauuguaagcugcugcccugggaacacagucuucccacaaguuuguaugucaugucauuucuagaaaguguggcuuugagaagaaaacagcuaaaagaguauaugaguggauaaagaauaaagggacaccuggucuccucuuguccaguuguauuccugaauaauacuuuacauagacauucaaacucuuucuaugcacauguguuuaccaugcacugauauuuuuaaaccauguuauagcugccgagcugcacaugcuuacggcauagaagcacccuugaauauuauuaguguuagcugguuccuuucagcuccggugguuugacccuggguuggcacuugggcaacaucuggcgacaugagcugacaggcacuauguacucauaucuagugagcagggggaaguugcuaauccuccuacaguauguaggucaguucccuacagcuaagaauuuccaugccuuacauguuugcgcuuucugagacuucauuucuggaagaugaagaugcaaagacaaaaugucuguggauaaagacuucauuuuuaaguuaaaaaagaaaagggaaugaugggcuguugaguggcucuggcgauagagacgcacaagccugaccucccgagugugaucucagcaacccacucccaaaaguuguccccugaccuccacauacacuccguaguguguguacacugcacacaugcacacacacaaacaugauaacaguaauaaaaauuauauucacauuccauacaucacagaucucucaaccaguuuccaaaaucaaaagaacucgaagcagagguguuuaaaguucauaguaaacaaggauugugguggcagaccuuaaucagaguggauacaaaccucuuuauuccugucagugugcaagcuuacgggucuccuuaauuaacuuaaggacauuuaaaccuuauuuaaaacauuaacgguuugugcuggggguugucaccucugucucuugagggauaauuagacaauauacaggcccuugagacauauauacuuuuuuuaauugaaaagcaaaucuuauagauuuugaaguuuuugauaaacgccauuaugagauaagucaauuuauguugaaacauuuucccaggaauuuagcauagcacugcucugcaggauuuagucccuagaacccucgcguguagaaacgagcacacacgagugauguuagugacuuucagcauuucaaacccccucaggcuggggaccugguucccugguacagcaucugcuuagcauguaccaggcccuagauuaggucuccagcucuauaauaaacaaaacagaacagucgcccuuuggagaucaguuuaauccauuguucagaaggugaugguaaaguuucuagaucuccacucuugccacugucuuaugguuuuccaugcaaauuaacaguaucccccaagccccacaaacgacauauugaacauugucucuuucuuauuuaaaaguugguaaggccuaggacauauugaguacuuaucauguuucauauuuaauacuuuuuccaaaucuggucuucaaaaguuccugacuucuguggaagguagucuuauuuuuaagaaaaugagcuuuuuuggaacagacuuacuuggguauguuaucugucugggacaagucagaaccccaggcuguaguucuguggggguguaucacuacaugugauuuccaaaacacucaccccggggcagacaguuucaguauuucuguauugguggcuauuaacucuuuuuuggggggaggaauaaaaauuauuccaagcuguauuuucuuucaagagauuguccuuggacuugaggggagucaucaaauuucacuugaguggaguagauauuuuuaucagaauacuaaaauaaagucacuggagcaaaucugagguuacuaagcucugccaccccagacuccagugcugagcguuauuugaaaugagaaaacaucagugucccccuggagccugcaucugaugugauauuaaggagagcucccagauauauuuauuucucuugguuuaaucccaagaagcugcuggaacugucaguuuccauuacgaaagcggcagguguaaaaaauauuaucuucaguucucuacaacagagccaauccaagaacuuuccagaaaaaugaaaaaucccuugcccaagccaaauauaaucucuaauugugaguacccccccccacccccgugugugugugugugugugugugugugugugugugugugugugucugggcgugcacgcacaugcaugugugugcauguacuuguggguaugcgugcaugccucugucuguguguguguauguguguguguguguguguguguguguguguguguguguguagcagcuuugugcauucucuugccuucuagcuuuaggggugucuccagaaaccauaagcaaagggcauuccugucuucaguagagucuucaggggcucauccacuaucucaugaaacucagucuacugauguguuuucaaacaaguacaccauugauguuacgucagugaccgggaauaccagguaugaaguguguacagcuagcucaacucuguucucccuuugcuugguuagggcccuucagccuugggaguuauguuggguucuuuggucuuuaaggaagacauaaacacacuaccuuugaucucuuaccaagauucucuuccuggcaacacccguuuaaacccuguguuuaauuuuaguucauacccacaagagaaggcuuuaggccagcucagcccuccccuucacugugacuaucagcugcaacaauuccaugaguggcucacgcuugugggguugguugggcauucgguuaaagucagacgaaaaaugaucuggguauuccaaaguuccagucagucuuugugugaggcaugaacaagaaagugcuguguaucucuggauucucaacugucccucuaccucuagauuuuauucauaguaauuuauuuuauuaauauguuuucuuauauaauguaauauuuauauuuuauauuauguuguauauuauaauucauuauauaaucuauaauacauuauauuauguaauauuaauaacauauuaguaauauaauauuaauaguaauaaccacaggugucucuaaaguguuucuucgcauuauucuccaaucccgucuacuggccggcacacacuucuccaggguagucugcuucuucucaucuuugcccuagccagcuuacucaaaaacaaacaaagaaacaaacaacaacaaaacaaaacugacaucuacaggugcuucucuagacacaaaguuguuauuuuguuuuuuuguuguucuuguuuacuuauguuuacucauugggaauuuuugagccuacaggaaaaacagaaacuuagagccaacaacuaaguaccacugcuuagacuuacaagugucaauguuuuucauuugucagaaaacaaaacaaaacaaaaaaagcaagcacaacuuuucaggaaauaauacugauauagagcugcuaggagacccauuccuuacucuucucccucccaccugggcaaaccauuauucagacaauuucuaggugggcuauggggaggccccuagucagauagcaauaggaaacaacauuuuauuuugcuugcaggugggaaauacaauuuccuucuuguuuuuccugucuacuacuaagguugaacauuuuucauauuuauuaguuauaugaccugcuucagcaaauuguuucuuuguccauuaccuguuugauugauuuuacuauuggguuuguaaaaguaucugaauauuuugauuauuccuuugccuccuauauucagauagcuacuuccagccagcgcauaacuuguuuccuauauuuguuuauacacacacacauaguagauauuuaaaauccauuuacuuuuucuuuauggcauuugucauaaauacguauaugugugcaugugagugucaagaauuucugccuuauccuacagcaauaaagauauucuaaaaacauuuuuaaagguuuucuuuucacaccacaaccuuucauuuaucuggaauguacuuuuauaguuggauagaaauuuauuuugauucccaaauugauuggcucuauuucugccuuugcuguaguggaacaacuugcuuguguguguguguguuuucuugucuuauugcuuugcccacugucuccaacauuaauauuaaauacacacguccucagcuuuggcuaacucucaccgaaucagucauagcaauguggauguuaucucagcuuuacagaugaugugacuagaaccacauugcagaaccacacagcuaauggaucaauaacacagucugaaugaaaacccaucugagccaugucagaguuuagcuguuuaugccccucggucacugcugacgugggaggagcuaacccuucucaccuugccugcuugcgcccagauucuguugcuaauaaggagggggaaauguuauggaauugaugccagagaagcacuugcaguuagucugaacaaaacuaauagacauuguuuaauuuagaccugccaaaaguagaucagagaaucuuauuaaguauggagucauacuuauuccaguugguguaagcauucacucagguaauguaaucacaucucaguggaaacucagaaacaacggaucuucauagcguuaacauucugagaaugaauagaaaugucucccucccucccucccucccucccucccucccuucucccucccucccucccucccucccucccucccucccucccucccucccucccucccucccuucucccuuaccucuguccuucacaaccuucccagccucugaucauaaaaacgcaggagcagcuuacaaaggcaggcauaaaacaaggccgcagauaugcuaaaaucagggcaaacggaguacacauguggcaaauuaauaauucuuccuuagagucguuucuuaguuugaccgaaacacagccuuaagcuuccuagcaacagaagcgaagaaaaccuguccagcugugcauuucacagugggcacgagauggaaauagaauagucgcuaagggacuacccagcauguccugauucagagacuggagggaaacguuagggcauugggcuacaggugggcugcacucauuagggucuucucaguggugggaacugauuuugcaugaucugcguuauucuaggcaaauuccgccuccuugagggaaagauuauucuuuauugugaacaguaccuaaaacaauaggugcucauaauauguuucuggaaugaauguuauuuauacccaucuguaaaaaaaacauuggcugaaguaacauuuguaauaauuauagcucuagacauuaucaaugaacuaccuagaaaugacauuuuaggagguauuuuuuuaguuccauggacaacaucaucaaaaauaacucaauauuuuaguaauaaauuuagcaaaagcggugcacagcuuacccaccggaaacuacagagcaccgugggaaagccaguggggaaccggggaacaaauacacaacagcaauucuguaugaagcacaaaggcugaaacuuuggcuggguggcuuuuuugguucucuggcuugauugagugcuguacuuuaaaguuguaagaagagggugugucagggccaagaagugggaguggggggaagggcaugggggacuuuugggauaccauuggaaauguaaaugaagaaaauaccuaauuuaaaaaaaaagaaaaaaaaagaagagggaaugaagacauagcucagcaguuaagaacauuggcuacuuuuaaggaggcugugaguucaaaugccaacuuauaacugucuguaacuccaguuccagaggauuuuauacccucuucuggccuuggugggccccagguauacaugugguguacaaauauacauauaagcaaacacucauagacagaaaaugaaauuuuaaaagauugaauuauaaauaaaaaguuaauguaacaugcacacacacacacacacacacacacacauacacacacacacgcugcucggcagccuuaguaucaaacuaagggccucaggcauaccugggauguaccugcucucccuuucccccacccccaacccagcuucucucccagccaagaagagcguauuuggauaaaauagaaucaugcuauauagaaaacugcuucaaauguuuaacauucaucauuacugauaacacacaaaucuguauucggauagcccacgaauugguauucucauacauaaaauagguaucugcuaucauuguuagcugauuguuauucagcuuauagcaugugacugucacauuucugaacagcucugaaaauauuaucacauuuaaugccccauggagccagggaaguuaaccauuuugcccagugcuacucucuagcagaggaaagacccaggggcaggagcaggagcaggagcccagggccugggcaguccauguguucuuuacuguccuccccugaucuucuuucugacuucauugugguaaacccuaguguccagugacuagcuggaagcauuugacucauaaauauggaaugagaauauauuuugggagucuuaaugacaccaucaggguaccacaauuaaacaaguguccccauuuuaaaauaaccuuuccagguggcaaucuuaggacgucacaauaaucacauacaaacuagaugugguagaucccaccuaugauggcagugcuugggcuaugccuccaaaaccaaccaaacaacaacaaaaaaauccaagcacaguuugcaagguauuugccaaauguuggccucagaaaaugaacuccucagacagagccuaggcacuaacacgauuggcuaacaguccuuguuucuaccucccagacuuucauugucccccggggaacugagggguuuguaguuaggacccugggcuguaagguccacagugggguucaaauccugccuuuauaacaaaaguucagcauguuggaaagaugaaggagacugucugugaagaugcuuggaacucugugggguaugcaagaagcuuuuaagacuagaagcaggucaaacacacgaccuuguaaggcuggacuugagaugagcagugcauuugcacaagaagccacugccauccauaaugcagagcucugagugguagcgcaugccuuuaaccccaguacuucagaggcagaggcaggcagaccucuuaaauucaaaaugagccuggucuacauagaguucuagggcaaccugagcuauguagagagacucugucucaaaagcacuggacagcaagcugagucucuauucucagacuacuguccccuaugcccugugggcuauuuauucuucuacaagagcaggugauugggguaacaguugcccugcgauacacuaauacaagcacccaaaguauuagucuggacuaaaggaaagauguuucaguguccuuuacugaagaugggugucagugugggucaggcuguccauuauguucccugguucuggagacucucaguuuauaaacccagugccaagaaaacuguccacaauucugcgugaauccugccguugauuccagcuggacaguuucagggcuacaccuuggguuguuuagcuuagcauuccaucugcuaagcaccucagggcugaacgcgguggucccuaauggcggguuuccucaaacaacucaggccucaaaaucugucuuagaaauagguauuguuuguguacuuuaauauagaagcuguaccaagcuuuuuucaugccauaaguaagaucaacuauuccugcagagugacacuguaaaucaguauagaccuguaggaacucaccucuuuacugcacucggcacccacagucuggugucucuucucuuuccaggaaugcuauaauaacagcuagauugcuaggggccuacccgggcaccaggugugguucuaagcuuuuuuuguguccguguuuacauauaacaaccuugugccgaggaaucguuuaauugcuuuuguuuaaaaaugaagaaaguauggcagcucacuuaaggaguucagcaaggauuugcagccagugagauaccaucucuauucaguagagggggauaggaggggggaagucagcuuagaucgccccaaauucccucauucuuuggaaucuuacuagcaggaagauauuguccagcaaccaagaacaaagagaagaaaggaacgaggaaccuaugccuacagaggucugggagauccuuguugacuguccugagaccugcucugaacugaugugguucugcuggucuuaggagccuuugggauuucagagacaucaucccacuuuguaguaugugugugguaggccuaugcuugcugggguaucccaagaucuugcagacuuaggcauguuaggaggucacguugacuauagagcauucuauauguucauugacauuccacaggggugccuggguuccaggaucgguaguaauggaagaaccagucagccccuuugauugcaagacuuaaccagcuccugggugguaguauguuagguagguacccuaugcucauccuucuuagcucucaaugcagaacuggccacauggguauguagcacacuauaguggacagucauggccaggcugaucuauggcauggcugaagauaaacuggcauuuauuaaggugcagccuuaauuuggucauauugcucaaccgcaaagcuagucagauccaacaugcagaugucucggugugacuuaaguaacaugacaacuaaaaaaaaaacuagacugcuuuuaaaauuauuucacucugucaacaaauauuuaucgggagcucucaccaccacucacaugccaagaagcucauggauacugugagaauagccuugagcaaguugaucagaccuuggaauaggaugcucaggagggagggcgauuaugugggccucugcuuccagugugggcagcuacuaggcuggggaaaccuggucccucuggaucuugcuggcuggcuccaccuucagccuggagguuauguccuugcucgaaucagguuuuuuggacucguccuuuaggaauugccuuugcagcugcucugagccacacaggaaaaaccaucucacuguguuauuuuauagccacaccuagcuuugugaccaaaaaugguauugccaacuuggugacccacuuuguucuccagaguugccucugauugacuugccugugagccagaacuacauccacucuuugagguuggauauuuaccacugcugagccaauuaucaguaauuuggaucauuuugaagugauuucuuacugacucucacggugcuuucucuccgugguaacacuguguccaauuucucuucuaccuccugccucucucuuuccugacaguuuggaauccuugggaggguuccagggccauacauccacauguccaaaaauguacacuuacuaaaauugaacauuucauuucugaggaaacuuuucaaguuggucucucagaauugcucuaacaagaacuuuuuugggauaaugggcaauguaguagguuuuagaaccucccaggccuggcuucagugucucuuucucaaauguuugaucuauguagccaguuauuuccccuggccuuaauuuccucaucuguguaaugggacaguaacacuuccuugacaggugagaauuuuccaucuccuaaugcaaauccucaauggaaucaguuauuauuauugacacauugggcugaaaccucacauagugcaugcauucaaucuuuaaaaaaauaaaaauuuauuuagcaaccacuucuuuugaaaucauguacacgcaagcugaaagacugaggguguagcucagcaguggagugugugcucagauugugcaaggcccuggguuccauccguagcaccgaaagaggaggggaaagaugggguggagaggaggagacgagagccaggggaggauuaugcugaauaaacucuagagcccaucccaaugucacugagacccagaaagaaaaguggaucgaccagggucaugcagcugguuggcaugugacagaagagaaccagcacagagcauuuuauguggcuucugauuucucuaccuuuggaagcccuggcuuccuuguucacaggucaagaacacugagccaggaagcuuccgaauaacaaggacuugaagucugcauuuggggagaaguuagcacacacuucccacaucuuugugaaguuacccugucccuuuacagaguacaaagcacgccacgguugugucucucacgaagcuggcaggaacaguacagggugguggccaagacacuggucagacacacuugguccuuccaccacacggcagcuugcuuccaccacacggcagcuugccguaccucucugaguuucggcucguucgucugcagaacagaaacaucaguaucgacucuuagagucauugugaaggcuauaggcaaugcuacuacacaagugauguugucuggcaugugcugggcgcucucuaaaacugaguauuaugaucaaugacacauuuuuaaaaagucucucuauggcuuccccguuaucucaagcuaauaucuuacuagcugugagaucuuagcuggucuuccaagcaggugauagaugauauggaccaggucuuuccuacccucucgaagcucuuucucauccagaagcaugagacccuucaccucugguguucuaccuuucucaaggaugauaacauccugaacggauggauagaggcuguccgucagaagcagagucacagcggggagggagguaacucagcagguaaagcccugagaaggcaugggaaucugaguuuagccccagcauacacaugaaaaagcaaagcacaguacuugucaucccagggguggggaggcagagacaggcagguccuuggggcuugagggcagccagccuagcuucauuggcaagcaccaggucccagugagagacccugucccaaggaacaaggaucugcauagugccugagggacaccaucugaagcugaccucuggucuccaugcuuccacauacacauuuguaaaucccaucacccccaaccccccccuccgcaucgcacccccccccccaaauacacagaggauuaggaacucuaucccugaguuuccucgauuauuaacagacacaggaaagaaguagaauguugacuuuagcaaacacugccauucccaggagaugccgcuuuuuugaaggcauugcuguccuugggcucugauauucugcuuguaucaucacuaccuggacacuauguucuuuguacaucaauauacuaggcuuugcuugcugcuauuuccuauuauuguuugacugagcguaugaauaguugaguuucccauuucuguuuaggaacuaugauauacuugagaccagaacaauucaaaugaaccccaaaacaagaggccaaauuaauauaacucaaggguaagucccccucaccccucacuucaguggagaaauuguauuuccugguaggucuugacugcucugucucugggucucagcccucccucgauucugaaucuuacaucacuucguuucggcuaacguaaacacucaucacccugcaugcugcaggauucuucuccaccagcugagacugagccuccuuugcucaguccuuguggugaugaaugguugcagaaagaaguacggcaggaaguguccuugcacugauggaagaggugaggcggcuccacgugagauucugcaaagagauuaagauuuggcaccgggcuggguuucuaugcagccucuuaggcagagagccccaggagagggaagcagagugucagcugggguuugcacacucccagccagccuugaagggugguugguucuuuccuuucucucucucucucucucucucucucucucucucccugucuuucuuucucugggguacccagauuugccuuauuaaaggaugaaucuggaugcuggagcuuuaaaggagaccagguaaguguucucauuaucugauguccccuaggauucuuaauggcuggaaucaggcugcuugcuccuucccuggugcaguuaguagccaaguagaauuccucugagacauuuugcugagaaaaccagcaaaguuucuuucaauguuauggaaguuucuagaguguuuuaacccauaaagcuucauuggagaggugcaaacuucuuuccaugaaaucgcagccaugagauugccacucucuuuucuuucuuucuuucuuucuuucuuucuuucuuucuuucuuucuuucuuucuuucuuucuuucuuucuuucuuccuuccuuccuuccuuccuuccuuccuuccuuccuuccuuccuuccuuucuuucuuuucucuuuucuuuuugucuauaggauuuugaaaaaaaagauucugagggcuugugagauguguauuauuuggaggguuuuauuuugcuuucaucgaugccugcaguguguucugugucauuuuguucaguggaaaugucuaauucauuaugugcucuagccaacuaguuuuugaauaagcugcuguuuuauguagacuugauuuugaauucucuccuggguguuuggcaacuaugauauuugugaagcauaaccugaagucugagcaguuuuaagaagaaaaaccccccacugacaagcuuuuugcaaacaccucugcuggcuugccucaucaaacugagcgacaggcuuuuggauguuccaagcagauuaugguuuuuuuuuucucaaacuuuuaguauaaauaucaauaguuuguggaaagaauggucugauugaucugaggaguuaaguuuuuuuuaccuauaugcauuaaaagcuuuauaaauuuucuuggugagauuagcucaauaacagaucuuuacaaggguaguuuuaaacucagccccagcuccauuccaaaugcuguuucuuuucuguuuuuuuuuuuaaaaaaucagaaguuaaaaauaacccuaguauaaaacuugaaaacuguuuuguuucucucuauuuggcuaauuucguugcaaagugcuguguguaaagaauuugaguuaugaagacuacucuuacaucggcucacaggagucuaucugcaaacguccauaacuuucugugagagcguauguuuuaugguuguuaggauuaaaauuaucaguuaagcacuccuuucugcagcccuagaagaaaggaaacaacccuaaggaaauaacucgagaaauuggguucauuuucugacacaagcuugugucuaaagucguguguaaaggggauauuuggcagcuugcagucuguugagugugcaggaugacaugauaggagcaaaugucugugguccagugucaggcagaaagagguaggcacucuuaaccauguuaauuuacugaaaauaaauagauguucucauuauauguagaggaucaauuauggcucugguugugggaggcugucugaacauccguuucuucuuauuguuuuuguuugaugaguucauguaaucccgcuuuucucacgagaacccaagaagccauguacucgcuugaauuuuacauuacuuaagcauuuuaaccauugugaguauuuuuauuuaauggagaggcugccagugauagugucgggaauuuggugggcugucugcagauuuacaucuucaucugagaagaagugaggacagcuuuaaucuuuggaggaaagaaaauuauuccaagaauuaaaacauggaaacuuaauugugauguguccagucuucuuuauuauuugagaaucuagucugaaaaugcuuuucauagcuaacaguuauaaagacaugcuuugagcguggaagcgagugguaaauccugauguugcuuuguucaccaucggacagauaacaucuuaagaaauaucuuuaguucucaauuauuuuuagaagacaaaaacaaagcauaaaugacccggaguguugcuacauucucauucuauccucucccuuagcucuccuuuuagaggaugggaaaguguccagguaaagacugaagaacaauugcccggaacauccaaggaugauagcucucgguuuucucuuuuccuccuuaauccuuucuugguaaagagucucuuuauuguuuuauuucuauugaaacaguaaggcaggcacuggaaugcaaaauaauacaaguaggaaacagggaaccgugaagagugucuuccaugggacagucuuugagagaguuuuuguaaagacauuaacaguacuuuugaaauggauuuguccuaccuuuaguuuauaucagcaacauggcagaguugcuuaaaauaucagcugccugguucuugucucaaauggaugggggaaaaaagauacauagguaggugauugauagauaaauuagguagguagguagguagauagauagauagaaagauagauagauagauaagguagguauguagauagauagauagauagauagauagauagauagauagauagauagauaagguaggcauguagauagguagauagauagauagauagauagauagauagacagacagacagacagacagacagaccuguuguccauagucuccaagagacugguagaacuugaguguccuagugagaccccgagacagaggaacaaagagaagucauuugaguuucucagaaauugaagacuuucuugaggcagaugacaaagaagcauaaagaaggcaaggucucaugaaauagauacuagagcaaugggugcacagcauuagacaaaugcuaacagaaaauauacaauaggcagaaagagucaaaaguuaaugaaaauauuccaguagggagggguuacgggccaccugaccaggauaaagagauugagcucgaaaccagaaucaggcuggcugaguuagaaaauuaggccaauuaguaauaaugaggguguuuacucacuuauagauuugcaaaacagcuccccaggcugaauuagggccaaugaucauuuccugugcuaaugcuuuuacagaacagaagcaagagcagcgucacggaaggugcagggugucuguguaugaaccacugugguuuaaggacaugcuggauggcggguuaacagcugaaugcucagcaagaacagaaagucaaaaaagugugugcauggugaaagacuaacuacaaaaccaucagcagauuucagugcaacuaagagguugccugccguacaccuaugggaagcagagaguaugaugacauuuggaaaucugauaggggucucugaugaagaacuagauuccuuuuucuaccuuuuguccaguaggaaaaucagcucuuugcucaggaucaucuuuguuccaagucucaugggaacccccuacgugucuuacuuuauugaacccuuuuaacucuggaaguaggauuauuagcuagaauaauugucauuuauagcugcagcucaaccugcagaggcuucacaagaaaggggcauuuugaaaagaaauaaacaauucagaugauaaaccugggaaauccaaguaggaagucccccacccccaaaacuaauuuaaggagcaucccuugagacauugauauuggagcagaacuaacacuuacgaggucuucuagaggaacugacgaguaggaaccagccccaguccucauggaaucuuuguagauacagaauacacauuggcggauguaaaaaggagccaggaggcaccacagaucuuugccccuuuucugcagacucugucaaaugaaugccaaucucaaaucuucuuuagaagcagagauaccagaucaaguugcagucaauguacagaauguucuagaccuagcugacagacuggauuugaauaaaucacaaggacaggcuggccuucauccaagaguuauaaaggaauuccagagugaauucaugggacuguugguaaaaagcaacugauuuuuaccuucacaauuccagcaaccccuucagccauaguugcugaguggaaaagugccuggcuccuuuucucuggacauaaauuagagcguguguguaaaauauacuagauggagucauauauuuuagauagcagugguuuuuaaauucccaagccccauauuucaccacauuggauaacuuugagaacauuucauucuugaaauugcugagcguuaccagccccuuacaaucacguagaauaagcuuauuauaauucaugugaacugaguagcagaagcacaaagaagugacuggccaguaguuggugcuuugagaaguuauucaucauucuagggcuacaaaggggagaggacugccguggucucagaaguggauguuccccgucaaguaaguuaugaaacggcacguggaagaguugaaagaucucagcauuugagcucuguguacucaggcccacggcuccaucagucccugcuuccacuugucccaggccgucuucuggucauuucuacucuaacuuaacucugcggcccaggcacucuguguucuuuuuuccuguauguggcucugauucucuacugccugugaccuguuguauauauagcaggaguauuuggggagggaccuauauggagucaguaaguuuaaauguugugcugggcaggacaaaaggcucagugcaggaugcugguugcagucaaaagcuaagaagaguaaacaggagcugugaccugcacucccaaaggucucucagucauuuaacggauuuuuuuugagcuggaaaaaaugcauugggguuauaaauaugaaugagagagccacucugagaaugggaaaugcauaaacaaucacaguagagcaagauaucucaacuucagcacaugugacauuuugaacaaaauaauuauguguugaaggggcaguccauuauaggauguauaacagcaucucuagccugcacuuacugcaugagaccagugucccccccucccccacccauagguuuaacaaccagaaaugucuccauuuucggguccccuacugggaaaaccaccccuagcugagaaccacuggaguacgccauguugguugcccauguugaaauguacaagcugugaggugcuucuaacccagcccaggcauagcuugucggaggaagucaggacauggaggacaccugcagggugagaagccuuagggcccuuuggaggaaaaagucagguaagcuuggagucuuagagagaaggaggaaguccugggccagccuggggcauuauuuuuagggaugguggacugagcuuuuugcgcccaaucuuaucuaucccaaguucacacucagagcgucuuugggagucgcacagguagacgaggagugaagugcuuuauuucugcuguucacgagugguuuagcagggaagaaaugacaguucaacucucuucuuacugaaguuccaauaauucugacuaaacuaacuacauguuuuuagcuaaaauguggacccuuaguuaacuaaaugcaguuagaccaagauucaaaaccuuguuaccaguaacuugucuuggcuuacuacaacuugggucccauugcugauaugcacacaucguuuuggcaauggccagucgaagcaccuuuucucucuccauugcucccauaacuggcuccuuuuagagcagugauucucaaccuuccugaugcuguaacccuuuaauucuuguuguggugauccccucccccaaccauaaaacuauuuuuguuguuaccucauaacuguaauuuugcuacuguuaugaaccgugguggaaaugucugaucggcaggauggucuuaggugaccccuguagaagagucacagcucacagguugguagccacugccuuagagggugaucgguuuggauuucugcuggcagggccugugcgcacuugcugguucugccuggaagaucauggaacagugacugucccuucugggcaggugcaucuuguguuuacccagcaaucuucugugauccucccuaugggcuccuugguuacuucagugacuuuucaacucauggcaagaaauaguaaauggcauugggcacuugugguguuccagcagcggggauauauagaagagggagaagcaagaaaagaugggagaaaguggaucaagaaucccuaagaucauacuagcugauauauauuauaauaguguaagauacaauauaauauaauguuguaacauauaauauauuguauauuagauauuaugguauauuauacauauuguauaauauguauuauaauacauuuauguaaauacucucagaaaacuucugauccagcagcgacuccucacuuuaccaguaagaaccauguuagacaucaaguaacuaagauaugugugcaguuggaagcccagcaguguguuggacucuguagccuccuacuucuucuacuuacauagaagaaucacccaccaagaugaaugugucugcucuggcauuaggcgcggucaccggguauguugucagucuacaaagcaggucuggacuugggaaacuuccagaagaaaugaugaggaaauccucauguguucuggggggcuucaggugaggugguacaucuuuucuggugccauuacaucauggccuccuucucggcuugcuuugaggacccucauuccccauguccucagaguucuccaagcugaggaauccagggcagaguucuaaagcucagguuucuggguaccauugccuuucacuaacuggacgguuuugacgguguugcugacauaauugcaaaaugcuaaaccacucaugaacccuccuugaccuucacugcagguugcacugggugugaaauagcauaugggcuagaaaggcaugccgcagaggugugugauguacauuuggaaggagguuccaucucaucaacaggaaaacccugggaagcauguguuuguuaaagaguaacugacucugauugaauggauacaaucuucucaccaggcaagcugcuggaaacuauagugaaggguguuuuguggccuuuugaaugcuaguacuaugguugcuauauaaaagagcgucuuuuauaaggcuguggggagcagggcucaauuauagagaaccuaccuaugugcacaaggcacauugauaguuuuuuuuucccuaaccaccacaaaccauuaaagaaacaaaacauaauugaaaagaucuagccaauuaaccuucuuccuuugaugaugaaacaggggaucaaagauauugaugacugguucuuaugcaagcagagugaagcuaaggggguuugacaugccagugaaggcucacuugcacugcguauguuggaaaagaggcgcuccaacauacuuuuuccuuuagcucuuccagucacuuuggaucuagucuuccaggaaagcuuaucacauccuuagaggcuggaagggaaauuaaaaaaaaaaaaaaccugacaguguuguuucucagccuuaagugguugggagacagcaguggccaguuugagacagcagacagugguccuguguuaauguaaggacauaggucaguuuggagcagauggauuggccaggcauggcagagacuuaggagagcugcugcccaacagcuauucagcucucaccuggagacuuaggaggaaggcaacgcuaugcugccagcacauuaaacuugguugaaaguacaggaggagaguacagagcaaaagagaagacuugcuuggcgaucaccauguguuuuguuuugagccaagaucucauguagcccaagaugacugcaauccucuucaaacuacguagucaagugugguuuugauuccguacccucaaccucccaggugcuggaauuacagggcugugcugucgugcccggcuuuguuccuuuuaaauagaaagucauuguuguguagucuuucaagcguaaaaauacagaaaaaaaaaauggaguucuugugcccuuuacuuagcuucagcacuuaccaguguuagcuucuuguuucaucagccccucuacugagcaugucauuucugcuggagcaauuaaaacaaacuucagauuuuauauccuacuuuauauauacauccuggcuuggaauucuuaguacuccugccucaguuuugcgugucggugggauuacagugugcacugccacgcaugacuugaaauuaccuuucuucuauuucuucugucuuggcuucucagucaucauaguugaugcugcucaagguucuaaggagaaauuugaguacuaggcuaccuaagaaaauuauagaaccuacuacggcaaucacagcuauaauuccagcauuugggagguaaaggcagaacaucaggaguccagugccagcucuggcuguguagcaaguugaauuccgcccuggaccacaugagacuuuuccacaaacaaacaaacaaacaaacaaacacuccaauccuaaagacaacauugagucuccuuaucagcacugaguuaugguacagcauguacgaucccauaccuagccaucugagagaugcaggggaaguggaaaugucuuugcucguuccuggggaguuugucaugcaguuggaaggaacuaacagaaaggaacagcuucacaggagcggugcaggcgggaagucagguacagcucaagccccgcuuggcucaaagcccagcuuugacauuuaacagcugcaggguccugaacaagcugcucugcacugcugagccuuguuccucauuuuuaaaagagggagaaaaacucugcugucuucaggauucuaugaagaccaggaguguggcccugacauuggguacuggagcugacuggagccccaagagagcugcuuucuccugacagucuguacccaaagucaccagcaugacugagugcuaguucugggcucaucccguuggauacuuuggcucauuugaguugucuucucagcaacucuguuuuauauguccacacacuaaggcucagaggaccaguuugugcauuaugaccuaggcagugaguuaggaaucuagccuagguaggcugauucagaguugaaugcucacacuuuaaacuguuagacuguccugucucccaauagguuaauaaguuucaacuucuuuuuuaggauagucuuuguauccuuguaaauuguuaucugcuugguggaaucaucaggaaaauuaauaaaacauuugcagauaauaaaugaucaaaaguacuugguuuuaugguugucauaaauaauaaauuauaggaaugauuagacagucugcauacuuauuaaauugugcugagccaaauaaaaaucugacaagaauauggaaaauagugaaauuagcauacauucaagcuuuuauggugagggagggaggguaggacccagugguucccccauaaagagagcuaaagucauucccuugggagguuggggagggguuccacacuagaccuccugaugagccacuuaacauggugaguauuugaguggucacaaagaaaauguauauguccccaaccacucuaaguagccuacguaagaaguuauaaaaauguuguccugacccagguccacguacucaggguaagucucagcacagccucugugugcuucugccgucucagaugaggccuuugcaccucauuguugauucccagaaaaugggagcucauaaagggcauacauuucagguguguuuguucaaguucacaagacaaaguaagacccagaacaguaccaagagacgucaaaugcuggagugaccaaaucccgccucccucuuaugucugucaggauuacagccuuuccaaccccuaccuccuagagcagccacgauccugggggaaccgcuaaggcagcagggugggcaugauucaagggcgcuccuuccacaaauuaggaccccgaggaaugaaagaaaagaaccaagggggggaguugcacgugcucaucugguccagguaguuagguaguuacuucugcuaccuggauuuccuugagcaagaagcuugucuccaacgucuugaaccauuuggccugaggcgaugaagccuuuagugcuagggcuucuaacugcucuuuggacuauuucccuucuccaggagucaggugcuuagcgcuugggcuccugcaggcaggagagauguucaaggccacuaacaccuugucguguguuugugguauacguucuuuucucacaggcuccugggaaggcggguaugcgugaaaacggucuggggcaagguaaaugagucauuuaccuagcuagggaaagugugaaaugugucucaugaaaggcuucgccugugggauugggggcucagaagaaagcaacuggagauugugacuucaccauagugaccagaaaaagaaaauagcauguguaggaauaagugauuggcaaauacucagcccuaaauggacauucaaaucaccugcuccaaggcuuggggaaccuuguuaaagagagggcagaaacggcauuagaggaagagcagcguagaacacggucuuccaggcgugaccuguuggcucuuccacucucagacucagcaguggugacugauuaucuaucugcaugggaguaagaucucugggcaguuaauguuugcuggggaagggaggagcguuuucuccaguguuguagcugcugguaacuugcugugcuccuauaaauaaacccuaacucauacaucuguaagcaacuguagugaaacucacugggucacagaacaacaacaaaaauccaauaagaaaacagaagggggagugguuaggaagauaaaguugaucaaugcaaguggaagggagacaagagagggcaaugaaggcuaacuacggauaaauacauuauuauacguguaugaaaaugucauaaugaaacucaguauuuguauaauuaauauguguuaaugaaaagucaaaaccccuagaaaugagagaaaagaaugaaccccugauguuggggccccacagggagcuauuucugcaacguugucaggcucucagaacucgccauagaggagacagccugggaacauggccuugaccuggugaugaaauggggucugggacaaaugacacagaagaagcaucgccaggacucuguugcucacccacccugugcgagcagcucauggcucgcuggcguauuuuucucaugaaugaaacgaggacuccacaacagacuuuuugucuuucaguucugugggucucugaaauuauuuuuaaaguugagguggggggggggggcagagaaucaaguaacuacugagaccagauuucaguccuuauuagguuguagaaugggaacagagacagaaccugguauugagaaagaauucggagaaguauuugagaagagacagcuuugauauugaguaggaagaccuacaauucuagucagugccaagcccacgcuaacccacaaacaagaugugaaucacaggaggagucuagggaaggggagaaaaguucuuucaggagcuaaagggcauugaaaacaagcaccugaggccuccccugggaggggguagcuguuuggaaguguggugaugaugagucacugucacaggagaauaugccaaggugauggcgguguccaagagcugaaccccgugaaaguguaggccagggagaugaagcauggagguuguugcuaucuguucugggugggggcacuggaggaggcuggcucuccagcccagaaggccaacugagaaggcacuguguaaccuuuagccacugggaagaagugaugugugugcaugucuauguguaugucucugugugugcaaauguaugugugugugugugucuguguguguacaugucuuggugucuaucucucugugugugcaugucuguguguguugguuuaugacaguuaauguuuguauggagcacuugccuagaguuaccuuggcuaagagaaucacuuaggaggcuggaagagcgagacuucagaugaguaguggucccuaaaaacucccagaguggagaacagaaugggucuucucucuuguggcauggaacacgagccggaugcacagucaggcacuguuucccaagucacacagcagcaauaacagcaucuguuguuugccagacaucaggccaggcccauuaguugccuggucacagaucucauagaaacucaucaagacagaacuauauauuuauccccauuugcuguauauuccagggagccugacagcauugagacucaaaacuaguaguaaguugcaaagauaaagauuccuaccaaguuuuccaagaccucauucacaugacacaguaagaguccuuccccaguccacaguaggugcucuccuugccauacuuacaguaauucauuacuguaauacaguaaugcaguaauguggaacauagaaacuccaaauaccaugguuuugaaacauuuacuuuaguaaaaauaaaaaaugauauuucucuuaucuuuaauuugccuuucugguaacucaugaaaggguccacugugcuugccguugauucuccuaggggaauugucaagccccgcugugucccgugggaagacaaggugauccgacacacuuaagucaccuacccaaggucauacagcuuguuaguuagcagaagggccaaggccggaaugggagagccaguuugauccucucagcucuccagacugucccuacacugucacccugagccagaccccccagcuccuuuccauagugcagacaugagagcuuccuuuaucucaggggcuguccaggagaaagagaaaacgagacagagcuggccagaacacccacacucggagucuuuuucugcaccaaagcccuggaaucucuucugugaauaauggugaucuacucacacauacuuuaaaauagcuggcuuguuuagaaauuaaaaaaaaaaaaaaaccaaaacaaaacaaaaaggcaaaggagaaaaaacagcagaggggcagaugguaguuuuuagaugaguugucacuggagauuucuaaaagccaguauaaaaaccagcuaacaaacuucucaugucacccaagaucucccugcagugcgcuuacagcagccaggguguacaagugugcaccucuccccaucaaaccgcuuucuugagcauucuccucagugccuuguugcugccuaauaucauggacucggcgcuugcaucaucucuaccguaugaaaggcaaacugagacugaguaagguugugauacgguacaugggcuugaaccucagcugcacgggagugcugcuucucauuguggcugccuaacgugugguccaugccaagggcagaggcugcagccauucgaccaggcagccacuugacgaaacaggucuggauccagagaagacacuaggaggccccuugugagauccuuguuugagaugaacagcaacgguacuuuucuacucugcuaaucaagauuuaagaaauugacugaauugacccaaagucaagcauauuaucucuuccagggccauguccucucccccacguguacacacacacacacacacacacacacacacacacacacacauacacacacacacacacggggacacccacuaagacacacuauaccucacacaugcaaaacagcuaagaauaagaugaguucaaauaacucaagccaacaguugguugaaauuacagacuccaaggcuagugggcucagugccaugguauucugaucccaucucugccagcagacugguaucuccuuuuuaaaagagaagaggcauuuuguguucagcaauaguuacaggaggcuuuucagugucgauuccuuuuggcccucucuaaguaaaagugaagagcuagcuaaucucuuugccuuucuuaauguucuuaaugcauggccuuccuugaugggcugacaauugucauuugagagaauucguguaugauugcuuagccgccuuguguugcccguagcaacuaagauuuauuuuauaaacacacacacaacagccacucuacagcaggcacugcugcccgaaauaaugugcaaauagccucuagccuucuccucccaaccuucaggggagauugagaugagggguucugaguagcuuacaugaggccaccuagcuggccaguugaagcaacaggcuuaggauucagguagccugacucccauguguuccuaaagaguaguggagaguuucaauuucuucuaccguagaguucauugucucuaugcuggacuuuucucacacagacaccgagccugcaguucaugcauccugugaccuuggggauaagaaagaacccaaccaaaccacagcaagcuuugggaaaugagucagagcccauuucuguugaugauuuauuuuguaagggagauucauccaagugaaugaacacguggaccguggcugucuguagcuccuguuugcccaucugaugccaugaguuauuuugcuugauacucuaggacguuuccuuucaauacccgcaaauucauauauuagcauuuaugccuucagcccacuucugcaucugggguuguggacucaacugcacuucaccucuugugcauuugaccccuuaugcuaaaaauaagggugggaugaguguguggauuucgcauaggacagauggagguuuuacuuggaggaguguggcuuacgcuuuacaacagcugcacguauggagcaaaaucguuccagugaccuauuuucagaucuugacacauacauuuggcuaaaaauucagcaugcacuuucucaagaaggaagugaauauaaacaaccucauacauuaccccguacauuggaauccugcguuguuaaugguuucuuauugcccugccauauaguaugcuggccaggagacugaaagucccuuucuaggcuuuguggugauggggacugucggaggcgacagccuguguuccuuagacaucauccugcggacccucucauuuugccagaggcuucuaaggguucaguuccccagugucucucaaggcaguggugcugaggaugggaccugaagcgggucaccugauucaggccaacugagguggguaauguuuggugaacugcgggaugcugguguguggaggcucuccagcacuucucuugucuccuccagccucaucgacugcccagacaccagugcccugcuuuugaucucaccccauagaccucuguuaugagcuucaggcuuggauucccuugggaccucacuagugaaccuccgaacaguaugguaacugcuggucuccagguacacccacaaaacaauugcugaucacauuuuccuagugccguccccccuccccccaaccacugugguuaccuuaguucuucuaaaacaugcugcuguuaucuccacuguguucaucgaucgaucccagucaccuagaauaaucucuguugcuuggacggcacauagcaucuacugagugaacgaaagucucucauuuccugcugaauugaucaguucccuuccuuagccucauggucaaggcucuuuguuacuguguucuuucauaauuuguggcaguuuccagugauuuguuuuguuguuguuugcauacacacacacacacacacacacacacacacacacguguucuuggcuuguccucucguuugcagacuacuuuucuuuuccgaagcugcaucagaucagcagugcccccccccuuuuucauuuccuguccuuuauuucuucucucuccuauccucuuucccugcaccaccacccccguuuuuuuuuuuuuuuuccgagacaggguuucucuguguagcccuggcuguccuggaacucacucuguagaccaagcuggccucgaacucagaaauccgccugccucugccucccaagugcugggauuaaaggcgugcgacaugacugccuggccccugcacccucccuugcucccucuuccuuuccccuuuuuuccuccauucccuccuucccuccuuucuuccuucucucccucccucccuuccuuccucuuuccuuccuuccuuaaacaaaaccauaauguagaacuaguauucauacugagagaacuugauucugcacagaggagcacaugcuaugagcauuuggcuggggugguauuuuacacgguaccaguucaaguaggugcuugcaaugccgauuuuuucuguguugguaaagauggccccaccuugccuccuuuauuuagagcacaaaaauaaguggacuuguuaaagaaacagggauuaugaugacagguaagguuaaauaggaacauucuuucuccuugaaacacuuuugcuguauaggccaggguaacuuuaaauucaggaccuucaugccugauacaggcauguaucccaugcccauuuugagaugguaagaaugcuaaugucuucauuguuuauguugaugucuugaaccacccaaucuuugagccccagacaccaugaagauguuaggaggaagaaggagauguugcaugcuggucuuuuucaucucuuugaacugggcucucucuacuucuauuccuguuaaguggauuucauaugacagcucccuuagggaggaaaguucuauuuucuuuuuaaaaaucuacaaauuagcauuaaaauuacaaauacaaaagaagugcauuaaaaagucuauaaagcauuagucaaagaugcugguuggucacuuuccaggguagucauugucuguguguauaaugcuuucauggagcugcaagacauuccacagagugcuucaaccucuguagucgcugcugguaggacauccaugccaugccucccccuguugucgcugauagucuguucccagcucuugacuuagaguggauuuuugacuccuaucaucaugccugcccugauccccuacuugggcaccuaccugcuccucuucacucccauuacuaccagaucagugaugguggauggugggucuuccuuuucuagaccugagcugacaucacagagcacagggugcaguucccagucaccuauuagagggaaccccuuguauguauuagccuuuagagaaucaggcugccuuguuuuguauugccuuguaagaacagcuucauuuguugucucauuugaugguugcaguugaaaucuagaaaugucugggacauccguacccaaugggcucccagagucacaggcacgcagaaccugggucgcuugcuccuugucuugcggugguugccuucugcuuuugauuugagucucauggugugcuguuuugcuuugaauagguauaaacuucugcccccugagaaugagucaggaagaaaaaauaaaaaccuaacuucuccuuugagauuuguaacaaggugcugaaacuugacaaaaacucucuggguguuggugaaaagaacuuuggcuuacucuuggcucaaauuucugaguugaucucaacaaacaaaugguauuuguuaaauucaaugcauucccacagaugaaaguaaaugcauacgcuagggagaaagugugauuaaaaaaauaaacagauaaaauuugagaaaucggcuacuugaaugaacagaaaauagacuguguuuaaaagaaagacauuuuaaaugaaagccucugccuucgugaccggcacacccugccaucuuaaggacacgcuagucuuguuucucuuugccaaaaaucacaagaccuuccacucuuguucucaugcucuauucagaaaguccugggauuuuuuuuuuccuugcuccuuugaugucccuuaguuugauacacugggcacugugggugccaugggcuuuuacguuggaacagaacucgaguugggggaccuuucacauagacuuuaagguucuguagaaucuguuggaaaguccuaagugccuuugagaauuaagucaggagaagauggcucaguggaugaaagcugcugcuguguaagcuggagaacuucacuucaaauguccuugaaaauggugcaucucacugugaccuggucauggagaggaaucucacacagagucaagugaaguuuugagagcuucuagggacauggagaaaagccgauuagcacauuguauggaaaaagcaaaacauaaguuuaauauaucaccaccacuguguacaaaugcaggguuggagauauuagcugguaucuuuuaaauuuuauuuuauuuuuaauuuauuuuuuguacuccauauuccauucccugccccccccuccauccaucuucugucugcuccacaucacaccccuccucccuagcccaucccaucuccacguggaugcccccccucaccuggucucuaaacucccuggggccuccagcaucuugaggguuaggugcaucaucucugaaugaacacagacccagaaguccucuacuguauguguguuggaagccucauaugagcugguguauauuagcugguaucuuuuacccaucuuuauuuuuuuuacuuuucuguaaggauugugaauugugaucauuagauaagggguguauugaaagcagaaguaucaucuuugcugguaauuuucaguuccuuuuuucaugcugccucuggcccuugacacuucucuagcaacagugcuuuucaaccuugguuagcugagggagcaccuuuaugcagguugcuuagccucuuaugcaguguauacacagcuuagccucugugucaugagaugcccgugacuuguccucaaucgugacaacccaaaauuccuccacacagcacuaguguccucugagguaauccuuuguuugugaacuacuauucugcaaucauguacugaugaauuucaaagugcucaacucugggaccccccccccccccgacccaguaagguagcagggacuguuguuugcacaauaaugaaguccacgaaaaucuguauucacucacuugcccauaaaacacuuccucaccagagaaguguugguucugagguggcuguagguagugcuagcccuucccucugcagggugggaugcucuaggaggaauucaacugcuuauaagcaaaagucugaggcacuagcaggucuguucauaacaaggagguggaugcugaauucccagccugagaggagaaugaaagcagaagggccauugacuagacacgguggagccugaaccagagaacuaaagcuccuuacauuccugcugucggggagcaggcuuguccucagagccgggggcagcucucagcguguggguggaagaagcaggaccucaggugaggagaucggugaguggguagguggaaagcacuugcaaugccucaugggagcuugaauuaagauggagacauauauaccugguguggaagugaagacagaaagagagaggacguuccucuaggagagaucugaagaagugagugguacuuucaaaaugaucagugggggggaaaggcuucaagcacuugauaguuccugaaugacguauuugugaucggcaguguuuauagaggcuugugauugucaguugcuuuuaugacacgauuaccgauacuaucucugauuuauaugguuccucauccaggaacaagacucuaauccugagaaaaauuuuuucuuaugggaaaauauaucuuguuuuauugcaguguccuuuaugauaaacuuucuagaaauuaauguguggaaaaagacucccucugcuauuggaguuugcuuucucuacguauggguuuucaagcccuugucuuccuccacagccaaugguuaauuuauuuucagccucugcuagauauaauaaagcuugaaauguuuuuuuuucaaaauaauguguaggguacaagaaauauaaauagaggauuaucaagauaaugguucauucauauaauauauaguuuauaaaauaaauuauuacauguauuuuaugaaguaaauuauucgguuagguugaaugauauaaaauuuccauuuuauaugucaaaccaggcaaguagcagcaauuucacauggcccagccaaauacuaauguuggcuauaaagaaaauuuuugugaagugaauauucuauuuuuuuuuuuauugcuuuaauuuuuuuucagaaguuccuuucccugaagacagagucgaaaacuuuggcugugcaucauguugggcauggcuggaauucaacacauuauuuuugcuuagaaucuuguuuccauuggaacaagaguucucaacccuggcugcucggagaaucccuggggaacauucagaauacugauccuacccuaggcugauaagucagcccucugggguugcuaugugguggggcaggacucagcccuguccggcuuugcucuugaagguggcacaauggugcagccagccuugagaacugcuguaccagggcccugcuucuacacuccuucucuauaccaccuuacccccugaccuauuucuccguuguacuuuguucuuaaaagacccaaagacaaaauauguaaaaucagcuuaacuuggucagcuccuguuuugguuuucauucaacagaauauugauugaguagcuauuaggagcuugaucccauggcucgauauuuuuggaaaauugugauagccuagagaaaaguuuggcucccuaaaaagccaggcgauuaggcaagauauccagagcaaaucuauagaggcucuguguugggauggugugaauggcugagggguggggaaauauggggugauugcaauggucuguauuauguggggaugguugcucaagucuuugaauauauuagauuccauugacuuguauacuuuaagugaguggauuguauggaauguuaauuauaucuuacgaauacuccuacuuuuuuaaagcccaaaacuaucuuuuuugggaagucuaaggaccaaauaagugacuuaggaacagcaaaggagaugcuguguguaguagcccauuccuuuagagaauggcggagcuuagagcacauagucacuaaagccaaaaaaauauacauccuacuuggagacaucuauuacugccaccuauauuucaaauagaugcugaguguucugagugauaggagguccuagaaggcauggagguucuaagugaggcaaggacaggaauuuucugggcacuuacugccuuaggcacuuuagcaaucuccauuacucauugcacagccaccuccauuauacuaaacugaagcgaaggcacccagaagggaccuggcucggagucaugguguaggcuaagugguggcacguggagcaccuaaagagaggggaggacucugauaggagugugaagaugagcauguugacaugacugcggacaaggaaguaugagcaugccagaggaacagacaguacaaaacagcaggcuuggcucaguuaauaguggaagauguggccacagggacacuaaggacagcuggaucaaagcagcgcaucagcgggccaugcacaguguucuuagugugcggacauguaaccuaccuaaacgaguguuugucugggucuguuucaguaucucaccugguauggguauaaucacaggaccugccaucuggcuccauggcauaaccucccgggggguggggggguggggacagccaccagacaggaagucccaguagccugaggcuguugcaaagucuccuuaggagaugccuuaugacucuccauuccuugugguggcaaagccccggcugagggcaacaucugaaaauaaggccaaaugcucagaacacuuaacguccagugagucuuguggggguggggagauggggagaagaaccucuuuccaccaccccaaagaggagcaaacagaguuuuccguuguucccuuccuucuauaugggauaccuacccuagaaaugggauaggggcgaggacagaggaguuuguguccaucuagagucccaggcugacggccugguuucugaucagcuccugaaugucagucgaggugguuuuuaaucccugugaacucaguccccuccacucucuuagcuugcucuaucacaagccaggucauucaugagauuuuuuuuuucccagccucucauccuguucugacuuucuguccuucucagaaggacagaaaagccucaauuccucauuuauagugcaggauuauugucuccacauccccuccacucucgacuccacagagaaucuauucuuuaccuauucaguuuccucuggacccaacccuggucaaucccauuauaccccaucucacuaguuuacccuuucagucacugcccuuccuccuagugaagucagccuguucugcucuuugaccugcucuaaaccucucccuucucacuuauuaucuccuguuuguuccucuuacccgccugccucaccaccuccggucaugaaagaggugugagucacagauuaaucagcgauguuuggauguuucuugaggcagggaugaagggcgauaauuaggaugauguccaacccccccccccccccacacacacacacaugccuucacccccagggagagcagcaggugucccugaagcacagcaaucuccuaugugcuuguccuuucuucuuccucuaccucugcuucccuccagacuggaaaaguuccuuucucugagucucuuacccaacacucaauagcccaccccuacccucuaccgccgacccuuaaccacucacauucaggggcucauuuagccucuuacuugcuugggucuuuauucuguucugggucugaaacagagauaauaacuacgaucauuuucacacggggauggcgagcuccgguugauuuuuagugugugaaaaggacacagagcaccggcagguaaagauugucagcuugacucuggaguuccgaggggugugcucaagcagacguguagaacaaguaacgguggagcuuguuggguaagcugguggagcuccuaauucagccagcuagagacagcuucuuccuuuuugccuaaaugagacugcguuugcauggcuuaaagugaugaacugaaaaagaacaauucggggagguggauaucaaaagaaagagcccuugagcucuccucagguucuccucauuuucucuuacucucuucucucucucucucucucucucucucucucucucucucucuccucuuacucucuagccuuuccucuuucucucucuuucccccuucccuccucuuggccauggcccgucucucucucucucucucucucucucucucucucucucucucucucucucuuuucuuuuaccuuuucucuuucccccugccuuucuacaauaaagcucuaaaaccauuaaaaagaacaaaagaaaaagaaaaaaaaaaaaaaagaaaagaaagagcccuugguaucaccccugcacagcuucccagagcuuguauuccagauguuugccucuauucccuauuuuguaacauguuaccuuuacucuugagacacaaaucagacacaaauaagggauggagauguguuuauuccuguauuuccugucuucauucuuucucucucucucccucucccucuuccucuccacacacacacauacacacaccuucccaaaugcccaaaucaagcucuuuugcuaacuacuacaugcccaugaugugaauggccaagcaggaaccaagguuggaguucuuguaguaagcguagagaacuuugaaagaagaaaguguauaaggguuauccucccugugaaacaaaagcugguucugcccuugggcuuuuagcgauggcuaaacccuccagcugaauuauauuugcuucugaaacaccaucaguuguuaacgcaaugcagcuucugaauuacugagauuuaggcagaaauguaacacaauaaaaagcagaacgaaaccaaacuacaaaacagccuguauuccgggcugagcacuguguggucauugcuucuuagccacucuacucagaguacgucucaguggcucuguacgucaccuggcucacccagcccaggcacucauaccaaagguuggcuggcucugcacugacugauugcucccuccccgccuuuggcaugcuggcuucgaccaguaaccacagccagauggcacaagccagcugaaauccaaggacuauuucaugaguuccaacuguaugcaauauaauaugcuguaucacuggaauggcgagggcauaaagaggagaaaguccuuggcuuacccacgaguagugauagcacugaguuggccguguuuaaaauucauccuauaaaauccuauaaaagcacacccgcauguucuccccuagaaccucucagaaaacaugacaacgcauaauuauuuagggcucccuugaagcaaaggacaauaguauuuuaauuuguugcgagaaauucaaagaaucuggagacaaagaaacucuuaaguccgcuuuguacacauucgaguuucacaacauuauuuuuuauaccaaacacugucgccugauucuuucaacaaaagaccucuuuguuuugauagcuaaggaaaaccuuaaacucacuaagacaacagagcaggcuuuuaaaauuauaaaauguaagagcuaaaauguuguauuuggggacuguuaaguuagaaaaauauuuaaguuuuguuaauuauuaaguaguuugauauauuuuuuuaaaaaguuccaguuaauuuuagggcuuuuuagggcauuuucuuuguacauguuaagucuaugggggucuuuggaggguggccauaucuuucucaucugacuaccucgugaggacagaugauucgagagauaauaacuuucucauacccuuacguccucucaaggccaaguauguugcuuuugaccuuuggccccucaguauaucaguccugagcccaugugcucacacgaacccuugcgcugagaaccucugugacagauaggguagaggcaugccucaaaggcacagucagaguccccaacgcauccucaccaacuacagcaucaucuuacugucccaaccaucaucaccauuauuauuauuguuguuguuguuguucuccaauacuuuccaaacuccuuggagauuucucuuuccacugcuaucuuccaaagguagaagagugcccauugcuuuucugguuuauaccuucaacuaaggggggcaggggagagaccugagucccuccacucccuguggggugucucuggaaguuuuuaaucacuguuagugcaaaugaggucauuucuagcuagagccugguaggcaauaggcacacuacauuuuguacuuucuuacugugugugugcgcgugcauucacguguguauguguguaugugugugugugguggugguggugguagugguguguauguacaaaacauauaaagaaacugucaaguuccaagaacucuuagcuccauuccaucagugccucaauagcagaaccugugucuugugugaguuuuucuguacccagcccugugcuggaagaugacgggagucuucuggcacgggagauaguuuagccuucaucuuacucaucugggaguuuguuuagauaauauuugccaaaaccugugcaaguccaaaacauaccuaguuucugaaaagaggagaauugugcacauauucucauucauugccagagcuaugaacaauuguuagcugcugggagagggaaagacagcuuugguaagaguguagcuuguggcaagucaacugugcucuagugaaaggccacucacccaagauuauuugggcagcacaaauuggccuugaagggugaaaggaagaaagaaagaaagaaagaaagaaagagagaggaagaaagaaagaaagaaagaaagagagaggaagaaagaaagaaagaaagaaagaaagaaagaaagaaagaaagaaagaaagaaagaaagaaagaaagacaggaagaagacaggaagacaggaagaaagacagacagacagacagacagaaagaaagaaagaaagagagagagagagagagagagagagagggagggaggagggagggagggagggaggaaagagagagggagggauggaaggacagaggaagggaggaaggaaggaaggaagcaagcauaugagguugaaugguuagaaaacagggcuggauacgggaaaaggugggacagaggugaguggaucaaaacauuuacaaaacucucauaacaccuuuuuuuuuuuuuuugguuuuuuucgagacaggguuucucuuuauagcucuggcuguccuggagcucacuuuguagaccaggcuggccucgaacucagaaauccaccugccucugccucccgagugcugggauuaaagguguacaccaccacgcccggccuucauaacaccuuuuucuuaaaauauuaaucucuuuugaaauaaaaugcauuuuuuuucugauaaaaagaaaauauuuaugagaaucagugguuuugacucaaacugcauccgcuugaagugcucagaagguuucaaccauauggagcuauuuuucauacacuauuuucucugguuaggacauuucugccucuccugacuuccucuggcuuuguuauuaccugcaaauugugcuaaaguguucccucuuagaagcagucuucacgguuggcuaugacucuccugcuucugaagcauggcgugugcacacaucggagaacauaucagaugucauacacuuuguaagcauccauaaacuucccaccuucccucaugcuaaguaauguucuugaagaucaaaaagaaagaaagaaagagagagagagagagaaggaaggaaggaaggaaggaaggaaggaaggaaagaaggaaagaaagaaagaaagaaagaaagaaagaaagaaagaaagaaagaaagaaagaaagaaaggagagagagagagagagagagagagagagagagagagagagagagagaaccuaaaugaccauuuuaucaggagcuccuggcaaguuguuagguacaaauaugcauccagcaaaccauuuuugaaugagagagugaacagaguccagacagggaaggcauucuuagccauagauuucuucuuuauccaugucugcacuagauaugguaagagauucuccagaaaaauccucuagacaggaacucuggucuagguguucgacuggggaguuguccccuguguacaagauccuaaaauauccucuagggacaaguuaugaucaucuuucucccuuuaagccuuugaauaaaauucucucucucucucucucucucucucucucucucucucucucucucucucucucucuuucccucucucucacacacacacacacacaccauuuaggcauuaauacuguuaugacuaucagauacagauaaaauuggagacaacuuauagcuaaucaaucucuuugaaucuuuacuuagaaugauccaaugaccaucuccauuaacgagacaccuuaccuguuucaacuagaugguggcauguaaggguccaguauggucagugugaugcaacagucacauuccuacuguccauccucaagccuccuuuuauuuugcuagcuaucuuugcuugucaaaacaauauguuuuaauagguucaccucaacuacaggcugucuuuaggcagaacgggauuaaaggcucuggagggacuaagacaaagcagaccacagcacuggcacacaaaaccuaaaagcagaccaacagacaggaugaaaaucuccaaaaucaaucuacagagccaagccagcuaauauucuucaaaguaucccaggcaucaauuguacaaaggccaaccucaccaaugaauggagccagagaaauaugauauggauaaaucuauguggauaaaaauggaacuucccuccuucuugccguaugcagaaaucaauaauauauauauauauacacacacacacacaaauaucuggggaccaugcaauuacuagaaaaaugaaggaaacacugagauaucccuuaugggcaaggauuuuaaauaugguguuaaaauaaaguugugggguaauaaaggcugcauggcaaaguaaacaaucagcagaaauuggccaggggaauggauuuucaaacuauuaaucuagcaaggaauuaauauuugaaauacauaagaaaccaaaaagccaauaacaaaauaauagucgcccaauuauggugggcaaaccacuagaauauacucuuuucaagauuuauuugauuuauuuauuuuguguauaugaaugcucuacccgcaugcacaucugcacguuagaagagggcgucagaucccauuacagaugcuugugagccacccugugguugcugggaauugaacucagaaacuuuggaagaguaaccagugcucuuaacugcugagccauaucuccagccccuaaaauagacuuuuuaaagaaagaaaaauauuuauuuugacucacaguccgaaaauccagugugucauguaucaugauggggaaaguguggcuuggugguuagguaggcugagccaucucuccagccccuagaacagacguuuuaaagagagaaaaaaaauauuuauuuugacucacaguuugaaaauccaguguguuaugauggggaaagcguagcauggugauggagaagugggcuguggugggaaaugcagccaggcaggaaggagcauggggcggcuuguucaggucuuggcgaaauagucagagacagcacuagaggcaagaucagguuauacaucuccaaacccuccacccccccacccccaccccccgaagugacccauuggcuccagcugaccucacccugcuucccaaaggcuccucagccucucaacagugcugccagcuggggagcaagggcuccgaaauaaugagaaugagcauuggugcggccauacuggaaaacagcguggcgacuucucggaauagcuaaucuuucaucugauucaguuauuccuacuuuuggauauacacugugaugauuuguacaugcuuggcccagggagaggccacacuauucaacaguguggcccuguuggaguacgugugucacuguggcuuucagacccuccuccuagcugccuggaagucagucuuccacuagcagccuucagaugaagauguagaacucucagcucugccugcaucaugccugcuuagaugcugcccugcuccugccuugaugauaauggacugaaccucugaaccuguaagccagccccaauuaaauguugucuuuuauaagacuugccuuggucacggugucuguucacagcaguaaucccuaacuaagacauacgcccaaaggaaauuaacagcauguuaaggagaaacccgcaaaaguguguuuaccaaggcauuaccuacaaaacauaagaugacgagcccaaggaaacauccauugauggauuuaugauuuaugauguuuauaagaaguuuaauaugcaccauccagccauaaccaagaauaagagccugccauuugcagcaagguggguugacuaggaaauaagcuaggcggagacagacaaaugucacaaguucacccucauuguagacauugaaccaauuggccugaaagaaaaggagagcaaugaagggaagaccaaagaagaaacucagcggagauggauaacagguuccaaaacacagcuuggaagaaggaagaagcucuguguacugacugaggcugagucaaaagacuuuuugcaguaaccuguuauguauuuugagacgaauuaggagagaggcacuccaaggccccaaaugccagugaucaggaacagccauucugguuacccugauuugauccuuaugugcuuuggacacauuacuggggucacguucugggacaucccccacacauguaaacuuauauuaauuucgagagaaaaaaaaauaaagcaaaugucacaauaaaaaagaagucgaguagagaaauggggcgugguccaaaggcagugaugcaggcagaggggcccucaggauugugaagacagagccaauauugguucuucccagcuggcaagauggaggaggaugugaaauggcucaagggcagcaaggaguaacacaugaaaggaguaacacacagagaguacauagcccgguccuaggauuggcuuugauuccuucuuucuguucagagccugcagcaucccugagcagugggaugcccgggacuuucugucccucagagcaucccauguguacagacaagcaagcaugaagcucuggacucugagcuagggaacacgguuacagcguguuugugggacuuuguuuuuaucuugcaggggcuuuguccucauguguuucacuagaugacccacugcuccucagagcuacaagaagccuggcaggucaagccuuucagucccgucuguaaggccuaauucaccuccugacaucacaaaccuaacaacauaauucauuuguccuaauuugauuuuuuucuuguccagaggcuuucuuggcagcuagguuuucucaugaugacaugauucaucccugugguaauucccauuagaauaaguaucucaggcaugauucaucucagcagauauuaagcuggaaguuuccuuuauaaccgcccauuacauucacagccaugaguaacaucguucggcaagagauuccccacccucuagcugacacuuguuaguuuugcccaugcuggauuuaaacucagagcuuugaaggaugagcaaugaauaggauuucagcagcauccuuuugcaaggauuaucugaggagcacaaucuauaagaguuuccuucauguccaugguuguagaucugaagugcugguaggggucagaauucuguggagagcugguuaacacagacugcuguauuuuugucucagaguuuuguuuuguuuuuaaauaugguuauguuaauuaaucgauugauaacuuuauccaugcauucaauauauuuugaacauauucacacacacacacacacacacacacacacucacacauauguacguauauauauauaugaguguguggggccauucaucggaaugugguuggccuacugguagccacaaccuuagagaaaauggacuccuccagcuaucaacuaucaacuucccaagcaggagaggggagucaggaaaggggagucacccguuagaguguugacugacuugaucaugugcaggucuuguguagcacaguggaugugaauucaugaauccagguccagaagacacugugucccuugcgugcuguccaaucuuugucacuucugagaugaucccugagcauugcagggaugaggcuauacagauguuccucccauuuguggcugcgcucucuggagauacuuauuuucugccccuuuuugugaguuucugcauuaacugccauccacugcacucaugccuacugagauaugaauuuagagggcaguuugauacuaugucuauuuaacaaaaauaguaguaguggauucagcugugaggucuaugagggccucccuugcagguucuuggccagauuuucacuaccaggcauguguuuccuccuguggaagggaucugggguuuuugauucagcacaucugggauugcaguccugacaagucccaggcaauacugccacugauggucugcugcccuuauuuuugcgauccaaggcuacauaaggcuauaauuauuucuccauuguacccuguuucugcuauuuccggugugcuccugugcugggagcaagggguucaauaagcaauggugccaacagcuugguaaagaagcaaccagugacuucuguggcuuguaggaagcaucacuauaagguuuugcuuugagugugguuguagcaccagaaagaaaaugcuugccuugcugaugaccagaugaaggaagcaguguggaccggaaggaauucuggggaaaggguauuuguugcugugaaauucccagauugucaccaaugggacguccucuuacagucccgagaagcuucccaugguaaggaagcuucgguuugcuuccuguaggagucggugcaacaacuccagcgaacuggcauggugcuugcaaagcuuuuauuuuuggcucuuuggaauuguguuuggucagugucuugugcuugguugaaauacucucaggagaauggaauucuccacacagacucuggaauggaauguggaaucaagaacagaggaaacacagacugcugccaaaauguggcucccuguccucuucguuaggucugaagccacugcagucgccaccccuccuguuuuucuuugccccuaggcaauuugauagucuuuuaaaucguugccuuugguugacauaugaaaacuccaugagaaauugucuucaaccuuugagaauucucuagaaccuucuagaacacugcuuuuagauuccagccaucgagagaagccaauaaaagggaauuccaaaccaauucacucuaugcaucuuuuauuauauucuggaagggagauuccccaucuuauuauuuaccuauuacuuaugauuaacagagcucaauagcucuugauuauuuguuuuucuagcccaggauacucuaaaaagcauuagcauaggggaggacagggugcuguuagaaguagauguacugucacuguugaugugaucgccgacauugaccaucacugauaggaaggagggagcauaagagucgaucugaauuagagaagaaugaucaucaaaauaagcaaaauugguccgagagauggcucaaugguuaagagugcuggcugcucuuccagggaccuggguuugguuccuagcacucauauagugacgcacuaucaucuguaacuccaguuccagggauucuaaugccuccaugggcaucugcagguucugcaugcaugugacacacaggcaaacaaacaccuauauguguaaaaaucaaucacucuuuaaggccaauuaauacgcuccugcccaggcucagcugaguguauggcugagaacagaaacucuuaaaggacuuuggugacagucuaggcugcccaucuugugucaacagaaagcauauugagccagguaugaccacacaagcuuuuaaucucaacaccgggggucucuguggguuccggucuacauagcagguuucaagucagccagguuugccuagugagacccugucuugagaguggaagagauagagagugaauggucucuacgauggucuuuuuuugaauaacuaaucucagucauucauuauaaagucuauaagucuaacaauguuuauuggauuaacuugauuuaggaaaggcaauucauaaauccauaugcuggguuuaaugaggcucuuugauccuuccaaauaaucauuuuaugaaaauuuauaauuaaaaauggguaagauuaguauucuuuacucugcaucaaucaacauacaguggaauaguacuuaaaacuaugaaugcauuucucaggacuggccacaauuuguuaguaacaaugacagucuuauuuggcaauagcuguucugaauacuuugugaggaccugauguaauuuaaugugauuuuuacaucuaaugugcgucaaauagaguugauagugucaucugugguucagaugaauccaguggauccaugaccccaaaaguugagagauucucaggaaguuuguguugaagauguauuagagagacucauucaugaaucaggagguguuuauugagauaacaccaaccacugcucuggacguauaucgaggaaaaacaaaguccccaugagcugagcuucuaguaggaguaaagagaggaggucucuucggagguuguuucuuucuggacagagcaugcuuuuccaucuauagcaaacugcuugguaauuagagcccugugcuaaaguuauaggauccugucaccaaauuuuaaccaugcgcaccuuauuucuaaaugguggucaugacagaaccucuuuaauuagcucuucuggggccuacauagaacucugucucaguacuuggcucauuuuguacacaccagaaauguugauguaauagcaagcauggugcagucaauggaccccuauguagacuaaguauacuuaguauaaguguucuuucuauuggaagauuucugaagguguguuggcaggaccuaaaacaucauuuucuauaacucugguuccagagagacagcucuggaaacaaaacuguauaaaguugacuccuuuuggccauuucuucaagugaagacaaagucccuucucucuguagagaggaacaagcuuucuuccugaguaaggucugcuaaugugguauguguggcugcauugugccucuuagagcucuucaguccuuggcuguguucccaucugcaucauggugccgucuuugccuucacucuacuuauuuuauucuguuuuggaucuagacuccgugccuugguauugguuucuucauggcauccccuaugcaagaauggcacuuagcaaauggcuuuaaaauauuaaggucauuuuguuccaaccaacccuggcagcacuugucacagugagaugaguguaauucuguggagagguucauuaaguggcugaaguguacucauacuuaauacagcauugaucuuauuauauaaaucuuaaaucucuaaaaguugacaauggcucaauacagacucuuagguuaguuucccauuuuguuuuuuguuuuuacuuacagaaaugucagcaaaaccuaaaagacauucaaaacacuccuugagaauauagaacacuaugcuuuuguuuucaggacuggaguuagaguacagggccuuuucaugcuaggcaguuguucuauaaugagcucuagcuccaacccaguccgcaauuuuaaaaaauauaauugaggugcugagcauggugguacacaucuuuaaucuuagcaguugggagacagagacagaugacaaacuuugugaguuugaggucagucuagucuacauagugaguucaauguguguguguuuauauguguguauauguucauauuugugagugcaggcucauacgugcaauaguguaugaguguggaggucagaggacaaccuuggaugguaguucuuuuuuuuuuuccccauaaucuaaacuaauuuacuagcucuacaucuuuuuuuuccuuuuuuaaaaaauuagguauuuauuucauuuacauuuccaaugcuacuccaaaagucucccacccacccacucccacuuccuggcccugguguuccccuguacugaggcaguucuuguucuguacuuuguuuacugcugaugagggucuuuuguuguuugccacuguguacacaaagcgagucggccugugggcuucgaagacuuucccgugucugccucgacucuuaugcuaaggauuacaggcgugcaucugucucuguguggguucuuugaaugugaacucagaccaucaucaugccugucagcuaccaaguguuaaugaauuuauuugguuugcuugcuuccugucagcuucccuauugacacggcacuucuucguggauugccaguagucugacaaggcucguuacgugugcucaguaaacacaaauggauggucaaacaacugaaggaaggagcacauggcuauuuagcaagcucgguggcuauauugugacauguuuauuuuaucucaaaaauaauauugacccauguagggcaguagucugccuucuuuucagcacauucucuuaccacauuaaucacacaggauaaaguuuauaugcuuuuucacuuugugauuucaaaacuauaaauccccauauaaaggaaacacuuuuggucauccauuagucacaacuugacuauuuuaaaaguaauuuagcauaagaaggaaaaguaugaauaacaacaucaguguuaguauugcuaaaaccucuugccaaauaacaacaggaucuugaauccuacaacugagcugugugacuguauguggggcaauagauuaaagguagggaaaggaguaggauacuugugacucuuaugcuugcuuuagucauugauuaguuguauaagguuagcuauguuucucaucuguaaaauaaaaucaaucaaaucaaaguuaccauguggggucaacacggaugugcccaacaccucaccuguugccuguuguaguggcacagcagucauguacuugcuccaugacugugugaacuaucuggcuauuuuccuagucuagaucuacuaguaucuacguagccacguagauagucuaguaucuaugucuugaaugucuauggcgcaacugaauuggaaguggaggaacaaggaugguuucucugugaggcuagaucuccgcagaacaucagcugggaugagagaaacaagugagcuagagucuccuuugccagcuggcuaauggaggcuucuucacaugguagucguuguaaagccugaagcaacaagagagagcaaaccccguuacaaaaaauaguuuuguaagguucugcuugaguaaguucccaucacuugcaaauggcaaggcuagccaagguuagcaaggagagaaugaacagcaaguuuaauagcuaccacagucagcagccaccacuguccugucaccacuggcuaagugccaggugcucuuuuaauguguuaucuuuaucagagacuguaauucuagucucagcuuuaugaggcagauauucccgaguccaugcauugcagagagaguaacugagcguccgaaugcacagcagggaugcaucggaggaaaaucacacagcugggaagcagggcggagagcuaggagucaaagcaacgccccagagccuuuguaagcauugaguacugcuccacaaccccuuccuuuuuauaagggagugaucugguaagauguggugacuugguuuggcauggucccugauuauuaccacgucuacuaccauacuguccauagcucggcauuuuccuacuaaacauuuugaauuuguuuguugaauauugguaugccugaggcucauuaacucagauccucuuucugggcuuugguggugaggguaauagagaugguggcagguuagauguucauucuuagaacacuucacuuucuacguaaggugaggcacagccuucuuauucccuuuguauuuuuuaacuaaaauauaauuacaucauuucuccccuccaaucucuucuguguacugcuuuacuuccucucaaauuuauggacuguuagugugugugugugugugugagagagagagagagagagggagagggagagggagagggagagggagagggagagagagagguggggagagggagagggagggagagggaggagaggagaauuuauguaugcauacacauacaaacauaaauauguaaucacaaccugcugagcucauugugucauuuguguguauuugaucucaggacuggcuacuugguauuggagaacuaauuaagggucucagcccuggggaagacuaauccugcucacagcauucccugaugcccauaguucuuugucuaggggcucugcaagauuuucuacuugcacuuuaacauguccauugcuguugccguuguucagguccuguguagguagacauauuacugagauaucaugggugaagcuuccuuguuauuucuaggaaacacaaucucacagaaccacagacuccugguuuucugacuuuaaaaaaacaaaaaaacauaaucuuugcauucccuuuucuaagauguacccugagccuuugguguaggacuugugcuauagauguauccauuagggcuaagcaccccaugaugaacuguugccuacgcuuuguccagcuguguuuuucuauaaugagcucugucuguugcaaagagaagguucuucgaagagggaugugagcgacacccacucgugggucuaaugguaaguauuuaggauacauuuaggaugcucagguuuagcagaguggccacaauugguucuccucauagauccauaacuucagaagucccaugugcucaccuagguucuaguaucacgccuucuuucccuccuguugaggaagccugaagucuaauuagagagcuguugguuacugcuaagcuaugagugccacuguuguacucuuagggauauuuugucaugcuagucauuguaaguucauggacaucacagcaagauaagacuguuggugguuuuccucccuuggcagcuuguauaguguggggugaaacccuuuggcaguacaaacuggcuuucuccauauacacucguuuaacacagaaagaacacagaucggacauauuggaaaggcuccaugcauacuuauuguauaaaucuauacccucuccacaaaucacugaaagaaggggccacaccauauaugucaccaauaaugagauauuggacaaauaugauaacuaaagagagguagacuggugccgaccaguaaaacauguugcuccauaugacaguagagaaguccugccacgugauaauuuguggcaagcucagugcuaugagacuauucagguuugaggaaauguugcagcuucacauguacauauaaacuucacugauauugaaauacuguuugaugaagccaaucugaugccugaaucuggcucgaggcugucacauuaugaccuuccuauaguagguacuuauuggcacuuuccuauugcaugauaacuuuccugaaggcacgguaaaagaaaaucagagcagguggacauggaagugugggauaaugagaaaugaacuuaaaaagaguugugggaguggggagaguaugucagugauuccaccaggauugaggaauuggaaacagaagucuauuagcuaugaacaaauuguacuguaccaagcuucaccuguagguuaaguguuccuuagaaaacaauuauuggucaaauaacaugagaaacacucaaacaugcaauuaaccaaaacaaaauaaaugucuuuacaacauuacugguuguuuuuaauauucuguuggacugauuaaaucuccagauggggucuauuuacugugacuauguuucugugaccaagaugucuguaugucaugucauuccuucuauuuucuaaggguuugggaaaagcacauuggaaaagcuggagaaggacugaauaggccauuagauaucuaugaaaguauuauaauaaguauaguucauaaagccaugauuguggacacaguaagccuuuggggcagcuuggcaugaaaagaaaguaggcaaccuauuaguaacugggaacugucuguucaucuuuuuaaacaaaacuguuuuagccucauuccucuucugagaacaaacaaauaccaaguguaagggguugcaaccucuaacggguuggaacucuuugcuauaacaguuaaggcucucugugaucaggcugucuggccuuccucauugcaaauuaacaccucccccaucucugcucuguccauccugcucuguucgcuauugaccggacagaggcuccauuuuccagucucaucacuuggguucucuccggaauuaccuccuccacucauugcaauuuaagucacaacuguucuccaaggcuaaaguugagcccugcuuuuccuauggggccuuucuuaguucuccaaagggauuccugcccuugaacaucuggacuaucuauuccugaacuugugggggacuaacugugguguggauugucuguaugguuuaguacauaggacagggugacaauagagauuucccuccuucuuuaaggacaucgaugucuaagaaaagacagacauugagaagaaagucaugugcuaaguucugcauuugcccagauaggguuaggaugacauuguguagccacacauaaaacacaacaauaaaucaugcugaauaacguagacuugcucucuuguuaacaaucucucaucauuucuugaggaggagugcauucucucuuaaagaguuacccaacuguaaugggugcuauuucuuaacacaaagucagguaugccagaggaguuuccuuaguggaucccacgauaucccuaagaacugaguauuauuggccccucuuuacagaggaggauccuggcucaaaaccuucaaguaacuuacccuuguuguguucaugaccaguucucugaccagucaaagcagaaccagguauuuaucccacacacaugaccucagaaucuggaugcaaucucaacacaccauucacuuggaugcacuggucuacagaacucuaaugacagagauuaaaacuaagcauucuuauucaaacuccaagugacagggauguaucagcgugcagaggaaaggagaguagaaaucuauguuuuucuaauuugaaugcuguggggcuuugguuuuaccacaggguuucauaaggaccuaauacuggggccucuuaagagccacaguuaaagguaaaauuuggagcguacagcacaaugaagagacauccauugccacaagagcauugcaggacucugaucucuguaagauguuugauuuccccagaccugacacaguaacugcgaauaaagcaaagcaagcuguucaaggugucaugaugaauucacugucaaguagcgucccuuccuuccuucuuuacaaagcuacaggugucccuuggugugacauuuuuuccauguuguucacauacgaucucaaagacucuaaaaaacuccaggacaucucagacaaaccaacaguuccucccugcaagauuguugaacuccacaauagccaggccucuucuuccaagcaauguggagauaacuacagugcaagcagaauguuguacccuuugcaucugcccauauguuucugacacagugaaucacacugaguccaugcauguugugucuguguccaugcauguugaaggacuacauuagaauaggcagaagacauguuugggaaucuguuccaaucagagcauacuugguguucaaguauaaguguucaagggagaaggauucaagaaaaugucagaacuggaauacugggcagggacuaacucuuuaaauguggagaagagggaggaagaagagaauaaaauggucaaaggcucagaugcuaccugauagacaggaaguggauauccauaagggaagccuuccccgcaccccuuucaucuuugccuuacuuuguucauggaacaagaauucccuauggaggucagauugaggcagagauggaaacaggcagacuuggucagucauguaggagagcccaaaaggaugagagaaagguuuguccuuguggcucuacaggagagcaaugcucuccuguggaggaggagaaauuugagcugaauguauuuuugguuggugcaacucuaagugcucuguuugauagcagaguuguuugaauggccuauuucauaacuacacagagcuucuccaaauaaauggugucuguggaauguucagguuaaugcaugagcgcagagcucaaagguguuugugcuuagaccgacugagccuucuuucuuaauaagucaucuuggcaucuugucaacaaguuaauuugcuuuucuaagaaacuagauuaauacuuccugugcuuugugcuauucacagaucuacagugccgugagaagaggggaagaaauagaagauacgguuggaucucuucuccauugcuccacacagcucccaaacucugagacagcccauggaaggauugaagauggucccugcuuaaagcaguguguacgagacacugaaugugaauuccgugcuacccuccaaaggacauccauagcucaguacaucaccgguucucuucuagaggcaacuacaucuuuaggagcaagaaguggccuucucaguuccuucggaggauccacuggacgaauaaugcugaaagguaauguuuggaauuucauuuucaacuuuucauauuugccuuuagagaauagucuaugaucauaauccaauaugcaacugcugguggaaaauugucauaaacucuaagaagaugaaagaagaugaagcaaaaguaacuguuuuaaguacauagaauaauuaaguuccuuaaaacuuaaaugaguauuaauauuuuaaaguucaucuuuuuuccaaaaauaaguagauggcuaaaauuuuaccuuugcuuuauuuuuuauuuuuauuuugcaugugaggguaggugaaugagugcauguguguuacaauugugugucuagagcucagagaacaaccugucagacuuugaucugucuuuccaucacauggauuccagugauuggacucagguguucaggcuuuguggcaucuuuccuaaagaaccaucucauucaucuuuaaaauuuaaacacacacacacacacacacacacacacacacacacacacacacacacacacacauacacacacacacauacacacacacacauacacacacacacaaacacacacacaaacacacacacauacacacacacacaaacacacacacacagaggguaguuucuucucgcaauaauccaugagagaugucaauuagagugacaagauguuaucaaguaaauaugaucuuaugacugcauugaaaaucagcagcgcuuggcaacagagugaaaccuagauauuccuuacauacaaaaccaauagguuucugaugauaagaaaagaaaagaaucacucuucaaugugucccacuguaaaagcccagaaaggcagggguagcucagagaaauggaggccaguggaaaacggugcugaagcauccagacuucccugugacuucacacgauacacaggcaggccagucagaagugucagugcacuagagaaccucggagacuugcucacuacacagcugucacaaacugcuuggcaaccuucccuggcaggaagcucccaaccagacagggaccaugcaagguuguguuucacugccugggggcugcccgagagcuccaucugacauccggcugcucugucacagagagugacgaugucccucuaccacaagcccucagaccagggcuagccgccggcuagugagugaccuugcuccuugaucuucagccuggcguguccuucccucacguucacccuuggcaugucuaauagaaauaguacuuccuccugguauaccauauugaguguuacguuggaugguuuucugcuaucaccuuaacuugugggggauuggcuuuaaagcacaccauacaggaauaggaaucugaaacaguaauauggaggaaguuggugcuagcgauacaucgccacccucauggaacauacacugucuacaguaaccaccaccacaggguuaaagguuucucugcucugaugggcccccagacacuagcaagucaacauuuuccauggugcucuucucaagacauuaagccgagauuagcauguggaauuggcaugguuucaaugcguuugacugcgcggcagucaaacaucaucacgugagcucaccaucccaaacuuuccacauacuguacacccuguagacugaagauguuauggaagaucccccugaaguguugccagucaucuugcuugcuguuauguauauuuacaaggaggcaagacuuguaugcaugaaauagcuagagacuaauacauaauuguggcgaguauuauauaaggaauguaaaagacucuaaaguguucaaagggaggagauggaguuacaucagacaaaugaaucagccugaaauaaaagaagucaguuaagcuauuuucuuucgacuucuagaauaucuaggguuccaacuaggagcgcaaacagugccccuuagaccugugaaaguaaaaacuggccagcaugacugcugccgugauaguaacuugaucuugauugcuguuguacuuccuuggucagaauagcgucucaugagcuaugcuagcccauuagcuaacguaagagcuuucaguugcucucuuaagcaagagguggaguuuaauuuucuguuuauagcuucuuaaugguuccuaauaacugucagacuucuaaauacuaccguaggcugguugaccuuuuuucccuccucuggccuuauuucuguuguuucuaguuugcuaucuuguaggcugauuucagcuucagggcccucuuccaugcaguuugcaacauuucaaagugccuuuguuaaauauauguuucuucgauaggcaguagugggaaauaugcauaaaaacaaguuaguuucuuaucacauacacacacacauauaccaauaagccacucuaugguguauguguaugucaaagcauuauauuguacaacagcaaaugcaugugauuuucauuaauuuaaauuuccaaaggaaggccagcuuguucuacaaaaagaguuccaggccagucauggcuacauugugaggacccugucucacaaacuauauuuaguuuaguuuaaaaaauaauauuuaaagaggaaaacacaaacacacaaagcuucaaaagcacaagguaggggcuggcgagaugacucagugguuaagagcgucgacugcucuuccgaaggucccaaguucaaaucccagcaaccacaugguggcucacaaccaucuguaaugaaaucugauauccucuucuggaguauaugaggacagcuacaguguacuuacauauaauaaauaaauaaauaaaucuuaaaaaaaaaaaaaaagcacaagguauugucagaauaugccgaauccuaaucuuguguaguaggucuggaaccacgagugauucagugaauauggaggcggugccugagggcucugcuucaguuggcccccucuauuauuguucaguaugugcccuguggcacggauuuggucagcagcuuccaaguuuaaaaugcuaaugaaagauugaucauaaaguucaagggauauggcacugaggaggcugaggcaccaagauauuuaguuugagaccagccuccgcuccauacaagacccuguguaaagaaaaccaggaagcagaagaaacugguaaagaaggcacaagacacacucagucuccagcuuucaagcagaccguguucuguaaggucauuucucaggagcugugcgagccuuuggacacucucucagagaagcagcacuaaguaugaguuaguuccuagacuuuaguucucagaaucccuucagucuuugcacagcagaaaucuacacacucgaacgugggauguugaaaguugauccagcgggguguugggugggaaacaccagaaguggguuaaauggcauuuccugucaagaagaaauuauggucacuaaagaugaaugaagaguuaagacuuguacuggcuuuugggacucacuuucagccaguucugagauuuuacaugguggcagcucucguucuugguuauggucagcugaacuucgaugcucauaccuggguagaagaacugggaaaauuccccaguuacuuucaugaauggaacagagugagagagacggaaaagcacgggaucuuuucccuggagaaacuagggaaggaagagggucaaagaaugaccucuccaagggagaauucauguuugaagucugugaaaaugaaccggggggucgggggggggggagguggaaacaaaggaggagacagaaaauuccacuuguacaaggcacauggucuugguggcagaggcagaaaguagaacggcuauuauggaagccgagacaacggcggauguggaguuagugggcagacucaguuuuccaagaggacaguucuagaaauggguagugaaguggcugugugugauuguauuuaaugccugggaacacuacucaaaaacguuaggggagaaucgcuaauguuuuugauauuuuaccacaauuuaagagagaaagugaggugggugcagggaaggcucaugcugugccggucuuucuucccaggcgugcaugagcuaacgaagaucuguagaacccacuuccuagaaguggcuuggguuacaaauggggauuggagcaaccugaaggaaaaaaauugggguaaaugcugucuagcagcucaucaucaccaugcccacgucaggaggugcucacacagggcucuguagacuuccagcuucgccguagcuuaugggauggucugaagauggccaacaaccagacuauaaucaaagcuggcuuaaaaaaaaaaagguuccgaaacucagagauauuaacaaucuauuuguuuaugcauacacauguaugugcagaggcugaaggaaagugccaggucuccgguugcucucugccuauuucacugaggcacagucuuccccuuucauguuuugggccaggcuggaagccagaaggucacagcaauacuugugucuccauacuucagagccugggugauagguguguuuuuuguuuuauuuuguuuuuugagauuuuuaucaaugguuauuuuuuauuagauguuuucuuuauuuacauuucaaauguuaucccuuuuccugcuuuucccuccaaccccccaucccauucucccuccccccgcucaccaaaccacccacucccacuucccuguccuggcauucccuuacacuggggcaucaagccuucacaagaccaagggccucuccucucauugauguccaacaaggccaucuucugcuacauaugcagcuggagucaugggucccuccauguguacucuuugcuuggugguuuaguccccaggauacugccccaccuggggauccaucccauauacaguuaaaaaaaauccagacacuacuguggaugccaagaaguacuugcugacaggagccugauauaacuuucuccugagaggcuaugccagugccugacaaauauagaaguagaugcucuuagucaaccauuggacugagcacaggguucccaauggaggagcuagagaaggacucagggagcugaaggaguuuucagcaccauaggauaggcguguucuugaugccaaguuugcugcacgggagcugggaucugaacuccaauccucucgauuuugcaaugugacaguuaguuuuaaugucaacuugguacaugcuuagagugacaugggaagagaaaaccucaauugagggcauuuucuugauuuuuguuugauaugggagggcucaguccacugugggugguaccaccccuaggaauaugguccuggaucguagaagaaagcagguugagcaggccacagagagcaagccaggaaacaacauugcuccauggucucugcuuuaguuucuggcuccagguuccugccuuggcuuccuucagugcuagagugugauauggaaguguuaaguaaaauaagccauuugcucugcagguugcuugagaacaugguguuuuaccguaacagaaagcaaacuaaguuucaggguaaucgcucuuaauuuguugggcagucucuccgugcccucaagagacguguucugauacaaagcauugaucagccaggauauggccuuaauugcaagggugaguuguuucuagauggacaagggcagagccuaugcuuuaguagagagacuucuacuaguuugacccaguuaaucuuucucccuuccuguccguuugccacaccccucuuuccgcucuccucauuagaaucucuccccggguuaacacgguggaaauggcagucaaaagaaucuuuagcuucaauagacucacaaaauauccgagugcaauggcaucugcugguacaaaccuggaaccccagcccuugagaggcccaggcaggaggauggcaaguuggaagcuggccugggcaguauuaaaagaccugucucucccaaagcaaagacaaaauuaucuccaucagacaagauaaaaaaugaggagaaaaggguaaaguaauccauaggaguacucagugcugaaagaggaaaguaaaauaaagauguagugaagagaauuucucaaaccacgcaauugaauguucucacggguguacauggcacgcgcugauagaaugcacagugccacaaacacagcugucccuucuuacauuguuuguaagugacaagauuaaauaugacaguuaaccaguucaaaguguaguuacugacauguaaaguauguauugggaaggaaaagcuccacuguucauuuuuaauaaccuuguaugucugucuguacaucugugauuaacuauucaagguauagcuagacuauagcuagaacagugauauaaaaaagagagugugcuuuacagaucgaaucuuacuugaaaauagaggguguuuugcuucugauggaaaagucuaacacauuuucaaauuagauauauagcuuuuacugcaauaacuauauccuaucagguucuuuuucaagaguuaauagcucugaauauuaaaaccagaaaucauaguaggaaagcacacacauuugaagugcaugacuauagcucacaaauagcucuguuuauaacggcugucucacuugacuuccuccuaaucaaaacaguuagcccuugcaugccuaccaggcugagaagguaugcacauagcuccaauuccaggcuuuucuguuuguuuaaagaaacgaccugacuuauuaguuuugcuaucuugaaauuauuuguuggauaaaaauauaccuuaaugugaugcugaguauauuucuguagcaguuaauuaauuaagaaauauucguuagcgguccacuguggccuagaguggugucagcuaugggaagaaugcuaauacaugaggaagucugcaguuuguggaccaucguuucccauaccagagaaaauggaaugcuuggucuugggccagcugaaggagcccuuaccacccuaagugagaaagcacugggcuguugagcugaaguggggccaugcgucauagcgucaggaguuugaugggcacaugacaaaaugccucugcuguggggcccggguagucagguaucaugcaaagaauagaaucuacccccgggaaaccucagcaucuggccagcuagcugugauccaggaaugagcgugccagaagauggggccccuaaccugagggggcaguccgcucuucuucaucuucauuuugcccccagaaauugcuuuguggaaagaaaacauuccguccuguaucucagugagagcguugaugccgcgggaggaagggagggaggaugaaaggcagcaggucccauaacagaagguccuuugaauucuaagcagggaacccagaaaggugauuggugagaaccauagugccaaagcagcgcuggcgguuucaaauuaaaaugucaacucauccaccagagucaucccaaaugguacaccaagaucuaaucuaacagugacuggaugccaaggcucuccccgcaaaccucgcuaaauagugagagcagaaacaguucuaaaagacaaauuuucagggucgcuaauuaaaugcuaaaacaaacaaacaaacaaacaacaaaaaacacccagaauaaaggagaggcaaauguaaucagaaaaggaacaucacagcuggauuucaccgggggaaucaagaauugcuucugaacuacgagcuaaagagagagccuaagcacugagucugaagcuacaaagacucaauagguaaacaagacugacagcacaacuuaaaaugaucgggagaaugggucaaaucucccaucaaagcgguuauggccaagaaaggccguucaugugucaucuacauugauguacuauuuccgugugcacacacuacacuuggaaguuugaaaagaggccaaugugaagauguugaggcguucaagccccucauuuccaguaugcccguggccaguaguuauacggaagacccuuagggauucacagucaaaugaaaucaggagagaggaggcacacaggcucuguugaaaugagauaaugaugaacacuccaugaaggaguguuacuucgggcucucuugguccuguugggaauaccagucucugauuuauaugcuguugucgagguggcacugaacuugagccucacugucugggguuucagucucuacaucccugcucuuacuuagagcucuccuuuucugaacuucaauuucugcauugcucaaguggaaaccagaccaauaagccuaguuguuuucagggcugggugugaugauguauacaaggaacucaguaucugcuaaguugucaaucagucuugagacaguaacagucacugauggggauggggauacugcugccacucuuuauuaggguaccacaccugccaccccucuacuaaguccacuaacucuccugugagcucagucauagcaugcacagagaagaauaaugccuuccggguauuccuggcugugggcucuugaacuagcaacuuaaaggacaccgaagaggagguuguccaguggcuuccgacagccacuuguaacuacauuggaucguccuucguuuuccugcauuuagccauucauucauccauuuacuuaacguuuauugaacaacuucucugugccaaaacaacagcaguaagcaagauguggccuugacuuucaaggcaguggaggagaugaacgaaugagagcuaagccugcaucuuuagcacaguuagggguuguaucugaaagauguauagcaccuaggggcacggagaaaaguccaaaagcugugcugagugaaguguggggguucuaaaacuacuugagagccuaaagcaaugagaacaggauuuaacaaggggcgggggcaaccucugaccuacauuagggaagucuuuuuguuucuacuuaauucucugcugacuaucuguucccacaacaguagaaaauguacuauacacucacugcuggcauugggaacuaugcuggcuagguuuuaugucagcuugacacagguuagagucaucugggaagaaggaaccuccauugugaaauaguuuguccugugcauaauuaugucuuucuugauaggugauugauauggggaaucuaucccacauugagcagugccaaccauggguggaugguccuugaugguauaagaaagcaggcugagcacuugggaggaggaagccaguaagcaacauuguacuaaguuucugcaucaguuccugccuccagguucugccuugaauuccuacccugacuucccugagugauagaauaugaccugagagucauaaggcaaaauaaaucauuuccucccccaagaugcuuuguuauugugcuuuaguacaacaauagaaaccuucacuaagacagaaguggagcagagacugaaggaaaggccacccagagacugcuccaccuggagauccaucccauauacagucaccaaacucggacucuauuguggaugccaacacgugcuugcugacaggagccugagauagcugucuccugaaagacucugccagagccugagaaacacagagauggaugcuugcagccaaccguugcacugagcgcagggcaccccauggaggaaguggagaagggacugagggagcugaggggguuugcagccccauagggucaauagugucaaccugccagacccuccagagcucccagcgacugaaccaccaaccaaagaguacacauggagggacccaugcauggcucuggacacauauauggcagaagauggcuuuguuggacaucauugggaggaguggcucuuggguuugaguauguuugauaccccaguguagggggauuccagggcgggaagaugggaguggaugggaagagggaguggaggagcaugcucauagaggcagggcaaggggggaagggauggggguucggaggggagaucuggagaggggauaacauuugaaauguaaauagagaaaauauccaauaaaagaaaaaaaaagacagaagcugagucuagaauuugucauuggcacaaaauuuagccuucgaguuaaauuuguauuguauauuuuagugacaauaacuuacucauuacaguaaacauuaaaugaguuguuuggcuuuuacuacaugaaauuaauccuuuuuugaguuuucagauuguuuuaaaagauuagagcucacuuaaauaggguaugaaaauucuuguccgugggaauccuuauaaaacauaauggaauauguuuauaaucuguuuauaaugagucaguagcagauaauugggaaugagaaaguccucaagauagccugagucaugaaguuuaaacuucagucaaaguugagucuugaauaaauaaugaagaaaucaauaguacaguuaaauugagagugcuuuguuuuguuuaacugaauucuaccagaacauaucuaacuaugugcaugcaggaaagucuaaaauauuugccaacuaaaaauacauaccuacuauuuuaauuuucuuuuauuuaagucuucuuaacugugcauuuuuuucugacaauaaaugcuauuuaaaaaauguuuucuaugcacuaaucagcaagcaauuucauggaaacauaaacaaguuuacguuucaguauuucugaggcugucaguguguauauugugaauauuccccgaguuugcacucagucacacucuugauuaauaaauaaacaucuaaauuccaauuucaagcacauguucuugcagaugauuugggacaucgagagcaagggaguaugaaaacauuuuagagacuuuggaaacacaaguuccagacuauugacuucuaagcauauaacacgcauauucaacucaguuucccagccaguguguacaaagccaguauuugauccuaagucuggcugauucucaaauccauggucuuuaccucuaagauagggcuucuucaauuuuucccuccaugaccuauuuuugccugagaaauuuuauaaaacuguggauauauacauauacacacauauauuuauauauaccauacauauaugaaauauacaugcgaaauauaugguguacauauaguuuauauaugugguauaaucuuauacaauuacuaaugauaaagaauuuuuguuuuagaauaauuauuuuuaaauggugugauuauauguaugcuaagguaaaagccaauguguacacuaauaaaauugaauuauuuuuagauaaagaauuaaauauaggcuccguacuugauacuucaaacuacagagcaucuucaacaguauucuuaucugauuaguauuuugaguuuauaacuuaaugcugaaaauaaggugucacauuaaauauaugcuauacaauagcaggauauguuuaggacuaucugagaaauuguuggaaauucugucuuaacccucaaagcuaaauuuuaaaucaauuuuuuuaaaugaaaagaauaacugccugugauuccaacuauagaauaacugccugugacuccaacuaugcaggaaccaauaccugcugugcccuccucaggcacuacacacaauuacacacauggaggagagagaggggaagggggggcacuuuuaaaacguagagugccaggaacuggaaggauggcucagugguuaagagcacucacuucucuuccagaggacccagagaacaacaggaaacgagacuaagacaaucuuccagcccacacccacugguggcuuugaguccaucaguuuuauuuggaccagcccuaacugcaucagggaagcaaauuuauucuuaguaggucaaaucuagggccugcguguuuugcuuugacagcugcuauauuuucaaaacuggaaaacuuuuuuauuaacaaguagcuuucuaacucuucuggcaacccagugccauuaucccugcuuggccuggucagcaggugcuaacucauguacaaaacacaucagccucauuuucacaccugcugcugcucaauuucauaccugccuagcccugcagacagccacauuugucgagucuuacauuacgucgugguugucucuugugcuggggagugcuucaguuccaggauucaggaaguuagaccaggaguuggggcaaaaaggagacaaaccauacacaugggaaaguugucuugacacagguuugcacauacaggcucccuggagauccagaagaagaugugugagauugugaggggauaauguguacagaaccugaggaaguggcccagugucacagcgagagggaagagccauuuggcugacugaugaggcuacacagcaaagagugagaaaaaaaacuuggcccuaaugccuuagagagcccaugcagccuuuugcacauuggauuuuagggaaguccuaccaacagugaguggccugugaccuagagccugaguggcaaccccugugaggagaagcauuaccauugcaaucccaauuauuccugcauuaggauugggugugcucagaaggaagauguaagagucaaugugagcccucuuaguuugaguuggcguggagcagugguugcaaaaaaaggacuaguuuagaaaauucagcaccacugggggaaaaaugaaauauaaugaaaaauacagcugguuuaagaacggggcauuuuacuacaacauggcacucuugugaagaaaaaaaaauccgcaucugugccaauagcaucuacucugaguacaucugcgugcuucuagcuuaucugccucagcaaagcaucugggagcaaaaucuccuugggacugacauaaagcauagaucuugcccaaauguggaaaaccuuuagggacgcuaaaaccauuagggaucuguaacccugacuugaaccaagcagaauaaacaaaccccugcccaaauuggaauucgcuggaugccuugcagagcuauccaaggggaaaggcuggagccuccagggucuuugaguggguuaacaucuuguuucagucuuucggccugagucuguugagaauguguguuucacuccguccuuugaaauauuguaacauccuccuugccaacccauggauacuuggaacucugaaccaauaauauauacuuuuuucccccuuugugaaagugggguguuaaaacuagauuagaccuaguggaauugugauacaaauuccaagguuggaaaggcuccagagagcauucacauuuuccauggauggaguuuugcuacaaucccaaccucuauuucuauugucaagacccuuugucacuuuucccagguuuauagguuaguuuucuauaugcacagcggagagaaacuuuauguauaguuucuuuagaaucuguucaccccauuuuuaaaaagagaagaagagaaaacuggacaggcaguuuggagacuuguuucaucaauaaauagucacuuuccugccugcugugagcucuagacuguguuaagcacuguuugcgaaccuuagagggagcugguaaaaaugaaaauaauguccugauguuuaugacucaucaaaagguagagaugagacauuuaaauaggaaacagggcacagagcagcuccaaacugagcccucaauggcuacagacccagagcucacaggaacaugguuugaauuauucuagagcuacauucagcccuuauuuaacucugauuuaccugcaggagauggguguuacaauuaugggaaauaccuacaucuaucugcucagacucuuuuuagcuaaggaugaaacagaagagaaaaacauucuucucaacuccuggaacugguaauuuaguugacagaaaugacuacgugaacaagugacuauguuguugugugaugacaccaaagcaaagaucaguaguuaagaauguaggguuuagggggaaagaaaaaguaauaaaauacacaugacaugaauguagaggagggacuuuuggggcgagaggaagaggaccaauaagagagagcaggaggcaggagucaguggaggagcggaauuaauuagaacaaaguauaaugguauauauacaugauauauaugugccauaugugguauauauuauauaauuauauuauauuauauuauauuauauaauuauauauauauauauuaauguacuuaaguacaaugaucauauguaaauaugugaaaugucauaaugagaguuuuuacuuugugugcuaacuuuaaaaauaauuuaaaauuuaaaaacaaauauauuuguaagcauuuuuuuaaagugagauaugaugagacuuccaaguacauucauagagugaucugggaagaucacuuaaguccucucuuccugcauuuagaaauagcacaaggaaagcuuuagugguaggaugagucucaggaauggggauagcagggaaggaacauagagggcuuggggggaggucucuggaacagugguugggcacuaggccauggcaaaccucaggacagggauuuaagauagccacccuuccuggaucuuaccuucaggguccguuucucccauccauagcaggaccuuccacaauuccaagggguaucagccauggucagaacuuucccugcccuaggucucuccaucuucccagagaacucagggggugcaugucugugugauccugcucugacucagcccugaggacgauggcaauuuuaagggagaaauuccauuuccuauaaaacgaaagaacacuuggaaggcagggagaaugggaagaugggauaggagaagaccagugaaagggaagaaggaaaggggagagaccaugacacguagauucacugaagcagacauguuccagaaagcucagauuccagagaccaccuuaucaaaacccgacucacagacccagccuugugaguggagcucauuugucaaacuucagcucuucuccucccugcuucagacuguacguauauaagcugucugagaagaaucugccuaaguggcugccaugacugccuugucccuucuggaaccuacuaacuuaccccacagaggacucugggucuuuggucccuaugucugugucuauucugcucuacaguggggucuaauagugagcccagaaggugacaucaucaguuuguuguggugucuuaacccacuucacucgacucagcuuuugaaccuuucaucuaagcuaaucaagagcacagacucuuaaacccaaaucaaacaauauaccuaccauuuauugacuggggcaccaucugccauucacuguucucagugccuuacgaacaccaaccaucuuguaacuggaaaugcagucccagagcuggcaagucuuugacuucaccugaggcaucaagagucaggagaugccuuuuugauguuugcaauagaaucucucaaugauaauauugacuuguuuaugccacuucauugcacaacuguaaucuuuucucccuugccuguggcaccaaucccucagucucaguuucaugaucuacuuuaaaacauuucaaauucccugugcugaugaaguauuuggaguuacucuucaaugcccagggucuacagucagcaacuacgaaacacaauccaaguucuaguggauuauuaucgaauagagaaaucagagcugugagaugagucccuucagggcaaaagaucacaguaacuacauuguauugaucagcugucagaaaauauauaaucuccuggugacuuuuauguuuacaucucuaagcauaucuucgagccuuguuacucaguuacucucuucuccaaacugaauuguuccagcccacaaucugaaguccuauaaggcuuaguaggucccccuagacugugugugaucucucucucucucucucucucucucucucucucucaaaagggaaauccccauaaaagaagcaugugcccagugaauaacuuacacuucaguggaaugagggagccacauaacuaguguguauuaaugagcugcuucauccuuuuccgacucucaugugcuuacacaagugaauauuaacaugugcccagggucuagggucaccuggcugggguucacacggaagcaugcaacccuuccauuauuggccuggucgcugugcuauuucaguuauguucugugucauucucagaacaaccuagugaugugacugaaacuaaaacuuucacacuugaaguuggugucccuaaaacacuauuaaaagagccugaaaaaaaaggaaaaagaccugauaucuuugagcccuguuucucaaaguuauucucuucuugcuccaaacuggauuguuccagucuacaaucugaaggccuguaguuaggcuuaguagguuccccuauuuuagaugacugugcgugguauuucucacucucaauggcacuaauagaagguguggcccuguuggaguagguguguuacuguggguguggacuaucagacccacguccuaggugccuggaagucagucuucucuuagaggccagcagaugaagauguagaacucucagcuccugcaccaugccugccuggaugcugccauguucccgccuugaugauaauggacugaacuucugcaccuguaagccagccccaauuaaauguuauucuuauaagaguugccuuguuccuggugucuguucauagcagcaaaauccuaacugagacauaaguugcuaccagggacuaggguuuugcugugauaggccugaccaugcuuuuguuggaagaguaugcauuuugggacuuuggauuuggaaagcaguggaauucuuuaaauggggcuuaaugggcuauccuaguaaaaauauggaacacuauuacugagauuugaauugugcagaccuugccaagagguuucagugaagaagaauuucaguacaugaccuagagacuguuuuuguaguauuuuuggugaagaaugugucugcuuuuugcccuuaucuggagucuaccugacgcuaaggugaagagauucagauuaauugcauugacaaagaagucucaaaacucccaucauagacuuuguucucugguuaagucucaugaaagcauuuuaagcaaguguagcaagcugagaaaggaaaaauauaaaauauaugguuugaguauuaaaaggacauuaggaaguaaauuggagcugaauccuguguucuaggagauaacagauuaagggaaugguacuuuggggcaagauccuacccagcucaguuuagauccaggcauggugguacacaccuuuauucucaggagauaaagcuaagcagaucucugaguuuaaggccagccugagacagagcuaaauucuaggugaagaaaagcucaaauccagggauagugguauacaccuuuaaucccaggagauagacauguaagucucugaguuugaggucaauuuuuagagcaagaucuaggauaucccagcuuaggcagugaaggaauuggaaaacagaaagcuagugauaauguaauagaacaagggggccauguuccaccuucugcaagcagcagaacucagcagcuuuggccauguggcucuggcuuuagagugaaaaagagaagagacugcugggacaauuauacugauuaacuggagcuaagaaauuaguggaaaagaagaaaccagcaucacugagguaaaaucuucugggaaguguuuucugagaguacaaagaagcuaguuccagagauagccaaaauuauaccuuaugcugcagcuauacuugguaauguguuagagucacccaggugguacugguuuugaaggcaugaagaagucaugaagaacaucucaggcuuggcauggaaguccacuggugaaggugcagccucaguuguaguugauggcccagggcugaaggagucaugcaaaggaguugaggcuuggcuccaugaagagagccaaugagaggcuauugaugaagccuaguugucauggaaaccccauuguauuugagaugccaguaccauugggugaucaagaacagcagcaccaguggaucaacccgagcucagagcagagggcagagcuacagaacugauaucaacccuuuggaggagcccagaucauuugugcaucccagacauugaaacaagaagcuguaacacugaaauugccuuggagacaccacgauguucaagaugccagagccauggacuaucugcugaggaaagcugcuaacaggcaguggaaccagcccaggggaaagaaguuuguugcaucaacaaagaugacaaaggaguuggagaucugaaaaccacuuugacauuagacauugggaugcagaguuuggaguuugaccagcugguuuccugucuugcuuugaggauuacgguuaagugauugaaugaaucucagaagagacuuugaccuuuggacuuuuaacauuguugagacugcuauagacuauggggacuuuuaaaguugaacaaaauguauuuuuaauuauguuauguuuagguaugguucccauagacucauauguuugaacaagccuaugggggccagggaguggaaugucaugguuugcauaugcuuggcccagggaguggcacuauuuggagguguggccuuguuggaguaggugugccccuguuggaguaggugugucacugugggugggugugcuuuaagaccucauccuagcuaccuggaagccaaucuucucuuaaaggcuagcagccuucaggugaagauguagaccucuccacuccuccugcaccaugccuacuggaaugcugccauguucccgccuugaugauacuggacugaacuuugaaccuguaagccagccccaauuaaaugcuguucuuauaaggauugccuuggucguggugucuguucacagcaguaaaacucuaacuaugacagccguggaaagucuaagcuggcugagaagaaucccugauauaacugucauaacugucaugacccuuccagaaccuuuccauugaacccauggaggucuccaggucuuugaacccuugggcaguguguauuccacccuacauacacacacacaagauacaucgguagaugugaagagcucaagaauguugacauguaccauucuccuggugauauuuugcacucuaagcgaggagccacaagaaguuuccagauaaacaucucuacccaaagagcuugaugauagggcuaaagaacucggaaguggacaaacaggauuugaacuuggguccauccugucuuagagucuauacccaugagcacucuuuacuugacauggaaccuuaggaggauuccaguagauggaggcaucuguagcaaucagaggugccaggacucuugggcuuucagcccuggcuugcacagugagcaguggcugcuggccagcagggacucacagacaccagaugcuggcaacccggacuguccacauccagcuggaggagccaacacuguucuuguguguucugcuugagccccaaagaacaaagccaacagcugucuuuucagguccgauggcuguuuuauaccaaaucagaaaaaaacugaccccaggaaggaagugugaggccucucccagacuuguauaaaugguguuguuuucuuuacacaguccacugggcuggucuccagccuccuccugccuggcguugccaucagggacaucaucucacaggaccaaauggccuuucugagccacuacacuuugaucuagugaauuuauaauauuucccuuauucuuuuguagcauagaacaaucagcagcugauauaaacucaugcagguggaaguuaggggaaagcugaggccgccgaagagaaaggaccagcccuugagacuagagguuaauggauaaucacaaacauggcccaggaccuagaagaagaaauaagaaaugcgucugggccuuggagucugagaaaaugaagcuguuggauuuauuuuguaaaugaaaucuagauggaauuugauugccuuaacucugagaggcuggaauguccagauuuggucacaguaagaaguucaaaaucagaguuguauauuuguaagccauuuguuuagcugugaugguuacaacuuauggugagcccucuuaggaaaagacugugauaaaggaaggacuaaggacuacaaacucaggcugaggagcagcaagguggcccagaauuucguauuauggccauggaguaaguaagaagccacaguaauauaguggucugaccuagaacucaagcaaagcacaugauguuaagcaugaagcuguagagccccaagcuuccuccaugcaacaaccauaugaugaucugagugcguccagcuugagguucccaaauauaucaucggccacuuuuuuuuucgcuuuuucuuaauagccguucuuuuucuauuuaaguggaauuuagcuuugucaguaaaaagccuuugcuuaaaucaucaagcauaaucaugaacacacuggcugcauaauuuaaauauaaaauagucucugcccaugacuagcacauuuauauuaucuagguugaauucacauaguaugccuucuaguugcuuuguuaccauuucuguucagaaggaggaaugaauaaucuugaguuugcagauaaguuaaauucuggugcccaaauccugagaaaugguuaagagcacggacuuuggagccaccaacaucuagcuuagauuucagguucuucucacuaccuauggcuauuuggacaauuagcuggugcucucugacuuugcucagcuauaagauggaauguuacccucccuugguaagauuaagaugccuuaauuuuugcaaauaagaagcguagugcuuagcugagugggaggcuuucaaaugucagcaagagcuauguuaucagcgccauucuuucagccuucugggggaaagcaauaaugucucuagguccuuaugcauuuuucucauuaagugacauugacuuauuucugcaguggucuguuuguucuaagucagaaacaauaaucauaguuuaccuuuauucuguagagcgauuuuuaacugcuacucacugucacaggcugaaaauaugaguaugaucacaaugaugauaaagagggguuuuugcauuaauauaaauauguguguauuccuuuuucaaaacucaaauguuuucaaaauaucagauuguuugugacuugaagacaugguuacuguuacaucuaaauugguccucucuuuuuaucuaacaccaaggcuaaguuagagccaaaauuucaaauagaaaauaaacguucuucucugaucaaaauuaaacacauaguguugucagaucaaaauaagugcaaacuugagcaugaacuccaacccauuuaguaugcuuaucaguaaaauaauagacaaacccacauccuuccaauagccacagaggaagcaucugacaaacucuaacauccuuuccucguguguguguguguguguguguguguguguguguguguguguguguguguacaugcaugugcauacauggaaacaucuucaagcugguacaucuauauaaacugcucagcuaagucuaugcauagugauggaaaaugcccaaacagauagucccacucuaacguuguacuggagguucccauacagggaaacgacaugagacuaugagguagaaggaauccagacuggaaaagagaagugaaucuacuauauucagagaugccaugauuccauguuuagauagagucaugcaguacaccaaggcaguacuagaacagggaguucucagucuacaugggcauuuuuccucuuucacugugacauggaauauaauaaacacaagcagaaugcuugucacaggguuaugaaaaauauauguuaucaucuacaaacagcauggacuguuaaagagccuuuuaaaaauaaagauaagauuagguuuaggguuaaagaaaugcauaauguguggggauuuuuauguuagaaaaaaauuauguuuucauauccuaauuuuauagucucucucugucucuuucucucugucucugucucucagugugugugugugugugugugugugugugugugugugaaaagucacagcaaaaauauuaggagagagcuggaaagauaguucagugauuaagagcauugacuagucuuccagagguccugaguucaauucccagccaccacaugguggcucacaaccaucuauccguagugagaucugcugcccucuucugguaugucugaagauagcuacaguguacucauauacauaaaauaaauaaaucuuuaaaaaauauacauuaguagaaauuuuagugagugaaauauuggugauuuuaauucuguuccugauugucuuuaucuuuucuguagucaugcauuauuuugucagaaagcagggucaacagaauguuuccuagaauugaauauuguccaguaguuuuuucugaggguuuucugucuaguagacaauuucauuuaacuauguuuuaacuuuaauucuagagauuauuuuauuuauuuauuuauuuauuuauuuauuuaucuauuaucuuuuucaugugcacugguauuuuugccuacauguaugucuaugugaggaugucagauccccuggggcuggaguuacagaugguggggggaaccgaacuugagucuucuggaagagcugccaguacucccaaccgcuaagcuaucucugcagccccuagagauuauuuuaaguuaugauuuggaaguaauaaugcuucacucauuuuacgaauucaucuuugucaggggaggcugcaaacaagccagacaccuucuuuguuagaucgauuuuguuacucuaaaaccaauaacaagaaguaauggggaaaacucacaccaauuuacuaaccuucucuaagccugucacuucccuacagaagcaauuucuagcucugccugagaguugguguuuuuaagacaauuuuaacuuuuuucuaaaaagaaaucaauguccuucuuucugugccucauuuuauauaauuggaagugcgccauuagauacugcaacugagaaccugauauuuagcuuuuuaaaauaaaguaacuguuuaugaaauucacucaguuuuucagaguuaaaaauagagucuauacaagaagguuuuccugcuuucuuccauaagucaaauaacuacuuuucaaaaggaaaauuuagucaaucauuuaauguauuaguguuuugccagcccauauucucugcaccgugugugccuaguaccugggaaggucagaggaggguacuggauccugggcacugaaguuacagacuguugcaagcugccauggggggagguugggaacugaaccuagguccuaagaaagagcaacacaugcucuuaacugcacuaucucuccauccccaccaauauuuauuggaaaaauaugaacaccccaaaaacugagccuguuuuuugauugugagaauauuggaguuuuguucuauggauaaaauuuccagaaacauuuuaauguguuuuuuuaaauacuguuauuuguacauuauuucaaaaaaacaaaaaacuaaacuaagcagaacagaacucuguguccuggacagauaugaaaaccuaggccuaccauuacaaaucucucugccccucaaugacaucgcauuuauuguuuuauguuuucuuuuuucauguaaacucaugaaaaacuuuccauuucaauacagauuaauuuaccucagucuauguuuuugcaagaauauauguuagauaaaguacuagaauuaaaauggcuaaggagacaugccuacaaucuugacucaucuugacuugccuuccaagccaugcauagcuagcucccagcuauugacagagugggaaugauagaguuucagaagcaaagucauaaacagggucuccugggguuucuucauauguccuuuaaaguugugguuggagauuagagagagagaaugccuucuaacuucagacucuauaaggagaaaucuaacucuccaacuccacuucuuacccaggagggagggagggaggaagagagagauagacagacagacagacagacagacacacacacacacacacacacagagagagagagagagagagagagagagagagagagagagagagagagagagagagaaauucacuucauagaaaaucaggagacuaugucuccucugcaaaagaucccucaaaaugauuggugugaaaugggcguauuuccagaguuagaacaagguuaacauuuuaaccccaucucuuuagagcacuguuaucuuuaagaaaauggcuuaauauuuccuguuccauagucuauggaauggagauuaccacacaguacauguuuucuaugagaauaaagccuguuauguaaugcuaauaauauuaauauuuggaaagggagcgcuagagcgaguagcuauuauuugaggugcauucccuguaagcaccgugacaggcagagaaaugaaccauaaagaggugaaaaugaaaacuugguccagcuugacuuugucaggcugaauuaaacguugagagucugacgucaggcaguugguugccagcauauuuaaaaacaguacaguguggggaaaguguccugguguacuacaaucccuggugcacuaaaaggcauaauaacauugaaacucaacuuaaaauacaugucacuucuuccaagagaggccucuggcaggaucuggcaugguuucagucacacagauaacauagagaucguguaggcuauuagccaucucugguccugguugugggagcuugggguaaccucugucuaaacagauaaaguaaggaucauuuagacuauuagcuaccucugguccugcuggcccuacagauaacacagaucacaaggcuauaaaucaccuccaauucccagcucucuggguggaaaaacagguuuugcaucccuucuuuugaaagggcaaucugcaugcuuagcauuccugguuucccuggugaucugugggugcaaggaccuucaugcucccagcauagccaagccaagaguauccugaguggcuaugcuuuaaucacuauuauagaaagugcuaccaucuugguuagcacacacucccuaacacuacaccuucccaacccacguuuaucuaaaguuuguuugaaugauuguuuugcuugcauaucuguguguguaccaugugugugcuuggugcucaaugaggucagaauggugcauuagaacccacuggaguuagguuccauugugagcuggcguguggguagucggaacugaacucggauccucuggaagagcaacggguccucuuaacugcugagcuaccucucuagaaccaagaagcucuuuucuuaacugcaggauuucucaaacccuuuaauaauccccacagggaauaugaugugcuaucaccagcagcccucaaccuugcugucugucuccacauccuuuacagagggaucagugucucuucacggugucucauuacccucagcugucuacaacggguuagccagggccuucagauuuucugaaguuuaugguuccaagaacuucuccugggcgucugggaaucugugugcagaaggcaggggagaguggcugugccugcucaggagacaguaguuugucccucacgggugaagccuauuuuaagagauaggguaucauuguagaaaacaaggaaguaccagaauaugggugugcucaggaagaaacaaguaugugcgcauuuagauuucugggucucaucaucuaucuaaguugcuccuugccuugggggaugagaaguccaggccaaaccuuucuuuugugagcuguuacuccaaaaagcuucagcauccucagagagcacuccgcucucuccuuccucucuggugaucaccaacgagacuuugucugcuaggaccauuccccggggcaaucuacaagaaucugaaucaggcagaaagacccaggggaugaucuacacuuaugagugugucccaggaguuacucuccgucuaguacauuuugaaaaucuccaagccuauagggguugcaugacagaaaacaguaacuuguuuagcacaaaaucucgcccaaguaccucaagcugagguucaagaacaccagccacuuccacuuugcagagugguuguuauuucuuuuuuuuguuuugguuuauuuuuuucauuuguuuuuuuguuuguuuguuuguuuguuuguuuguuuguuugguuugguuugguuugguuugguuugguuugguuugguuugguuugguuuuuugagauagggucucucuguaaagcccuggcuguccuggaacucacuuuguagaccaggcuggccucgaacucagaaauccgccugccucugccucccgagugcugggaucaaaggcgugcgccaccaugcccggcgguuguuauuucuuaaugaaagagaaugaguuuguuuuuuccuucuaugcuucacguggucaucacaguuccagaguaaugccaucacacugggaggaaaccauugcucgggugacagggagauaccacagcucuuacucuguauaagguuggagccaugugguugugccaaagacccaagaaucuagcuuaucagcagucagcucuggaauuagcaaaagggugaguuagaaccugaagauucuggcuucuggcugagcacucugccucucuacacuaaggagccaucguuugcgugcucagugauuagaggccggccuucaaguugaacaguaccucuuaauggaugcaagaaaaaugaugucaaauuugucuguucauuuacuacgugccuaccguguucuagucuaauucuaagcacucugauauuaggauuuaguaaauaagaaaagaucacugcucguacagaacagccuuccuuagaaucuaaaaauaguuuaauauuaaaaaaauuaauggaucacagggcccccaguggaggagcuagagaaaguacccaagaagcuaaagggaucuguaacccuauaggugaaacaacauuaugaacuaaccaguaccccagagcucuugacucuagcugcauauguaucaaaagauggccuagucggccaucacuggaaagagaggcccauuggacaugcaaacuuuauaugccccaguacaggggaacgccagggccaaaaagugggaguggguggguaggggagugggggggaggguaugggggacuuuugggauagcauuggaaauguaaaugaggaaaauaccuaauaaaaauauuuuaaaaagauauaauuucucuaaaaaaaugaaaaaaauaaagugaguaaaauaucuuuaccuuuguuugaacccacuauuuccuguaaauuauuaaucuauguuaugcuuuguauaaauccuguaucacauacuuuagacaguucugacuuaaaacauggggaauuccuaugaauucacaaagggcccaccugagugucugcaggcuacagcacuacaauugaagagacacuucaggcugagggagagaagccuaccuucugggccacacucaaagaggucauuuuaucugaucccuccaaguaaugugacaaacaaauugcuucacacucacccaaaucucuuguaaugcgucuauaaacugggaugucaaggugacagcaugcugaauaaugaagacaugggauuugaaggcaaauagauccuguucagaggucagcucugacuuacugcuuauguuaccuuaucugagcuacagcucuugggagucaaaucuggaugauaauauggaaucuccugggagacggugagauggcucagcagguaaaggugcgugccaucaaaccugguuaccugaguucaaucccugggacucacauggcagaaggagagaacugacuccugcaaguugcccucugaccuccacgugugugguauggagcacacucacgcccacauacauuuaaaauaaauauaaaggaauaaauuuugaauacugacucuccugaauuuccacagaaaguauagguaccuuuuacuugagcagagaaucgcaauuuggaguuacuuugucucccggugucugugucuagacugugauagucucaauauucagcuguagagugagcauuacagaagacuggguggcugagccugaaagugagguagauaauuuuagguugaguuuuggguuuugagcgaaagaccuguaguucaguuggccuugaacucuguacccuccuguuuccaucucuccagccccaacccaaagcuaggauuaugaguagaguagagaguagaguagaguagaguagaguagaguagaguagaguagaguagaguagaguagaguagaguagagaaugaguugccacacauagguggggaagauaguuuuauucaucagaaacuuucuaagaugguuuuugcaagagacagcguacacucccugugggugcucaggugagagagaaagauuaggaguggugagcuccaggucucuaaggcagcaucaggcuguguagagggagguggcgaugauaggcugaugagguaggagaggcuagcaugugaggaggaaggcugugagcaggaggguccagcaaggaugagagaaggaggaauguauuaccugcucaaagcaugggagcuggugauagaaaacugugucccaaggauacuuguaugauguuaccuugugaauauauaaaaucccuguguauuccugccuuuagaaaacguguggagaagcccaaauauguuucaagccuugcagccuugaucuguuuucuuuggacaugauaucacaggccauuagauuuauugugguuacucugauuauguuucuuucuucuucuuuuuuuuuuaacuguuuuauucucaucuccgucacuccuacuuaucacuagauccaucauugugacagugauuuguaucucaggauauauuguuguuucaaauaugucaucuuaguuauuuauguauuuuguuucaucaucucgucuauuacauauuacacaaguuguuacuacagaagauuuacuguuaguuccucuguagaguacuuuauuuugaaaccauguuuucaaguuagaugcuucugagaaaaagcauucuguaugugacuaauuucacuguacauaaaguaucaguaccaaaaacugucccuggcaucuagcuuuagugugauucaauuuccaguaagcacagcuauuuuauaaacuauucaaagaauugaacuuuggggucauaguggcuagauucugggauacauguuagacuuuuaaaaauauaagguuagaggaaccaagugguaguccccaauuucugcuacaguagguuuuuggugguuuaguccaggagacagauaaguauaaagugaaucgcucagucaccuaucugacuuuuaggauuaaacagaugugaucauguggcuauaauagaauuuauagggaaaacaaaacagaaauuguuaccaggaauaaguuuagaaccaucuagcuuuguaucaguggagggcaaagacaguggaaccuuaaaaauuuuucuucauauauuuuuuugaguuaagaucucaccacucacuguuaagcccuggcuggcuugaaauuuacugucucaucuagacugucuuuuuuuuuguuuuguuuuuuuuguuuuuugauuuuugagacaggguuucucuguguagcccuggcuguccuggaacucacucuguagaccaggcuguccuggaacucagaaauccgccugccuuugccucccaagugcugggauuaaaggcgugcgccaccaccacccaccuagacuggcuuuaaacucauaaucuuccugucucaccuucucuaguccugaaauuacagacgcucuccaccacacugagugauucugugguagagccauuuguggugauacacccaaaaaucucugcaagagagagugaaagaguugaaaucgagagagugaaagaauugaaaugggaaagcuguggaauuccuucuagaacugguagcugcccagcacuuccagcuuggcagaggugggagucuaggaguaugguguuaucaggaauacaguugggccuuaucuuaacaaggaccacuuagaccuuuaacaacaggaggcauauaugauucugguugcauagcauauggucucuacugcagcagucuaagaauauaaagauguccaggaggucugcuaugagaaaagacaugcacaagauggagaucguggguaguuuggaucacauaguaguguuuccagaagagguuccaagaaugcuaguuguacagaaugaucaacuagauauuagauaaagugagugugggugaugcuggccuaagauaaugcaaaugggcucuuuaccgaaagcccuucagagccugugguaaugucccagugugccugaaguaucucuaggaagagauuguguaacaugaauguuuuaaccuuucccaaaguuguuuaaccacaaagcuggauguucccccagggauggggauauagcucagcugauagaggacuugagcauacacaugguccugcguuuggguuccaguacuaccuaaacaccuguaauucuaguacucaaaagaaacagaaguucagggucauccgcaggaaaauagcaaauggcucaguuaaaaaauggggaaugaaugaaugaaugaaugaauuugggcagauagcuaagcuaagaacuagaguagaaagguaggaaagugaagagaaguguguguccguucuauuaagggaacugugugaaccuauccaucccugccuucgguucuucucccuguggcacuuuucaccuccugcccugcauuccucugccacuuucuuguuaccagggguaacaugaaaaauagcuaauccucggugaaauagaagucuuugcaggugugggaacgguagaauauaccaugaugcuuugaaacuguguuauagagggucuaugcauuuuuaacaaaugugcacauccaggggcagucuucuguccucaaacucaccuagcugugcacacacucagccuuauuuaucuuaacucugaugacuaaccaaggaagauaaagaaguagaugaucuauaaaauuuuauagugagcuuguuggauagugauguguuaaauuaaugaugcuucugacaaaagauacaucccugccuccaccucccagggaugugggagaacagaugugaggaaggucucuaugugugcaaguaugacaguuuagggcugcucacuaagcuuagaaaucuguaagguuuuggcuggcuuuccaguaaauaucuauugucagggaucccagucuuggaauaaccauaauuuuuuuuccuagaacgccaacugggcaccucuauggccaauuccaauccuguuccuucaaguucagcuggaaucagcaaggagcugauugaucuccagccccucauucaguucccggaggaaguagccagcaucuuaacagagcaggaacagaacauuuaccgcaggguccugcccauggacuaccucugcuucuuaacccgggacuugaguucaccugaaugccagagaucacugccccgucucaaagcauccaucucagaauccauccucacgucucaaaguggagaacacaaugcccuugaagaccuugugaugagauuuaacgagguaaggagccacuuggacguuucuguauuugagccaacauguauuauucucaaguguacuucuugucuggguuugucugucuuugauaucucuccuaccugucuuugucucuucuaugacggucaauuuccuucccagucccugagauugccaccauacugccuucuuccuccucacuccacccuaacugccugcaagucugauggagucuacaaguauuucaauuccuagccuccccaaucacccauuuccaacaguguuuuuaagacccgugucuugguugugagcuuugacagcauagcaccgggccacaucuaucuacauaucucccuucuguccaucagcacuucucagaaaugcaaaaggccaacaugcccggagcuucucaucuaaggaagcauggagguaguuccuagggagggaugaaucauuccacuccucucucuguaucccuaacaucuucaagcccagaaagucaccuuaaagcucugagaaaugccacaagccaggucuaaagagcacagugagcguagaguuuggaaacacugaagguggagcuucuauauggcauccagggaccgaguugggaaugggaaacugaccgcugccgucucuauggcuguggggcacugcgcgugcagaaauaaaggggugggagacccucauccugccagagcuuggguagacugcagcgggacuccauggaaccauccgggacgggcaucaggccucacaggccacacaaccccucuccaggggauggggaagacucagucucugauucucaggcaccacagaccacugggguaucaaucaccaaagagcuggucuuggggucccugggccucacaguagccugggacgacugguucuugcucuuggacaucccagagcgcuguaugucguggaagaacugaaaacggacccuugggcugacucuggccagggguccgaagggggaagggagggggagagcucuagcagguuacugcagggaggggagagagucugcuagcuaggcagccucuguggcuagggcgcaggaaggccucucagcgggagguuagaugcguggcucauuagagagaaaccugcucuauugcucuaucacagcugaucuccaugagcagagacaguccaugguuuuagaauuuuauuauagaaaggcagagagagaaagagaaagggguggggggguaaagaaguagaggcuggccauggccacguggagagagaggggaagggaagaugagaaggagggagagguaagagacaaggagagagcaagagcuuaagagagagaggagggguggagcaggccccuuuugguugugagccuagccuuuaauggcugauccaucucuccagccugagcagccccuuuuguagugggcugggcuaccuugcuguugccagguaacuguggggcggagcuuaccuggcuguaaccagaauaccgggagcuugggacauugucuaugugacugauagucacaggauuauggaguugaggaguugauguggugucaggcguuugugucugggagcauagcuuaagguucagucccuuguagauguuucuacugggucucccgaguaagccuugcuugaccagaacacagacugccuuucaugguccaaccuguggcuuaggucaaggaggaaagugacaagaaggagaugccgguccuggucuuaaaggauccuucuucucucuccauuaugcaccccacacccaucauuuucuuguucuucuuccacucauuauagucuugacuuuuuugcucugauuaucaaguuacuacuuuuuaauauagauauuauagguucuugguugaauuuuacgaauagcacaauuucugauuuggcucacguguaagcuccaucuaaugcuaagaagacucucauugugggucauggcuaucucuggguggcagagggucaaucagccuuuguuacauguacccguccuuacacuuggccucagucugcagccuccaugcuuuccagcaaagacccuggcaaugguggugaauaucauugaccaggaugaagcccaggggaugaagaaaagcguuagaggcugagcccaacugacuucaugugcagaugugucucuaaacaccauuccucaggaagaagccuguguccacaggccuggcaggcaaauggucaccauauuacaugcaccacaugucuucacaguaaggaacccugaagaaaaacuuucccauccucaguggguaaaccaaggugcaaggagauggguggcuguugugagauccaaacccauauaaucugggcuuucaccucuccaguguccugcaugucaccugcauugagggugauacuagcuauaacugcagauuuccaucccaccccaaacuaagacaaaauuacagggaaucccuaggagcuugcaaaccacacugacccagaguuguuguuguuguuuuuuuuuuuagguaaaucuccugguggucuugauuucuuacugauaaaaauggaugggaaaaugaaaguucccauaaacagagugauuuuacuguuucgugacuuauuugaaauuuccagcucucuuuacucucacaucuuuaagacccuguucuuuaaaaaaaaaaaaaaauagaccuuaacuuacaagugaauugccagaaguuuaaaaaaucuaauuuuaaaccaaacuuggacuuuuuccaucaaucuugggagucaaugaugaaccagcgauucccugacgcagagcagagcuggagauagggcacccauagccagggugagguaugcuuugggcuaucucugaaaauaguuuagcugcaacuucagaauguaaacaagacuucugggaaaacacuuaaacuacuuaugagaagagaguguuuucaaguauucucaagcaucuauuuccauacaaaucaugggcaaagugauuaaaacuucagucuguacugucaucaaaggcagauuccaaggaauuuccaccaaccagcucgcaaauagcuaauucugaucacuuuauacugaaagguggaaaggcugcguaacauccaaagagaaugauacaagaaugacuuugaauugccuccaaauuaguguggcuuucuacaaagaaaugaaaggaugcugagagggguggagaggagauaggucgauucuggauucuuucagccuugcugaacuuaagaguucuagauucaaugauauacccuggcucaaaaaauaagguggagagaaauugaagaagacauuggacaccgaccucuccuccccccccccaucccacccaugcacacgcacacauaaucugcauauacauaugaacauacacaugaccauguauaugcaccacacaaaaagggaaggaaacuucaccuauuugugaaaguaucuuuuauuugccuuauggaaucaucaucucccagacuuacugccucuaucugcuaaccuaggccuagaccuggaagcuucuagccucugugcaauccaaucuaggccuagaauguuucuagucuuugagacuuacuacucaauaagaucacccuuuauaguucuuucugaagucugagggcugguucaacucagcugccaggcucaaaacuccucuccaagcugacugauucaaacuggcuucucucagcuucugacugaauugcucugcuuggccccauacuaacuuaagcaauauauucuaauuuucagguuccuuagcauucucuggcucauucugucuucuccugugucuagcuuguucucucuaacuguauaacugucccaguaaaacugccuccuucccaucucccucugcaccacucccucuuacauugccucuguuuccucucuuuccucaugagaguuggacauaucuuauucugucagaucuuucucugauguguugcuuugucuuccucgcacacaucauuuucaaacaugaguacuuccuucuacaaacuaacuuuaccuucauuguuugggguuaaaaguguauaguaaggaugcaucuguauuccagccagagcagccauguugcuagauuaaaguaccucuacaccuauguuaguaggugcucugaaccagauauuuucccauuuuuuaaccaugcuccuuuuacagcugucaugagaaagaaagugaaacuuagacagcaaaacaaauaaugaugguauucuuauuuauagaguugauguaagaguuggaggauugagguaauuggggagucccaugaggacacaacaaccaucaacauuguauguagaaccacugaugcauuccaaaguuauugggcaaaaugaaaugugaugagagaugggguauuugcauccccaagcaacuuucuacaagauccuggauagucacagaacaguggagaagcccagccacagauaccaucuccagguuucuuggccaguaaugaugcauguccucuuccaccuuuacuuaaucugcuuuaaagaggugugaugucaccuuuauguguucuugcugcagaggcgaaccagaaucuaggaauggggaaaugucagacaugcucggguugagggacaggcaaugcuuuugaacaugucaaggucauggaaguugaaaauccaagcuuuaguaaauacuggacggggggggggggggagguggaggaaagugaugggaaaaucccaauaagguauucaguuguauuaguuauuguguuaauguuuaugucuugguuuuuauacuucacuaugauuaugaacaguauuagcauccaggaaggguggaggaguguaaguggaaacugcguacuguuucuacagcauuuguguaaauuuaaauuauuucaauaauagguuuuuugggguuuuuuuguuuguuuaguugguugguuggcuuuuuugguuuuccgagacaggguuucucugugcagcccuggcuguccuggaacucacucuguagaccaggcuggccucgaacucagaaauccgccugccucuaccucccgaguacugggauuaaaggugugugccaccacucccggcaucaaaauagguuuuaaaauaacacaaugaguucagaaagauugagucacuugcccaaggucacacaguagcuaaauggauaucagacccuggguuugucuucagucugucuuuccuuacugccuuucuacuuuuuaaauuaugaagucaacuuucuggucaauccggaagugcugauucagaaucuaauuagccuugagcucuucccgugcuuuucccuaagucucuugugccuucauccuuuuuuauuaucgcuauuuguauuuuuuaucuaauuuucuaauuacuccugccacaauccuguauuccuucauucaucuguacaagacaucccuacugcaugccuacugcaugccuacugggcuuuugccuccuuuccuuuccucccaaugggaggccagacagacacaggccaauuuuaaaauaagaaauuagcaauauuucaccauggaacuuaacaccauuaaccaaaaugguguuuuggucaaaauaagaaacacuuaucuuugagagaaggaaacaaauuccuuagugcaucacaggcccuaaagagacaaaagaagagaacaucaacuaucggagaguacuaguccccagggcgaggcagaugaguuuauuggugcagucagucaucccgggccauuuauucagcacgucucaggagcaagcuaguugguggauaugcucuaaggaaaguaaauaagagugugcagcugccagaaguuaccacgggcagacacaaauagcuaccaaaaaaggcagcgagugcaugcagcguggagugccgcagacaguguggaugggggugcugaggugggagacugcagccccuucuguugagcucuggagucuagggcugguccuugaguaguagacauuacaggggagaaacugcggggcaggagggauacuugaacaggaagacaauccacugagcgcucuuccguccugaacaagacuuccugguguagcaagguagcuugcuucuaagcggcagcagaacguaugcgcuagauguugcccacauccuagccgcucuguacauacggacuuaucuguaaugagggggaaggagaagagaauuccugcugcgacauugcguaauguuuguucugaggaaaguauggcuaaaaugcagcucuaagaacaaccaugaaacagcuggaaagauuuugccacuugagagaggccaggagauaaaucacuccagcguuucuuccugugcccuuuucccaacucuguaagacuaaggugcgcguuagccagacaccuggcccugcuuucuccuugagaauauccagaagcucaaggggacaggaaaguccuuuaagcagucaggcaccagaucuauacuggacucagcccugcaugcuuggucugagagacagaucuuucugggccuucuuagguuggaccugucccucaggcccgagucuugaccuuaagcucccaggagccaauguucccuaucucccuuuggaaggccuugcugccugcccacacacgaagccucuuucuuggagagucucaagucauuuucuuuucacccucuuuuucuuucuucacccagcuucugccgcuagcccacauucccuuugaucuuccuuuguuuuuauuccccuaacaauaaauucccaagccguuuuccuuuucuagaagagacagagagguacuuccccuguguccucaccacagagaucauaaguagcugagaagaguggagcagagacugaauccugccuucuccacuuuucccuuucccccuuucucagcacacccaugcuguaacacagggcaagggggagcuuucuagggucacagcuccuagucuuuacuccccauaccuuauguccuguauaauacagccuccauccuugugugccgaucaccuguggugacugguuugcaggaccuguuccuaaagugacuccacagccugucacugcacacacauguccauacucucuuccaugucacagacaguugcucucucuggcuagggggaucacguucagcuucaagaggccauuaagagggcaguguuugcuucuuggguaguucuuggcaaggccacuugucugggcuccucuucuauaccagcuggugugaaggcagguccuaaguccuucauugacaccggcauuaguacagggaccccagacuccucuggaucccagcuggcugucuuuacccacguguggcuaacugcgucacucaccaaccugccucucuuggcuccacaaaccugguggcccagagcaacacucuggucucgcguauuucuuccacuugguagaacucaugagcuacaucaguccagcaauucaaaagccacuuguuuuuuagaccaaaaaaaguaggcacggccuuauuccuaggaagaagauaaacgaguaaaauaagccauauuucuagagaaaagcaguucuaacugagaccuguccuccacgcacagcucccuaaucccuccuguagaguacuucccaagugacagcuaucccuacagcagauucugacucccaggaggcugccuuguugucacugaggacagacuauuccuccagaaaggcagaauaccaagcacagggugguggugagguaugguccugcacuugaaauguuuugggaaaaauaguucugaacuuaccuagccaauuguguugagaagcguuuccuaccagagucuugccccguuuuugcaaaagcugucagcuggauaaucugcuguauaaacugucuuccucaaaugaauacacauauaggcugguaaagacauuugaggaaauaaauuucagcucacuggcaaaucuccccaugggggugggggaaacaugucucccauggcuacgagucuccccagaaguguccuucucccccaaaacaguauugacuggguaugguagaacacaccuguaaucucagcugcucaagagguugaaacagaagaaaacacuugagcccaagcguuagaggauggucucagcaacaaacaaggacgccaucuaaaaacaaacaaaacacagcacagagcuccaugacagcacagagguccacccugcugugcagcauuauguaagcaagcuuaucuguuggugguuaucuguccuggagcuggcugagagcagauccccucacucacuguagccuuuaguaguggccaauggacugucacuugagggcagcuuuggagacuggcugccuggauucaauucaccuugcccuguuaucuuaucuggaaccaacuaccuaaucccucaccuuuucagucauagcaauuaaauuucaggccucaugcaugcaaggcagacacugcuaacaugcuagcuggcuuuguguuguugcggccaaauacauaagaaauguaauucaaggcaauagguuugguuucagaugguacgggccccagucaucuggcuuuauuuccaguccagcauaagauggcacauggcaacaguggaagcauguucaccucauggcagccaggaagcagggaaugccuacacaucuccuuuucccuuuucuuuccugucucagacauccauagcaggccuucguuucaggaaacauccucacuggcacacuuaaagagguagggcauaccauagcagucuagauucaucucaguccaaucaagaugaaacaucccgacugcucuuccagaggucuugaauucaauucccagcaaccacaugguggcucacaaccauaggaucauaugcucuuuucuggugugucuaaagacaguggcaguguacuuacauaaaacaaaguaacuauggauaaaaaaaaauucacuauaauuuuauuuuauuuguuaaccagccacuuaacaagugagaaaauguaaguuuggucuugcuaaguaaaugaucuguacucugagaacuagaauggugggugacucagauguccugacuuccugagccauggucuugguauaacgguuuuuaauugaacacugaaaaaguguuaugucugaauuugguugucuuccgcugaaggauaccaucuucuucccaagaggauuuagaacaucaaccugacuucaacacucuuugaguucaccagccuccuuuucugauccuggaaacacagcaccuccuucacacugggacuggaagacacgcagaagggaccuucugggggcaugcuuucugaugucuagcaggugcauccagaaacacuucaguccugagacugguuagaacaagaaugguauuaauagaaauaaagguaggcaagaacugggacauaugcuauaacaaucaucauuauuaucagaaguaguaaaagugacucagagaaacugcagcagcccuucggggccguggucccccagugagcagguuaccuugguggccuugaauauggucggaaagaucacauaaacuuuagucagaggcugagcguuugagccucucuuugacuguaugagcugacccuauuaggauauuucauucagcccuuugaaaacccacugucucagagaucuuugcugcucauauaagagccaaggaggaauguauuuaugcuuugccagggaucugcauuugcccaaaauauuuaaacaaccauaaauccaacacuucuugugggcauuuuuuguucaaguuuaugucucaacugcugcuuuagacacuaagauacauuauagugcacacaggcaaacccucugcccuggcagagcuuauuauguuccaaugaugccuuaaaagcaucucagaugugcccacaucagaacuacugccuccucccucucgggucacauaacaccccaugucuucuccacaccccacgacauagccaucuucccccauacccguccuaguuaacagugucucucucuucccggguacucaggccaaucaccuaggauuuauccuugguuuacuguuuuccugaauccccagugaguccuauucguucuuccuaaaaaaugcuuccuaaacuagacagcucuucccaaucccuccacguuggaggcagccagcacugcauccuauccguccugcuuucaugcuagcaugccccggagccuacucucaacccuguagcaagcaugauaaguucauaagugugaacaucguguuccccugcugaaggucuccccaacggcucaagauccuguuugaguuugcuuccucggaccuccguauucuuuugaauauguuacucugguuucauccacauagccucugaacuuaguguucugucugccuaggaccuguuucucuguguugugccacaucuguagacuucucaggaucaaauuuuacuucaaggaaaccauugucuugcauuggcuuuuuuuacccuuucccuaucucuuuagacuccagucccccccccccccaacuugcucaugucuaugucucucuuucuuuacauagucccacauauguaauacagguucaauaaauaaguacuggauaauuuaauaacuaaugaugucacuugguguuaucaauuauuuauugaaagagaugcuauuaaaauacagagaaaaacaaaaugugccuuuuuuuuuaaccgcccuuaaggauuuacaguuuacuucaagggcauauaaggcauaaaauauugaauaaacauaugcauggaugaaaaaccagugccaagcacuaacaauuaugggaaaggugguggagagcuagcagucuggguuaaugggaagaggagggcucuauugggacgccugggcaagagccugggcuccaaauccuucucacugugggacucugggcaagugucauagcucaucuucacuguuauauagacuggcuuuggcaucacccaggagacaaaccucugggaaugcaggugagggcccuuccagagagguguaaccaagaggagaagacccacccugaaugugaguggcgcugucaauggguuagaguaccagauugagucaaaaggggaaaaggaagaaugugcucucaguaucagcaucuguaucucucugccucguaacccugggagacucacguucccgccuccaugucauccaccuugauggacuuuaaacuaugagcccaaauaguuauccuuuauccguuauuugaucacggcaauaagaauaauaguugauucagcaaguaaauuuuagcuccuguuucuugccucugaaaugugagaguuuuauugguuuuaccauucaccaaauguucuuucucacaaacuuuugaaauccaugagcccacacucaucaaacauguguuucucuaagguaagauacucauggaaagccuuucuaagucuaagccacacugauaaugauauacaaagcagauuaucaaaucaaaaagaacgggaaguugguuaauuugacaacuguuugaggauaucuaauuuuuuaaagcuuuuaaaauuuuauuuauauauuucauguauauaaguacauuguaacugucuucagacacacagaagagggcaucagaugucauuacagaugguugugaaccaccaugugguuccuggaaauugaacucaggaccucuggaagagcagucagugcucuuaauugcugagccaucuuuccagcucugaugacaucuaaauuuuaaugauacacaaaaauauauuuauugauacauaauaaugacuagaauacuuuagugaaugaaagggauuacauacuuaguuugauccaaguuuuaaaaauaaacuguuucugaauguauagcuagauaauguauucacauagauaguaaaauacuugccaacauuuuagcaauugcucucuuucuaauguuuuccuuuguauuuuaucuuaugaguauuaguguuugccugcauguguguuuguaugccacauggccucuaaagaggccagaagauggcguugaauacaugaagcuagagucacagacgauucugaaccaugguguugguauuuggaaucaaguucagguccucuuaaccaaugaaucacaucucuccacucuucagcuccacagucucccucucccucucccucucccucucccucucccucucccucucccucucccucucccucucccucucccucucccucucccccucuucucccucucccccucuccuuuuuucuuucuuuuggacugauagugcuacccauacuauuuaccccuuuuuuuaaucuuaaaauuuuuuccuugaugugguauuauuauauaaggauauuuucauacaaauauauauuguacauugaauauauaccauguaauaccccagccucccucuuguccccuuccucuuuguucccucaaacaguuuggccuucuacuuaacugucauauauacauacauuguuucauaaaaucuaggagccacaaaugagagaaaacacauauuugacuuucugagaccgguauaauucacuuaauaugauuauccucaguuacguucauuuuccugaauaacaauacauguguuuugaguaguacuagagaacaaaacagcauccaugcgagacaagaaucacaucauuggcuuaccacccagucucugucaauuuuccaaugaugaugauuaugaagaaaguaaugauggagcugcaguugacucugugccuuguacugagucaacaacaaauaaacacuuuauguuacuuuuaauauauguauguauacauauauauauguguguaugugugugugugugugaauauauauaugugugugugugugugugugaauauguguguguguguguguguguguguguguguguauccccuuccucuuucccauauaccccucuacacuuauuucaaauucauguugucagaguugaguuuuuguauuggauaaccaauugguguguguggaagaucauuucucuggcucucagcauuccuuagugcccacaguucuugauguaagcuugaggccucaugaacuuuccccauccacuuuagcauguauauugguggugucccugcugaauucauauuuaagcaucauauugguaagacuuuauguguguaacuucugacauuaccaggacacaaucucaagcaaacucccugauucuuuaguucuuaaaaaaucuuucucuccccucuucugaaauguuuccuaagccuuaggugcaggaguuguuuuguaaauguagccaugauugauugguggugguuuucugugauggucccuguugcaaaaagauuuuugcuauugcuguuauauuuuguuuuugacaaguggugagaguuacccuuaccugugugguauaagaaaaauggaguauaguuaaggauuaugcuggcuugguaaaguggugauuuguggcuucuccuccaagauuccugacuucaauaacccuaaauaguugacuugguuuccaguaccaggcuugcuuucucccuuauugaauaggucucaaguccaacuaaagagugguugguugccaccaaggguauguaugccacuucugccuagucacuguugugacucauugcaucagagcaggagaggucuguugauugcucuggucaagcuucuguggcaccaucugauacagugaaaacugguccucagggagcagguuuaugggucaguucuagcucagggaccuuuggacccugcuggugaaguauaugcugucguuaccaauauagauuuaccuucuaccucuguggggcaaccaagagcaauagcaauagucuguaaugacuugggaaucucuuggacaucccugacuucaaaagaggacuucucaggucuggugucaagguuuuuguuagaugaucuuuggcucuuggagaaagcaugaucagccuagcugagaaaacauuauuuaaacuuuauauguauauacggacuuaugaacacuucauggguuuuuuuuuuuaaucacauuuagcuuucacacaacacugaagagagaggaaucauuguauguuaguuauuuuucuaucaaucugauagaaugccuaagaacaacuuaaggccugauuuauuuugacccaauuuuaggggcuuaaauauaucuuugcagggagauagaacagaccaguucauaccaugguggccaggaaacagagaaaagguaaacacagccccccaaggacauguccucagagauguuugccuccaguuaccucuugucauaggcacuccucaauccauucaggcugauaaccaagguuaaccauugcuuuauuuugaaaauaagaacacugagguucagaaaggugacaaaauuugcccaauacuacacagccacaaagugucuaggccaagaggaaacucagauaucaaagcccaaacacgggagcuggagagauggcucagcgguuaagagcacugacugcucuucuggagguccuaaauucuuaucccaguaaccacaugguggcucacaaccaucuguaaugagauuggaugcccucuucugguguguccgaagacagcuacaguguacuuaaauauaauaaauaaaucuuuaaaagaaaaaagaaaaaacccaagcacuuggcaugcauauaauaugguaucuuacaaaguaaaugugucauggaaagccauagauauagaaacuaggacacaaaauguuguuuguuugaauauuuuaugagugacccagugagaucaggauauggucuuccagcacauguuccaugggauguuugcacauauucuguggagaagcaguaccuaauguggucuaaugcauaagccacacugggagcaacgagaaggaagauguugguugggauauccccccccccauuguuauaucaaugcacaugaggacucucccauuugagcauuucacaaaaagucugagugucagaaggucagugcuugcuauagaaccagcacugggaagcccuauggguaagaaggagauuggccuaggcuuugaggccuugcuugccaaagcagccugccuaccagguccuugagaaggagggaaauaacagggagaagguggagcauuccaugggaggucagagcaagacagaugccaaggauagugagguauacauuccccucauccuaacucaugggacugcccaugugagucuacaaagcgagauucuaaucccauuguucagauuccauccgccucaggcaacugcaaguuucaugccuucccaccacucaucacacuucaaaaguuauaccgacaguaaaauuacguguacaucauuaggguaggaacagaaagccugcaaacuggucuuggacuggaugcagccaagacaguuuucaauacauccaacuuguauaauuauucuucuccuucucaggugcccacagucgccaucaugacucgaauaacccaguccaugguuaaaagaugcauaacaaaagagacuuuuuucccguugcugggcauauacaguucaggauaucauauaugcuaggcucuaucaacugggcauauacaguucaggauaucauauaugcuaggcucuaucaacugggcauauacaguucaggauaucauauaugcuaggcaagcucuaucaacugagugacauucaguccuaucaaagaugcuuucaguuuaugagcauuucacacauguugaccuaguuauuucacacauguugaccuaguuauuucacacauguugaccuaguuauuucugaucuuucucuggcccuguagaacacacauuucuuuuuuuucuuucauacguagauccuagacuuuauauaugcaugaacauauaugacauacaagcagggaaaguagggagagcaaaaggaauagugggaugaugcagcuguuugaauaugagguuguuuuuuuuucccauuggaauaagguuguacuuaaaugucccucacaucaccaaaggauguuaccuccacuguagcuaagcuaagaguugacaguucugcugcgccaaggaaugaguuguaggcacaauuauuuggauacagauuuccugcuauggucaaagcuauuugacuugagugagugucaucauucucaggccgcagggaacagguuacauucaucuaagaaaugguuuguguauuaagauggucuauccaugaagucauucaucaacuguuuuaaugaacaaugguucugcuuggaggguggcacagauguuaggugaggauaagauucugguucauuggcugugaugauuuugaaaagcauccaucucagaaaaagaauaacuuauaagguccucuucuucaaaauugauacaauaauuauaaauaucaagcaaaacauuuagucucacucuuucuuguucucuuacaagccaccucccaaauuaauugucuauguuucuuuggcuguauaaauaauuuugaaauauguaaguguucugaaaaccauuguauaguguaaaaacaucagauaaacaaucauacuaauagagaggcugagauaggagaagcaugauuucaaaaccauuauaugguacacagcaagacacuaucacauacagacaagcagaaacuguauauggauuguacaauauuggaccuauuucucaaauuaccaaauuagagagaccacugaaugacagccaacaaauuucuaauuccucauauuuuugaauuucaauugauuaggauaaguuggcaauauuaagauauauuaaggaaaagugacuauuacuuccuguuauuuuuguuguuagagguggaauuauguuuguuuggguuuguugaaagauuacuuucuugcuuucucuagaguguaguuucuuuccuuguguugguguuuuccaucuauuauacuuucuagggcuggauuuguaaaagaaacuguguacauuugguuuugucauguaauaucuuguuuucucugucuaugguaauugauaguuuugcuagguauaguagccugggcuggcauuuguguucuuuuugggucucuaugacaucugcccaggauuuccuagcuuucauagucucuggcaaaaaaaaaaaaaaaucugguguaauucugauaggccugccuuuauauguuacuugaccuuuuucccuuacugcuuuuaaaauucucucuuuguuuaguucauuugguguuuugauuauuaugugaggggaggaauuucuuuucugguccagucaaaacacacauuucuuaaaacuaccaaaacaacaaugacaacaaaauuaagcaacaagagauucauguauaaaauauucaaaguguucaaugguugaaggacucaucuccuuaccccagaaugagggauccggguuagaaaugacugaacaauaaccagaggaagcccacaaggaaaauagcagggaaggcauaucaggugaagaauccaacuuguucaaauaugcuaggcaagauauacuuuguagauugaaggaagaacugaaugcagaaaacccagcagaagagaguaaccacaaucuauaggugacaagggguugcugggaugauagcaaaguaaauggaggaaauauucuuagauguuuagaacaaagaauucuagugauccaguggcugauugaguagcaaggcugcauagcaggagacucaagauugacucagguuuuccacccaggacauuuggaauaagugggauaucugugacaucauucagauaguuacaaagaugaucuuggggauacacuguguuugagacauucauggguucaauuucugcuccucccuuaauuauuagcagggccuuugaacuauuugaguuuauuccaucaucuuugaaauagggcuaaguagucuccuuguaguaagugauuauuaaaguuuaguaagacaaugagucuuuaguuuaggguagauccgaaacacauagaauaaauagaguauguuguuucuguugucaugaauguuauugcugucacuaucauccuuugaggguggggccuacaggguuuacaguguuuguaaagaauagcaucugcaggggauaugagccuagagaucacauacuagacuugggcugaugugauuguagagucugcccuauagaagggcuggcugcaugagcuggggggauucaaucuguucuuugagacaucaaguauaagagagaucacaggcuucagugaaaaacuuuaguuacaccuacugccaugguagauaacaaaagaugcugugagcagaggagugugggcaucagaagagaaucagacugaguaauggaaaucgagacaggaaggaaauuacaagcugugaaucacauacugaagcugagaccuggguggaugcagaauucagaauggcuagcagaucagaggguggcccagaauuuucucucuucaccuucagacuggcccaccagaaguguauccugagcugacauuugcaggaggauuucuacagauuacaccagagaacacacacacagacaugcacacacacaacauacacagacacagacacacacacaggcauacacuguauacaacaguuaaaggaacaggcuacagguacugauuucuuucucugauucuaguacuuuggaaguaaggagaucaggaguccaaggccauccuccacuacauauugaguucuaagacaaccugggcuacaugaaaucauguaauaaaaagaaaggaaggaaggaaaaacaaagggagaaaagaaguaagggaggggagaagagaaggaaaaagaaagguaggggcacuuuugcuuagaugugcggccucuaaggugguaagguagauacauuucagcauuugaagguugggcauggagaugaaguugaaccauuugugacuuugggugggaaagcucaccauugcaccuagaacaagcagccuuuggagguaugagcuuccuguacuagagguuuguggagucugcuguguggccgcaaagcuggaauuaaacucaugacuuggauuagaaguuuguccuagaucaaacucaauccaccccacagccaguuuuugugcaucccaugaaccaaaaacaguuuucaagagggagugaugaggaacaaaggaauuugggggaaggggaagguuggcaaugauguaaacacaguauuccuguaugagagccuagaaaauuucaauaaaaagucuguuuugagacagguuaaaacuauaguaauccaauauuacacuauccauaaauaaaaucuuacagggaugcaacugugcuuauuuguucuugcguuguuccuauugcaaugguagaagagaauacuugcaaaaaaaaaaaaaucaaauaauuugcaaaccuuaaaugccuguuaagcauuuaaagaaaaaugugggccaaccaaucccauacccaagccauccaguggucuuuuuaccuguguaagauucugugagagagaaagguuuugccuuuuggcuggauguucucaauucauuucccuugcugugacagauaucuugaagagaagcaacauuagaagaaaagauuuaugcagcuugcaguucuaaguugccauccaucauaacaaagaagucacagaggcaagucuuugagacaacucaucacaccauagucaagagcagagaaaaaucaaugcauccaugcugucugcuuguuugcuuguucagcagacuuuucuucacuccuauacaguucagggccaagccuggggaauggugcugcccacaguuggcuggggaauuaacaaucaaaggaauuccccacagucaugcccuaacaacucaaccuaaucuagauaauuacuaacugucauaauaaagaucauugucaccaucaaagcagacugcaguguuagaaaauaagcaggcugugggguggaaauagagagccuagggaagguggagugagugggugccuuugcugaccacgaagguguuuggagaguaggguaggaagauguaaguuuauccguggcagagaaaacagauaagccuuuucuguucuugaugagcagauaguacucauaauaucugcuuuauuuuacagccuaguuaaauguaucuguugucacaucucucagcaagaggggauuuucuaaauguucuuguuuacaaaugcgcagaagauuuuugcacauaaagucaugcuuuuguuggccaaagagaaugagcacuugcugguucucuggcaauccuaacaaaaauacugaaguguauuuauacuccggggccaagacgcauuucaaaaugacgcugcucagauacaugaucaaccuuccucuucugucuccacugggcucaaccacagugucagagccuuucuuccgaaaucuacuccuacaaguauguuagcugaugcucacugcaaucagucacauaaacacaaagaggcuucccugcugggaugcucuguggauugcucaccaaccacugagggaaguaagcaacccaaaucuacugaaaauauugcucaaaauuggcuuuucaaacacuuuuuuuucuuguauuuuacagugugguuuuuaucaacaucacguaacagucacgaaauauuuguuucucauuuuuuuugaaauguaaugauauucaggacugaauuacaaaucacacacaggagcuuagucauggcucuuuacacaaggcaaaagacaaggaggugguuaaaugcaaguaacuucuggcuaucugugccaaugggagaagcagauacucuacuaauaaaaauccacccagaaacaacuagaaugcguugccucauaguuuagacuauccuuuucuggggugauuauucaacaguuguuaagaaacagcuucauucaucucaauucagcauuuauucuuuaucuccacgguaaccaucuaagauaauucuguggucuuaacuuuuuaguagguacuuccaggagacccaguggcaucccugcauguuacccacauuuggcaguuguugccacaagauauguguuuugcugucucccccuccaaucuguuuaaggcccucucacacaucagccuugaugccucucugucaaauucugugggacguggcagaggcuucacaguuccagaggguacugcacagaacaucggcagucacagucaagagugaugggugagagauuugcauucaaaucccagguucaccacuguccaccaggaaguuuccuacucagugugugcaucuauaaaauggcccaaaugaugucugucuaguacauagggaugccauaaggaucucaaagagaauuuaaggaaauguauuuugacgugacuacccauagucaagcauucauuaaauggcuaauaaggaaaaaaaaaaucuaaaaagcacuucgaccucacuuacuuuuagaacaagcaagaaaaaaaauuccuugcuuuaaauacugucauauuuuaagaaucuugauaccuuugucauagagaagcuaccaagauuuuuauaauuauuucuuuuauuuuuuaauguuauaauauaaucauauaauuucugccuucccucaaaccuuccugcauucccuuucuugcucaugugugugcuugugugugugugugugugugugcuugucuguguguguguguguguguguguauccugcacagucuguauaauauuacucaugaguuuauuuucaggguugaguauuugguauuagauaaucacuagauaaccaauuggugugcucauuuccuugggaaggcuauuuuucuugcucucagcauuucuuaguucccuguaguuuuuuguguagaguggaggccugguggacuuucuugcauccacuuuagcaugccuacugguguccuuguacugcuguucauguguagccagucaucuuggugagaccuuaugguugcagcuucugacauuccugguagacacaaucucacagcaaacuccaugacccucuggcucuuagaaucuuuccucucccucuucccugaaacuuaggugggugcaggaguuguuuucuaaguguagccauuaggaauggaugcuacgacuuuauauuuuguuugguugugguuuucuguaauggucuccaucuguugcaaagagaaauuuucuaggauaagggugaggaccacacuuaucuguggguaugaggacaaauauuuagaauguaauuagggauuaugcugguuuaggaaaguggugguuggauguuucuccgccaauaugaaugacuucacuagcccuggguaguuggcuaaguuuccauaaaagcuaucaagauuugggagaaacaaagaccacauguugagaaacugaacacacuucugugggcucuuugaaugauugaaaacaugcugcaagucucagcguugguucuacugccuguagcugggucuguagaauauagaaacuggacugaaagcuucuucaacagucuuccuccaugccuccuuucaaauguuuaaaaacaaaaacgagcaaacaaaaacaaaacaaaacaagacaagacaaaaacaccaaauaaacaaaaaccucaguagcuuauaacuacauucacugugggugugaggcugaacacauaguugauagcaugaauaaaaacgccuauuguagauauacugagaaagugaugugucgucuccuuuacccacuccacucuuucuacauggucauccccugcuucagaguugagaaugucuaaagaaggaacagacagcuaauccagagcauauggccuccaaugaggccacucuuguucucacaggcuugguaugaucaauaacagaagcugaaagcacaauaauacaccacaugaaauauuuuagugagcaacggacugcagguagaaaggugcuccugugagguuuaccaugaaguagcugugagcugccugccauggaugcugggaaccaaacucagauucucugcaaaaucaacacguguucucagccauuggagcaucuccucagccuuguauuuugagcuuugacaaagguguauguuguauaaugaccaccauaaacaagauggugaaugcccugccauuccaagcauucccucuguagcucaucccucuccugauuucucccuucaucauuuggccuuuucucaaagggcauacagauaucaccauagaacuucuuccguguuaucacauguauuaauaauuugauaguaucugagcaguauuccauuguauggaucugccacaguuuauccauuuauaaguggggggacauauggcuuauuuuucauguuuguaugauuaugccaccagaaacauuuugaaacagacaaaugcagcuuuucauuucucuuagguauuaugcaguguuauguaagguggcugugucauuugacaacacagcaauaaugagugauacauuuguuacuggacauucccacaagcacuucugcuguuacaaaccucagauucuuuuucuauaaaugggacaguuauuaaccuugguauuauaaagacauuaaaaaguaacccagcauacacagaagugcuugguacacuguaaagugcuauuaucaacugaacacuguacaugauaguguucauguaaaacauguuucucacaaaagcuaagugcuacacuacaaugccuccccuacauauuagcaaagugaguuauuccaaaucuaaagcagcaaguggguuugccuuagauguauucagaaguuuguguuggcucuuguuuuugaacuuuuguagaaacauaagcgaccaagauauaaaucaucaagugugaauccaauuuguaaagaaaaaugagccugggugagggacauuagcaggaauggagucagcacaauagacaacaugacauguuacaacgacaccagugcagcccccaccaggcugucuccucggugaugggcaucuagaaugcugguucugugccaguaggaggcuguccaacauggguggcuauggugggcugggagacacuggguaagaaaacagagcuaaagauucaauuucaacccuuuucaaauuagaaauuuacuuuucccauauagaaccauaaacguggaauacguuuaaaaaaaaagcugaaagcuauuuccuuugcaucuuaaagaauucuuuuuuaguaucucacagagauggugauguauagaaacacuuguagaucuuuuaguauauguauggauccaaaaagagauagaaacagcuaacauuccaggacaaugggcaugccuagguaagucuugguucuuaaaccauugucuaauauaaggaaccuaagcucuucaagaagagcugacuuugguacggagacacauaagauuuagaaugagccuggagccucuggacggcgcagacaguaaggaaucguucacacugaaacgcaguggugggacacucaaagagacagcagacagauggcagagcucccuguggccaaagcuggggcaaucucaaacaaagccaggaauugaguauauccuagaguauaagauaaagggaaacagaaaaaccuuuauuuugagcauuuuaccccacugaaaauccccucugaggaauuucaguuuaaucuugaaaguuuuaacaagauauguuugucgaagucuguuggguuuugagccuaaugagccuuacaugaaauauuuacaaugaacauuuuauugcuucucacuaagacacacaaagaaaaaaugauuguagguaucaaaauguucgucuguuucuaaaacugaaagaaauacagaggaacuuuuuuuuuaagacaggagauuaccauuucaaacaucaggcaugaaaccaaagguuuguccuucugccaaguuaaagacaaaauccagcuuuaguguguuguuucaaauguugcuuaguuuucccuuucaccuuaaugaauuagagcaaauaacaucaacuuguaaauguuguuuaaugugacuguuuaauacuuguuuaauagaacugcuguguggguagaacuggucugcacaauaaacaccuggaccuuuuaccaaccucauuucugacggcaugcacuuugacccugcuggccaagauauaagugaccccauuacaucccauguagcuaaauacccauccuuugcuuucuacugggcuuccgguaagaaagauucugacagcauguauuacauucggauugagaaggcucugugccagcccgaguuaagaauuccaccaccaccauccucuagaagcuaggguuucccauaaugcccuccaccucacacccucuugugugucuccagagcucccacacagagugacacaucagguggguuauggcucugucauauguucugcccgccaacugugacucucuuuucuacaguguguuaugaggccccauacugaauauuuaucuacgccaccuucucuccuagacuccuuuaucauuugacauauuuuucuauacagcaaaacauaaagguacaaaugggaauauuuacuucauauuacaguucuaaguagaaauugcuaucuuauaugcaauuaauuguucguaggugauuugguagccuaaccuaccuuggugugcauguguuugcaguucuagaagguugaacccagaguuucacacaugcuacacacaucuguaauaccgaguuacgaguccagacucuaaauaagauauggagugcuucugguugaaauuaacuuuuuugucucuuaguuucugaugagcucacacuauacuucuggaauaaaauguaaucguccagaacacccugguuccuaaaggugcuugaucuauagcaucauaauuauaccuaaagccccacauggacuugcuaaguugcuagaucugggucuucauaaauauagauaaauagauauaaacagguuauggguguagcucaguugguagagcauuuaccuagcaugcaagcucuugauuuaauccucaaaaccugaaugugauguuccaucccagccuacaagagguggaggcagaaggaaggaccaaggugcaagguuugucuuguugaaaaaacacaugacauuccuauuuuaaaauagaaaacaaaaaacaaagagcaaacaaaaagcaacagaauaaaacaaagaugugagggugugucuuucuccuuccuggacugucaguccucugugcuaaugguggugauagagagaagagcacuugggcccauauuuggcugcccuucccaggaacagagcaaagagcaaaacaagcuuagugacuugucacagcacgugaaggccgaagacuuauuagucccuaguuugaaauaguuucacagagugggaaggacaagaagccucagaucuuugucuaaguccuuccacuaaaccagcuguuuuucccuuuagcaaagggagcuuuauuggcccuuauuuuccuucccaauaaauaauagaaugacagcaccaaacuguugcugucuuaucuauguuuccuucuacuugcagaggcagaaaagguacuuuaaggaagcuuucaaaagucuuagaguaaaaaguacuagaaucuuggaaaggagaaaauagaugccacugacuacagagauggucagagcuuccugaaaaccuaggcaaaaagacaaguaagaugauaaguaauguucucauuggaaaaaggaaggaaagaaaagaaagcaaaggcagaaagggggcaaagaagccauaucagaauccacgaugccuccuauagcuccuggagaugugugcccugugguucaugggaaggcgucuuccaggcagaaggguuugcagcaggaaugucccuuggacugugucuaauacugaaccuuaguagaggauguauccaaagcaugacucuaaguacucagaugcacucauacagaccugccaagguauacugcucgcugacagucuuucuuggccaagggaugaggccuagagaaucuaaggaauggaugccuggcguggaccuuggagcaucuuccuggaauuccauacgcauuagccagagucucaucaagugugauacgcuacagagaguuuuauauugauauuccuggcaagccccuuugcaugcuaaagcaauccagacuuguaaacaucauccaucccaccagcuuuccaguuuccaggccacuguugucucgaggccaaggaacuaaauuuuuaugguaacucauaguaaggugagaaggaaagagacuucauuuccuacucuaugagauguuauauuguugauuuuuuuuguguguguguguaaguauacauuacuuucuaugauaaaauuuaaauccaggacccagugaugggacaaggaaagagaaugagauuaaggaucguugcauggaaauauauuugauaaugucuaguuaacacaugaagcauagacuaguuuugucacaucgauguuauuccacagaugguugaacgacuaaagaaaggacauagaaaacgucuggugguagaugcuaucuagccaccucaucgagcaaacaaaccuucuuuaaaccucuucgcucugguuaaggcagagccccuacacccuuuccaagaugagcagucccaaguguaccuuugggucccugucaacuagaauaacauuucagagguaggcugccaaauauggcuccuccaauccagcccaguuggaaacauaagcccugucuacguuccucagccagccagcacuugcaguagcuuuuugagggagugccucuaauaccauccacuuguucauucagucauucauccagaaaugcugauagggugcugugcgugguuuucggcucuggggauccuguaguaaaagccaaacaaaauucugacccuuguggagcucacauuuuagguaagugaagacaugauaaguugcaaaacuacagaguguauugaguaagugauguguauugaguaagaccugaucagcuaauuaagauuccuaucuccaauugaaaauggucucugucaccugcccucuccgguguguugucuggugugaugcaguaagcagagcccagucucauccaccacuuucccaacagcagaacaucaccuaugucuguucaugaggaaugucagacacagcaggcagaaaaccauccgacagaaugaaagccuguaagcuuugaaaugacaugaaacugaagggacgauggcaacuuuaggaugaaagagaccaaagagaccugagaacaaaauccaaauaaguagcagccgcuacagcaucugggagcucacugcaaauguggacuccuccucugcccacaucucacucucugaggagucacgauucucauuugaacaagacccucaaccacuccugacuucaucuagguccaaggcccuacacgaagauuccuaucuuuaucagaguaacucagaaaaccuuuaucaggacaauuucuacucucuucucacaaucuguugaacuagaucacaaaacugcagacuccacaguguggagugugaacuuggacauuuuuaaaauaucuuucccaaaugguuccaucaugugcugcauuuaagaaucccuggucucuagaugguauugccauuuaugaaaguauccaaagccguucuacucagaauucagaacacagauuagagagcugcauauuaauuaugucaccaugauuccugcuuugagcaccaguccaugaccccaaguuaauacggcaaugcagucauggaauguagguaaauacugcuggcucacauuacaggagcuuucuagaacauuuacauggauuugaaaaguacuuuucaaaggauuguuuguucaaacaucauucucuuuccaauccauguuuggcauagaguuuaaucagauuuacagcggugaguguucguuguaagguuguauguuucuuuucuuccagggcaugcaaaccaggacaucuggguuucaucauuaaaauacuagacagguccagugauuuuaggaaauuuaggccagauuuuauucaccgcagguguuggauguauuuaauagaaggauggauccacuuauuuguaguuuaaaggcuaaaaaaacuacgcauaccaauuuugucucugcaaagugauuaaccaaacauuuacuuuuuuuuuuuuacuacaucaccaaacgcuuagaaaaauaggaggaaagagaaagauguuucuuuguuagcuuuuuaugaaaauaugcacuauugagauaguuuucacuuuguauaccucucaucaaccaagcaagacucauuuuuguuuucuucuuuacaccuguaaauuugccuguggugucucuuggaccuaaaagcaguaucuguuauuacuagauucuaauacuagauuccaaaauacuagguauuuucuucauuuacauuucaaaugcuaucccaaaagucccccauacccuccccccacucuccuccccccccccccccacgccuacuucuuggcccuggcauucuccuguacugaggcauauaaaguuugcaagaccaaggggccucucuucccaaugauggccaacuaggccaucuuccuggguuuuuaaggauagaaaguuuccuuuuauauauuguuuccuuuaaaucuguuacucauaaccuaccuuuaaacugaggacaagggaaggggaccccguguuuaguaaacacuagagcugagccagcaccccuggauuccucacuguaucugguacagaacuucugcccaagucagcaagcccaaacugcaauccuuuguuguuuggguuugcucugaagguuucuuuuucuuuuuuuuuuuuucuuuucuuuucuuuucuuuucuuuucuuuucuuuucuuuucuuuucuuuucuuuucuuuucucuuuuguaauugaugucaucuuauaauguuucaauguuguguuugucuguuucugccaugugaacucuaaacauuuccaugaaaauauuucuucaaggugauugccugaaccagguauaaaaccuuuaucccugaggcuaagguuuacuagucuauaagggaagcuuggcuggugucuggcucuuccauacuuuguuguaaggauauguaaaaccuuugcauugcugucacuguaaacagcccugcccugccccaggccaucugucacuuucacaggacuugucagcaagacucuaaccauugauugacugcccugaagagaacaagcaggcuuccaccaaucccuuuuaaucuuagggcugauggccucagucuccaacacaaauccccuuccucuuuggaucugaacaucaugucagccucccuaggaucaaggcuuugaaucucugcagcucuuaaccuugggugugcccacggagcucccuauucacugugggugcugacagacagaugugcccucccauuuugaagcagauccuaaccagaagguucucagggccucuugcugcugccuuccucccccuguggaagcauggcgaacccuuuggucucuucagucucuaccauagguaauuagacaaaugguagcuucgucauuaacucuuuccuguuuuucauggaguuuccuucuaggaagguccuaccucccuccacccucccugacccucuucccccauagagcacagcugauuuuccucucuggcuggagcuagaggcaaaaauugaagccccagcauaucugaaguuuugcagacaggucugucaaagccaccucuuggaaguacacauacuccagacaaacacacacacacacacacacacacacacacacacacgcaagcccacgcacgcgcgcgcacacacacacaucaccaccaccaccaccagacugcugagagagagcuguguccuggcagauccugagcagggaacucugguuuguauugcccauuguccuagcauuugcccaggcauugccacuaacuuaaggugguuaucuguagcagguguagccacucccaacccucaucaccucucucgccaucaucgauuccuggcaugccucacuucucccauuugagccuauaucugaggacccacagaggaagaacaagugcaucagagcuucuucacacagaagucuagcagguuauaccuacaagauguucagagaucagaagaccuggagucuagcccagcacugacacuugcugagugaccuuuguaagacacuuaaccuuuuuuuuuuucuguuugucuaucaacaacaaaaaaggaaagaaaagaaggaaaagaagaagaaaggaaggaaggaagagggggaaggaagaaggaaagaggaaagaaaagaguggggaaaggaagggagggagggagggaggaaggaaggaaggaaggaaggaaggaaggaaggaaggaaggaaggaaggagauguaaggccuuuuuaaauugcagcauucuaaaguccuugcugagucauugcuauaucauagaccuugguaagaucuggucuguuuuuuguguaauugccucaugguugccuugacaacggaaugacagcagccugugugccucagucuccucacuuugaauuauaaggaaaaucucccuuugugucuuggauuuaaauuuuucccagugacacacugauccugaaucuguagcaccaaucauaaaaggcuaugcugcccuuucucacuucccaaccuuuugcagcucuccugccccaggcaguuuuccagugaugaagaaauauguuuccaggaggccagacgcagguaucagaacuguaauaagacugccagcgggcaggagcccugggauguguccacaccaggugaaaggugcucagagagaacugaggcccucauuucaagcucuucuagcuccuaaaaggaagaaaaaaaaaucacauagccacaggaucaagggacacaccacuagccccccccccaccccccuucaucggcaucuuaaagguuccaagaaauucugccagaaaaaaaaaaaaucuuauucuaaucccaguguuuccugaacuuacacggcugcagacacuucacaaaauguggaccaucugguagaguauguucccggagcaugguuugggaaacauuacaucagaauacugcugaccuauuuucugucuggggucuucagagaggaaugggauaacagcugcugggauagucaccaagcaccuucuaccuggcaaacaugggggaaauuuaaguuuauugugugugagagagacagggauggggggugggagagaaagagaccgcaguccgaacugcacacugagcauuacuaacaugguagcuggaagagagagaggacgcagaggagauggaagaagaagaaaagcagagcagaagcacauggcuuggagaaacugcaaguucuaaggggucucauagauguggaagacgguaguguagcgguagaucugcccaaucuaggcucacagcauauauucauauuaacugaguuguguuuucauugcuggggcuuauuugggauggagauuuccugcaacagguagccaucaaacaacuuucaggggugaaucugaguuggaguauuggggggagagagagaaagagagagaguguguguguuuguguguguguguguguguguguguguguguguguucauucauggaggucagacugucuuuucuugacaauucuuuaccuuuaaaaaauaaccaaaagaaaaaaaagaaaaaagaaacccaaacccacauuuguuuauuuguguguguguguguguguguguguguguguguguguguguguauguuuguguauguguguguagucaugugccaagguacucauauagaagucaaaggacaacuugugagugucaauucucuccucauguggaucucagagaucaaacucaaguugucaggcuuggcagcaaaugccuuugcccacugagccaucuggccggcucuccaacuucauuauuugagacagggucucucacugaaugugaaacccaucaguuaggcuagaauggcggaccaaugagcuagauggguucaggggauccgaacuccucuccugaagcuugaguaacaggcauuuaaaccccugagccauccaucuacccagcccuaacugguagacuuuuccccgcucucuuccugucucccuuuacuuccucuuuaucagccucuucaagagaaaggaagaaucauuaucccagaggcucuuaaucauggaaggaguggaucugcaaugggaaaaaaagagagagagagagaaaaagaaagaaagaaagaaagaaagaaagaaagaaagaaagaaagaaagaaagaaagaaaggaaggaaggaagaaagagagagagaaagagagaaagaaagaaagagagagagagagaaagagagagagagagagagagaaagaaaaagaaagaaagaaagaaagaaagaaagaaaggaagaaagagagaaagagagaaagaaagaaagaaagaaagagagagagaaagaaagaaagaaagaaagaaagagagagagagagaaagagagaaagaaagaaagagagagagagagagaaagaaagaaagaaagagagagagagagagagaaagaaagaaagaaagagagagagagagaaagagagaaagaaagagagagagaaagaaagaaagaaagagagagaaagagagaaagaaagagagagagaaagaaagaaagagagagagagaaagaaaaagaaaaagaaagaaagaaagaaagaaagaaagaaagaaagaaagagagaaagaaaaagucucaguguuccauaagguuuacaauguuaagagggaaucacguauuauuuuuuaauuaucaguacugguuggcauuuauugagaagcacuuggcucugugcacugcaugucuuuucacauacuaucuuuucauuagucaccauccauuaaaauagagggcaucugauuguaccuaguuuauaggugaagaauuuggaucuccggguaauuagaaagcuuacuccaggucacaaaaaauaaugagaggcagagccaagaaaugaaccuuucugguuuuggcuccaaguccuguguucuuugccaccugguacaauguccuaucuccugcacagguucucugcccaugggagagcaaagaggcugggauucucuuugucacauuuguucucuccugugaaugcccagaucacccuguguacauguacugaacgagcuggccguucuucucaguggucuagaacauauccccaugucuaggagggacaggggggaauugaucucugggaaaugucagugucuuuuguuucuucccacagaucugucugacaggaacaucugccaacaugcgcaggcuggguuguuccucucccuuccccuucugacugauuguuggugugggcugagacguagccccagcuuccugcucaacaugugcacagcagaagcugaaaguguguauuucauaccaagcuacguaauguaaugccuuucuggacucccuuucacgugccuguggccgguguucaccuacacuggacucagcaagauucacaacacaucuccaaagcccuuggucccucucaguacuccugacagacaaauuucacuuauucccuuuucucaggaaguuuggccucugggcaaaguuucuucaaucaagagacucagccagggaaccauugaaugaaugggccaaagccauuccagagagagagagagagagagagagagagagagagagagagagagagagagagagagguuuuucuacuaucuucauucuccagcauugaaguaucucagaaaaauagaaucuucuaggaugguccaaauuauccaucagccuuggauauuauccagugucuugacucccuugcuguauuccccuaauaguagggauuuuucggggguaaagaacauugguaggugauuguaaucggucacaggugauugugauaggucugggaucaauagccuugccucacuuuuuguaccacaggcaccagugcugugcucaauuguaugaguugucuucugagaaggacaucacuaacagagagucaacugcuguguuucaugccuaacacaaaaugagauacaugucugugagcaccuuccacucaugucagaccugugcugggaggcaggagcaaagugauccuacuucaggaagcuccugcuccuaugaggggucauggccacuaugcaacaauaccuuauguuggcacagagggucucugaauucucugugaaucugggugggcuuccuagaggagaugguauuggacuacuggaaacauauuggauagaaugggugugcgggggcuuugaggccucucaaaggcuaugcccagcucacucuucuauauucagaacuagaaacagauguuugagucuggcugcagagaugguaggcaggagcaaagcugagugaagaacgguaucuguggaaaggaugaagcagagugauucaaaaucagcacccaugaaacacuggaguucaaaaacuaacucagacaaucaaagucuggcauggggaguccuuggagcaggccuguuugggcugaucccaccucugacacuuauuguggccucuguggcuaaaccucucuugcuuuccuuuuuuuuuuuuuuuuuuuuuuuuuuuuuuuuuaauaaaccaagagagacgaugacagagccagcaugagcuagcucuuugagacaugacucuggaaguaaguugcaggcugcacucucucacgugcuuucuucugcucauucuuuccucuucaagagucuggaacuaggggaguccaugcccugccuaggaggucagagauagaagagugacugaauaaagcauuaaugagcaaccagcaggacuaaaggucgcaaucccuguaccuucagaacacgggcauuuuguuucugagugagaucuaaccaguugcauuucucagagcuuguagccucuccaaagcgguugcuaaggggcuuuuuuuuuaagcuaugagcucagaaugucucuccaagguucaaagcuauaaauaauucacuguuaauuccuauaggaaagaaggaaaauaucagaaguauacugguaguuuaaaaacgcaucuuucauuuucguuuccuaguucauaaggcaugcuugcauagccuuucugaacacuggguuccucaucuuaaaaugggaacaguauuagcaucagcuugcagggcugggcuaauagaagaaauguugugcuuuucauucauacauaucuaacacaucuagccuauuauucuuauaauuaugaucuuuaaaaccaaaaggcacuggggauguagcuuugugauagagcacaaacaacauguacaaggaccuggcuuugaucaauacauacuucuauaaaauaagguauguaugagacaagucuuauuuuugaaguccauuucaaugauuagcuuuugacugaauggccauucaauuugacuggcugugguaagagggaagacaugugagagagugcagccugcaacuuacuccuagagucaugagucaaagagcucaugcuggcucugucauugucucucuugguuuauuaaaaaaaaaggaaagcaagagagguuuagccagagagccacaguaagugucagagguggggucagcccaggcaggccugcuccaaggacuccccaugccagacuuugcuugucugaguuaguuuuugaacuccaguguuucaugggugcugauuuugaaucucucugcuucauccuuuccacagauaccguucuucacucagcuuugcuccugccuaccaucucugcagccagacucaaacauccauuucuaguucugaauauagaagagugagcugggcaagaguaaugcugccucagagcugcugggaauucuccuaagcuugccucauuaaaaaugaugccuggguaucccaguaagaauauguucaguaguugauaucaaaucacuauguaacuguggcuacagaccugauuucugaguauuuaaggaauuuauggcugaagaauucagggauaaacaacuguguuuugcuaacuauggacaagagauccuuccagcaguaggaacauggccagaaugugcucuuacccucuaggaaguuaauaguacagagcaaauggacaugcacacaacuggccuagucccagggaaaaauaugcagccugaggguucuuuuguucacuucaguccuuccagccugaaugccuuaaacaguucccagcaagugcacagucaugcagaauguguggaaagaaugaugcugacagagaugugaacagccuugggaggcaucuuaguuagggucuuauugcugugaagggacaccauggccaaagcaacucuucuaaaggaaaacauuuaauggcuuacaguucagagguuuuguccauuaucaugcugggaagcaugguggcacacaggcaggcauggugcuggaaaagaagcaucaggcucagcaagcaacagaacagagagugaaccacugggccuggcuugagcuuccgaaaucucgaagucauccccaccugcugcaccacacucccacucugugacagacccuccaacaaggucacaucuauuacaacaaggccacaccuacuccaacaaggccucaaguccuaauccuuucaaauagugccacucccuaugacccauggggccauuuucauucaaaccaucacaggaagucgacugggacccggcacugguagaaaaaccagacuuccagagauguagcaaaugaaagugggaccuuguacuaauccagugaaauauuauuuaauucauuauuugugauuuuucuuccacaaguauccaagauguaguguuacugguccagcauggugcacauagcaaguauuuguuaaaagagggagaauuuccuuaaaccaaaaaagaaaaaaaauugucaagauuuguuuccaguuguguuuuagcaacaacucaauuaaaaacugcucaacagcucccaaauagacuuuuuuucuaacauaaggaguaguuguagaguuucagguauggcugggucuagguaccugaaugaaugagaucagauaacuuauaacuuuaaaauuccauuuuguucuuaucgaggaaagaaaagguaaccugagaguuuccuguuaggaaagaauuggggugcucauggauucuucuggucuggcagaaggucuauaguuaagaugugagacuuagcaauucuuucuucugggucucugaggucuauaucuggaauucagccacuccaucacucacauaacacgguuaauuguagccauagcagcagcugcugccauggucacccagaaaacauccuuccagcuccucucuacgcacaaaagaccaccucacucucauaguagcuuuaugugaagagcagugugcccauuuuacagaggagggaacugaggcucagaguggcuaggcaacuuaucucugagacuaggagaaacaguggagcuggaggucaggugcagcucucuucaccucagaugucugugaaauccacuccugcuccuugcuguuucccucuggcuccuucuuccuguuuccaaguggccccagguacuuaggauaaugaggaggccagagcaucuggcaugaaguaugagacuaugucacaggcacugugcuggaccucuucccagcaccccaggguaccaacaaaggacacugagugccuguacucgcucucagacuuugaugcaguuagugaguuuaucuaaagaugcagauuuucaggcccuucccugaccuuagagggccugauuucuuaagucugggugaggccuuggauccacauuugaucagacauuaccaacaccugugauccccacgugagugccccaccuuugagaagcagugacaugugugggcugccuuggucugccuagggcaguaaugaguauacucuccacauaacuuagcuacuggaaagcagcuuugucugacuuucauugacuucuauauaguucaccauuggagcccaaucuuugccauuagagugaccagauacccauugggaaagguccuucugacuaugucuauacuggcauguuuaaaaaaaaaaaaaaaaaaaaaaaccucuuggcagaaauuaaucugucuccuuuuucuggaccugggaacagcaauaggaagugcuuaggcuuuucccaaauauaauuccugagcccugagaauccucucuacccacggccuccugggacucuggauggccccuccguuggccagaagcaccaagcauccccauccuggaaaugugggaaugauggucucuguccuugagaacucagggucugcugagacagagcagacucaugugaaagucagacacacaaacauaacaaaaauaaacuggauguacgugcgugcagugaaaagccaguacagcacaacuguggccguaagguccuacacuaagucucagagaacaggaaggaacugaauggaaggugccaggugacccagagaaugccuucccauaagaaguaugugucguucauuuguuccucuacuugcuucaucucauuagacuucuagaugguagauaauagccagucacugacauggcuacucacgguaaauacagcaggcuuaauuaacaucugccuucacaggaacccaccaccaaaugugugcuagggucagggugauauaaggcacuggcuccuuucuagaucauucauucucuguagaccuaugccuccacguucgaugaccaaauggucccaaucccauuuccagguccauaaguccauacacaugguucaaaaaagaagucaauggugccuuaaaaacagugaugguuuugucagguuccuauaggcagucucaccccuuccuucuggggcccgaggcccaagaacaaaaaauggucuaaaugauuggccuuuucaaucuucccaucuugguuuauagcccauccaguuaauaaacauuucagaucucuaguucaagucuguccauacaccacugucaccucauggccucuuaugguuuacagucagucagauaagcugagacacauaaaagguauucacggagcuggaaauggacuugggaccaucuggucauugaacgugagaggcaugggaucuacgggggaugaaugaucuagaaaguagucugugggcagucauguccucucuacuccgagacuucucaccagagggagcacagcuagaccagugucagugagggucggugagucuuagagguaagaucuugaugacagaucuagggaaguucuuccuaaaggauaaguagaaaugagcuaauaaguuggguaggagggagccuuccauaggaggaguagcaucccaaggucccugaaauggacagaaaccggguuuaacucuaaaaguaagggcaugaaaggugagauaaagcuggagaauggacuugagucuguggccaagagaaauaucuuacuguauagaagacaaagugaaccaaggaaagaucacuuugaaugcugcaagaacauuccuuccuggcugaacuaugaggcaacgaaugacaugguacuuggugugggaagagagagcaagauguucagucuggcuaggccucuaagacaaggaugggaauaacaaaagugaaguugcacaugcuggcauaccacuauaguuauacccacugggaaggggaagguugagguauaaggacuguaaguucaaggacagcuuaaacaacuuccugagacacuaucucgaaacaaagaacgggcaugaauguuagcuaaugguagaggguuuaucuagcauaugcaaagcuuggaauucagucuucaguauuggaggaaaagaagguugaaagggaggaaagacgggagggagggagggagggagggagggagggagggagggagggagggagggagggaaggaaggaaggauuuggaaaggagcaauuguagagaaacuuuaggcuauagucaugauccauggguuaggaucaucagaguaagcacaagccuucagggauaagcucuuaaacugaggggcuggagcgauggcuuagccguggggagugguuuuugcauaaccaugcaugaguccuggaguccagguuaacuuuagcucccaggaucuauguuaugccuacucucacgcagaaacucuuacagacagacacauauaaauauccagucaacaaauaaagagagagagagagagagagagagagagagagagagagaguguguguguguguguguguguguguguguguguguguguguguguaugaaucgauccaagaaucugauucucugcuuauucauacugaccauugaaauaaggcuaaauaaucuacuacauggaacauuccuguuuucugggcauucccuauaguagagcaaucgugcuguauguguucucauguuuuccuuugugacugauauggugaaacguuuucugagcugguagcacccuucaucgcuacuugguaaauauaacuguuauuuaugcugugggcuacauuugauaccaccaaaauuuuuugucuguuuuuuuuuaaaucgcuuauuuuguuucacugguaacauucuuaucacuuagcaccaauaaaaucauaaauauaaauauucuaugucaucauaagaauugcccucaaaguuuguaagcuaugugguguguuugggcuauguggugugugugugugugugugugugugugugugugugugugugugugugagagagagagagagagagagagagagagagagagagagagagagaguuaguuuaugauaacagugcuuauauaaucucaacaaccaagggcccuggggacucacacucagggauggaacaguugguuuaaauuauguuuccaugugaaauacaguauugcuauuuuuucccuagcaugugggaaaguguaugggaaaugauuugacugauaggaaauaaaucugugugcgugaucaggauugagacacaaaggagggguggguucugcuucucugggaggaaggccgcuccugggugaagguuaacccuuuccauucacugccugguaggaauagucagaauaauucaagugacuuucaauacuggccgaaagucacaggacucagccaggcaguggucucaggcaggagcugggugacucugaagaaccauuuuaaaucuucagaaucccauuucuacuuggaaagaaaaguuugacuugguucccauucuagguuaagguccaucaaacacaaaccaagcuaaaggaagaauuggcuagcugcaccaaaccgagaccagucuuuguuggcaaacauuucuucuuaguccagcagagccaagguuucaugaacugacuguuacauggugaggaaacgggcuuggagaacaagcaagggguuuugcuggcagcuacaggggagcucagguuaagaaccccauagacuuccucggaugauguaggaaaaguuugucuugguggccugauuccaggucuguucagauuuugccugcagcuagcaucccuccagagcaaggagauaacagaggggauacucagaauguccuggauguuggagugacagguuuuacuucagcuuauauuggaaaggaguuggcaguuucugacuccagugcaacaaccaccagaauguagccauguuuaaucaguaccccgcaccauugccaccauuuucuuucuuuuuaauuggcuauuuuauucauuuacauuuaaaauguugucccccuucccgauuuccccuccgcaaaccccuaucucauccccccucccuuuugucucuaugagacacccacccauucacccacucacacaucacccaucuagcaucuccuuauguuggggcauccagucuccacaggaccaagggccucuccuuccauugaugccugacaaggccauccucugcuacauauccaccuggagucaugggucccuccauguguacucuuugguuggugauuuacucccugggagcucuggugaguccaauucacugauauuguucuucuuaugggguugcaauccccuucaacuccuucaguccuucuccuagcucuuucauuggguucccugggcuuaguccagauaguuggcuuugaguaucuggaucucuauuagucaggugcuagcagagccucucagggaacagucauaccagguucuugucagcaagcacuucuuggcaucagcaauagugguggggcugguagucugcagaugggaugaaucccuagguaaguuggugucuggauggccauuccuuuagucucuguuccacuuuuugucccugucuuuccuuuggacaggaacaauucuggguuaaaaauguuaagguugauagauggcccuaucccucaacuugaggccgugcauuucuacuggagguggucucuacagguucuaucucccauuuguuggguguuuuagaucaugucauccuuguugaguccugggagcaucuagcuucccuagcaucugggacuuucuaguggcuacccccaguuccccaucccucacugcuacauauuacuauucaauuuccugauccuuuguacuucucuccuguuccuucccauaccugauccugcccccaccuuuuuucccuuccccuccccucucccucccagguccuucccuuccucuaccucuugugauuauuuuguuuccccuucuaaguagaauugaagcaugcaugcccuggucuuccuucauccuaagcuccauauggucuguggguuguaucaugugcauugugagcuuuuaggcuaauauccacuucucagugagugcauaccauauauguucuuuugugucuggguuaccucacucaggaugauauuuuccacuuccauccauuugccugagaauuucaugaagucauuguuuuuaacaacugaguaguacuccauguguaaauguaccccacauuuucuguauccauucuucuguugagagacaucugggucauuugcagcuucuggcuauuauaaauaaggcugcuauaaacaucguggagcauguguucuucuuauauguuggggcaucuuuuggcuguauucccaguaccaaaucuaagaacacaucuaauugaucauucaccaugaucaaguaggcuucaucccagagaugcaggaaugguucaauauacagaaauucaucaacauuguaaccauuugcauacuuguuucuguggagggacaaaaagguguugaacaucuauccuauacauugugguuuggcaugggucuuguugaugguaguuuuucuuuaauuaucuuaggguuacuuucuugauuuaauucugucucuaucuucaaauguauagcuccaaguugagugcuuaagucaguguuucucagccuuccuaaugcuucgauccuuuaauacaguuccucacauuguggugacucccaaucauaaaaucauuuucguugcuauucauaacuguaauguggcuacuguugaugaauuguaauguaaauaucuccauuugccaaugaucuuaggcaacccuuguaaaaggguaauucaacccccccaaaggggucucaacccacaaguugagaaccacuggcuuaagaggauccacccagaaccauguagaaaaagaaauagucacguuucaucagcugaauaaaagaauacuaagcggacaguccuaguuuuuaaguauuauaaccucaucagaaaguuuuuugugaauauuucuccucugaaacauaaacucuuuuuuauuaauuuguuuuauucuuguuuuuuuguuucauuucuuuuguuuccuuugugauaccggguaucaaacccagggccuggcaagccaaagauucuagaucugaaaaauuggcauuggacaucccccuaugguuggugcugacacuaaacaucauuaauucuuauuguuuccauuugugggcagugugcccucuaccuugaacuccuauuuccucagaugucugggucaccaugaacucuguucaggccgcacucucucacagacugaagaaagaguuguuccuuagauuucagcucuguugcuaacaugucuuccaauugauauggucagcaacagacuaccggccacccucccaugaguuagccaagauggagcucaacuuggagagcuguggccaagcaccaggaugaacaauagugaaauaauuucagagcagaaagagaucauuuaaauaccaaagaaaugggauguagaugugaauuuuauacucugguagggaaaaaaaaaaaaagacccaagaagucacgguagaagaauguaauccuggaguuagagccagaaaacauuccuguguguucauucacacaaccaacgaaugucaaucccaagucuaaggcaagccuuggcuaccuauuugccugaggaucuucagcaaccucuugggguacuugagggacuaaucaucccugagucugaacuguuaugagagguaugagaugucagagacaaaguacuuaggauggcuccugguacauaauaauuauuaguuuuuauucaucuaguuguuuugucauuugaagaauauaguagauucguauguguuccaagauuguuccaaguuugaggaauucuauagaagcgggagaggaaggauuguagcgccagaauggugaagaacaccauaagaaaacccacagaaucaacuaaccugggccuauaggggcucccagagccugaaucagggagccugcauaggguagaccuagguccuaugcauauauguuacgguuguguggcuuggccuaacagggggaucaggagcuaucuuuggcucuguugccugcauuugggacccuuuucuccuacugggcugccuuguuuagcuucaauaggagaagaugcaccuaguccuacugcaacuugauaugucaaggcugguugauauccaugggaggccucuccuuuuuucaagagaaucagaggagaaaugauggggugagcuaagaaaaagggaggggaggggagguagaagggaagaacugaguggagaagagggaggggaaacuaugaaggagagauaaaguuaauuaauuaauuaauugauugauugauugauugauugauugauuaauuaauuuagaaaaaagugauuguuccaaaaauauuuuuguauuuuugguuuaguacuacauauuuuaauuuuuuaagauuuauuuauuuauuuaugcauauguguacauacaugugcacagagacacuuaugaacaugagcuuaugucauaaaaggcgugugaagaucagaagacaaugguagagauuuuauucucucuuucuaccauuuggauacuagggaucaaaauuagauugucaaacuuugaugacaggugcugcuacuugcucagccaucuuaccugcccugauauguuugauacauuucuugcuugauaaauguuuucagugcgugggcuaaaugcauugacugcuuuuaaucuucauguccacuagccaaauuucaagaguauccaagggaccuauuuuuuuauguauagucuugaggaaucauguagauugagagugauuuuaugguuaccuuuuccaaccuuuuauuucagauuggggaugaagauguagaccuauugguucuucaggagccauaucaaagcagcaacagaucuggguuucauaguagagcuccuugcuuacuucuuuuccuggucucaaauugauuuuuuuuucuuuaaauauacauagaaaucaaguuucuaggcuaugucuucagugaaugucugccauccaucuuccaggugagcuccuggguaacauggcugauccucacagcaggcuccauggaggagaagcgggaagucuuuucuuauuuggugcauguggccaaaugcugcuggaacaugggcaacuacaacgcugucauggaguuccuggcuggccucagguaaggaaguauggugcucugaacagguuccucuuucuagucagauagcucugaaucaguucucuggacagucagcaacacuuacugggauaagcuccacgcccuggucccucaaagagagaggaggagaaaggagagggaaggcagggagggggcagcaaagggaaggguccaggaguugaaggagcaaaaaguccuacuuggcuggcuguaaucaucucuacugucucagagauagaugugcacaguaugagaguuccuuccuagugacucucugucugcucaccacuugccucucagugagagggccucucacugcauaauuaccucguauaaagaacaacucuaaggagcaggugucuacuuuugacccaugguuccaaggugucccacauaugcucacuuggcuacuggugccuggguagaaccugaagguguugggaguguguauuggagagguuucuuuuccucauuuugaaccugguggaaguggagagagaaacaaagaagggucaaggacaagguauuauuccuaaaaacuugccugcaguagccuucuuguagcuagaaccccuccuccuaaaauuuccaaaacccucuaaaauagcaccccuaucagaaggcaagaaucuccccacauguuuaaauauaucugucaaaagugugauucacccucugagugaccacucaacucucagguuuuagaucuaguccuaggguccucucucuuagguucaggggucaccucaucugacaggcaggcuuuuaaugauagcccgagcuuaaugaccaacucagcuaccauucaggcccagaucuagggcauugagucagcccaccccaacguagaccccaucuaugaacuacuggaagaugugaagggcccaggugcugcagauccaaagcuucagggucucaaugacacagggcaacaacaggguaucugaaaggagucccagugagcaaucaguauuaauaguguagccaaagccagaggccuugaacccgaucaaugacucauugcaauggauucaaguaaagaugggugcacugugggacacacggugacacacuacagcuuccaagaugagauguuugguuugggaagagggguuuauuuuauuuuauuuuauuuuauuuuggaggggagguugcaaaggcagaggguggaucuaaagggagaagaugagugggauugcgguguguugaugugaaauucacaaagaaucaauaaaacguucuucuaaaaagccaaggaucuaguccugauuuuguguaaaauaaaauuguuuccucucaaaaagaaaauaaguaauaaauaaauagcccaagcucaguuccuuccauagcuucuacucuggcuggacucaugagagauacccccacugccuccguuaacccuguaaaggcagaacgcaucuacagagccagcucucucugagucuuugggcaacuccaucaagcugcccauauuuaggugacaguugcacaguagaccaugauccacacugccuaggaugaguguccaaggaguccacuugacacacccagccccugaggcugaguucaugcuuuucacguaaacccugucacaauacucucuauggggauguuuccaacugucuggauuccccgugugggauaaaggagggcacgaaagcaucgugggcagggcagucccgacaccccuuaugaugccaugauacugcuuuugagauugccagcuacagugucaccuguugaucucagcagcagcuucaaacuaggaaaaaaaauccauuuaauauguuguucugugaaucauauaucgaaacaaggccccucugguggugugaagcuaaggucaaacuucauucugcaaaaagcuguugcuacuagagucuaagcuagcagacuucggguaugccucugagggacucaaagauccggagggauacauaggacagguucucuguagacaaagccugaaauauuuguacaaaccacguguucugguuuccuuucuguuguugugauuaaaacaaacaaacaaacaaaaaccucugagcaaaagcaacuuaaagaaggaaugugcuaucuggcuuacucuuccaagucauaaguccgucacagagagaagucagggcaggaacacaaacaagaacuuggagcagaaacuugggaggaauacuccuugcagguuugaucuuggaaucauacuuagcuuuuuuuaagcaauauuuuauuaauuauuugagaauuuaauacauuguauuuuuaauauauccaucuuuccccccaucuccucuuauugcuauccuccuccaucuucccaucccuccugccaucccuucccauccaacucagauauuucuucuucuuuucuuuucuuuucuucucuuuucuuuucuuuuuuuuuuuuuuucuuaccacauagaguccaguugugucacccaaccaaaaguagagcccgacuuggaauguggucagccuaccaaggaucacaucauuaaagaaaacuggcuuccccucucccagcagcuacccaaugcuauuagcuccucggcuaguagugggaaauuuuugccuacuuuccacccuccaugcugggauuuuugucuggccugaauaugcacagcucuccugcauguugucacaguugcugugaguucauguguguaacugccccuuuuuaucuggaagacaauuuucugaccccuuucucucuuacaauguuuccacucacucuuccaugaaaacucccgagcgucgggagagggcuaggauauuauucucuuauuuugucuuuugaucaaucaagggucucugugcuuauugucaucugcuacaagaaguuucccugaugaggggugggagaugcucugaucuaggggcauagcaauaaaucauuaggagucauuuaaugucacaaaacauuacugaugguuccuuccaaggucugugaucuauccagucacaggaucuuggcuccucucccaucucguggagugggccuuaaauccaaucagggagggguuaguuacuuuuauaccaucugugccaccaugacuccaaaugaagauagaaaucauaaauaaauaaauaaauaaacaaacaaacaaacaaacaaacacagggaaaaaaccuaugaagugacaauaaacuuuauggaauguugucuacauaauguaaacuacacugucaccccuuuaggcuuuaaaaaaaaugucauuuauuugcaauaggucaaggaaaguucuaaagauguggcaguucauggaccagucugacauugagaccaugcggagccugaaggaugccauggcccagcaugagucuuccguggaguacaagaagguagugacccgagccuugcacauccccggcugcaaagugguccccuucugugggguguuccugaaggagcucugugaggugcuugauggugccucuggccuccugaagcucugcccacgguacagcucccaagaagaagcucuggaggugagccuuuccgagcgggcagcccccgagaggcucacccagccuucuguguacucacuguacaaugggaagucacuuucugagucuagagcaagccuugguauuguuuauguguagaaagagguccuggaaaguucuggagaaagcgacaccagccguuuggaaguugauauuguuacgccaggcuuaaugugcuacuguugagcacaaggggggaaguguugcuggauuucuguuguuuuaauugcaaaaguugauuaaguuuuuguuauuggguacagcuaucuagauuuagaugaggacaucaaaugagaccacuaacuuacagaucagugggguaaggaguggggaaagucagcagugccuucucuucuccgggcucugccccuuuugcccccacucucaagaauggugugagcuagaaagucaggagauugcacacugaguaaggggcacaaagagguucacaagauauaaggaaaccucccucugggguguuuaaaagugaaauaaaaauguuuuuaaauguguuagggagauuuuugaggcauuauguguuugaaaaaucuaaagcccgaauccagaguccuucauguucucaucuguguagauggccacacucaauacugacccuuacacacacacacacacacacacacacacacacacacacacacacacacacucaaauucaacacacauacacucacacacucacacccacacauacauaaagauacacacacucacacauacauacacauaugcacaugcacacacucacauacucauacacccacucauacccucacacccacacauauauagacacucacacauacacacucacacgcauacacacauguacaaacucauacacacucaacacacacauacauauacacucacacacacucaacacuuacggggacacacacacacacacuagcaucaucccuucuuuuuuuuuccacucuauuguuuauuggguuuguaacuggacaaagucacacguguacaaaacgaagcucauacuaucccaaagcagaguggggacuaaagacuggggaucucuuacuggccuuugggggagcucugaggugagggguagucaaccuucccacugcagagguguggccacagggguagagagaagaggagagcaccuggcuuuggucacaaaacucagggccuggcgcuaagccaggacagacagacggaagagaagccucaaaaaacauccucccaggaagccaggcacuaccugaccaguuccacuguggugugguugguucagacuuauacucaggggcuauuggaaagggaagacagcagagcaggagggaggaacgacacuggugaguggucacuagggguacuuggaccugugggaaggguagguagggaggugggccagcugcaacuaggcagcuagcagcggguuucauaaaugccacuguggccaauguaucgcacccauuugaugacaucauggucacuguaguucagcuuccguucgaauaccuacaaguagcacaccuugaagccagaaggcgagaauggcaccugcccugcuuuucuaugacaaucuugucauucauuccaaacuugcacucaggcaugccacucagguaacucuucaucaccacucggccugacacacgggcacucagcaccugccccuguggggacauaagcaggcccacacucuccagaacaucuaggaagaguucauuccggcgauacuugaugccuucucgccgccagccaaucugcccggucaccuggcuggugaucugggacuguucuuccuucaucugaugcugacucucgauacccugcugggugaugaaggucuucagugcaccugucucugaguucuguggguagccaaaguccagaaucucauccagcagcucguauacgagcacaaaauuguucuugauguucuccucgcugaucuugccaaaguaagcagccauuauaucacacaucuuguagaggaauucaaugaccauggcagcauugacauucugcuuggugacugcggccagccagauguuggaccacuuaacauagaagaagcuggugcaagcgauguuugugacagggcugcgcgccugcugccgugcaugaaugacauugacccgaaaggcauccacagcauuccucccgaugucaucucuguagacccgggagauaagcaccucccccuuaugauuauagaugaauaagccuccaaucaugguggcagcucagucucugugacccauugcucugagaacagaccuggagucagucaguagcccccacaaggccagccuggccacucucggaucccaagauguccgccugcccccuagcaucccuucuuauuugaagugggaagacucaaaacuucagccuaucucaugucauccgggaagagaagcaucacgugaucuaggaagacuugagacccccugacauggucugguuacagacacuggcugauauuuccuuggucuuagcagcugguauuaaaaguccaguaaauaaaagaagcagcuuuagaaggccucccacccuccacucuccuccgcucccugcaauggaggaccacugccucuugacugguuugcagcucuucccucugauucuggaagcuuccugaucacgagcaagccacaaucguagcuuuaaaaaacaucaagaagcuucuuccuguggcacacaugcacaaggccaccaaaagacagcuuuuaaguguuuuuucuggagucgggucacuucaucuuguuccaugucauggagaucuuuacucauucucuucucaaauucccauuacaagcauaaaaugagugcccuccucugugaaguggcuaaccuugucccuagggagccaugaaauaauauugcuuuugggguuauaaauucacagugcaguuuagauuccuagaggugcugggauugucacagcaaggaaggagcaaguucuaggauuucauguggugaggugaaaacaauaggaaauaaagcuuuucuuagagucucuugacuccauuucaguaaaauaggcuccgagguuguuauuuaccacuguuuugauuuaggucaccuagauguauguuguucagaccugauaaguugcaacaguguacucuugaacucuuuuucuguaguuuguagccgauuacaguggacaagauaacuucuuacaacgagugggacagaauggcuuaaagaauucagagaaggagcucacggucaacagcaucuuucaggucauccggagcugcagccgaaguuuggagauggaggaggaagacagugccagugaagggagcggcucuaggaaaaacucccugaaggacaaagcccgauggcaguaagucccagcauuggcgugucugugggugggugcagugcuggugucugugggugggugccgcgccagcgaguauguugggugggugccugucuucuuugcuccuugacuaguguucuuccuacucaguucaguuacacagaaaaaaaacugaccaaaaugugccauuuucuugcuuaaccaaggcugcuucaaacuuuacuaauucugagcucgaauuuaccuuuccuauguugcucccuuguucuuaaauuacugcauacauuuaacuuuuuccauaaguuguagccuuuuuaaaagaaaaugauuucuuuacuuuuuuuuaaacugauaguaaaauuuuagaacugugcguauuaaugggguauauauuauccccguaaaaauagcuaaggcuguccugccauuucgaaaacaucaauaacugaguuucaagauuggaaucccaaucuuuuauucacuuuauaguuuuuguaauaguggcuucuauuaaauucuggguagggugcuggggaggauauuaaaauauuuuaaaauauaccaggguccuagguauuaagugaugcucaaaaucaguacuuuuaucaguccaccugagaucugcagcucuaacaucucauuucgaguaacacugcaaauggggauauuuuaguuaggccuacacacguacccaaaaaaaaaaaaaaaaaaaaaaaaagaugagaaaaaggaggaagggaaggagagggagaaggagacgaagaagacaacgacgacagugacaaccaacaaccuuguccuagaggcugcaauguaucacaguaugccacacagucuacccuuuuguccacacaucuuuacuugcaaaugcucauugcagugaguuacuggucuguuucaaggccucugacgucuguuacacucucugcacuggauucccuacacuaucuguacugguuccucauugggacuccuaucagguauccuguuguugcccugugucauggagauccugcaacuuuggaccugcaagacuggcccuuucacaugccccagaagaucauagaugggauagacauuaggaugggucaacucagggucuaggccugggacauaguugaauuagucaaccugccaccuuugcuggagccccaccccccgggugagcucuccagcacugcccgggcuacgucacccaaaggcugcagccagcacgggguaggggcuacucuccuggcgcccuguccucaagccuacucaccugcaccuuugccuguguugugcugcccagggaggugcaaggcccacucuccugagugcugcaacuaggggauugaguccagcccucccauucucauuaccucagcccagcucuccugcacugugagggucaaggaggcggcaggcaccucucucuuguuaacaguacuccuugccaggugagggcacgguuaggucuccugugcuccugcccuuggagcuguuucaccacacuccugacuccaggcaaggaugucuguaaaauagcuuuaaaauaguuuguucgucuuccacuagaaacuguaauuuguagauccaagaguauuccuuuguguguuuguguuuuguucuguuuuguuugauaaagcaacuguggaucuuugucugcggcagaauaauuuuugaaaguuauugcuugguuagcauauagaaaaauagguuucaaugcaacauuucauaaauauauaccaucauacuuuuuauuauauccuguucuaauuggcuccuucaguuuucuccuccaucucgcuccuuuauaacugacuaugcucaaacagccccuccucuggguucaagacacuuauauuccauuacccacucuagccccacccccaucuuuugacaucuuuuuuucauuuuccuuggggcuuuaauauaucuguugcagaagucuuuccuugguuaggauucuuuucuuauguguuuuggagguuugguuugguuuggggggggaggggcaugucuuuuguuuguuuugaaacacggccucaccauguagcucuugguguccuaaaauucacuguguagaccagauuggccuugaauucaccgagauuccccugacugccucugaagugcuaggauuaagggagugaaccaucauaccccaugucauagguguuuuuaagcagcucuaaaugagaugcuuuuuuccugauuucuuucuucauaauuuuacuacugacauaaaggaaagcuacucacugacuuugguauacuaguguuguauucugcuacuuugcagaguccacccucuuguaauauucccuuugggaauauugaucauuuuuaccaguaaacuuugaaauguuaguucagcauuuuaccuaguucagugguugaaggagcugaguguuggcuguguuauucugcuguagcccauacuucugguggcuuaagugucacuucugacuuugugugagcaccuucugacuagggaucucacuuuugagaaccggcaccuccagugucaccacaaaaccacaccauccaaguaaaggaaacaaggaaagcccaaugggauugccguucuugcauauaaaucagaaaauugggaaaccacuaucaguuuugccauugaguuacaguuuauuuagggucaaaguuguaaauaaauccaguggaggaauggaggagccagaggggcaagugggggagaaacaagauuaaauaaaccaaagaaagugugggagucaaaaguguaaugaagggcaagagggaaaagcacgaaauuagaaaaauaaaauaaagaaaugcucuaugaucgugagcagacccgugaucaaaaggagauaaguagauaagugagaaaaaauaaauaggaaaaauuaaauucugauagguuuuuuuuaagccaguggguccaaaacacuacuaagagugcaguagaaagaaaagcuaaaagggagaccagaaaaagaaacuguccagaaaaaacaugggugacaaaguuagguagauguauaaaggggaauaaaaaaaugaauacauagcagggcgugguggcgcacuccuuuagucccagcacucaggaggcagaggcaggcggauuucugaguucgaggccagccuggucuacaaagugaguuccaagacagcuagggcuauacagagaaacccugucucgaaaaucaaaucaaaacaaaacaaaacaaaaagaauacauaaagauacacaaagccuuuuaaaacacaauaaagugaaauaguaauaaaagcauuuaaagggggauuuggugcccaguuccucuccuccaugcugggaucuugucuggcuuguccuugagcuggucuugagcaugaugucacaauugcugggaguucauguguguccagaaaacauuguuuccuugaagucacucaccaccucuggcuccuagaaucuuuucuucuucggcaaagauccccgagcuaugagggaagaaaugaaggaucgacaucccauugagggcuuaguauucucucucauuggcuaguugugagucucugugucaguuggagucuacugcaagaaguuucucugaugaggguugaaggaugagggucgauggauacacucaucuauggguauggcaauacaucauuagcagaauaauacuauugguucuccacuagggcccagaggagauguugacguuuaauuacugcuggcaaauaaaaggucaguuuucuucaauggagugacuuugguacacugagcacacuccagggcagacacuauaccaguagcaguuaacugugucagggagugacaaaaauuuguguugguaggggaggagcaggagaaucugggaggacuugggagaggggaaugaacaugaucagagugcauccugucacagccuuacagaauuaaagaaagcauuuaaaaauagaaaaagaaaaaagaaaaacacacaggagggggaaaaaaggugaaggauuagagugaauucugggagauugcugguuauauagaucagggagaagguaagucagacuucaggguauaugcaacagggagacggugggucagaccccuggauauuuuacuuuuuuaugguuuauggcagccacugguccuguuuggggcaagcaucugaucuucucuucuuugcacaccagggcccucugcuggcuacacuuggcuuuguagucuacggucuaagcacuuuucuccaauccucccaagaguccccauucacauucuauaggauggcuaauguagcucagagguuucucccaaguucauugggaguagaagaagcagucauucuacuaagauuuauacagguggaucugucuuugugcuuucaaaauccacucagcuuuaauuacccugcuggggggauucagcuuuggcuaucaaggguucuacugcaacuccaugccagcgugguagcuccagagguugcucaauuugcugaccuuuggcucaaggcuguuaagggccagacuggcccucaguugaugagcucugcuuccagccauugagggcagaaccaccuuuuuccuaugcacuucucuuccuggccuucugucacaugccagcauccagccuucauguucucuacaacuaccccccaaauuugucucuuaagcuuggggcuagggccaguugacucugauuccucgucuugugagucuucccuuuucuuuagcugccaggguagcccaguuuucaaugacagacuugacucccuugggaugggagaacccuucagagcuggcugaauucuuuuccacugcuggcucuucccacaaaagaagucaccaucucagcaagaccuacaacuggauuugagacucaggagaaguguggauuugucugugguugggacugccaguaucuucccuccagagccaucugacuguauaccuuccagaugacauuucuguuucugcuuuccugugccagggauccaggccaccagugcugugcuuagugugguggccuucugcuucucugcaccuuucagcucuccuguugccccuuuuauggauuuccaaagcucuaccucucuuuaguaauucucucucugucucugugugugugugugucugugucugugucugugugucugugugugugugugugucugucugugucugugugugugucugugucucugugugugugucugugugugucugucugugucugugugugucucugugugugucugugugugucugugugugugucucugugugugucuguguguguuucugugugucugugugucugugucugugugucugugucucagggagguagcuucuagucugcaucugacacggaaguuaccucuuaugagaaauuuauuuccauuuuucuauuuauuccuuuccuuuugcccucaucacuuaaucaccuauauccuaagaacauucucuuccaccguccacuuuccagauccuguuguaagcauccugagaaugggggaagaaaaccgcaaagaugcaaauauuuauuucacaaagcuggaaagacauauugaaauccucacuuucagaccuuuguccuaaggaguggaaguaauuuccuggcucuuaagugacugcuacucuaaaaggaagcccuggaugcauggcagggaggcaggauuucauagguuuuccggcagccaucccaauaaccacuguuuccuuauuugccucuguccagagcaucuugugaaaaugccccguucagagugucuuagcucacaguguuuuucagguccuaaaagacaauggaacugggcucuauugaauuuaaaaacaauagccuccagcccuuguucauaagucaaugcccaacucagugaaaaaaagauaagaaaugaagaaaaaaaggaaagaggaagagagggaggaggguacgaaggagggaggaaggaaggaaggaaggaaggaaggaaggaaggaaggaaggaaggaaggaaggaaggaaggaaggaaggaaggaaccaagcaaucuaaugauccuucaguuuacccaacaugcaguguguuagaauuccucucaaagccuuuagcugcuccugccagaaaacucaaugggaguagucauagaaaccccagaaaaagcaaucaucaaaagcuuauaucuagcuggacggugguggcgcacaccuuuaaucccagcacucgggaggcagaggcaggcagauuucugaguuugaggccagccuggucuacagagugaguuccaggacagccagggcacugucaagaaacccugucucggaaaccaaaaaaaaaaagcuuauauccacagcgcuggagagaugguucgguaguuaagagcauuggcagcucuuccaaaggccccgaguucaauucccagcacccacacagcagaucacaacugucuauaacuccaguuccaggggaucugacucccucucucucacacauauaaacagcagacagacaugcaagcaaaacaccaaucucuauaucuaucucauggccugacacugaggagaugacuaaguauguuugcuaugcuagcaugaggaucugaguucagaucuccagcauccauguuuaaacaacaacaacauaaugugcccuuaacccuggcacugaagaguuugaagcaggauuccugggacuugcagacuauccacuuuaggugaauagugaacuccagguacagugggagaccaugucucaaaaacuaagguagagaucaauugaagaagacauuaccaaccucuggccuccacacccaaucuccacccccuacuccuacacacacauccaagaucucagcagaaaaugaauagaaugaagagacuacucgaaugccauugacgguuuauggugugcuuauagguccucuguacagaugaggaagcaccuagaaagcugaagacacuggcuuaagugauaaagagcacagcuagagcaugaaacugaguggaacuucugcccagcaguacuaaagacaucaucuauauccuaagaacauugcuggaaagcagcaauccuuggcuuuucuucauacuacuuccuuggauuuggaacaguucuugucuuaguuaggguauugcuguaauaaaauaccauaaccaaaaacaacuuggggaagaaaggauucauuuuagcugacagcuuguagucuguuaucuagaggcuucaaggcaugcacucaaggaagaaauugaugcagaggccauggaggaagccugcuuacuggcuuguucuucauagcuugcucagucugcuuucagacacacccagggccaucuuuccauggauggcacugcccacacugaguuggacccucccacaucaaucaucaaucaaaaaaaaauaaaaaaaggcaccacagguuggggauauuuucucaauugagauuuccucuucccaaaucacuccaacuugugucaaguugacaugaaacaagccaacacuggucucuguuagaaaauaacugacuaaauaacuaaauaacuagcuauaacugagaaaaaggauaaguuaauuaaaagcacaaguuuugcacaaagguaaaacuuuaaaacacuggguuuuuuuuuuuuuaaucacuuggaguagcuguaacaaaucauggaaaguugauauucuucugguauuauuauuauuauuauuauuauuauuauuauuauuauuauuauuauauguaaguacacuguagcugucuucagacacaccagaagagggcaucagauuuuuguuacagaugguugugagccaccaugugguugcugggauuugaacucaggaccuuuggaagagcagucagugcucuuaccugcugagcuaucuuaccagcccuauucuucuguuuuaaaaaauaacauuuagucuuuaucaguuggugauucccguucaaauagucauuguaaauuucuauaaaguaauaaacaguuacaaagaaaauauauaagcauguugacacacaggguuuucaucagguaucccuagaaaaucgaucagauaucaguuucugguuucuaauaccgaauaccauagaagcucuucaaaggcaggguuaaaaccuucuuuccguuuugaugccuaaaaaugaugaggugguuucucugcuggcugaccacaucuuugaucugguuaacauugcuugguucauacauaaaucuuaauuuuccaucuuauccauuuucauaaacccacaaaaaauugucucccaggggacacaggcucagaacuccauaaaauccacucugucuuaucagagacaaaagaugcuaguagcuuccugcuuaaaaugaauuuauuucauuacaaacaauugucaauuuuauuuuggaaauuagcccuuggaugaaugcuuuuuaauggaauuauuaccaucuggcauuaguuaccuuuguauuugaaaauaaauacugaugccaagaaagacugccucccuguacccucuacauagcuuaccucaucucugagaagcacaaacagacuucagaauagccaugucuuaauuaggguuuuauugcugugaacagacaccaugaccaaggcaagucuuauaagaaacaacauuuaauuggagcuggcuuacacauucagagagguucaguccauuaucaucaaggugggagcauagcaacaucuagccaggcaugguacaggcagagcugagaguucuacaucuuuauccaaaggcugcuagugaaagacugacuuccaggcaacuggggugagagucuuaagcccacauccacagugacacaccuacuccaaccaggucacaccuauuccaacaaggccacaccuccaaauggugccacucccugguccaagaauauacaaaccaucacaagccauaucuuuuuuuuuucuauuuagauacuguuuuuguuuuuuucauaauaccuguaguuuuucacuggaaacacuuuguuacauuaaauuaaaaucacaaauucuguguuuaaaccaccagguuauguuuuaaucauuaucaaugcucacaaacuuucaacuuuaguugguugguugguugguugguuuuugaaauaggauguuacauuguaguucagacgaaguuacuguguagcugagacuggccuaaaaucaugacaauucugccucauucuccuuaguauugcaauuacagguaucagcuacccuuaccccagccauuucacuuaaaaaucuaccaccaagugacacaggaaaaaauaggauaguggccccagagagaaauuuaggugugaccucugaagaaagccaucccagggauaccgcuggcuagucaaccuggaacagaggcaguggagaagaggucaaaugaaugaugucgguuucccuaaauuuguucauaguggugcccuucacugcgccagaccuggagcugggugcacuugugaucuuugcuuuguuugaugccuuccccugcuuggugaggucaccgacuacuucuuuaguagauaaguggagagagacucuuagcuugaauguuuuaacaagaucacacagaauacaggggcagauccacauauucuucucagagugacugcagaggacgucccacggugcgugcuauccauccaagcggaugugcaccaguuccuauugcagggggccacagucauucacuaugaccaggacacacaucucucggcccgcugcuuucuccaguugcagccugacaauaccucuguguggagauacacaugaguguuugaguucuuuccauugucacugaggggagacagguguggccuuuuggagggaagcuaaguuacccaugugucuuagucagggucucuauuccugcacaaacaucaugaccaagaagcuuacacuuccaugcugcuguucaucaccaaaggaagucaggacuggaacucaggcaggucaggaagcaggagcugaugcagaggccauggagggauguuccuuacuagcuugccucucuggcuugcucagccugcucucuuauagaauccaagacagccagcccagagauaaucccacccacaaggggcucuucccccuugaucacuaauugagaaaaugccuuacaguuguaucucauggaggcauuuccucaacugaagcuccuuucucugugguaacuccagcugugucaaguuaacacaaaacuagccaguacaccaugcaagcuuuucuuucuuuuucacuuuuuauuauaacaugugacaucaagaaaguggggugaaauuuuauguauuugcaccuagcauucaaaaacugguuucuaauaucauccuucaguaaaaagaagcaagcuccuuuagguaaauggcugacugugggauggaagcagggagccucuuacggugccacaaaguagcgagugcuccaaagcagaucaacuaacuauccacgcaaacagaucugagucugugaaagaagcacaagccaaaagagcuucuagugggaccaaauaaauaagguaggauuaaguuauaacucacucaaagcauuagcuaaauauccauaagucccuacaguaaguaucuggccuguaaaauugauaaggaagcaaacaaauggggggaagagauaaauucccugugcagaagaauuccaaaaauguaacacguagcuucuccauucccuaggagguggaaguguaaugccucucuccuucagugucaucuggauuuagugauuugcaucuaauuaguguauauggaaagaaucuuuagaaaauaaacuaauaauaauaauaauaauaauacauugggguaugaagaacacuaccucagucauguuuaagguccacaucaguggguugucauguuagaaguaugugcaguuuauaaagugugauaaggauauuguuuuauugcuguaccaguccucacccaaccccauaaucuuggucucguuuugagcaaaacaccagacagauccuaacuaaagcuccuucuacaaaaugcccagucguacuucucaaaaccgucacaggcaccacaaagcaugccuguggucaggugccuuguaaguauaaauaaguuagccagugugguuuagcauuuuacauuucccaugcuuacuugaauuuauagcagaaugagaaaccaucuacugugugugaagaacaggcucuguguugguccccuucugguuauaagacaaaggaaacuuguaucuuuuuuuuuuccccaaucagguuuauaauuggagauuugcuggauucagaaaaugacaucuuugagaaguccaaagagugugacccccauggauccgaggagucacagaaagccuuugaccaugggacagagcuuaucccaugguacgugcuguccauccaagcagaugugcaccaguuccuauugcagggggccacagucauccacuaugaccaggacacacaucucucggcccgcugcuuucuccaguugcagccugacaauagcacguugaccuggaugaaaccucccacugccuccccagcaggcgccagacccaagcucggugugcuuaguaacauggccgagccuggcaaguucccauccccaggcaacgccggggugagcggccuggcagagggaauucuggaucuguucucagugaaggcuguguacaugggacacccuggcauugauauacacacuguguguguccagaacaaacuuaguagcaugcuucuaucggagacgggggucacacugcucuaugggcuucagaccacggacaauagauuacugcacuuuguggcgccaaagcacacggcugagaugcuuuucaguggauugcuggaacucacuacagcugugagaaagauaaggagguucccugaccaacgacagcaguggcuucggaaacaguaugucagccucuaucagguaagggguguauccagcccucucccucggguugugcaacccucaggagcauacacuuggcauuuaaacuacuaggcucccagcccugucaguuacuccuauguacccgugggaagcuuucccuaaccuccccgggccagccaguuucccugucuaaaaacuggagaugagcugaacuugugcauagcgugucuaugagaguggauagagcacacaguguguaaagacaaaguauaaauugauaugcaugucugcucauggcggcggguccucuuguuauucugugugaaaacagugacagaucagugcauuucucagaucugggaaggaacccuucagacaggcgucuccccaacugaaggucucggcugaaagcaucauuucagauaaacuauaugauauaugugauauauacauauauauaugcauauauauacauauauauauauauauauauacauauauauauauauauaaaacauuagaauauugauugagugacuuccacauacauguuaacacacaacacucugccaugcacuaguaccaaaaaaaaauuacuuaauuuuauuaguuaaauuuuuuuaauaucugugugauuuuucuccagaauugcauuaacagcccuguaagagcauugcuuuuucccaaguuuggaaaaauguacauagaaaauaaaaauauauuuuuucaacuucaaaaugcaauauaaugagaaccagggaacuauguaaugaugcugauguggaugguggaagagauacgguccccuuaacuuugucaaggacacagucaagggcaaagcgagggcucacaguuaugaguauuuaaauggaguugugagcagcugggaagauuaaauauagcaauaucagauaagcaucuugguuaugagcaauggacacaaauuacucgcuauaaugcccggggggggggggggagcuuaaccaaagggugugaauuaguuuuauggucuucauagaacagagauaucagcauguuaaaguucaugaauuuuucuaaaaagauuuuguuuucguuuuuuuuuuucccagagacagaaacuggcuguccuggaacucacucuguagaccaggcuggccuccaacucagagauccaccugccucugccucccgaauguuuggauuaaaggugugugcuaccauugcucgggcuuugcuucauucuuacuuuuuaauuaauuauguauugcugugugucuguauguggguggugcaugggcagguaggggccagucaaggccaaaggcaucggauccccuggaccuagaguuacgggcaguuuugagucaccguguggaugcugggaaguaaacucuuguccuauagaagagcagccugugcucuuagccacucagccaucucuccagcccacacgaagaauuuuuuauugacucuccucccuagcaaaagauuuuauuaucugcauauuauuuucaaugaaucaaaaucuauuuacaggagcuagagagauugccaguggcuagaacacuuguuacucuugcagaggccccaaguucaguuccuagaaucuacauuaggaggcccacaccugccugcaacuucagcuucagggcacuugaaaacuccugugcucgggggcaauggcacacaugugcacuuguuuguacauguguggacgcacacagacacauauauucauuuuuaaauuauuuacaaauacuuccuuggaaguauaaaggagggcuacccuuaaaaauuuagagugcacaaauaaaaaaaacaguagguaaguagauagauagauugguagguagauggauggauagauagauagauagauagauagauagauagauagauuugaggggaguacugaagauugacccagggucucuuaguugcuagacgauuuccccagaaucauaauuugcaaagucuuaaagauuucugaaguaccugcuaggcaagcacucuaccaacugaacuacaccccagcccuuaauaugcaaagucuuaaugaauuuucccacaaugcuaguuucugaaucaccucuaagaccaagaugggaaguguuuuggguuugguuugguuugguugguuuaccccagcugacguugaaguacauugaugacccagguugugaucaggacaacuggggacacaaucagauccuuaucaggaaguuccuagagucugaaacagaaccacguggguguccagaucacgcgucuggaaacacuugagcuuacccacauggggauucacugggaccauuaauacauauucccuguugcugcuugcuuguguguucagcauacgguucuuuucaggaggauggucgguaugaaggcccaaccuuggcacaugcuguggaguuguuuggugguaggcgguggagcacuagaaaccccagcccuggaaugucagcaaagaaugcugagaagcccaacaugcagagaaacaacacccugggcauaagcaccaccaagaaaaagaagaaaaugcucaugaggguagaguaaauuccuuuauuaagcaucauacccacccagucuucuaccacgacauugccauaagccaccuuaagucauuugauuuagggacaagauaaaugauaaaacagugguagcaagggcuugccacaaaccucucaggugucagggucggugucaggaaucaagcaaacaccaaggagaaaccaaaguucuuuaaaaagcugcaugguggcgcacgccuuuaaucccagcacuugggaggcagaggcagacgaauuucugaguuugaggccagccuggucuaccaagugaguuccaggacagccagggcuacacagagaaacccugucucaaaaacaaaagaaaacaaaacaaaacaaccaacaacaacaaaaaagcugcaucagcuuaaaacauaguacaugcuaaauaugucucauuguuaagucaccuucaaagugcuauaucaguagagaaaauauggugcugagaggcaggcaguaagggccucagagcagcagacacacggugggucuugaaguguguauaggaguuuucccaacacaacacaaagcaccugccacggagaagagagcagagagguuaaagguccugcuuauuccuaaccgucuaugugagaggcugaaguacaagucccauggcaggacuggaaaaagaaaagcgguuguggcaggcaugauggcuccguccuguaaucccagugugucagaaacuuaggcaggagcauuacagugaguucaaagccagccugagcuacggaguaagacaugucucaaaauaaaaucaaccuaaaguaaaauaaagagaucacauuuaugaaggcgauaugaaugaugagugcuguauaugaaacaaauuaagauaagcagcacuguauauuauugguuauauaacauauuuucauuaggacguuugucucauagcuaucuacuccuuccucaugggagguucguagaaaacuuuauagcuucauauucuguauguccccaccgacuccagggcugugcauccccuucucagucuccuuuucuggagggacggugcguaaaagugaagaacacacugaguaaaaugaccuuagcuuacuugggcagccuuaccguagguuuuuacuggucucaccaggcaagacaagauugaaggacacagguuagaaagcagaaaccuaucugagcuaagcuuucagggugaacaauauaauccaggagccauggaaacauuucuguucccagggagagaguggagaggugacggacgaugagauggcuacccgcaaggccaaaauguacagagagugucgcagccggagcggcucugauccucaagacguuaacgaacaagaagagucggguaaugaaugcagagugcucacaucuaaaucuuuuuguuuuacuuuuauggaaaaaguaaagauuuggcuuuguacuaugauuuuaauuugauaucauaggaauaauuuuuauggcucuuuuaaaaaacauugaugcaugcacacacacaugcaggugccuuuaaaggccagaagagagcaucggaugcccuggagguggagcuccggguaguugugaggugucugauguggguacuagaaaugagacuagaguuuccuguaagacccgaaagugcucuuagcuucugggccaucucuccagccccuggugagaauucuuaagauaauuucuuuaucuugguaagauaugaaacccaagagguauuucuacaagugcacucuacuugaaagaaaauggucauuggcuugccaaucuugcuagauaauauuagcuauauagaauacaacugacuggauguuagugcuuuuaaaaaugccauggccacauccaugaccaagacauuuauauauucuuugcugaggucuugggcaucugugugcuuuuuuaagcucccagacaaugcuagcuuguagccagcugacacccaccagacuggcccauucaucucgguauuuguuccuuacacaagaaucauuuguguagauuguuuugaugauacuuaagggaaagcaggagcgaagucaucacuucuuuuuuuuucccccuuugaucccugcagaggccaaugucaucacuaacccucccaacccccuccauuccagaagagccuacucuuugaccacggcugggucccccaacuuggcuaccgggaugucaucucccaucaggccagucucuuccccugugcugucuucuucaaacaagaguccauccagguggggccuuaacaugaugaaagagagggaaucucuacauuacuccugcuguguggaagggcgugugccgcacucccugugcaaaguccaucacuaggucuaacucaacaguuaaagugaaaaccaaaaacccuaauugaaaauuauucugauuuuccugaaucuguaaucauagucucucauauugcugugaucccaucuaauuguuugagacaguaacccuuccaaggucagagacagucaucaaaagcuaaaucugcaccaucuagcugacuggccacuaacuacucauaggcauuuaauaucaagcaccaauuauucgaaauuaaauuaagcuggaaagucaguuccuuagucacauuuucauugcaccacaacuacagguggcuaauggcucugagcugaaugcugcagauagaggacaugugugucccugcagcagauagauagaggacaugucugccccuugcagcagguagaggacaugucucugcagcaaguucuuucagguaguaccaugcuaaggggaaacgaacuuaagugugagcugccugaccuuacugauaguugaggaacgugucagacauguguaucugacacaugauggaagcugugcuugccuggcgaaguaauuguaaguauugcaacaaaucgaauauguuuaucucacccccaaagcugggauuguugcaaaugaugguguaaggacccuagacauuaaaaaagaagaagaaaaagaaacaaccucugucuuugccggugguggcagucgcacaccuuuaauuucaacuguugggagauggaggcacugugaauuggaagcuggucuggccuacagagcuacuuccagacuugcccacgcuauagagugagacugcgucucaaaaucaacaacaagaacaacagaaauaauaacucaacaguucaaugcagaaguaauuacagaaugaaaagccaccaaagggagcuggauggcuggagacaugugcaagauccaggcagagcccacauaaagcagaugcugugcacugcgccagaggagugggucucagcacacagacguaggcuuugacaguguucauuccuccacacucugcacacgagggcacagcuacagacuggcuccacaaaaccagucuccauugcuuugcacuugcuagugauucugacugcauuaaauuaucucuucaagggaagacuccucucccaaugagugacgaaagcuggacuuuagucuuugugcaaucaaauccacaauagguaaaaacgggccaaagucuagaugacucuccguuuuacucucacaacuuuuccauaaauucagaucuauaauaaaacuaaaaucugaaaauagauggaauccuuuauauuucagcccaugaagaauccuggauguauaaaacagacauaucaccuggauuaagucuguuuuccuuuuauuuaagucacuugugagcaggaaaaggcagaacagagugaaggagggaagccuuuuggacaagaaacuaacaugcaggauccaaagucaaaucucauccccagggggagaggggccagucccuccugacaagacaaguucuaagacacaaggaagacagaaguagcagcagccugaauuauguucaaggaaaagugagccuaaguccuacgucuaaagagagagagacuagauacagaauuuucuagacaggaaccaaggguggaauuuaaagaggaagacaggcaacucacugguguaaaugcaguguguuucaauaauaacuauuuaugacuuccugaacuuguaugguaagcugcccaccaccacacacaacuguaaauccaucuguuugugaugcccucccaucagagagguggcugucagaucuuaagacuaaguaauucuccaugagcgaacacugguagcagaauugagaguagaccagcuacucaguguucuuuguacucucucguaaauuaacacuugaaaugcacccccagagaggggaaucuaagccuuccucaaaaaagaaaaaagaaaaaagaaaagaaagagaaauacccgguuaauugauuugacugaaagccauagacaaagcauuucuccuacuacuuuuugaguaauccacacagaaaauaaaaagcguggugagccagccagccuaaauauuugccugagagcgaugauauuuuuauggugacuggaugaagccuuggcaggugcagaugggcuccagugaaggauuggcuuccuuccagucuccguauuuuucugacucacauuuuccauuaauaauaaaagcucuucccuguuuucauugaagaacugguuuaaaaaaggaaaaaagaaaaacauuuacgcauuucaaaccuccuagaugcauuuccauaauuuagaauacagaaaagaacaugaauuguuucccacagauuaugaagaaagaauuuggauaucuuauuuuuaaaaacaugacuuuucuucagacacaccaaauuuaagagauuccccaggacuuaucaaucuguaauuuuaaagaacuguuccauuaaugaaggaguauuaaucccagcccuucgcccccaguugaguaaacugggaaugcuuuuaccaguacauauuuauucccucugucaguaaagaaucuuggcuauagcaucaucuccccauugcacauagugucaucagagacuauuuguugaggcagaauggcuuggggucugcacuugccagugacagccauguuucucugcagugccuggagcagcagcagcuggcaugggcgaauccgaggaggaaugcaaggcuuccagagcuucauggucucagacaguaacaugaguuucguugaauucgucgagcuguucaaaucauucagguaggacaugguccuucuucuuacucuucuucagacccacaguuggaaggcaacccuaaaagggagguguuuuccauucuccucagcaucaggagccgcaaggacuugaaggacaucuuugacaucuacucuguacccugcaaucggucugccucggagucagccccacucuacaccaaccugacaaucgaagaaaauaccagcgaucuucagccugaccuagguugguuucacaauuuaccauuucccuuugagagcuuucucuccaaaaaccaagguaggagaucauccagccauguacacuuucagcgugucacucauggugugcugcuaccuggagcuuggugaaacugagaauuguuuccauagucauuugauauugaaggguaggcagguccugugggaaauccaucaccacguagucuuucggcacuuaguuaaaauugggguguuuaacuaagaauguuccagucccucugaacacuuagcacccuuucccaaccauuuccaaguguccauaaagaauggacuguaucuuaauugagaaauaacaguuucucucuuaccuauagguaagugcucgcucaggccuaggcagugauugucugugcuuugucaaggggagucuuuggugaccucagcagagaauggcuuuccuucuuuguaaaccagaaugucuccuuuuauucuacuuauaacauuuuaacuaucaaugaacuuuaaacuuguucuuuuucuccuaaguucuugauagaacuauaaacaugaaagagcacacacacucacauggacauacacauauacacacauacacacacauauacacacaugcacaugcaugcacauacauacacacaugugcaugcaugcacauauacacuaaccuucuucaugcaguugcuucauaauuauuuauaaccuuauguuguccuuguaugaauauuaacucuuauguagcucucaaaacauaaauaccuauaaacuaaccaaguaauugugucuuuuagaucauuacauuuuaucuucuagauucauuguagguuucuggaaaaugagcagaaaucagaguucccauaccugauucugcuaccuuagaacacuuaggaccuuagaacacuucagauuaaaauguaaaaugacaaaauaaauuaaaucaaaaauaaauguaaacugacacagugauggcuucuugaugaacuaaacacacucuuaacguaggguccagcaguuagucucuuugauuaugugccaaaauugauuuuaaaaugguauugaugcaaaaucuauauacagauguuuauaauuacacauuuaagauacugaaaccuuuaagauuacauuucuucugccucugccaaugaaaaagcuuagaagcaguuauucucaaaagaaagaaaggaaaaaggaaggaagggagggagggaaggagggagggaggaagaaacccagggcuggagaugggucagcaguugaaaauauuugcugcccuucuagagaacccgaguucaguguccaggacccacauugagagguucaccacccucuguaacuuuaggucuagaggaucugacaccccuggccucccagggcaccugcacucaugugcacacccaccuccaacuccccuacauacacauaauuuuuuuaaguauuucuuucaaaucugaauuugggagagaugugaugguacauaccuuaaugcuaguacucaggaggcagaagcagguggaucucucugaacaucuuuccagucccuacauucauucauucauucauucauucauucauuccuuuugcuuucucuuuacugugggaagccagggacucacaccaagucugcacauuauuuggacagauuagagcuucaucagggcacugacuucauaauaccgaugaacucugucaaggagacuucugaauggacuguggguggcuguguuucagauuugcugacuagaaacgucuccgaccuggggcuguucauuaaaaguaaacagcagcuuucugacaaccagaggcagauaucugaugcuaucgcugcugcaagcaucgugaccaaugguacugggauugaaagcacgucccugggcauauuuggggucggcauacuccagcucaaugacuuccuggugaauugccaaggagaacacugcacauaugaugaaauccugagcaucauccagguaucacauguauggcauguaugacacaucauguauggcauguaugauaucacauguauauauggcuacauguguaugggguguauaacauaucauguauggcauguaugguaucauauguauagcauguaugacuucauauguauggcaaguaugauaucacaugcuggcauauaugguaacacauguauggaauagaugguaacauguguauugcauguaugauaucacauguauagcauguaugguaacaugugcauagcauguaugauaucaugugugcggcaugccgcuugcuggucuaauacuuugauguuaagaauuuuaccuagucuauacuuuucauaucugggauauaaauagaauuucuuuuaaugucaaguccauagguauucuuauaauuaucacagguucuagagcaucucugacucaaugacaauuacaaggaaguugugcccaauuacuucucacuguucuaacacauacaacaguccagaauuccaaucuguuacuuaucauguauuuguuagcucuuacucugcaauccauguuccaagagcagagaauauaguauuggauaaagucucauucuucuacacagcuuacuuucuggugugugaggcaaacacuaaacaaauauacacaauuucaagagugagcccggucaggaaagggugauaacaggaaggcugagcuggagaggggcauuugggcaaagcucugagugaguaaaucauuggagguucugagagaagagaauccucagagaaacaugagcagcucacucauacccuggggcaagagugagcuggggauuuaugaggagcaucaaaagcuaccaugaugaucagagccaggcaggacaggcagaugcaacuucaggcagaaguccaaggacuagcucaucuaggacuuugagaccgcaggacggacagggguugacaucuguccuugugaaacgagaagcuuuaagaaguuuuaagcaggagggugcgugaucuaugcuucagaaggucugcgugagcccauguggcaaggaacuguccugacaaaagauggagauggguggaaacugucccaggagcccaggcgaggggugacagcuacagagagugaaacuucacuguggcagcgucacaggcagcagaauuaacuuaaucuccugaucuggaauccguggaaucuguggaguagcugugugacccuuggauuuaacccauauugaugcuaaaacugaggguucacugugacuccacugagcguauguuucgugaggcugcuccaagcgaaucauugaaucacugcaccccaccucccacugcuggacgggaguugccuuuauuacucucaccgucuccucaacuaauacacgcacuguguuuucauauaaaucagccuuauucuuuucucucacuaccuuuuuuuucucuuaaauaaauaugcuugguauaauaagcucauauguaauaaauauuuucuuuuggacuaaaaaccuacaucuuaccaguacauaacuaaaguacuucaaauauuugguugagacaucucuucaaauauuugguugagacaucuccuaaugaaaacagaacaguuuuauuuuuaauuguguggugcuauuuucuccuucuuaguuuccuuugccuaaaaaacaucucuuuuuaaaaauucccuugcagaaauuugagccuagcgucagcaugugucaucaaggccuacugucauuugaaggguuugcaagguaacuccucagacccuuuuaucgcaucacucaagaguacacguugcucugacgcagccuuaagaacauguguuucguuuagguuucugauggauaaagacaauuucgccucaaaaaaugaugagucacgggagaacaagaaagaacugcagcuaccccucuccuacuauuauauagaaucuucacacaacaccuaccucaccggccaucagcucaagggggaguccucuguggagcucuauagccagguacagagagugucgcugcggugugacuuucaucacugaaccccccagacuccuguaaaguauggcuugaacuauacagagccaucaagugugggaaaacaggcuacacacagugguguuuucuuugcuucuuucugccuccuuguuuguuugcuuuccccucaaucuauacuuacccugcauuguaggcaaagaaaaaaaagaaaguguuuguuugagacucagcuuuuagaucucagucggaucuaccccuacuaaaauuaagauuuccccugggaaagcuauccaaucaucucacuaaaugcugaauaaaucaauauauauuguggugggaaagcauaguaggaaaugcggcuuucuugcagagcuaaucccccaaaguuguuuguuuuguuuugcuuugccauucguuagacaagccauccaucccuauggcaaccaacuaaagauaaagcugcaugggcuggaggcacuuuccuccaggcugaaauccaugggaacguucugggaaacagugcagugggcucucuggacugggaaaagcacauccuuugacccaaccaccagccagcucucaugucucucucucucuuucucucucucucucuccucucucucucucucccucucuucucuccucucucucucccucucuucucuccucucucucucuccucuccucucucucucucuccucucucucuaucucuccccucucucuccucucucuccucucucucucucucucucucucucucucucucuucucucuauccucucucuccucucucucucucucucucucucucucucucucucucucucccucucucucucucucucucucucucucucucucugguccagggaaugcaagugugugguuuuaugcuucugagggaguacaagcuaggaaacaaauucuaucacaaccauacacccccagccgugaaaucccuuuguucuccagauugguccaguacuggugguagaccaugacacaguuuucccccaaaguuuguuuagcccagaaugggcaugguggcacaugccucucucuaaucccagcacucaggaggcagagguacacacauaucuuccugaguucgaaaccagccugcucuagagugaguuccacaacauccagggcucuguuacacagagaaacccugucucuaaacaaacaaacaaaauuuuuuuuuaaucucugaauucugaggaauuuuuauuaggaaaugaaaaugugucuucagaguaaugauuuucaaacuaggacucugccaagggccuucagcugcuugugcugaaaugaguaagccacugccaagaaggggcuuuacccaguucugcuacgggaccacugacccaucuuuuaugcacuuugcauacuggacauuuauuuucacaaggagcuccaaagucaagagaaaaaaaaacuuuguggaacaagcgagaugguucagugaauuaaggcacuggcuaccaaaccugaugacugaguucaaucucuggaacccaugugguguaagagagaacuccuccaaguuguccucugaucuccauacacgcuaugguauucauaugcgcauguacacacacacacauacacacacacaaacacacacaaaauaaauaaguaaacaaacaaacaaauguagauuuuuuuaaaguuuaaaauccauuguucuguaggaaauaaauauauauuauauuuuaauugcucuacauaguuuauauguacauucacaugugcauauucauaguuauaucuauacguauauacauugugaguccagucuucacaacaaaacaaucaaggaccauuucugagcguugauuuccaacucauuguuugacuucaagaauuuuuaaauuccuucauauuuuaccccacgcagagauuaccucagcuuuugacuaaggcacagaggcccucacaccucacaccucacaccucacagggacugccuggugugauuagaccaugggaggaaccccuaagcucauuucuaauccucuuaggcucucuuaguccucucaguuacuucccauaguuucuuuccugggcagaugaaaaacaaaaacaagcccuguucuccuuaccuggaauuuccggcccuaguuucccuuuuuuaaccuaauacagagacauuaaguuauacagacuuuagcaaaaaccuauaaucuuuucauguugaaaccccuauuaccaguggcugaccaguuucagcucaucagagaggaagcagucucacuugcagcugacauacugauuacauagcucucuucagcuauggcaauauaccauagauaugguggcuaccaaccgaaacugaugggcuugggauguggggaauaaaggccacaaacuauaccaaguucuaggagaaccuguggagaaucuugcauuaaaaaauccuguacauccugcuauguuuaguugaaaaaacucuuagaggccaagacaucccaauaauggauuacuguuauguggaaauaauugcauguacucucgagucacacuauaucagcucaauugcagauaaucaauuccuugucuugggccaccuuuucaccaugugaugauuuuaaagauagucuacagacaggucuagggaagauaagauugcuccaagcagauguuacaaagcugcaguucacaaaaauguguugagaguccuccugcuuccagccuaagauccaggguagucaauagaugcugccucaucugcaucacuggcagguucucacagcagucugcugaagaggcaaagcuugguggguggguggguggguggggcagugugugagugaccacugguacccgcuuaugccuagggaagaggggaacuuacgggcuacuuacuuucucugcucuggaugcaauuccaggcuuacauagccaggugaaucuuugacaacucuuugcuucuauucuuacaugcuacguuuugauagcaaaguuguuuucucauugcagaauuugggucuuaacggaagagguuauaucaacauuggauacugauuuauauaaauguuuacucaccuuauuagggggucaaggcuuuaauucaccaucuucaccucuacugacaauuccuuagacagacaguaugcuaauuacauuuuuuacauuugucuuuuauugaaaauagauucuuuucucauacaauauauucugauuacagcuuccccucacuaaacuccuccaaguuccacuccccucacuuccagaucuacucccuuucugugucucauuagaaaagaauagguuucuaagagauagcaaccaaacauggcaaaauaaaauauaguaagaugaagcaaaaccugucauaucaaaguuggacacggcaacugaacuggggggaaggacaccuaagaacaggugcaagagucagagagccacucuuucucacagucaggagacccaucaaaauauugagcuaauagcugaaauguaugcacagaagagcuggcucagacccuugcaggcacuguuccugcugccucagucucuguaagcucauaugugcuuugcuuaguugauuuggagggcugugcaucccccauccucucuggaucuuacacucuuucuaccuccucuuccacgggauucccugagcucugacgggagggauuugauggaguccugagauuuagacucucacuccacauaaugucuggcugugagucucugcauccguuccccucugcugccagaggaagccucucugaugaugacuggauaagucacggaucuaugaguacagcagaauaucauuagggaaaaaauuguugauuuuuuuuuuaauccguagugucuggacuaucuaggucucugaacuaucuagucucuaguucuuggcuauccaagcaaugucggguguagguuccuucucguggaguggaucuuaggucaaaucagacacugguugacuacucuuacaaguuauguguuauuaccuuagcauucucuacaggcagagcagauuguaggucaaagguuuucugacuagguugguauccauguuucucuuucaguagccuagagaguaccuucccacaccaaagagucuggaacauaagggugaggacucuacuuagacaccagcucagcuuuucuauguucaaugaguuguaugaguguuguccaccucaaugggaccccacugucaguuugcagagaguaaccuuuugucuuagcaauaaccugggugauuuggggauuuccauaggacccucuucacuaggaacucaguugaauacaaccuaguccugcaaauggaagccuugccuagcuacaagacacagccaggcuccauaucccccauuacuagaagaccuuguuaggaucaccuucauccauuccaugaaauuuccacugcacuagguuuccacaccacuccucaaaugcaucccaauuucugacaucucuccccacacucucuuuuccaacucugccucaccaacaccuuauccccacuccuuuccccacccauccccagucugcucacaaaaucuguuggguauauacccaacauuucugucuauuaugaauaaagauacaaugaacauaguugaguuguuuucacagucauucuuuggauauaugcccaagaguggucuagcugggucuugauguagauugauucaaaacuuucugaggaacuuccauauagauuuccacagugucuguacaaauuuacacucccaccagcaauguagaaguguuguuggauauuuaauaacucuauuaguucuuauuaugaccuggccagcuccuaauaaucaggacagagucauauugacuuauuuaaucagcuuuagcacaauugcuggaugauuaccccuaaacuguuuuucuacacuagacuggcuacuucccagcuaugcuccuuaaguuacuucccgauagucauccuaucugugcaggauuugcaccaucaggccauuaccugguucuccaucuucuuuucucucucuccucccucuccucucugccugugguuccuaccuguggcccccaaggcagggaacugaagccccacuuaucucuauucucuccaguaauuggccauuggccacuuuuauuuaaccagucagagaauguagguaagcgaaguuuacacaacaucguucgguguacuuuuuuuuucuuuuaguuaauuuuuuuuuuuauucagucacuuugcugaagguguuugucagcuguaugaauucccugguagaauuuuuggggcuaguuauguauacuaucauauugucugcaaauagugaugcuuugacuucuuucuuucuaauuuguauccccuugauuuccuauugcucuaacuaacacuucaaguauaguguugaauagauagaaaguagacagccuugucuugguccuggaauugcuuugaguuucucuccacuuaauuugauguuagcuauagguuugcuguauauugagguaugcaccuuguauccuuaaucuuuucgugacuuuuaucaugaagguguguuggauuuuuaucaaaggccuuuucuacaucuaaugaaaauggucguguagaguuuuuuuuucuuucaguuuguccauaugaugaauuacauuuacugauuuucguauauugcauccccacaucucugagaugaaaccuacuagaucaugguggaugaucuuuuugauguguucuuggauuuggcuugcaaggguuuuauugaguacuuuucccagccauauccguaagggaaacuggucugcaguucucuuuauuuguugagucuuuaugugguuuggguaucaggguaacucagguacuuuaaaaccaauuuccuucgguuuuuauuuuguggaauaaucugaggaguauuggcguuagcacuuuucugaaagucugguagaauucugcucuaaaacugucuggcacuggggcuuuuuuuuuuuuuuuuuuuuuuuuuuuuuuugguuucauuauuuuuguuuggcugguugguuugguugagagacucuuuuaaugacugcuucuauuucacucgaggauaugggucuauuuaaagugcuuaucugaucuagauuuagcuugguaagaaguagcaauugagaaaacuauccguuucuuuuagauuuuccaacuugguggaguacaggguuuucaaguauauucuuaugauucuauggauucccucagugucuguuguuaugucuccuuuuucauuucugauuucauuaauuuggauauuuuuaucugacuuuuaguuaguuuggauaaggguuugucuaucuuguugauuuccccaaagaaacaacuguuuguuucauugauucuuuguauuguuuucuuuguauuuuauugauuucagcucucaguuugauuauuuccugccaucuacuccucuuggguaugcuuacuuuuuuuuguuccagagcuuucaggugugcuguuaaguugcuaauaugggugaaaucacuccauuuuuuuuuaaauguagguacuuagugcuaugaacuuuccucauuguacucauuguuucccauaaauuuggguaugcuguguaaucauuuucauugaauucuaggaagucuuuaauuucuuucuaccuguccuugcccauuuuucauucgguauagaguuguuuuguuucuguuaacuuuuaaguuuucuguuguuucugcuguuguugauauccagcuuuaauucauaguggucugauagaaugugaucaauuuucuuaucuguugagauuugcuuuguguccaaguaugugggcaauuuugaagaacaucccaugagguacaaaguagaaguuauauucuuuuguguuuggguaauguguucuguaaaucuauguuaggucuuuuugguuuguaacacauauuagcuccaguauuuuucuguuuaauuuuaucuggauuaucuguccuuuggaagaggucuacagacauccuaccugguuuucuggcagguguggccuacuagagaugggggauaggauacagccaacagugaggggaaggugguugggggagguugaugggauacacagaagacuggggguaguggguggaguugcaguuguuauucuguagccgaguuuggaaggaaugagacugggguauugugucugggggaaacacacagagaguggcuucuaauuuuuagacauuucauaucaaagaaugaaggacacuuuuaaaaagaaaaaugucauguucuuauacuugcuuuagcuuccaaaauuuucacuucuaguaaacaguuuucuuacucugauuuguucuuucuaucccaagcccauauuaauugugaucuuuggucaaaaugacaaauaucuauguuuuauuuaauauucguaacacaaauguugacugaugugaacugugugcuugguucaguuugaggcuuucucucccagugcucaucugagauggauucauucauugaucgcacagguccuccugcaaggauguagaagcauagagcuggacugcugggacggggaugaugggaugcccaucaucuaucaugggcauacacugacaaccaagauccccuucaagguaaugcuucccaucaaaucacaggacauucuuuucauugaaguuaccugcucuacuaaacuauaccuuaagucugaggaccuugcccuagaucuggaagacuuucagaguguuugcaguacauagugacgugaacaggcucuuuuuuuuaggauuugaucuagaguucuuacuagaucuuuauucaacuaaaauuuaaaaaccgcuaccucauguuggaacauaaugauauuguugauauuuaucuucacaugguauaaugauaaauaaaaaugggggcuguucucuuccuagagaaauuaaaggucauaaacccugcugucuuuacugacaaaggaaaauauuaugugucagaagauaauuaaguaaucaccauuauaaaguagagagcacuacuuccaccugggaagauagaucucccggaagacuggccuuauuagauaauuuuauaaucuacauagcuuauuaguuuagcuaugcaguuacuccucgcucagagggucuuaagcuauguaacaucauuuuucucugagcuguggcuaggcuuggaaggaauacuauuauaugaaauuauaugagauaguagcuaaaaugaauuuuucuuuaacucauuuucuauuugucguucauaaaacucuugcauuguauauuaguaaauggcuauguuuauagauacacauuaaaagaugugcacuguuuugcuccaaauauaguauuaaauguuuuaauaugucuugggcuucacuauaucacauacuauaaaaaaaaugucuuuuacuuucaguauucuuucuuaaccuauacugauuuuuuuccauuuaaaaauaguaauaguuguuccuuguaguaugggaacaagacucaauaugaauaguuugaugucuuuauacaaaauguacuaguuucuugcuuaguuuacaaauacauuuggcccuccucagcaauggauucuacauccauggauacaacuauacaacuacagguccaaaaguggggucaaacuguguguauaaugaauuugaauagacuuuuuuuuucuugucauuauuuugaaccaauguguucacguuguacuggggauucuaaguaucugacaaguauuugaaguuggugggaagacagauguguggagaugauauguaaauauuaugccauuuuuuucuuaaauguaagaucuaagcaucguauagauuucaguaucuucagagguucuggaauuaauuucccaugaaucuaaagagaugccuguacuuuugaaaagaugaaagccacuuuaauccagaaccugcuggcugcagcaguuaagacacucucuguggcugugaccagccuucuggugacgccgacagacgccugacucuaaugagcuguuugggucucacaggaagugguggaagccaucgaucgcagugccuucaucaccucagaccugccaaucaucauauccauugagaaccauuguucauugccucaacaacgaaaaauggcagaaauuuucaagguuagcuccaucuaagacacuauuaucucuuaguuguuauugguacccacacagauguagaccacaacacagcuggacauuagccaugaagcauguacuguuagcguucuacagaccuaaaaagugacaacgcucagagagcuuuggauuuuauuuaggacgguccccccuuuuugucuguaaggauauagguauugcuuucuggucuccugacccuuuucaggaagccuuggaagguaagaauagagcaguucucccaugcuccugauaagaccggacgucaccuggcaguuguacaugaaaaacccgaagcuguuucagagaaagucacauuguugugccccaaacuauauagagggauuuagcaaguuagaccauucaaaauauuuucucuauuaauaguaagauuccuuauacaagggaaaauuaaugcagucagauuaaagagcagauuucuauaagacacuucgcccuucuccagugacagaagcauuuguagaaauacaguucucauggaagaagagaccacuaacaugggaguguacuccagucugaauaccaagaaaacuuugaauuuucauauugccuuagccucuacacuggcuuuuguuuguuuguuuuguuuuguuuuguucuuauuuauuuuaaaauaacuagaaauaaaaauugcccauauuuucuaucguuaucuuaaguagucauccugugucuacccuccaccuacggucuccuuaagagagacauucugcuucgggcacuagcauucauaaguccuugugaaaaugccaucuaugcuuacuccaugguuggaaugaauacucccucccuguugccucucaucucuucugucuguucccaggucucuaugcucuguguuucugaauuuccuggaaauuaagccgcagcugcucaucccaucucggcuugcuuuccuuuuaauacaucugacuccagaauacuuuccuaagucauaacagcugcuucccucuccagucugcccuagaucuuccccuuugcccucaacacaucccuuccuuccagcggggaaacugccaggagaagaaacaaccucuucuucaguuccuuuuccugggauuucuaaaacaauucaacgaggcugggauauccaguguacuuaagaacuguaaauauacguaucggguagagguggagggcguugauggugugcuuucuuuuauacguuguagaguguguuuggagaaaagcugguggcuaaguucuuauucgagaccgauuucucagaugacccaaugcuucccucaccugaucaacuuagaaggaaaguacuccuuaaaaacaagaagcuaaaggcccaucagacaccugucgacauccuaaaacaaaagguacuccucucugacuaagcagguuaggaguaugccgugggcucggggacaaggaaguucacgucguuuggacuuuucagaugacuugcgucauagccagcguuugaagacugagauuccuuaaaugauacacuugauugggggauuucuaauucauagacccguagauucucuccuccacuaaccuacaguuucauuuuguaaguuguacccauguggacuauaccuccauguuuuuaauuuuguucuaaguggaguaacacgugacucuuaacucuggagccagccgucaagguugauagucccauaacaggugacauaguccucuuuagggagagcaugugggaccuggggugaacugaaacagcccuaagaucccaguguaucauagacacauggcaacacagggcguuuucucuuccaucaugcaagaguuaaguguucaagcuccagucuauaaagauagguccagauuccuccagaaaaugucuucaaacucuuuuugcuuaagcaucaaggauuuugaaaaccuauauagcucucauauuuuugucucauuuuuaaaaacuaugguaccuuguucuaaugacccaggcuagcccagagcuccaauccucuuaccaaaggugugaaucaccauguccagccucucauacauguuauauugguuuaacuuuuuuuuuuugagacaaaucuuucuggauaccccuggcugaccuucaauucauagcaguccuccugccucagccucuugaguauuauacucccaagccucacuuuacauuccuaaguacauuaaaaaucuuaucacaaguugaaacauuuacaggguauaauccuaggauaucauuuauuuauaucuacaugcccucaaauauuagaugcaaaauaggccucacugcugaagcaaucacucuucccucuagacuuaauuucugucugaaaagucugauuuuaaaaaauaauucauuaaagcauuguauucucaccccuaugauaaccaucuugauuuugaauuuuuacuucaaauagacagaaagcaggaaaaaguuagggaaaagaggaggaagugacuguguccuugaagguauuuucuagguagauacaaugguguuuccuugucuccuuuacauccucaggacuuucuuucagacucuucacauucuuagguguuccuuucacggggccucaagcaucaugcagagaugauuagugggugagaguugcaucucucugaauaaaacaggauaaacacuuugagggaaguauagggagugaggaagggugagaagucagcuguccucuuauccucaggcaaaccugauuguuuaaaugauacaaacacagaggugcuaaagguccagaaguggguuccuuuaaaacgugcccaaggggaugacagagagauggcucagcaguuuagagcacuggcugcucuuccagagaacucagguuccauuuguagcucugacacaguagcucacaacuggcuguaacuccaaucccaggagcucugaugcccuguucuggccucugagggcacugcauauacauaauacacagacaaaaaaaugcagucaaaaccuugacacagaaaaauuguuuuuaauuaaauuaagaagugccugaaccuacguaucccuagacgccucuguacucuguacucuguacucuguacgcauuguacaacugaaaaaccacauagacccucaauccgagaguugcguagucaucaccuucggaagccaagcaggaaagaccaguguaaggagccagcuggaaguggugacgaccagagugugccuaucuucaggacugaauggcucuaaucagaucguuuuaaaagaauuuaaaguaucaucuccauggagcauccauuauguguccuuguaauccuagcuacuaacaaagcugggagaguugcuuacuucaucccaagaacagggguacuugggaaacaccgugagagcccaaucuccuuuaaaaaggaauaugcuagcccagugguucucaaccugugggucgcaagcccugucgguuaaccucuaucuccaaaaauauuuacauuauuauucauaacaguagcaaaauuacaguuaugaaguagcaaugagaauaauguuaugacuggggaaucaccacggcaugaggaacaguguuaggaggcuugagaaccacugcgcuagccaaauaaaucuguuucagagacgaaacuccucccccaaggcccaaaaguuucaaaucuucaccaugagcaccaugguccugaccucacuuuugcuucaguuucugaaaaccauagaacugucuguggacuuuguagugaaacucuuuaacuaagaugcuagugccuguguguauguauacucuagcuggucuuccuuagagguaagggacugcccauccagaggggaaugcugauuucuucuagaauauuguuuucucaggcuagcuccuccuccucuuccuccuccuccuccucaucuucuuuuucuuccuccuccucuuccucucucgcccuccuccucuuccuccucuucuuccucuucuuccuccuccuuuucuucuuccucuucuuauuugcuuauuuuuuagauauuauacuuucuuuuuuuuucacgacaggguuucucuguauagcccuggcuguccuggaacucacuuuguagacuaggcuggccucgaauucagaaauccaccugccucugccucccaagugcuaggauuaaaggcaugugccauagauauuauacuuuuauuguaagcaauuuuauguaugauaaauauuguauaaauuuuuuauuguaaaaauaaggagcauaggagaaaguuagaauaagcaguuaauacaaacuguauuaccaaguacaguguagcagaucaucacagaugauauguauauaaaaggaaaucuggaagaaugcugaguguuucacagaccgaaaaacaaggccucuaaaucaagauggcugugugaagugcaauuacaguucuaggugcagaaacaaacuuacaaaguuauaauuacauccaagacagcagaagucauaacuuuuaucagcaccccaaguaaaaacauaauuacauguuacacaugaacauuuuaugucacucugaggccaauugaaguuuuauuagcauauacucaugauacagcaugauggacuucaugauuauaguuuuguucacauguacaaugugcuauuuucacacuuccuuacucucuugagucuaaccuucuacuauccucuuccucuucccaaauaaaacugcucuguguucauauucuauaugugugugcaugcacauuugaauacacauguguacaaguauauauguguuucugaguggauauaugugaauauaugugugugcacaugugugcauuaugugaguauaugcuuguguauguguguaugugcaugugucuguguacgugugugugaguauguaugugauuaugagcacuugcuuguguaugugugugagugugcauuguguaugugcaugugucugcauauguguguaaguguguuuaugaguguguaugugagugugugugugugaauaugcauugugugaauaugugcaugugccuguguaugcaugcgugaguguguguauguguguaugugugugcgaguaugagugaguguaugcauuguaugagaguugccuguauauauguguguauauaugugugagugugugugugugugugugugugacuucaggguuucaacacaccacugugugacuauguggcacuguugccaguaggccuucugcauugccuccugucugcacaugugacacuccuucacuucccacaggguucugcuagaugguuugccucuugacuccugcuccuugaccuuagcuugacugcucauuucucuacagugauacacagccuugcuuuugggguucacuuguaccuggaacagcauuugguuuuuuucuaaaauuaaaaaacaacucacauucucuccccucuccuaacaccucccaaaucaucuauccauucaacuucacguucuuucucacucuucaaaaaaagaaaaaaauacugauaccagucacacacacacaucaguugccaacuucuaagcauauagagugcccugaaguuguugauaaacccaguacuccaguacuacucuauugaaaagaaaauaauuuucccucuccuugcaaauauuaguuacaaauagcuucuugguuauggguaggacuuggugccugcuuuuccuuuucuguguuugcgcgcgcgcgcacgcgugugugugugugugugugugugugugugugugugugugugugugagagagagagagagagagagagagagaggagagagagagagagaaagaucacauguugugguggucaaauaccaaccuucaugaguuaguuuucucuuccuuccuuucuucuuggguucugaggacaaguucagguugacagguuuguguuccaaguguguuuaccuucagagccaucuugcaagcucauaucuuuacuuuuguucaccucccacuggaauuuagcaauuccucugauuauaaauacagaaggaagaaaacaguaguuuaggcaauaccuguguauuuguuuaaccaggagaaaugacaguuuucuuguugucucacagauguuaguaauaucugcaagaaguauuucuauucauccuauuuuucaaaacuaucacuugacccacuaucauauguuuuuaacgcauuuccucaaauuuuuguuuuaaugauuuaucauuauuaucuuuagugggagggggcggugugugugugugcacaugauuauaggcaaaguuaccuguagaggucagaaguaucaaaucucccuugacguuaaacuuacuuuucaaaaacuaauuucauauuuacuuauuuucucugugaguguuuuucuuguguguaugucuaugccuggagcaucagauccucuggaacuggagcuaugaaugaguaguugugaugcauugcgugggugccagaaaucaaaacaagugcuuuuaacugcugagccguaucccuagcccuuuuacauaggcacucuuaaccacugagccaucuguccggccccagguucccuaaaauuucuaagccuguuuuguuauuuugauuuauaguuccaauaacgauagcauccguugaaaaguccucucuaaacuacaacuguucuggucugcuuguccacagggauucuagaauuguucucaaggucagaggacuuucaauauuauuuuaacacaggaaaaaaauuaaugucuuagcagagacuuccugcucuaaagcugaugggcuguuucacucugucccucgggaccaaugcuaguuuuccaagcaucagagguuuucucuuacaggacuuucucaaggguuuaggaauccagauaccacacacagguuccuugugauuauuucuaaaaguucuucccaaguucuuccuuuaaaggugccgauacacacacgcacacacaggcaugcacgcgcgcacacacacagcuguauccagaguuuugggggucaaaaaaaaaaaccugggcuacagcagccacaauaaacuaagcucaaccacuggcccuuaugugccaauuagaaacauguguaaugguggaaagcaaugagaagagauuccucccccacccgccugggagaaaggccggauggaggaaccccuuaacaucacccccaucuucaggacacaggcaggacauuagcuuuaaguggaaggcgagaggugugcacaggucucuguccuggaccugucaggugauccaaagaaguccuuaucccugaaggaaugagauucuuaggcgaguacugcugauucagggagcagccuccccguuguggauaacuacccucaucugagugcaggugggagagucuguucaaugagguacucuuguucuuguacucuaaggugacuuaaaaggaaaggcuaaggauaaugacuuaucuccguuccuucagacuugacagguuaggauaggcgacagguuagacagacacugcuugagugacugucaugccuguaugccaaggaacacagaguaacucauguaaagugggguaaccccaaguaaagaagccagacacaaaaugaauccaagaugcuaccccuggcucuagcuaucugugggccccagugaggagccaaagcuaauagcuggugccugucuuacacuaaauccagauauuuucuucucacacaaaugaaccuggaaagggcaauuugauuuuacagcugugguaagcacuugguagcaguuuugaagguuuggguagaagcucacuaaguugcaugugcagucuuuaauuguuccuaucuuucaggcucaucaguuagcauccaugcaagcacaggcuuucaccggugggaaugccaacccgccaccugccaguaaugaggaagaggaagaugaggaggaugaauaugauuacgauuacgagucccuguccgaugguaagagacacagagccuacugcugugaauggggaagugcucacgugauugguuuuuguuuuuuuguuuuucuucccaaauaagucuggaacuccauagauaagcaauacagaugauuuuaauaaugucuagggguuugagaauccagacacauagugaggacagaggaagaacaggguucuauuaaguaucacagccacacucuaggaagacaagaaccgcuuggaaagcaaggggagggggugggguguaggugucacuccagaaaugaguuuguagaggaagcggcggggguggggguggggagguagggguggggguaagaacagaaaaacacaccuucagccugugaguuucugaagugguaaaagcucuuggcagaugguucagucucucucucucuuucucucucucucucucucucucucaugccaccugcaagggacagugucauuacuguucugcugucucucuggggaucuggcaccagaaagaggcucguucuccuuccucccuguucucggauuacuaacccaacaagucauuuccuucuggccccacaagagagaaaaacaugaaugaugucuaaagguugcuagugaaggauucuucucgagucagaacuggggucugugugugcuucacuugccuguaauugguaucauuagccggagauuacacaguguuuucuccugcaaucuugcugauaguuggcuuuuacuuuggugcccucuaaaagguaucaguguucccaugagaaaacaccaagguuucuaauugcgcaaaccuuuuuuuuuuuuuuuuuaaaugagacagagucucuuuguuuaguccuggcuggccuggaacucauggucuuccugauuccaucuccuauguagcauucuauagugggcugaggguuuggcucagugguagagcauuuauaugccuuguaucaacaaaggcccugugauccuuggcacacacaugcugcuuguguagcuguucccacacuaguaaacauuugccauugauguaaagaccacuaagcuucucguguucguauuagcuucucauguucaaguuuguuuccagucauguuucaguucagagcccucauuacugguaacggucuaguuguguucugaccuaaacuauaaugcuaagcagugaccauuuacuauuuagccuucguaauagcugacuaucucaugccaucagcuaaaggcacacuuauuugacuggaaaugccacgaggcaauaauuugaauggagucaagacaaguuauuagcauccuagaccuaaacuugucacaagaauguguagaguaucauauugacguguccacccccaugauaaugcccccauagcaaaauaaauggacccagagaauaaaugaaaaauuauacugaugaaaucagccaguccagauguuauuugcuccuguaguaauauaaauucuuucuccaucauaaauuacccuggggcuuuuuuuguacuguugaaagcaggaaagggagcuuuuuaaauuaacauuuccguauuuuuuauuugcaaauagugaaauuaaacagaggaaagaaagaacguucugauuuaguuuuguguagggaaguaaaauuuaacucuacucucccacggaauuuauaaauuaguccuaugcauguucaagguuuggauggaguauucauugaaagcugaggccuaagcaaacucuacucccaugguguaugaggcuuuggauaaugacguuucaccacuaggaaccagaaguuucucugauaugucaugaaaaaguucuaucgaauguuugauggugcucccacauacagacauucucucucucucucucucucucucucucucucacacacacacacacacacacacacacacacacacacacagagaccccucugugaucuaugacagcugaaguccacugucauggcuauuucucauuucauuugaaagauccucuggcugguugacuuccaaauaggccuugaggucaugguaugccuugugaaguuuguccuaugacagcuuauauaggcaaccauuaaaugccuuagcaauggucuguuuucaauggugguugcaacgcaucucucacgucucugaguuuaauuaaaucuauaucaagaauaguacaauccuaacuaguaauaugaaugagcaaauuuuagcaugauucgaauuaacaaugcuugcuuuggagguuuuuguuuuguuuugauacgaggucucacacagucuaggccagccuugaaugcucuauguaucugaauaugaccuugaacuccugauccuuucgcuacccaaagaccaggauuggcugcauuuccuuuauugcuaguccuugaaucuaugacagucaaaauauuaguucucuaagacaccuccugauucauucccuugugaucuaagcuguuguaaccugugcuuugcuccaugccuuaauuugauguaucuggcucugacuuaauucuccuuaccuguauuuucuuucugcuucucuuucucuguagcagauguccuuacugcuuccccuguuccuaacagucaggaagguaaaugucauuuggacccaguauuuuaacugcauggaugucugcauuaugucuccacuguuuugcgucugauuagcaugaaguuguggcacuucugugcauagaaaugcagugaaauuauugaucucuugguaagcugcaugccccugauuugguauaaggauauuuuggucuaagcauuugugguccagaaagguagugaaucuagaaugagauauuaguucucuugcuuuucacuuuaaaagaauacaaucaugacauacuuguucugaauagagcugucaaacauggcaaaaaaaaaauccaagauuaucuaacauacuuagaaauauuuacauuaagauuauaacuuaaaaacaauagucaugaaaauuuuacuuuucaaugaauuuaaauggaagaaacuuugcauugugcauaacaauaagccuccucccgugaauuuuggcuuugauguuucuggggucaaaagaagcaaauaacuucauuucaaaggaagccugauuaacucacaaauguaccacauagaaaugcuugaaccacuagauccuucccagacccgugugccaucagccuuuugacauaggauacaucuaucugugcaaagugggccuuuucauuuagaguauaucuguaugguacuaaaacuacugcuaaaugauucugcgaagcuaaauauauaacccagauuuuaaaauugugcuucaagucaucauuuuggcaacaugcagccagcgucucagucuucuggauacacacgaguaguuggaucuccucacacaaagcccugaagggaagcauuugguucuucuucacugaugccugguaauucauuuucagacaauauucuggaagacagaccugagaacaaaucaugcgcugacaagcuucaguuugaguacaaugaagagguccccaagaggauaaagaaagcagacaacuccucuggcaauaagggaaagguaggcgaucacuuuucuuucuuuuaaagauuuuauuuauuuaauguaugugaguauaccaucucugucuucagacacaccagaagagggcaucagaucccauuacagaugguugugagucaccauguggaugcuaagaauugaacucaggaccucuggaagagcagucagugcucuuaaccacugagccaucucuccagagauggcuuuucuuuacaugauucuugaacuuuuggaguuuugucacuuggcugggacuccccuccccuucuuuuuuuucuuacucagucucccucagaugcccaaguccaaguggagaugcuauaggacuacugccugccacuugccauaauuucacccaaccaguacccauuggggguauacguuggcaggcacuggaaugguaccggggauugguggguuagugguugagacagaccuguaagccauguuaguugauaagcaagaagcauagugaucucacuguauugccagaggaucaagaacagggcgucacggaagauacucuuugaaaguaaagauuugcccaaguguacagaaacaggccacuccagcaagaggacaacauuaaagucauucacaccaagaacaugaaaggaagccagguuaugaagaauuagcaacaccaccgagaucugaaagacacauaagauacccaagucucaccccgaggugccucacagccuauagacacugaggaaaucuguucagacaguggcaaugucaaauuuuugaagcaaagcauauagaucaucaagccucuauuaauucaacaaauguguauagacuacucccugugaaagauaaugcauucuguccuaagagacaugaaggaugaauuagacacaguccuuucccucacaaaggcacugagauaugaaugugaagaaauacuuaguaaggagaagcauucugaccaugagggagagguauagagaaagcgcuuuggggauucagagugaggggacuccaccuucugguaaaacgguguuauuuuccuugaaagguguaugacauggaacugggagaggaguuuuaccuuccucagaacaaaaaggaaagcaggcagauugcaccggagcuuucugaccucgucauuuauugccaggcaguaaaauuuccagguaagaguagucaauagucuaugauuuaaaguugccaaaggauaaaagugugcuauuugucuaaugagguguuuugaauacuccaaaauaacuugauugugugauugaaauaaauaauuuccauagaucaucuccgacuuuucauaauaauucuccaagguuaguggauuuccacuuguauuuuuuuaaacauuuguuucuuucuuuguuuguuuuuuauugcauggguguuuugucuguguggauauaugugcaucaugugugugugugguaccuucagacuccuuggaacugggcuuauggacagcugugagccaccauguaggugcugggaaacaaacucaggucuucugcaagaaaagcaaguccucuucacuggugagccaucuucccagcuuccuuccacccauucuuaaauaaaacaaauucugaagcacauaaaguaauuuccccccaagauuucagagcacacauguagaacuauagaaauugacuugagcaaagaaagauauuugguugcugauguacuuuaaggaagaagaagaagaagaagaagaagaagaagaagaagaagaagaagaagaagaagaagaagaagaagaagaagaagaagaagaagaagaagaagaacuguagccugaagaugcccagccuccagugcaguucagcucaggcacaugccuucccucucucugucauucucuuuccccagccauugaguugggaggcagcuauagcaagccaccaucagaggcuucaaaacucggguucaaccugccauuucuucaaaaccuccagcagaagugauacuguuucucgcugacuuacuuucccaaaccuuaaucaaccccuguaacuggagggcugugguauucugaauaucuggugcugggaggaucuccacaugacagccuggacuacauagucccugagcuguggguuugaggcucugcccaaaccauaaggaaaggaguugugggaagagaggaaguuuucccacuuggccauugcuggaaacacaauggacuuuauguggugaaccacuucaaaaaaaaauuuguucacuaaguaaauguuagaucuaugaaucugaagccugucuuguuuccaaagucccuccuugaacugcaucuacucugccucuaaucaggaugaguuuggcucaauuguguacuccauaaauguggaccaagagaugaaaaaagaauaaauaaaaagauagaagucagaaagauuagucuucucauacaaauaauccuccaaucugagcucuuuccccaccucagcaaucuugggcacaaggggucuuuguguuucguuuucuuccagaaacuauaaagcuuuuggcagcugcuacugcucuucugcuaguaaacccuguugcagaugauaugaaugaauaugcagcaaauauuucaaaaacauaccggaagguagcacuuaaauuuagugguuagagacagcuuggccguuaagagcacuugcugcucuuucacaggacccagguuugguucccagaacccacaaccaccucuaacuucaauucuaggagagccaaugcccucugauugccucuuugaggaccaggcauucacauauugcacauaugcacaaguaggcauacauacauacuuguacauuuuuaagcuuuuuaguuucaugggacaugauuuaugccgcauaaguuugccauggucauauuuaacuaauaccuagugaugcuuauuucauuguaaaauuggaaagguaaccuaccggcaucagaucaagugugggggccauauuguucaagaauaacacaagccuauaaucccagcacucagauugcauagccaagagauuugccucuaguuugaagccaauaccgucuaauauaaugaaguccaagucagccuaaacuauaaaguaagacccugucucaaaaaagaaaaucauuguugcuucauguuucauucuuuauaaauacagguaacacuauaaaaacaaaaaccacucaacugguuuugucuuuucucaaggauuaaauaaacuggaagcacaaauucccacagauauuucaguucagugggaaagauaaaguuauaccaaauagagaauugugauagggucaguggccauuugucccaacuccaaacuuaaaauucagaauacauauguaguuguucuguuuucuguuuguuuuguuuuugagucuuuugauuaguuguguagccuuagauguccuagaacuacguagaccagacuggccucaaaugcacagagauccaccugccucugaggugugcaccaacauacacaccuggcuauuauuucugguauauuuaaaagauuuacaaaauauuuuaaaagauucuaucuaucuaucuaucuaucuaucuaucuaucuaucaucuaucuaucuaucuaucuaucuaucugguuuuucaaggcaagagucucuuuguguagccuuggcugucuugcaacagccaacucuugagugcugggauuaaagacaugcaccaccacucccuggcuuucuaaauuuuauuuuuauuuagggcuguguaugcaugcaugugaguaucuguguguauguguguaagugacuaauguuccaggagaggagaagagggcaucagaucccucagagcuauaggcuauugugagccaccugauauggguauugggaacugaacucagguccuccacaagagcaggaaguguccuuaaucacugagccaucccucugacccaacacagcacauacucuuuauguguuguucguuagcaauugaaguuucucuacuuugucuauaauuuaauguucuuucucagaauaacuaaaaguauuuccuuggagucacuguuauaguaccuccuaaaauuaacuauuauaauuuuuugguguacaugagaaaaauacaagguguuguuaccuuuuggucuuguguuugauaaguuaauaaguugcauuaucaguuucggugaaucucagcuuucaucauuauccaguccagucucagaagcacaggccuagaguccagcugcuucagaggcugagacaggauugugauuuugaagguugucuacagaauaauuggaaggccauccugggcaguuuaacacgacuuuuucucaaacuuaaaaaagaaaaaagugagguuauuagcucagaaaacuuuguuggcacuuguaaauacucaggguucaauuccuuauacuaaaaaaaaaaaaaaaaaaucaaaacacacacacacacacaucuaacaaacaaagaacaacaacaaaccagaagaauguagaugaugacacaaagucccuaggaguaaaguacccucugcccaguugugaaucuguccaguggcccauggcucaguucccagggcuggguucuuucuuaggaucagggauauaaugcaggcucuuccuguuucuaucugcuguaggaugugcgucucaguuacauuuagcccuuacaucuccaugccuuuuccuccuccuucuaauggggaaagggcauuaguacucucucauguuacccaucuuaguguuuggauacuucccagcaagcaacuugucuacccaguucucaucaggcguacacuguggccuuuagcacugucuguccuuuguggccuuuagcacugucuguccuuugcucagacagaauauacucagacugaggaugcagcucagugguuggguauuugacagaaugcacaaaacccuggaccaacccccagugcuaugaggaauagguaagaauagucuaagcuugacccauucccucuaauccccuuuacuaacucccaaacuccaaggccaugagucucuauaaagaaucugagaggagacuggagagauggcucagcgguuaagagcacugacugcucuucugauggugcuaagaucaaaucccagccaccacaugguggcucacaaccaccuguaaugagaucugacgcccucuucugguauguuugaagacagcuagaguguacuuauuuauaauaauaaauaaaucuuugggcuggagcaaauaggguugaccggagcaagcagagguccuaaauucaauucccaacaaccacaugaaggcucacaaccaucuguacagcuacaguguacucauauacauaaaauaaauaaauaaauaaauaaaucuuaaaaaaaaaaaagaaucugagaguuuccauuccuccgugguaucuucuuucgcaggccucugugcauauagacauguguuuauauucguuuuucuaaagacaaauaucuccugcaguuaccaaauguguuugugugugugugugugugugugugugugugugugugugugugagugugaacccuucuugggaugugcaguuccuuccauuuaaaaaaauauuuaauuuaugcauauggguguuuugccugcaugcaugucuguguaccaugagcaggcaguccccuuggagaccagaaguggggcaugguauucuucuggcccuccucuggccuccaaaggcacaaccugcacaugguaugcagauaaacaugcaggcaaaauacccguaaauuuguuuucuauggaaaguacuccacaucccaagaagggauauauauggaaaauauuggguagguagcaaagucauugggcaagcuuuuucaugcauggcucuuaucugugacuuuagccaacaccaauccacccucugagccuccccuccuuauugaaaauagauuguguccucauauuguauauccugguuacuguaucccuucccucuacuccucccagcuccucccaacaucucuuuccaucugcauccacucccuuucugucucucauuagaaaagaucaggcuucuaagagauggcaacagaacauaacacaauaaaauauaguaugguaaaacaaaaaaagucacaucaaaguuaaacaagggaagccaaaagaaugaaaaaagcccaagagaagaaucagagucccacuuguucacauacucaagagucccuuaaaaacacuaaacuggaagccauauuauauacacagaggaucugguauggaccugugcaagcccaguacuuggugcuuuagucucugugaguucagauggccuuguucuccuggugucuuccauccacucuggcucuuacugccuccucucccacagguuucucugagcuucguuccaaagucucuguguauguaaugucuggcugugggucuguauuuguucccaucugcuacagaaggaaggcucucugaugauggcugaacuagacaccacagcagagcaucauguaugaggaguccuuucaucacuacucuuuauauauauauauauauauauauauauauauauauauauauauauauauacauacauauauauauguguguauguguguguguguguguguguguguguguguguguguguguguaagaccaagaguauuuggcuuguccucaucccuggacuaacuagucucugguucuuggucaccccagcagugucagauaugcucguuugugcuuuuaagcacaccucugucuuuucucuacccauguccuuacaaggguuaccguuuucuguggaagaccucccaaacugcuacagccuaaagaguuacucuccauuugugaucuuuuguuuugcgaauuguaucuuggguauuccgagcuucugggcuaauaucuacuuaugauaugcacucacugauaaguggauauuagcccagaagcuaggaauacccaagauacaauuugcaaaacacauaaaacucaagaagagggcuggugagauggcucagcagguaagagcacccgacugcucuuccgaagguccggaguucaaaucccagcauccacaugguggcucacaaccauccguaaugagaucugacucccucuucuggagugucugaagacagcuacaguguacuuacauauaauaaauaauaaauaaaucuuuaaaaacaaaaacucaagaagaaggaagaccaaaguguggacacuucaguccuucuuagaaaagggaacaaaauacccauggaaggaauacagagacaaaauguggagcagagacugaaggaaugaccauccagagacugccucaccuggggauccaucccauaaacaaccaccaaaaccagacacuauuguagaugccaacaagagcuugcugacaggagccugauauagcugucuccugaggggcugugccagugucugacaaauacagaaguggauacucacagccaaccauucauugaauggagcacaggguccccaauguaggaacuagagaaaguacccaaggagcugaaggaguuugcagccucauaggaggaaacaaaaugaacuaaccgguauccccagagcucccugggacuaaaccaccaagcaaagaaaacacauggugggacucauggcucuagcugcauauguagcagaggauggccuagucagucaucaaugggaggaguggcccuugggucuugaagguucuaugccccaguauaggggacugccaggaccaggaagcaggaguggguggguuagugagcagggggaggaggggaagagauaggggguuuuugaaggggaaaccaagaaaggggauaacauuugaauguaaauaaagaaaauaucuuuuuuuuaaaaaggggaaaaaaaagaguuacucuccaaugaaacagcuauagacaauagugaugauggcuucccaggagccuucaaaucacucuucuuaaacuagagcugggucugugugguuggugugcguucuuucucucacucagcaaauauguacuacauuccugcuaugcacugggcaccgugccuggcauaaaggauccagggacugaauggcccaggagugagaaagaaaagucacaaaagcaucaucaucauuguaucuuuuccacugagucuucagacuaauccuaggaguaaauuccuugaaucacaccuacuuuuuuagauaagaaaaaagcagaaguuuuggucaacgaucaugucagaagaauuuuuuaaaaaaucauuucuuuaaauuuuuugagauuacaauuguaucauuuccaaaaaaaaaaaaaaaaacaaauauaucauuuucuucuucccuuuuuucccucuaauccucccccauauaccccuucuuucucucuuucaaacucguggccuguuuuuuuuuuuuccauuaaguguugauauauauuuuucauauauauauauguauaaaauaauuuuuaguaauuguuaauauauauuuuucacauauauaacaauuuucauuaauuguaugaauacauauauauuguaugaauauacacacauauacauacacacacacacacacauauauauauauauauauauauauauacauauauauauauauuuuccuuaaugcauaguacagccugcugagucauuaucuugcuacuuguauacaauauacaauaugcguuauauaugagaacugccguuguauaugagaacugcccauuuggugugcccuucccugagggugacugucucgcccucucucagcauuccuuacuuuaccauuacagaaaaccacagccaaucagaaugcagaguugugacgcucagucccaaaggauacaucaacaaaacuacuccagcaccuaaggcucggggaacauuggggaggagcagcagaaagauuguaacagccagaggauuagggaguuugcugugacauuguuuccuaggaacaaugucagaagccacgcccauaaacacaagaugaauaacaacaagaauagacaugggaauguggauggugaaagcccacgaggcuucaacaaggaaugccagaagacuucuaguauggacuaaugcuaugcccaggcucaugauuauucuuucaucucuccaaauuggucauuaaccucuaggaaauaaauauuaacugcagcauauucuguaugugcaguuuuaaaacucagggacacaguucacuagaaguguguguguguguguguguguguguguguguguguguguguguguguugcucuguaauuuggggauuacuccuuaauagcuaugcaguguuuguugcauuuguuuagagauuaaauaaacuuggcuauauuugccuacaauacuaucaucagccaugcuaaacuauaauggauccucugugcuguguaacaaggaaaugguaggacugcaaucuaaacacuaaugaggauggaaaauguugagcccucuugccuguagcuuuuggcuuauuuauuuucauuuuaugagaacaggccugucaacucuaaauucaucuggcucuagcagagggaaagaaaggaaaagcaggaaguccauuuuuggcaacaauccuggcagaaugagccccggggagacagcgccauuuaacagaacaucuggaaaagguagcauugccuucucucaguaucuuugcuugguccugcaugccacaugacucacacauuuugcugucuagccacuuccuuugaauuuugaaauccaccguuauguucauagauguuuacacuacccaagggcaacauaaauguuuuucaauuguuaauuuauucuuugaacucacugcaaauggcauuuuuacugacgauguucucacauuguucgccucaaaaguaaaauuggaagcaccuuccacuguucuagcaguuucuggaacagcgucccgaauccacaggauacauuauuucacuucuaauuacuucucauuguaaaaguaauaaauucucccagcuaagaguccagcugaugcacaagaggaacagaauuccuuuccauucucagugcugugauguuguuucucccacuggggaauucacuguaauguguucaaggggaaaaaaaauauuuuaaagaaaauccaaaugggauguaaucaaacaggagcucucaguugccacacaccagacuguacauuugucggccuuauccucuugcaugccuguauaauauuccuuuguauggacaucuauuuaaccacuugaucacugauagaauauuuggauuuuuguuucuuguuguggguuguauauacuuguauacagacuuuguauuuguaaagauugcccacagaacaaugaaguccugagacaaacagacuuauagaaguccaauuuaaauuggugucacuauccucacauuauuacucaguuuagguuuugauacuggugguugaauccaaaaccuugugccuggugauguguacccuaccacugagccgcacccuggcucgcuacccucauuuuuaaaacucaauagccgccauguuucaagguagcaaacuaacucacaagucacauucaggauauauuuggcucuguuuuccuuguugcaacuguguaucugaugugcagcugagagugaucuuucaagacacuugaagcuuuggcauuaaucaggggcugcuguuuugccggguuuagguuccugugaagggaugcgacacaccugggaggaaucuucuccacucagcccaagcacaucccucagcgcuaucaucaggacuccuaaaugcuaucacaucuccucacugaacgagaacgccgccaaacgucugugccgcagggguucucagaaacugauccagcacaccgcuuaucagcugcugaggaccuacccggcagcgaccagaaucgacuccuccaaucccaaccccaucauguucuggcuccaugggauacagcuuguagcucuaaacuaccaaaccgaugguaaggagccugcguccucaccgcucucuguauccuaucuugugcaacaguaaaugcaguuccgugaacacuuguuuucuggagauauagaggggcugggggagaguccagacagggacacacguaugugggggguggggggagaacauaggacagaaaagaaggaagcucaaaggaauuguuuuccugcuguuuuggagugauagaaaagucuauccagcuggauuuuaaagcucuauagaggcagggauuuccaagcgucacuuauuaacugcuucuucucacaagucagaaaguagcagccagugacuagggcaucacugugccucccuugaauuccagcacuccagagauggaggaaagagacugccaaguccagugcugacucagacuacagagagagccugucucaaagggggaaagaagccguguuacuucaaacaccacucagacgcacccauuugcccaaggcugcagugucugacagugauaaguucagguucucuggaaguuugggcaaaaaggcauuuguuuccacauaccuuagaaaaugagggauguuuccuagaaccuuacgcaaagucuugccuuuccuuugaacagcagaggugccaguagccccugccauuuaucucacacgcucuguaucugaacaugugccaaacaguaaaccaucgcaugcccuggcuccagcugagaucaggccgcagcucuuaacucugggacagcgaggugccuggcacuggugucaguggcggaugacacuaaacaccucugcuuuguuuugccuuuauuguauuuacugguuuuaguugagauugccuaagaacgguauagcuggacaagcagcuugcaaagcucccaucccaggaagaaagcaccgcacaggagcuaacucuccuuaaggguguucgauaagcuguucagaacaguaugauuuggacucacaaguggaaaucauggcaaacuacucucugagcuguaaaaguuuucuuuuccauuucuuuccaaucuuucacaagcgcccugugacuucaccucccuggcucugucugcagcccugaguccaaggcuuccuggacucuuaugcugcugaggucuuuuaagcacgccguaauaacuagcacagugauuuccucaaggaaaugucaggaugcuuggcuugggaugcauccuguuccugaagugccagggcuggugcagacacgcuggcuccauugauggcaaaugguacccuagcuaaggggaauagaaaaagcuaccacuccugagccuacuccauagucuacaacacaaacugagccucagagugccuuccacucaccccugcagucuucagucccgucccccccacacacacccugaucaagcuaggagcaccuguuggagcuacucaacucaagggaggcagaugguucuuguauagugcaucugcaagguucucugcagagccuugcaacccagaaagagcauuaucaucuaaccucucucagcucuauucagcgagccuuauacaccaccacccccuugcugcacaaggcacaagcuccaugcagagccaguauguccaucuauaagacuggccuucguuuaugcaauugugaccugaagccucccucaagacuuugcccacaguagauaaucaauaaguacguguugccuugagcugaagcagacuguccugaucaaucucacugaaauguggaccugugguucuugauuuuuaucuuugggccagaucuguuacuuucacacugacacauuagugagaggauauaguuugucaaugcauguacggcaugacaggagucacaggaagacaggucaggucgucacaguguguccacagucaggaaccagagaagggacauggaauagaccuaggcuauaagaccugaaggccuaucccaaugacccacuucuucuagcaaagcucuaccuccuaaaguuuccacaaccuucccaaaugguggccaaagaccggggaacaaguguuuaaacauaugaaccucugggggaacaauucacacucaaaccuuaagaugauaucuucugggugcuucucugugacuugagaauccagacagauaagcaaacaauaucaauauaaacacuuuucaguuguucaaaguaauuccgagguuaagaaauacuucauuuuccaaggccuuuccuagguccggccagcaucuuuaucucaugggauucaucucccuugccauuuuguagaugucaggggaucuuagugccucccagggguguccguggaacuaggaccaucuguaguccauuuucaagcuuccagcugauuuguaaacuccaagaagugaucagcaggcccaugcucaauaacagugaccaauaagccugugaaccugaagccgauacacaaagcuguaguuaccauuggcaacggccccucugaguucuuucuguuaggucagaaugagucuugcgccauguacaucacaaccccagucagaaagaaaaggcugcuuucuaaaaaccauguaucaugcuuuauuggguugaaguugcaguuuucagagugauuuuuuuuuccccuucaagguccuaaauaaaaggguaacuuuuaagagugugguaucugcauaccacgguguuuuuaagugauuaggagaccaugccggugauggaaugucugaucugccccaauauacacugauucagagaggccaaucaggaugcacugguucauguacuuuuuauuugguuacaaaugaguuuccaaacuggagcuguagcugcaggugaccacuagaacgccccccuugaagacagaagaggacuuacauuugagccucucuuuauuuugaacugaacagcuucauagagaucuguuuuacauauuggaguaccaaaugggaucuuagcuaagaaaaggugguuuagagauuuuaauagcuaauaauaccacacuuggaaacagagaccggcagacauccccccaacccccucauugcgaggaagaagcaggccagucucugaguuuaaggccagaauggucuacauagcaaguuccagacccccaagauacacaauggaacccagucuuaaaaacaacaaagucuuuaaaagcaauuagguuaggcccagugcagagaaugucugaccccaaacuugagugaaguugacaucuuuaaaugugagccgcuauuacuguuguugauugauuaucuuuuaucuaaaauguuuaagacuggaaguguuuguggaugugaaguuuaguuguuugguugguugggguuuuuaacagauuucaaauuuuuggaauguuuguagaacuauauguguagacucuuucgaucacaaccaaucgugaggucagacagggauuuuuacguuauggugucauaucaaugcucacaaaguauuggcuuuuggauuuucagaucaggaaugcuguuuucaaauuggggguaaaaccuauuugaugcuuauccaccucaaucaagcucgauggguucacucuuucaagucauccuagcugagucuauuucaugucacagaguggccaaggaagggacagcacaugcucuguaagccagucacaucagaacuggaaggaaccggacagguggauguuaugcacugauucaacagaggaaaccaaggccaagaagcuugaugugccuaauacgucuucaggaauccucgcacauacacuuggccaaccucagacaugcggaaaauuuuuauacacaagauaccagagugggggccaagucuuuguuguucaaaggcacuuagcacucuuuuccuugauguugguucauguagcaaaggucauucggcacauggaaggaaucuacaagagggaacauuagucaggugugucucagaaaccuuuugcucuuuugggcaacauuuguacagauugagccaucagaugaccacaugaguauggaagaguccagaaacugcacagucguucaucaaaaauugugccaaauaaaauuuggcgacaaaacacucaaagccuuugugaggguuccuaaaguuuaugacugaggagccuguugaacaugaugugaaucauauguggugacuuuuuucauauucagcuauaacaaaaaaauagguaaaaaaaaauaauuaugggccaaaaugaagauuucaaggaaaugccguuuuucuuccuugcaucguuaagauuuuuaucuuaccuuugaaauagcaagaauuggcuauaaaauggugugcacaguuugguauuuguagaugaaaaaaaugggaugagucuuucccaagauaaugguuuuguuccaaacaucagaaaaaaaugagguauuguaagccaagguuucuguuggagguagugaaguuuuacaugcagaaguucugaaggggcugaaccuagcuucgaguuggaaaauggggcauguucauugaugugagcaaaguggauuugggugguggugguggcaguggugggcaguuuguuugcuuuguuuuguuuuuguuuuaucuauuaccugcuguaucucucucucuccucucucucucucucucucucucucucucucacucacucucucucucucucucuccaaccuggcacaugguucucauucaucagucuauggagcgugguucacuuaggguuucuauugcugugcuaaaauaccaugaccgaaagcagcuagcagaggaaagggacuacauccgcauacaccucucggguccuucacugagggaaggcagggcaagaacucaagcuaagaacugaagcagaggcaauagaggaacacuacuuaccggugugugugcuuucccaggcuugcucagucagcuuucuuacacaacuuagaaccaccugcucaaaaguggcaugacccacacaggccugggcccucucacaucaaucguuuaucaagaaaaugcccugcaaaguggccucugggcaaacugagggagacauuuucucaacugagguuccucagagugaaaggcugcuuguuugucucuucuucaugaaauaauguguaaucuuggcuuuguuuguucuacagaccuuccuuuacauuuaaacgccgccauguuugaggcgaauggugggugugguuauguuuugaagcccccuguccugugggauaaaagcugucccauguaccagaaguuuucuccacuggaaagagaccuagacaaccuggauccugcuaucuauucuuuaacugugaguacacccuuguggucuaagcaaugcagcauuuaagccuccaggaaccauucuggaacucagggcaucgcaaagcuguggcauuucaggucgugcagguuuaguucccgcaauaauuucauauuuccuagaaagcagugacugaggucaggcaugcugucauagacucuguguuucugagucaggcagguggaguugugagauucuugcuuuaucucauaaacuaauaauggucauucugucuucuaggguacccaaaaucacaaugguguccccauaaauguugagcucagucagacagacuggcaucaguguauacacacagugaggcacauuucccgcuuccugucuaaccuuguguuuccuauuacuuaggucuuugcugaguuauuggcaaaacucuacagauugccaccuuaaaguagagaacuucagguuguuagucaccucugcuuccuccuucguuugcuccccuuagcuaacaggaaaaaaaaucagggcaggagauaggagagagcaaugaacaagggucguuguuucuuuuuuuuuuuuuuuuuuuuuuucagcuuuaaaucucguuuuucucuuccuaaaggaagcauccuccuggugauccaaauaccagggguaacuguucaaacauucucccaccacccaaauugcuuccucuuucgcucuaaacuggaagagcaguugccucuuuuauaucagaccauuuuagcaagaguagacuuguuuuauccguuuacagaaggcuacgguuaagucucaaggaaacccggaaaccagcuaacuggggugccuguuaacaugucaaaauggacucugucugcuagccucucucaacugcccaguaccuguuacauguuauccuggcugccauauccugccccaagcuguccagcccagagcuucacuucccucccuccagcuucucugauucuuauauuacccagccauuuugucugcaagguccuuuugcccuauuuugccucuuggcugcagcucucaguuccaguucucaugaccucuuggcuucuggcucuccccuuugcccuaccugguucagucugccagccauguucagucuggcccaugccagaugucucuggcuguaccuucccucgugccuacaauaaacauucuccucgacccauaccuaggagugucauauccucauuucaucuauguuuuuccuugagcuaugaaucaauuucugcuaacaguguuccauggcuuccuccaaaacaauugaaggagauuuuguaguuguaaaauauaauccuguggcacuuagaauagauuguagauagcaaacucauguugaugccgaguaggaucucuugugaucuguaagaaaugcaguuuuguuccagugcuuccuuuuuauaauauuucaaauuuugaccauugagagguucaguucaagugaaugcuauaagcaaaauaggguuuucaagugguucuagcuacgugauuacccgaguaguuacccgaguaguagcuacgugauuacccgaguacaaccccuaggguuugcauaaggguuuuauuaaccacccaccucauccauuguagcauucucuguggacagaagcuaagagaaccaguuucuuuguuucucuuucaucgucugugaccuugaucauuugucuuccccuucagaucaucucuggccagaaugugugcccuaguaacagcaccggaaguccaugcauugaagucgacgucuugggcaugccccuggacagcugccauuuccgcacaaaacccauccaucgaaacacucuaaaccccauguggaaugagcaguuucucuuccggguucacuuugaagaucuuguauuucuucguuuugcagucguggaaaacaacaguucggcgauaacggcucagagaaucauuccacucagagcuuugaaacgagguagaauaaaagucccaacggugucuacagugccagggcgggguguuuuaaagcagaaaaugaaguaaggagauagaaaaggaagggaaggagagccggggugcaguaguagccaagugagccauagccgaaugggaagccuagcaguauugggaagguguguguuaggugaaaggcaaaggcaugcaucccuggcuuguggguugacuuggcugugguccucaggaauuucaguuccuuguguugccucacaaauuguaauguguauaagacccuucuggagcucuugguaauaauguauagacucugauucaguaggucucgaguacaguccaagagucugccuuugaaguccuucuggggaugcugauugcucuucuacucugauaucaaguuacacauaugugcuccccacauccauacucaagcuggcauccucuggguucugcaaacauguuauacucucccacuuuucgcucacugccugucucuuuuuccugugcaagcagccccuggucacuaucuguguuugguaguguucagaauaauaugcuacaaccaaauccauuuucucacagucuugaaggcuagaaagcccaaaccaagaugucagaagguuucaucuccucuaagaccucucuccuugguuuggcuuucuaaaguauagucacauaauccucauuuguguaugcaugucuagugcuucuaucuuugaaaaugguugcauuuauuuauuccaugugcauaugugaauggacgccugugaaggucagaggucagcuugaaggaguuaauucucuccuucuaucacgugggcccuggggaucaaacucggguugucaggcuuggccagauaugccuacccacugagaugucccuuaauuuccucuucuucuggggucauuggucuuauugaauuaggacccacccucagagcagcacuuuaaccucacuagacauuaaaggcaccaccucuguggucacauuuucagguacuagggggcuuggaucuuuacguaucaauaaggggggucauaauucaggucauuauaguuacuagaaaagugugagaaaagacaaagaauaaaucgguuguuucaagaguauccugccauuccccacucuauccucuuuagacacacaucugucccaggcuuuauuucucugccuauguauauaacaaugagauacauacccaacaagacuucuuccuaauccuuauguuuuaugacuuccugguuuuccauuucuaauguguauggugagaaacuuccuauauuaaugaccauacagcacuuccagagucugcauaguauuguauuuuauauuuauauaaaauaucuugcuauuaaaaauauuuagugaaguaauuuuuaaaguggaaaaaaaaaaagccuuccugcacauguguagcaaaugugcuacuugaucuucaugugggccccaaacaaccaaagcgggaucuaucccaaaagcuguugccuguaugugggauauguucuucuagcugggcugccuugucuggccucagugggagaggaugugccuagccccacagagacuugaugcaccagaguuagaggauacccagggggggucccacccucucagacaagaagaggagggggaaugguggaaggauugugggagggugugaccaggaggugggcagugagcaggauguaaagugaauauguaauaaaaaaaugaaaaaaaguauuuaaugaugaauguuuuaugaaaaccaauauugaccuuugguaaaacagagauaguagcugccuugguagcuaaaucaccagguuucucuauuuguugcuguuguuuuuuaauuuaaugauuauucauuugaaucuaaguuagaaagaguauuggacacacugauuagucauggacaguccagccuugaaggacagcucucuuacagugagagguuucuacuggcgugccugcugcuauccacugcuccuuuggggguguacugaccaccguggagaucuuugcagcucucagucgugcauuguuaacaggcuuuccucgauucugcauccuuccaggauaucgacaucuucagcugcggaaccuccacaaugaaaucuuggaaaucucuagcuuauucauaaacagcagaaggauggaagaaaaccccucuggcaguuccaugccagccucguugguaauuaaguucuuauuucagucagcauaccugcaggacugcuacaucgaagguggccucuccugggguacaugagaguggccagugagccacugauuagguagcuauggaaauggcaacaacaaaaauggcugacucuuuggcauuuagcuaugcaguaacuuacugguuaagaccccacggccagugauuuuugauaaugacuggaccagggcucacccaucuaaacaaggaucacugcuccaauuuacugguuaauuauauuauucuuccucuauaaauuaaaaacauaugugacaguguguccagacucccucuggacaggcacuuucucugaccacuuuuaucaccaccucaaauagcccugccuucuucccuggccucccuucccucaccucugcugaucucaugcugugugcccucagcccuuauuuucuugggucuccuucuuccucccucccuuucccuguaucauucuauagaauccuuggcuucacaucuaugucaccugaggaacuuuuaaaagugaaagcugacacacauuucauaccauacccaucccugcacuugcuggaaagaagcacuguaauuucaguaaguugacacucugguggcggaauuuccucuugacuguggaggaagauauagcauugacuuuuccagcacaucagcuuggcaucaaguuacaaguggguccuagagauuuuguguugaauggagccuaaaacuacuguguuauauggaauucaugcgaagccguguggucuucauugacagauguuuaauacugaagagaggaaauguucucagacucacaaagucacagugcauggugucccagguccagagcccuuugcuguuuucacuauaaacgaaggcaccaaggcaaagcagcuucuccaacaggcaaguccacggaauccaugguuaaagaaagucagccuccaaaauguauggauguacauguguguauaaauauguguguuuguauacacauucacauaaauccauaaagguccacauggaugauacaucuuuuauucacuuaucuauaguuuguuuaucuuuacgugucagggcuugaacauauagcuuugugcgugcuaggcaagugcucuaccacuuaaucacaaccacagaucuuuuauuuuuauuaugagacaagauucucccaagaugaccuuaaauuucuaauucuccugucuuuugauuguuugaaauccuaaggauaguguaaggguucucgguuccacuagacaagcuagcuuaccccuagagaagaauuucuauugauucacuggccuuacaucugcacacacugguucauccuuaacccauuuuagaacugcuucucuucgagaguagaucaagagguaugcccugggucuuccuccggaguuagugcauaugaugaaagguagcaagaacgauaggaugcauggcagaacuaaaaaccaauccagcagccaugcauaaccauugaucuuguuauauuaauaacauuaauaguaguuacuucucucauuuaaggucacaucucuaugaauagugcaauguuugugcaacauuuuauaacugacuuaaguagcaucacaggaaacugcuuaaaguccgaaucucauauauauauauauauauauauauauauauauauauauauauauauauauauauaaucaaacaaaagccacugcuuaaaguuuggggugguuuucuauuccuugauugcuuuuagucaaucaguccagaaucuuuaguguggaaucacuauuacgauuuuauaaaaucagggaaacuucccauagccacuagugaaagcaacaccauauugucuccccauacaaauaaacaagugagcccucagugcugagaaaaaguaguguugagucucuugagaagauaacaguaccaacagaaccccugaaaacuucucaucuugaauaauucuuauaguagcaaguaugugcauagucugaacaguuugccuuagccccuguggaauuacuagaauuccuaguaguaauugcugucuacuuuagaccaagggaucagaguugugagaauuuuucuacuccuaccauccuuaccaccuuaaacucugcuuccccuccaagugagaaauguuaaccguggccauugcaucuuugucaggaucaugggagauggguguuugcuaauccaagcuaggugguagcaguugggucccaucacacaaccaccucucaggagaaggaaauaaagaagaugucuuugagcuggagagauggcucagugguuaagagcaccgacugcucuuccagagguccugaguucaauucucugcaaccacaugguggcucacaaccauuuguaauggagucuaaugcccucuucugguaugucugaagagagcaaugguauauucauauacauaaauauaucuuuaaaaaagcaaggacaaaaaaugaugucuucacuaucacugacacugcaacagaaaucuauaugaagggacugaaaaagaaaacaucaguaagacucuaauagcauucccauuuuauagauggaaacaccaauucuucuuccaguguuccaaaggcaguauaagucuuuacagccucaugcaugcuaagccaguguucuaccacugauauauccuuaacucaaaacaaauaagucauaaaaggaaucucagacuuaggucuaacugacuccaaagcuccaucuuaaccauuugaucgugcagaguccagagucaacaaagaaaaaaaaacaaacucuuuaggcacagugucaggaaucuacugaaaggagaauucccagacgagaacuuagcccugugagcuuuccgugagaagauaguuauuucccuggucagaaacagagauguuauuugcaaacugcgcuggguccuuugccucaguccuuccuugcaagauuucaaagaaccaaauccauggagugagaagccuaaaauuuuaauucaauaggaucucucauuccagcagugggaaaaauaguuaugcugucuggggauuaugaauaaauugcgucauugcccagagugaacauaaacaaucuuuuuuggggcauauaagaauuauuacagcucuagaaagaauuaugcaacacuccuguguaguaguuaauuuauaauuuucacuuguaaauuacacagcaaguccgucagaacgccgugaaagcagacuaguguucaguuugugccacucuucagggaugugccucacgcucucuuugcucuuuucuuuagguuuuggcaguugaccaagacaccaaauguacugccacagacuauuuuuugauggaagagaagcauuuuauaucuaaggaaaagaaugaaugcaggaaacaaccauuccagagagcuguggguccagaagaagauauugugcagauuuuaaacaguugguucccagaagaaggcuacguaggcaggauugucuuaaagccccaacaggaaguaaguauauccuggaccaagccugguugguggcugcucaguaugucaucagccaccucaccacugaacaccuucuuugaguccugaauuguuauugcaacaugguuuagaugauuuuucucaaagugaauauggagaaaugguuuaauuuuccugcacguguucagaugguuaacuaaagaaacucugccuaaaaacaccauccuuguaaaaaacacaaaggaagcaggaacuuaaaggauuccugugugccucagcuguagguccagugcuguauuuguaugugugaagcuguuucuguaagagucaucuuagacuagcagcccuaugggaauggccugaaaccucauauagaaacaaucgcugguauccaggcauucugaucucauggcaguugacuugaucacugagacagcaaagacugauggguauauagucugauagagauaugcuggacaaaggaugauuuaugaccaugucuacccucccccuccccccgccacugccccagaauagaacagaauagcaagaaauauuauuauucuacucauagaauuuaaaacuuaugaauuauuuauuuguggcauuuuccacuucauauuuucaaaccaaaacaaaggcucagaugagggagcugccacccugccuaacacugaaccuguugacucucuucugggugucucauaaagcuuuggcuuagcuggaguuauccagcuuuuacagucuauguaaagauucccaaauccaaaagucagaaaaaucugaagcacgucggguccgaggcacuucagauaggggauaaucaacauguaaaagguucugaguuauacauuagcaacagugugucuuugaaaauauucuacaguuucacacaaacuaaagauaaucucucagauuuaauaagaauuauuaaacauuuauguaugcugauacugcaugguuguccccuugaaaggaaaguaagaaacaacucaauauccauuggcuuuuguuuugaauuugucuguggaguaguuugcuuugcagaacaaucuagcaagggcccacuccuuuacugucccuuuguaaugugggauauaaagccauugcuccaacauauaucaucaggaugcgugacaaaucaagugauuaacaguugaaucgauucagccauuuaauccaacauauauuuauuaagcacccaauauguccugggccccuggucgagucucuuuacuauguaguagagguguaguuagucugauguccauuaguagcacauucauccugggaaggugagcuaguuuuucuuaccaggccuuccuuugucuauucuaguuagucacuguaagcauagucuacaagccagacagaacaccagccucucuuccaggauccagagcuacaucuuccuucucuacucuugccucagaccauaaaaggccauacuuugagcaaagaaacauugucacuguucucgccuuuucuuucagguguguaaggguaaagaauaagcucacaaugccuuaugggaaaacaucaggaguucggguagacgucugaagccaucuuuaauagcucccuaaguuuucccuguguauagaugucucgcuucauuacuuagcuaucugcaaaaaaguagcuccuaagggaccguccucuuaguaaacaaguaaacacuucaaaaucacagagaguugaacuggcucagacacccauuauuuucaauuuccucgugauguaacagaaauuguuuuaugcauuagaaaacuaaguuucagagacaugaaaauaaauuugaugucuuuugcuaaccucugcggccacgguagaaauccugguacuagccacugaggauuauccacacccaagguugcacuguagauggcaucagggggcagucagcaucucacucuguagcccuuauuagcuauguagaccaggcuugccuugaacucacagagaucuacuugccucugccucccuagugcugggacuaaaugugugcacuaccauauguauguagcaaaauauguauucuugcuaauuuuuugaagcaacauagaauuuccucucuuuguauguguguguguguguguguguguguguguguucacauauacuuguauacaugugugccugugcauguggaagccagagaaccaccacaaguucuguacaggagacaucuacccugauuucuuugagacagggugugucacuagacuuagaucucacuagguaggcuauacugacaacacagcaaacccgagcgucagccugucucugccuccuggugcugugauuacaagcaggugaucccacaucuggcuggcuucuucucuaccuucguccucaugcucuucagcaagcacucugcuguccccucagccacacguuccucucuuccugcucugaagaaugcuaggccauaaguucugucaugugaacuacccccgacaccacuuuuggauuguuggaauauguaacgaugaauguuacacauguaacauuauggaacuagaacuguaaguggggagaaaaacaaguuguagaauggcgggaaacaaucacguuuuacguaauagauaaacaauaccuccacuccuacuccuccauuguuugaguaaaguuggauaugccagucacuguaaacaccaguaaacuguaggguugugacucccugauuuuugaaaaggccggggaggauccuuuccagucuugguuacaauauggcaccaccugguggcaguuuccagugcugacuuaagcaucaaugggaacaacccuagguugugggaccuguugaaauguccaggccauuggccacaaacccugaauucuucugguuacuuagcauuguuucaacagccuguguguggagaucagguuaaaagaaugccaggaauagaauauuccaugugaagucuugacaucugauagggucaccuaccacuuccuucaucucuuuucccaugucacucucuuggagaagauaauguuaagcuacugucauuugaaaacagggcuaaguaaguggacagaagccagguuaaaaaaaacaauuacaaccauauucacacagagccaagauuuuguguguaucuguucacguacugggaaauacacuaauguaucauuggcauaaguacacaaaggcagaucaccuaagaacggugggauuuuguuuacagaccuguuugcucauuuguuuguuuaugagaaugaggugauauagaagggaaaggugagaauaggaaauggaucuuaucauuuucuugacuaggggaaaaacuuuauucuguaugcauaugguuguuuugccuauaugugucuguauaccaaacacaugccuggugccuaugaaagccagaagacaucaucauaucuccuagacauggagcuacagcagccucgagcuaucaugugggugcugggaaucaaacccggguccucuagaagaguagcccguacccuuuagcugcuaucuuuccagcccauuugaaguuuuuaauaaaauaaaaaugaaggcuggagagauggcucagcaguuaaaaaccuacacuauucuugaagaagaugcaaguucaguucccucgacauacauagugguuuauaaccaccuguaacuccagugccaggggaucuaacauccucuucugaccuccaaagguugcugcacacacauauauacauaaagaaacaaaccuucugaaaagauguuacauauaagagagagggaaauuagauuucacuagaguuuacucaaauccaauuagucagauaauaauucccacauuauugcgaagucuaucaauguucacugcagcuacugauuuagccuuuucccugugggcuuuucucauuccaccuggaugaguacuccauguucaaaucucauugccuaaaauuucucuuuuguaacuuuaaagagugugugugugcgugugugugugugugugugugugugugugugugugugugacagagagggaggagagggagagggaggagagggaggaaugggagagggaggagagggaaagggagaggaagaaagggagagagggggagagagggaggaggagggggaggaggagggggagggagggagaaggagggagagggagggggagggagggaggaagagagggagagagggaagaagagggaagagggagagggaagagggagaggggagaggaggaaggggagggggagggagggagagggagggacggaggggagaggggagaggggagagagaggggagaggggagaaaggaagggagaggggagggggagaggggaaaggggagagggaggaggacuacuuggccauggacucucuccuuccacauuugcaugcagccuaaggauugaacacaucaucaggcuugcaggucaaacacuuuauccacuaagccaucucaucagcuucaaugucuaauauuccuuaaauauuaacaguauuuggggaaggaacuucucgucaauauagcuguguuuguacuguauuuucaauaacaagcaaaacaguauauuuucuuuuuaaaaguuuguagcugguuucuucucucaaaauccauaacuaguaggcaccuauaaacugguuuauucuaagaccuaugugugagucaacaucacuggaaauugagccuuucuuccccucagaagcagguuuaucuuuucagcagggugcaugcaaaagaucaauguauuaacuauaaauuaaggugauguuucccauauugccaaaauacaacucaaauuuuuacuagaauuuuuucuguuuucugaauugucucagcaguuccucauguacauauuuucacuuuaaaaaugcagacucuagaagagaaaagcauugucuucgacgacaaagaggugaucuugagcucagaggaggagaguuucuuugugcaagugcaugaugucucuccagagcaaccucgaacugucaucaaagccccacgugucagcacugcacaggauguaauucagcaggugaauacuuccuugugggucacugccugcccagcaggcacagggcucccagcaccaugagaaucuccccuuuccucaccccaugacuccuugauauaaaugauugggacaagucagauauaugugcauugauaauagcucauuaaugaaugaaguucuagaaugggguuggaggcagggggaauacaucucuugguugguugguugguugguugguugguugguugguugguugguuuuuuuaagacaggguuucucuguguagcccuggcuguccuggaacuuacuuuguagaccaggcuggccuugaacucagaaauccaccugccucugccucccaagggcugggauuaaaggcgugcaccaccacugcacagcggaauacaucucuuaaggauaggaaauauuuuuucacuccugcaucggauccuuagcuagcaucuaugaugaguuuagaucuuugcugaugauguguuuaaggagguggcacugcagaaauuucccccaaacaccugaguaaauacugaaugaccaucucugaaggaugccauagaacacaagcaggaagccaacucugacuguugguccuuucgucuaugucaaacugcuguuuuuguuuuguuuuguuuuaacuugauuucaaggaacgguuacacacggcaugugcagucauugaacuccuucuugagaagugauguagcacaguaaacaacacacaaaccccugaucacauggcugaggguucaaacccagcucugucccucacucagagauguccagcaagaucccucagucucacugagaucugugucugaguuauacuguguuuugacuaacuucuuuuguggggagcaagggguucugacucauuucuguuggauaaauccuccucccgugucugacuuccccaucccauuccauuuggcucuggcaccacucacuguguggcaaguuuccaguugguuuaauaacauggagauaguacaaugguaccucccacacacagcuguugcaacaaaggcaguaguaacgcauguggggugcuucauacagugcuuggcacauauuugagugugauuucuuauuccuguuguaugauaaccuggcuaguuauuugcagucuccuuaauuaccuuugaauuucagauucuccuuucuuuugcucagcuuuguuuccccagaguacagcacaguacuggauauaacaggucaugacuauacauacaaugaauaaauggacaaaugaaagauggucuucuaggaauuguaaggaaaacaugugacuucuaaaauccuucagcacccaaaggugugauagaagcagccugguggaacagagagagccuagggcgagauuucauuucccauuggcugccuaaccuucaugucucuaugcugugguuggugguaggggaucuggguuuagccuucuuagguauguuauuagcaagacuugcucuggauucugcuugaccacugcugaguuuaagccuccucuucuggaaucugcuuugauuuuuacaagcauaagcuucugcacccaagccaggccauuuggaagcuaagagguaaccggagaaugugugcuauaaacuacagcuacucaaaugaaaaugaggcagggugaccugguuuggaagauccucuccaccucugaaaggcagagccauuucuccaccuuaaaucuucauucaugguggaugcaaagguggcagacauuugguucagcugacccuaacuuaucuuucagaccuuaugcaaagccaaauauuccuacagcauccugaacaaccccaacccaugugacuaugugcuuuuggaagaggugcugaaagaugcagcuaauaagaagucuucuaccccaaaguccucgcagaggauccucuuggaccaagaauguguguuucaagcgcaaagcaaguggaagggugcgggaaaguucauacuuaagcuaaaggagcaggugcagguaacguggaucccacauugcugucuucauagguccuugagagucagucacaucauaauuaauuugggagcuacugaaucaagaaaguuccuagucagcgggucuuggaaagcaguuauuuuguuuucagugugcuggggggaaggagguggggagacaaaacggcaugcuguccugugugguuaaaagaucccggauagccuggugguggggguggguggggagugggaguggugguggccacaugccuuuuauccuaguacuggggaggcagaggcagauggaucucugaguuugaggccagccugguuuacagaguaagguccaggacaguuagggcuacacagagaaaccuuaucucaaaaccuuagagagagagagagagagagagagagagagagagagagagagagagagagagagauccugggauagaggccuuggcucaucuacucaaaacuuacuuaccagagagaaauacaaaggagugcauacuaccucuaaguaugacaugggaaaaucagaaaccuggauuuaccaguccaucaaagaagggucuuuuuuuuucuacacaggcaucccgagaagacaaaaggagggguaucuccuuugcaagugaacucaagaagcucacuaaguccacuaagcagucucgagggcucccaucaccuccucagcuuguggccucagaaaguguucaaagcaaggaggagaaaccugugggugccuuguccucuagugacacaguggguuaccagcagugagcaagugcggcauauuuguuccagggauaugaagguacuguagcauucugaaauagucuucucacaggguggugccuugugcccuuucaagaggcuuguccucugaagacagguggggaugggaccucaaaacagcaccagggugcugaaguugcuuuuauguaagcuuuuaagauuuuagacuuccugagcuagagagguggcucguggguuaaagauguuugcugcaagccuaaugaccuaaauugaaucuguaggguucacuugguagaagcagagaaaugauucccacaaguuguccuuugaccuccacaugcauacuguggcauguacacacucuuguauuugcacgugcuaguauacacacacacacacacacacacacacacacaauuuauacuuucuuauuuuguagauaaccaagggccccaaagugucacacagacuuaaauuaucacacauaggacugccuuaauuaauaauauaaaugaacauucuucaaaggcuauacagauuguucaguguuuauucauuuggauugcuaguaguucagucaaaacuguuucauuuagacccaacaaccucgucucuucuuaacucuuaaaaaaauuaaaguaugccaggcaugguggcacaugccuguaaucucagcauuuggaagcugaggcaggaggauuacaaauucaaggucagccuggguuacauaaugaguuccagaccaauuuagggaacauggugagaccccacauccagauggauacucgauacaaagucagucuuagcagaugggugagcuacaauaugaaaagagugcaggggaauaaaagcuaagagccuccuuuucauggguucuuugguuaguuuuugagacuguguuggugguuuaaaugugaguggcuucuaguggcucauguauuuguugguggugaaggauugggagguguggccuuguugggggacagugauuuagaugcuugccuuuggaucccauuuucuucuuuuuuuuuuuuuaauuuauuuauuuaguauauguaaguacacuuuagcugucuucagacacuccagaagagggugucagaucacuuuacagaugguugugagccaccaugugguugcugggauuugaacucaggaccuuuggaagggcagucagugcucuuaaccacugauccaucucuccagcccuggaucccauuuucuuuggcaaguaaucuuuauaaggacugaacugacuucagagcuuugcuaaacauucgugcuucucuuuaaaaauagccauaggcacgacuauguccacuuaugaccuccugcaucacgguaguuccaagaaugaauacauuuuuuaaaaaaaacuaguucucucuguauguucucaucaguaaacaaguacggauguuuuagccuuucuggcugcuauaguauuuguucuaaaaaugguaacaacuaguuccaauaaccacaaccuaagaauuucuaaagaagcaaauguucaccucaggcccaccugaagugguaacaguugguaacacuuccccuuugucuaaaguugaggaacauuuacuugauguaauaagaagggugcuuguuauuucuccuaaagaauuugccguucccaggacagaaagaaguguucuaccucccgagggcaucacuguacuaggaaguaacuccuuuccagagugagccacuagagcucuagggugcugugguugaacaacuuguaaccuggugaggcugcacacauuucugcuuugauacacuaauuagccuauguggaugacguuacagggggagguccuugacgaagagcuaucaagaacgaacguggggggaagaaaaauacuucaccuccaucacauuuaaacuggaaauggaugauuucucaacugcaacccucuucacaccugauggaugugagguucguggagaggacaagcaaaaagcaaaggcacaggucugccaaccaacguccugaaggguaaagcagggacacccaggccauugcccggagcauuacagguggagaggccacccccaggcuucaggcaacgagcuucaccuguaaaggaccagagacgguaaacauuuuaggguuggggccccauggccucuguggcacugaguuaccucagccgcugagugcaaaugcagcugcugacaacagguacaagaaugaacaugacuggacaauaaagcuuuauuuguggacacuuacauuggaaccucagagaguuuucacgggucacgcauccuucaaguguuucaaucacuuaaaauuguaaaaauauuuucuuaguucaagggucacacaaaaacacaugaauuuggcucaaggaccagcuugcugaccccaacuugggagaacugggaaccaaagguauauagagguuaggaaaccucaaaaauuggccauggguuuaaugagaaguggaagucugggggcauuggaaauguaaauauguccuguaagauuuauuaacaauuauucaaauuaguuccuauauuguguacccagguucgcucuuugggcugacuuuccucaaacagaaaaaaauuuuuuuuuccaaaagcucccguucauacguccacagacuguucuguuuucaguucucaccaagugaaucuagaaugauguacaauucagugucuauggaguuguguugucuucagaagaagccuaaaucauuucuaagaagcaaaaguagacuggguuggcguuuaagguagauuuauuuauuuuccaauguuuauacugacacuuguguauuuauuagauauuaccuuucuugauauugcuaugggugacaagcauuagugguucgaucuguuucaagacauccuaaaaaauaaaucauaugagcaugagacucggguagagaugcagagccauagugugaucuucauuucagauucccugaggagccguggcuccgagucucacuggccaugugaucuaagucauguuaaaaccuacuucacaaaacaaucagcagagugcaauggacucuucucauccucggggugaggcaaauggugacucaucagacugaaguacguguucguccagagucaagccuauauuucaucuuucaauugucccuguuccgcuugaagauauucuucuucaaguuagaaaacccacuaaaaauccugacuuuugcuuucgagacuuuccuuuaccaauuacagaaggaauaaacaaccccuucuuugcacauucuaaaaagagacaugucaaaaauacaccacacagcuucccuaucacuggaagacucuggcugcacugucuuucucuugccaagagaacucagacuauucucauuuggcaguuacacagcacuaacagguucccuuuauauuaaauacuaggucuguaccaagcgcacagcgcugcuucgguuuuaaaacauauucuggagccauuuuaucaauuuucuguaaauuaaagaggccaaauacuuuggguuaccuuggguugaaaaucaaauuacuggucuaaccagccagagccaaacaaaaccugcagguaauaagauaccgagccaggcugguuuacccuacccuugugguccuccuuauaauagauggagauuugauacagaacugaaauagaccccauauucaaaugcuggugugcaucccaguuuagguuaaaggacauacucuacuaaaauugagucuccaagacuuuaagcagaagagauuacuaaacauaugcaaagagggccaucgagaugacccagagguggcccuugccacccacgcuuugaugaccucaguuugauaccggaaccaauggaaaaguaaaaggagaaaacugauuccauaaaauuaucuauccucugucuccacaggugcccccacaucauauagcauacacauacaaaaauaauaauaaaugaaauaaaaaauuuaaaguauuaacagcuugucacaggaauguguuacuuaaugaggacguauuuuaagaaaugcauugguagggaacuucauguuguaugaaugucagaauauaccuacacaagcuaagauggcuacugugucacggaacaaggagcuuuuuggcuuuauuauacauuauggggucacgguucuguuccauagcaccccacacagcaguuuauccaugaucagagcaccacuguaagguacaugacugcauuacaacuccuuagcauaauauggugauguuuugacugaaggcuuaucugaauuaugggauguaacugguuuaucaaaugaaagaaauaacccuauucauaauaaauuagcagggccacuagaauugcgcccaccaccauuuuauacuuuuuagaauacaagaaaucuggauaacaaaaaucuuaaaccaa

SEQ ID NO: 12584 - RNA, 4162 nt, Mus musculus
auuaauugguccaaagcaacuguuguuuuauuuaauuaaaaacuuuuuaaaaaaauuaaggaccaaaccuguugucuagaaucagcggccccacagcaguagcaauaauuuaucgucguugggauacagggauugaggaggcagagcaagagccagggagcaaggcuguguggcagugaacgcagaagcagcugagccugcacuccaguccaucguggcuccagaugaggagugggcguggcuggaagacguggaggccuuggaucuugcucuuuggaggacugugaugacacacaaaggggcaugggggaggaaagcuauucccuaaguacggaucccgcuuagcgaugagacccacaauccuuucuggaaagccccuccccaggcugcaggaggcccuguauccuguauccguaguccuucacauuuuccuccucugccuguuuuuuuucagacacuagggcuucccccagaagagaaaguccuucuacugggagagggggcguccccgggcagaccccaggaucccagaacccuucagucaaagaggguagccccaugccucugcuuuggagccugugcaguaggugcgugaagccauccuuggggggggggggugaugggucagccugggagugaaggugaggccaagugggcguggacagaggcgaggcaaggcacagcuggcugguuggggcaaggagcagggggcccuucagugggguucagcugccccauagaaaaaaggguaguagagggaacagggauaggagaacaugaauuugacugcaaacuucaucuccuuauucuucuugucccagcgguagacggccgugagcagcagcugucccucuacuuugcggcccaugaccaggaagcugcccgucagguugucuaacugugggcaagggcagcuugccccguucuucauaugcaggaccagcuucuugguguccuugcgcuuuaaggggccugccuugagcagcuucuucuucuucugggcuccaaucaacuuucgguccccguugucuaucuugaucuccuuaaugcgcaucuugaccacuguggcaaggugggcaaaggauggucagaagagggucacauuugcuuaugacagcgggagcccuagugugaccagagaccuagggacaggaauccuagggagaggacccucuggcuagcuccacccuucuuccacagcuagccuccccaacucaagaagccagaaaagaacuuugcacacccagggaagggaauuguucuagaaacaucuucucuccccuuugccccaccuuuugcacuauagugacauuuucuuuccuaagaggcucccaacauaaagauuccuccaaagcaaagguuucgucauugcuccuuucccuauuuuuauagacagggaggcuaggacacaaaacagaaccaacuuugcaaaggucacaugcagaacuccguggcccacagugaucuugguccuaacuggcuugguucaacugucccaggauagaagaguccaagaugaagccguggggaaagcuagucauaacccaucccagccagaggaacacuagggacucaguagagauaccagggauaggggacauuacuucuauugccaacucccgugcccuaggagggccccauccaucuuuuagcaagcuaagcuugcuccccccccuaaaaaagauagcccagccauggaagcaucucuaugggaagugacaaaacacagcugcaguagcgguagucagguggggcugguucugagccaggcugcugcgggaacugucaggauccugugauuccacacucaccaaagucacuggagcacaucuguuccaugaggccaucagcgcugugcuccaucucacacugggcacagaucuuggucacugaagagagaaagcaaaguggguguggucuuaaacagcaggacaguacaggcuccucccuuagccccccuccucacagaagcugcucuaauuacuaaagaggaggauggcaaugacaauucaagagcucauauagugcagggacaguauggugagguagauucucuucugcagccacgacauacauuacagucuaaguuuuauuccaucuagugcuugcugugaaacgggcacugccuuuucuacuuaucagcagaggaaaaccagguguaaugugguagccuagucagcagagcuuagggcucaggacuguggccccugcucuaugaccaggguggauauuauuugcaggggucaggcacaagccagcauuaacuuucucgaagaaaguccaaacgacucauuuuuaugugaaacauucuaaugucaucuguuggccacucacacuuuucuacaaccugccuuuggguucucuugugugcuggccuccaggugacaagccucgcugugagaaggggagucauggguagcaagguagggccaggacaggguucugagccugaguuuguccugcuguucauguuugggcuccaaagaaacuauaaaaggaaccuggaggauucugggaaccguggauuucuugcuuagcugacucuauuccugccugccacucucagccuucaagauagagacuuuucccucccagaaucccccagagagggagaaggagaaggugggaggcuccuaagaccaagcugauuaauuugagagggguuagggcgauacaaagaggagcucagaugcuuugggaggagugguggggcggggggggggggagauuugaauguuccagcugugggggcucacgggagcgcucacuaucccaguuaacaggcaaagguugccugcugggagcuauggguguguauguggggggcgggggagaugcuaggggcucaggccaguuuggaagaggacaggcauucuuggagaaaggaggaggggguguggcccccagauaugggacagcuuugaggaccugcacaaugaaaaggaagaugaaucagaaaucaggucuaauggcaguauaacgagccagugggaagcagggcuugggagcucaagaugcuggacuucacugcugggcaaagaagguucagaaaaguaaaguacccaaaagccuaggaauugggaggaggggaaguuaggguuacaggccuugaaacgagggcccucagggcuucccuaaccacccgccucuucucaaaguucccgaggucagggaaggaguagcgcuugucugggugucggcaguucaggucaaagaaacugccuagcgaccccaagcauccuugagaugaggaaaggaauacggcauuuaugagggacgucuccaaggcuuccagggauuccgcagcucggaaaaccgagcgugcugugaguugcacaagguacaggucagaguugggagagaacuagugggaauacccagagcuucaaguuuauaaagguuggaaggaaaaaggagacagugccagggcgcuguguauaggggcuuggcaccuaucggggaguacagaugaggguuuggggagaggaucaguccgaggcgcucugggcgcaaaggcgcuaccuggaggcgcgguggcaggcaggugcccgaacugcaccgcgaugcagaggucguuguccagggggaacuuguggcagugcagcaucucgggccaagggaaaccguaggccuccaugagcggagcgcagccggcgcgcacggcuucgcacagcgagcggcagggguagaugggucgguccaggcagacgggagcgaagagcgagcagaggaagaccugggugucugaguggcagcgcuuggccagcaguggcagccagcugcuugccugcugcuucaccucggccaggcucucgugcuccagcagguugggcagccgcaugcgcuuguagcccaccgugugacagagcggcagaucggcggggaugucgaggcacugcgguggcuuggaguaggagcggccgugcagcggcucggccugccaaccguaguagucguacuccuggccgcguguuggcgccccaugcagcgccccgagcagcaacgccagugcggccguccgugcgcuccaggccacccacauggcuggauguugcggccugccccgacggcucggugcucggcgccccgcugcccggcgugcgccccggcugggauguucccugaagccggcugcuacuagggucguccaaguagguggcag

SEQ ID NO: 12585 - RNA, 14809 nt, Mus musculus
uuguuuuuauucauuauuucuuuuauuucucuuuauuauuauuaauauuauuauuauuugcuuucgcuguggucacuaucauuggcaaaguuccuuuuuuuuuuuucuccuuuuuuuuuuuuuuuuuuuucucagcuuuucuuggacacggggcuccuggcuuugaaagauuccacuuggguuugaagaugccaaaggcugcuugagauguggccuugaacuuccggcuagaaagagggucuauagaaaucacucuugguuuaaaaaaaaaaaauugaaaacuaaaacaaagaaaacccuccacaaucucuaggucacucuuuucuccaccagugaucacacugcccagaggaaccagugaagggaggagaaacgggcagugggugcugggcugccucccagggcgagcaaagagcugccauccagggcuucuuccagccaugggggugugaagggaaggggguaggauuuguuuuuuuuuaaaaagaaaaggaaagagagcccagugccuugaguuaagauacugucccaacuccagggcuaccugcagccccugccaagggccaaggcuacuucccaccgucaccuccucauccaggagaugcauaauuaaaaaaaaaaaaaaucaaaacaagacccuaaauaaaacauaauccaaaaaaagaaaugacguggaggaauggagaagaaaggagagaggaggguggaaagggccggucucugaaugcauaauucccgagccaccggggcuggggagaaggguccccagcguccauugccugcuuggcguuagcuugucacauaguguuugguggacggcugcccauacacccuguagaaauccugguggccaggcugcugagaagcgucgagccagucucugaccgccaggccaggaagugacugagggacggaggguguggguggaagugggugugaauacuccugugagggcacuguccaggggaaguggccggaucggggguacggcugguggccaccgugguuggccacggaagagcaguaacaguuguccacagaacagacgagaaucuugcggccgccauacugggggagcauggguugcugggugguggagccguugggguacugcgaaggggggaacacgggacucgaguguacuggcuggguaccgccuggcagagccaccaagugcugcguggagcugcagggacccaggggcugcccagacugccccucgcugcuggcugugcccgcugccccguacuggccgcccacugggccugacgaagucuccaggaagcuagccucagggaaggcugucgagugcuugcgcuuuucggccccagagcuguucacaccacaaggguacagggguacgcucuguaggaagggcaccggugugcugaagggaccuguggagaguuuggaauguugccgaagcucccgacccaaacaacccggguuuccucucuugggugggcuuugaaccucuguggguccaaaugugugacaucuugguugguguuuacuauuuuuauauucuaacugaaaauaaaacaaaacaaaacugaagcucaggaaggucauguaaugaaugucacuugcccaaggucccaugccagaaguggcaaagccaggguauaagcccaggccugccuggguuaagcuauacugccucuuggagcugguacuggcuggccguuaccccugcccagaggccuuuaaccccucaccuucuagcaucuuccgcaacugcuucuccuucuuggccaccucguucaggaacagcuuggaguucagguggccgaucuuagggggagaaaggcugcugcccgugcaggucuggguccuggggggcaguggacggggcgucagcugugaggggggcgugucacccaugagcccgcccuuccuccccaccagugggcguggcccucucugcccucccucagauguguucuggaggacugggggcucucagcucaccuguccauuaggauuuucacagacuugguguucuacaagggaaggagaggacagucagucagcgggaaaggcacggcagaacagcucuggcuacugagcacagcaaggcuccuguuguucgaaacagaaccucauguaucccaggcuggcuuagaacuaagcacuaggaggacccugaacuauccuccugcuuccacuuccuugugcagaguacaagagaguauggcaacgggcauaguauacgguaccgaagagcaaucccugagcuuugugcaugccaggcaaguaccacacacccuaagcugcauucccaucaugucuucuuuguaccccuuacaugugggagagggugcuacaggccuuuugcugggucucuuuguuauguaguucuagauguccuagaauccacucuguagaccaggcugggcuggcacucugagauccacccgccuuugucuugucuuuugagugcugggacugacagugugcaccaccuaguccaacaggccuuugaaaucuggugucagaagcaugugaggagguucacgucguaucauguuacacauaugauccaaacaggacaccacaguccaacccaucaauacuuccacagcaaccuguuugaauuuucuuaucaugugaaacacagagaggccguuaacugcccaugccaguucugcccaguauuugcuauuaaaugagguagcugccaaaauuuauuucuuuuaguuuucaaaauuuaaaaaaaaaugugagccaggcgugguggcgcacaccuuuaaucccagcacuugggaggcagaggcaggcggauuucugaguucgaggccagccuagucuacagagugaguuccaggacagccaggaccacacagagaaacccugucucaaaaaacaaaacaaaacaaaaacaaaaaacaaacaaacaaacaaaagaauguggacuaaaaggauaguugguggacuaacagauaaaggauggcggacuggucaccaaggcuuaggaagcaucggugacuugcccaaggucacagaacuaggaacagcaguuggacaaagucuagcccaugcaggcuggcuccaaagacaaaggaggugagcguccugggcuagaagcaguugggagcagggcuucagucccaccuucaugaagccgacguccucugucuugucgaagagacgcugcagggagcccagcagcuucuuggccuccugcaugcgcuccccaaggugcagcgccugcgccgcguucucgcugcagaacuuggcuugcgccuuguccaggaccuccacugucugccgcaagucuucauccagcagcuggugcagcuuuucguacugcagccgcaccuccuccuucagcuggcucacuuucuccugcagagauagacaaggaucggcaggcacaugagcacugagugaccucgggcugccgucacuaccccaacuccauuucuggugcuagggucugggcucuugaggccccugccuucugaggguaaggugugacccaccaauucccccuguauagcacugggcugugugccaaccacucuugaccugugggcuccuauuccaauaggugagugauugacagguggcuccggcacagagagccucaagacccugcauccccaucaccccacuugugcucaggguucacuaccuccaccaggcgcuugucugacucgagcuuguacagcugguccucaauguccugcucucucuccuccagccgcuccugcugcuucaugagcaucuucuguagggacaguuggaauagcagugugagaauggggugcugcuccacacucaguagggcagcauaucacccucuuguucacagagucuucucagagguccucugacucaagaggaccuaaaaucucuaccagccagccucccuaccccucaagcagcaccaggaccagcaguuuucaguaaugggaaacgcgagggucuucauggguagucaagcccugagcuuucuaagggcagcccccugcuuucuaugacccaucacuucauuauauuuagaaggggguucaucuagucacccuagccauccaugagguaaguacuguacuaucaucauucacaaaggaugaaacugaggccuggagagguccgacaaccuggcuacagucauccggccaauggagcugaagagaugucucagugguuaggaaugcccacugcucucgugguagacccagagucagguuccguucccagcaccagucaggcagcucacaggcgguucaggggacucugacuccucuggccuucccaagugcucauagacacacauauacauaauuaaaaauaaauauuuaucucugaaguuguagagcuaacgagugauacaucccagguaaugggguaggaggccugugauuauucaagccaggaaccuuucccuggggcaccggcuugaguagagcacccuaagaugcagacagucaaacagccuccaaggugacacaggcuccugagcuugccuuauauuugccuuguucuauagcuuagcaacaaagccaccccuuccuuguucccgaggcuaagccccagucucagaagucacgugguucagcaccucagcaggaccaguagagagugacuccuuuuauuuuauauaugaguguuuugccugaacauaacuaugugcaccagguaccugucuggcgcuggcagaggucagaagggauuggaucccuggaaauggaauugaaugcagguucucugcaaggguuacuaaugucccuaauugucuguuuccacaauccuuuaucccaucacaaacacaccucuucagacaaagucucgcccaccuaacaugaccgccuccuuucagauaauuccccauggccaggaaccauccagccgcuaguguaagguaaguacgucuuuggcugggacaggagcgccacgccacgugccuuuagaagguccugugacugccugcuuccccaggaucuccccagcacugugcucacagggcacuucaguucuuccugucauuuccugccagcuaacagugcccgcuucuccuuuguccgcuuucugaggcccaacucugaggaacuuuccaugacccuguuuguucugaguugguacaggucuuccaauccuggucauguggucugucggcugucacauccugcccuacuggguagcaguguucuuuaguauagcagccacuuuuuacauugagauuaauacaaaauaaaguaaggcagauauggacauacgggccugcaacccuagcacugggaagcugacacaggaguuuugggagccggcgccaguacauagaaagaccuugacucaaaaaaaaaaaaaaaaaaaagagagagagagagagagaaaaauggagggcagcuucaggcucccagaugcaccagccucagcuacuguacauaaaaugcugccacucccaggaagucauguggcagcucuagccuagcaccccccccccucacuaggcuaccgcccccuacuguuacugugguguuacaacauggaggauagagcccagggccuugcacaagcuaggcaaguguucuacacagaccugcaucuucaacucacauucugauacuuuguauuucauucacaagucaugaucugauuucucuagaaauucuaacccucucucuuuuuuuuguuuguuugguuaguuuuucgagacaguguuucucuguguaacagucaguccuggcuguccaagaauucacucggacaggcccagaacucaagacauuuuaucucugccuccagaguguuuggauuaaaggcaugugcugcacacccaugcagcauucuuuucaacccucuuaagggacugagcuuuggcuugggaugguggcacacauccaaaguauuagcucuucgaaggugaagcaggaagaucaccgcaaguucaaggccagucugaaccagaaggguuagaaaaaaauaagaaaaaggcaaaagggguguugguggaaaauaagaauugguguuagcuaggcaugacggugcaagucuuaguuucuacucuggggacacugagggacaagauugaggucauucuuggcuauaaagggagacccuguauuaaaaggggggggggcuuugcagcugcagcugcccucugccuuucuucauagucauaccucaaaaaggcaggagaaccugguuguugugaauccauuuccagaaacacccaagggcuaaacacaaugcucugcaaagcagcucccagacacucaggggaaauguccaccuuggcaagggcacuucucuucugcugugggggccuuuaggcucaccacauaaccccugcucaccuucccuaagaguuccuuccucaauuauaucuaaggaaaucaagaccagcaggaaacuucaggcagaucuauucuagagagguugcuagccaagaaacaaagaagaaagaugcugagggguuaggugaagguaaggcucucuuuccaggucuagaaagccuggaguuggucccagcuggcucuucccugcagugacccggcagaccgugcccuugucagccagaguggccagauugacaauaaauauagcuuguauggcauagaaauggaggugccuaaaggacugcccagauacacaccugagcaaccugggcucugagacuccugagugcacauacauuuacacccaauuacaaguaaugacuguugggucuuuggagacccccgacaacgaaggggcugacauugaaacuuucuuagggguuuaaagaagcaguucaguagcuaagagugcuagcugcuuggguggagaggauccagguuugauuccuggcacuaacaggggcucacaaccaucuguaaauaaccucaguuccugggguuucaacaccuucuggccucugcaggcacugcgcacacacaguauacauacacacaggcaggcaaaauacucauacacacuuaaaaaaaacaagcuucacuguaaacaggaggccuccccccucuccuauaucacaggagcucaaacagcacgcuggcugccuaucaugugugugcacaggugugacucacacggaaacaagcaccccagauacaaaucaggguucaggccaccugauagcucaggcucucacuauuccaugucugccugccugagucauggaugaccagggcccugaacagagaugaggaagggaggccaggcugagucucaggagaaggaaaagacacacagacaaagguuccaaccaaccuaacuucuccugggcugggaaagagucuugcccuacaagccagugagggccccuccugcuucccgacugagguccuucaggaauuuaugacugcuauccauccuggcuccugcucagcccacucucuccucugaggcauucccaagaagcaccccuacucuaggaugcuaguguugggccucagcuucaggauucgggguuggguccagccaaggcccagugaagacaguaacccccuccucaccuaacagaccccccuuuucucagggcaggaaguagaaggaagcucaccaaugagagauucagggcuggcaaggcugggcaagccccuccccccagcuucccugcacccagggagggcagggagaggugcuacuucaagcaccagcgagacuggcaagaggcagaugccucuaccagaguuccaccaaaucaaaaaaucaaaugggcugagcacgguggugcacaccuuuaauccuggcacuugagaacugaggcagaggcaggggaaucccugugaagggaagguaaacagggguuauguggugagacuuaagguccccacagcagaagagaagugcccuugcugguggacauuuccccugagugucugggagcuacagaguggauauaucgggugccagagcuacauacauagagagagacuccaucucaacaaacaaaaaacugaaaccaaccaagcaggaagaugcuggaggaccacgggcuugggaggcgcugcccgcauccccuccccacucccagcuaccucugucuagcccaggaucuccccaccuucacggggagucaguucccaccugggaaaaacacacaugaggcuggauuccaucccccagcuugagucccagaaaggcacuccaaaacagggaguagaggcuuuuuaaacugccugugccccccgucccccuaagcuuccuggacuguggcccaacucaaguguguggaaggcggaaccaugucuagucuagaagcaaugcagggaccaaguucucuggagaagccuagaagugugggacuucaucacuguuccuuugccuuggggcuucagcauucugggccugugaacucccacaguucuucauggcuccagagugcccauguaucucagaccugcuuccaugccuugaugccccacccaaccaagaggggcagucauaagggccuaacuucugcccugccaccucaggcuccucuggagccuggccagcuaggcccuguugguauuuugcugccagacuagaccaggcaaacggguaagguuuggagaguaagggcuguguaaaaguuaauaaauaauaauaauaaacucucaagucaaccuugaagagaagggaggucaggggagaacaggaugagggccagggcagaggcaggccccagguuuguagacaaggcugagguuggcucuggcaggcucagugguaaaugugaggggacaagaaaggggccagguugaugggaaagaacacaucuccuugcuuaggucaugucagcgcugguucccugauucagcuuagaaccuuguagaacuuucuucccaagcuuccaagacuacccuuacucccauuuaauccuuuaucccaagauccaauaugaccuggcuccauggcacaagcauuuucuuguccccuucagaaagucccccuucccugccucggugccugcuuuggacuacuaugugaacccuuaagccagggaaaccacaagcccagggguaagggguggugggcacaggcgccggggcaaggagaaagcuagagacucagccauucccacaggccaccagcaugagagggcuucccagcugcagagccgaauuagcuuuugcugcgcacagagcagccucuggggcagcagaacaaagaggcgagagagaaagccccccuuugucuggguuugaaugccaggccggccagggaggaagguuuucccagagccagggaugagcuggccaggccugcuagcucagcccagggcagaggcccaaguggggcugcccacccagacucuccugacgccccagcucugcagcacccacuggggcucuguccuaacuccaacacccaccacaggcaacagcuuaccuuacaugaaucccaaccuucucucccuucccgaagagccccaggugaggaaguccuaaggccccuggcaggcucacagcccaccuauuaccuguucaagcacuuagcaagugguagucugaacaaaaucaaggacaggaaauucaguuugcggggguaaccagcgaggcccaaacagccugcccuguaccccacucccaucucaccugacacccacucuucucucacagacauaaacacaugagcaugcucucuccuucacuccacagccacacaggaaaguagugccaauuaagucagucgugcacacauccuuucuuggagauacucaugugagaaaaaaauaaaauuaguuacaauagacagacagacagacagacagacagacagacagacacccugaguccauaacugcuggcagguagaacagugggaguggaugacaggcuccuggcugucagcaggauccugggguagaggcagggggacuggaucucugccugaggcuucucuuaggucccagagaggaagccaaagcaggcuuccuucucuaaggacucagaugaucaaggaaaggacagagcucacacuacccucuuccccgcacacagagcuuccccacucugcuuuuggcagagggaagagugugggucugaacuuccugaaucagccuguaaccccagccccagcucagcagagaccucuaggccuccccucuuacacccggacggacucucuacagggcuuuuguguauccccaccccaccccaccccaucccacacagguaucggguacucucacucuaagcaacuacaacucucagcagugggacuguguucucagaaaacaccucuuuuccacaagaggguggggguaaagcacgugguucaggccaauaucuccagccugcuuccgggguccuagacaugacccagaagcacaaaagccauguaaguuccagugugcacaucugcaaagcccuucgcugcaugaccgggacuucuccuggguccuuucuauguugggagaguucauaagagugcucccaacucccaucagccuccccaugacuaagaugaacccuucaacuuagaggcuugaagggaucuugucugacagucaggauugcuaggccugagcccaccagaugucucaugccugggcccaccacccaaaggaaaaacccuccaagggcacagguaugucccagugagugagcucaaggccccaucugcuuggcacccaguccucucaaaggcagaauggggcaauguccuggccugcacgggccuaacucuugagugccaccccuuccugaugccccacccaagccacgggcucaaguacacaagaguggguacuugugaguauuuggagacagagcuacuggaaggguuaagcaggguggggugggggagagggguuguugguguugauggugguauugggucucuuguugucgcuauucuuguuuuucagagacaaggucucacuauguaauccugacuggccuugaacucagagaucugccugcaucugccuccucagagaugggauuaaaauugugggucaccacacccagcaacucaaaacacucagcagcagcguuaacuguuuccagccaacugagccagacccuaacccacugugagggcaggugagaaacaagaggcaggacauaagguuauuucugugcuuuugcucuuauaccuuggaaaauucuggugcccuuuuccacagcacuagcacaagacccuuucagggagacucccuccagcaugaggaaaccagcugaggcaaagcccuguccuccuggauagccucaagagaaggcaggguuuucuagucagcuuuuccucacggcucagcuccucccccagggugggagcucuaccucugcauucaauaagucagacuucuacuugagugauaaggggcuacugaaggguuuucaagccuggggcaccagagaaaauggacgugaggaaccuggaggaagauaagccuggggcacagaugcugagcucacagaauugcacaucuggcccuaaugcaacucgcucuuucugagcuugccccauaggcauaagagcacaugcaaacaugcacacgcgugcgugagugugcguguguuccauaagcacacacaacagacacacaccacggagcugcugacagaguaaagugucugaugaaaggaacccccagguccacucuacaagcaaaugucacccuuuccucccgaucuuaaaguaagacauacccauuugaggguaaauguaggcacacauauuaggauguccuccuaauaccaagccagguguuaaguuuucaucccuaccccaaggcaucccuagcacuuaaggggugcagacacaugggguauaccacauccucuacauucaguccuaucuucuucucuucccuucuacccacuuucuacagccaaccccaggacagagacuuggacagccgucuuuucuccagucuuucccugcacuuucccagccuccaccccuacagucuuuauuaauagcagcagccucaacccuggguaaagugugggcucugccuaaccggagucaggagaggaggaccacagggcuccuccacuuccccaggacuuggccuuucccagaugcugggaggagugacuccacuucuccaacccccacacuuccuuuaagaaaccagaggccucuccuggcacaaaaccccagagcuggcccaugcaauugcaaacuaauuauacagcaaauuuuguuauccccgcccucagccugcgguggcccuucugccuuuuguugguuguauaugugugguuuuuaauugcuaaacagugacucauuuagauugguccccuccuugucuccguccagcccccacaaccaccaaggaaacagcccgcaucuacauucuggacaggcccagcuuccuccuacugcagcagccuuguuggccuccaggggcccccacccuaaacacacacucccaguuccuaccaaacccagcccagcucccuuaucuuaagaccccuagcaagagcuuucaagauggcucagucuuagcucgacuccuucuucccggugugacucaacccagaguggcaagggacccgagaggaaccugggaggagcccccuuccagugaaagggacggaaguaugccccacuccaguucccuagccaggcccagaggccuaagagggggaaggcgguuuugacauuggcugcugcaguaggguguauacaaugggagggggugcgguucguaaucacccagccggcagcccaggggagccagcugccugaaaccagauuucaacgcggcucaaccuuaaacccacaggacucuuuuuccgucuuccccguccccucccuaaaugugggagggccguguaagagggcagggcugggaggaaagagcccagggugaagaagucacauacuuuaagguuuguucaugccaggcgcaggcagcauucaaguauagagagagcagcuuuagccuggggagcgucuacuaggacggauuagaagagccgacagucggggacuccucuggacacccaggccuugcccagcuagaugccagaguucuucucuaucuccggaagcuccccccaacccccagaguguuuccaguagagcugaaaacuaacauggcugcuuuguuuacuuccucauugguaugccagcaucauggaucaugucagccacagcagcggcaccaggacacucauuacauaaacagcagcuggagaagcaggaccggggucacugccuuggugacuucccguagagcuuacagaaacaaugcggggggcgggggggggaaacugcgcaaaacagaaaagcaacacuccaaacuacuucuaacagccuccccccaauuccauaaaugacugaaggagagaucuuaagggcgcaggugcgagaaugcauccagcagccagggccuuucccccaggaccuugccccccaaacuuuuacggaagaguuuggaagagggccucuaggcuaaugucacgagagucagcuugugcggauggguggcucccaagucgugugugugugugugugugcgugugcguguguucgcacgcguucaguguacuugcccguaucucauuccuccguaucuccacgucacacaccgagugucccugaugcgcgccgcuguaguagcagcaguacuggcacacagccaccugcucggccucgcagugguacaggcgguaggcguugugcugcgggcagcuccaggcccgcacgucguccgccuccaccaggaggugcccgcgggcgguggagggcugcugcaggugcgucugcacgugagacuggcagcagggagccucgcagcgcaggcagaccuucugugccggcagcggggggccgcggcgacagaacacgcagugcagugccgucggcggcuucuccacgugcagggcguugaacuucuccacgauguuggugagcuucagguucuucuccaggcccggcuucugauuguaggccugguugcacuccgggcagcgcacaaggccacuguccuuggcccaagccucgccgaugcagccccggcagaaguuauguuugcauggcagcugcaccgguuccacgaaaacgugcaggcagauggggcagaugagcuccuccucaaagcaguucuuccaauucuccgccauggcggcugcgggcagggggcccggguagaccucucuaaguccccaacccuggggauccgucugguacagcuggggacccaccgagcccggagcuccgguccccgccggccgcgccagucgcucagucaccagcgccuuccgcgugcccgccccccagaggagggagccuggguccucgcgccgcgcgcgccgccggcugcgucuccuccuccuggcgaguggcuagcgggaggcggcgggcugcgccagggccgcggcccgggcaccagcccuggaggagagcgcugugguccaaauuccauauaacaggccgccuccggggcagcgcggcuagggcagcggcggcccacggccugcgcucggccccgcggcugacaucggggcgcgccccgcggcgcaccgagcgggggagccgcacucuuccuuuggcggcgacaguggcuaccuucuggcuggugcgagccgcgccuuccucgccuggaucccggccgagguccgagggggcacgggaagcuaguucggccgcgccgaggcuggcuagagccggagccggcgagcaaggcgcgccagcgguccccgggccguggcgcaggcgucccccagcuggccggccggcugcggguggcagggcgcgggcgggccgacuccggggcgcugcgugcgcgcuggggcagucauucagaugaaauuccaguccccggccagagacaccagcccgccucugccuuccuccucccuucacaaauagaaacggaagggggagggagagaaguggaaaaaaaaaaaaaaaaaaaaag

SEQ ID NO: 12586 - RNA, 79686 nt, Mus musculus
ggaguuuuccagccuggcuuuagaggcucugucucacuacacagccccucggucucuuggccuccuccagccccuuaagugagcugugcagccugcccugcgggggaagcgccggcucaccauggggagcccgggacuucggcccgagcugcugcugccucaaguacugccgcuguugcuggcgcugcugcacguccugccgagccagggcuucccagguaggagcuagggauugggguguguuuccccaguuagucaucuaggaaccucagaagugucugccgaacccccugcccugcaacagcaggagauggggggggucucccuuuguuuacucugaacucgucuuucgcagucccaggaagcgggucugaaagaggaguguggcucccgauuagguacaagaaacugaguucucucuugcagcgcuuggagccggagccugagcaccuucugcuccuagggcuccaagguuuaaaccaaacccucuuggcauagaaggcuaugaagagaaaguuuggccacgggcucuuuugcuucuuucucaccacacugcauagcuucuuuugcuccccaccccaaccccucacaggguuuugauggcugucagugcucuaggccugacaguuuauuuuggguagaagcuccaaaucuuggccccacucuggagcugaggagcuccgaaacucuuguggacuuuacuagccuagccgaagagccuucgugcauccucuuguccagucugcucccugcucccuccugcucccaccccaucccccgaacugcgccaaacucugggauuccgagaaaguuuguuucucuaagggagaagugccagcugagaguggugacauguggcaugcacuugguuagcaccagggaaagcaggaaaggcacaggauuguguuggagggcguggucuccaacagcuaaggggacccugguauuuacuggguuuucacagcacagggaaaauucucuuuggaagugcuuguuuaaaaauaucuaguuaacauccucacaaugaaaucucaggcuuacagaaggugucagaggggcagggcuauuuguuauggaccccuguggccuuggaaugaagagucaaucuaugcaggccccuuuaguugucuguuucuagaaaggugggccaugcauuguaaaguaugugaauaauggucuucguguuagacaucacuacgaacaguuuaaaucgggggcuugagaagaaacccccaggaagggagcuggguagauguagguaggguggcuuuuggucuuugaauguuccaaaugaguggauggauggauggauggauggauggauggaugacaugugaguuacaagacaggagcauucuuuguguuuugugcugaugcuuacagguuugaaguuucguaggaacuaauuaggggcaaagugcagagggggcuuuaccuuaguugcuagagaaaugucauuuuaugaggcugaugucuccacucacucccuuggcaauaauuguguuaaagggagcuuagaggggaucuaaaugaaagaaucucaaccucugguugagccuguccuagggaggcuccccuuuuucguuugcuauccuccccccuccugcucucuccucccugcuccuuucucuccaucucuacccuuauauaguauagcugccaagccucagacacccacagaauccuagauuugccagcucaggcacuuacuacagcuuauguuuugggacuugccuuugaguuucuuggcucagucggcuagccugcuggucccgccuccugacagccaggcagccaccagguuccucuuugccacuauuccuguugaucccucaccugcccucuggcuccacucagguacccugaagcuuugcaggagcacuucccuggaggccucacucccauuuuuuucuagucuauuucuagccuguuucuuuaagaaauauuuauuuuacuuguugauauuguauuuauaccauuuuccccuuuguuuucugcccugcaaguccuucccuauaccccacccccuugcuuucuaaacuacagaauacuauuccaauuggaguccucucuuggcacauaucaauggauuaucuugggaacugagcucugcuggggcuguugaauucaacagaggaaauuuuagucugagccagagauuguaaaagucugggaagggaaaaugcucuagacuuguacaucuggaggcauauggcaucggcuggguucacuauuaguuguggaguaacauguuuuaaagauugucucagaggcaccuauaguaugugaacaucauaucuccaggaagagccugucuaagaagauuuggaucuggaacuucacaaagagggagcuaggaauuuaggaccccaucaggauccuaauuaugcucuuagagcaacuuugucagagaaauggcaaaucuuuccuauuuccacccguagaagcucucuggaguucuucuaaaccugaauuugauguagcuuuucugggcuucuaauuuauuuuucccagccuaucaaagacugugugucuacagaagccugcaggaaguauauggaacgcuccuggcaaaguugcccaugucuguguuuggauccuuuuaagaaauggacuuguucaugaauucuauucuuaaaagaauucucacaagcuucuguaugucugagacuuuggaagcucacucuacccccugcacacaaagcugaagguggaggaugaaugcuguggucauggacaaagucuuugugaaucuuccuaguauuggagaaaacagguaaaguggugugguuuuguucauuagggaaaccuuaaagcuaaaucagaccacggcugucaaagcaggcuuuggaagugccacauuuggagauaaguaugaggaguggagcaccuggcucaggcucuacaauuaaggucucagcagaaccuggcuagaaaugucuauuugugcuuaagacauauaaucagcugacuaaauuacucugcaauauaaaagaggaucugcuagagagagaagggcauuuuugucugacauugucuuuguugagaacacuuccagccaguaaauuguuaccacuucucauuucacagauuugugaguugaauacagggcuagacacuaucaguaaggcaccaauuucagaccuuccugccuacucaguccuugcaccguaaucaaaguucgucccuucccuucuagaugaugacuguagcauuagugucucugaggcuaacucauugucugucuguuuuuuuuuugccaaauaugcgucuuuuagguggaagagugugcauguguguguauaugcguguguguuugugugugugcagguauguacauaugugugaucuugcaugugugugugcaugagugggcauauguauguauucauguauaagcuagaagucggucuaaggugucuuuuguuucuuucuaccuucacuucugaggcaggaucucucacuaaauuggaggcuuaucaauggagcaaaauuagcuggcuggagaggcacacaaacccuccugucuccuuuuauccaguucuggaauuacaaguguaugccaccacacccggcuuuucauguggaugcuggggaucugaacucaaauucuucuguacauggagcaaggacuuuacugauuaagcacucuucccagccuguaaagugggcuaauuuguagccuguauuucucuguucaaaaacuuagagcaauaacuccccaaguccacucucauguggaaggcucuccauuauauucaggaacuagauuguucuggcacaguucucaagugcuucacccauggcuuccuaaaaccuaguccaugugcacuacauggccuuuagcaguuuaguuauguuuuccuucuuuguagaugucauugccugcaucugggagugaaccacugagcucuuugacuauucaaaauucuccccauuaucuaacaacauccacauuuugaugaaaucaacugccugauccucccucccuuccucaccccucccuuucuuccuucccaguuaugggaaggggacacauggccuugugcaugcuauacauaugcuuuguggcugagcuacacuccggcucuugaaauuauuucuggaucacugaaagggaagccucaugucuuuaaacaagcacagcucucuguggcuguucugugggcuuugucacacauuucacgcacuauaagucauacacuccuuuucuagauucugaguccuaaaaaucuagguuuguacauguuuaccguuauguguauuccugcgcaugcucagcagaauaccuggugcuuauggaacuuaauuuacagugagacucugauaaucugugagagaagugcaugaguaaaugggaccuugugccaccaugaaucuacauacauaggaacuauggcuugcuagccacagaggcucauuuuaaauccacgaguacccccuguuuaagcaauaacugucucugcugggggcuguaagaugagagacugagugcagccacaagcuggagcuuggauuuauuuuuguuggccacuucauuccauguccuuccaaagcaguugaauggucuccuuaguaaacacauauauauguacuguaacaauuccccuuucagugaacacaacuaaaaguagcaauugacagcaaagaguuucaauauagguuugcuguuaccaaguuauaacauagcauggaguuuguagcugucaaguuaugauugacauucagguugaagauucucuuacaaaacagcaguacgaauaauugucucucaaguucuaguuuguaaggagaucuucgagccagucucuccaucuuuaacucuuuugaaacugacagcuuuagugggcuuuuugcuuuaagagaggcugcucuuuuccugauauauuuacauucugcuccaaaauaaaauugguuccugucuucccuaaugaaaucugagcuuuacccagacacuuacuuuaucaaauggccaugaauggugaagaggcucugugcuuggcaaaggggagugaguaaaguacugaguuucuucuuuucuguaguauccugucuccuggggaacuagacauaguuaccuccaguggccaauacuguaauguaaaugugugaugggcucuauagacucugagggagucaugcuggaacuugaccugauguugaagggugaugcuuagagauguugcugccaagauggugaugcuaaagguccaagguugcauuagaaugucuuugggcuucacuaagaaugcuuuggacugagaaacagaauucugggaaacuauuuccuccccugaggaaaagccccuuucccaauccaaauccacuauucacuagaugguuucccuuuuuucuugaacugugugagaaaaagaaaauuguggacuuaacaagcaaaagaaagagagaaggagagaaagagagaaagaaaaagaaagaaagaaagaaagaaagaaaggaaggaaggaaggaaggaagaaagagcacagaagacaaaauugcuagauagaacuuugauucaaccaaugaguagguggaggucaucucucuaguuaacaccagcuauagaauuuccaauucuccccauuuuuaaagcaaccaugggcuaaguguagcucaaaacauuagaccacauuguaugccuucaguucuguauucagugcccccucaaaguaaaacuaaaugauaaauaaagaaaaaaaucaaacaaaguagaaauaaacauagauugaaauugugccugcucuugauuaacacaaagucugagaucugagggaguguauuuaggucaauauucaggguauucauugucugaaguaguugugaauaagacccaaacuauucaauucaaauaucucuguaacauguaacagaauuuccaagauuacuucccagagacaaaggaauggaagauaaaaugucagugaauauuuacaauccucugaauaaaagagccaauuggguaggaagcaagucagggcauacuuagcugaugagaccuuuggauaucaaauugcccuaagacaauauuuuaagugauuuagacucugggaaguuuacacauucugaggguaagguuugcagauaaagauuuaaaacgaaggcuugcaccaaauguucuuagcaauacugcuaugcagccaaguucccaagguaauaauugauuacaccuggaucuuaugagcacauggaacaaucuggcuucagaaagcuccugaggaugcauuccuuagagaaaugaugcacucauccauaauucuagcucauaguggguguuucucucugugcauugcucuucaggaagaagauaaauggguuuggauccacugacucagauuaucccaggaacuuggaguuauacaucacauauauuuguuuaaaaaccuuuucaauaaguuagauuggcagaguuuuugcuuggcuuucuuuuuuuuuuuuuuuuuuuuuugcaauaguuuuucugugaugaucuuauagggacugguagugugauuagucccaugugccaacaauuuguuuuuuuuucugccaccaucacaaugucccuccaguuguguuuaaugggcacaucuucaaugcagcugcacccuagcauucucuaaugauuugucuuggucugugccuuguguggguggcugggcugaauaacccugccugguacaggcuuccaagaauauucaagcacauuaguuaaauuggagccacggggcaagaauuaagccaaaagauuuugggcccacaguggaauguugcagaagcaauggugcuguucauggccccuauuuuuuggaacucaguucccacauggccauuccuuauaggaacucuccagacacauuaucucugacucauuugccuguggccaaagguaaaaugcuguuucaauuuagauuuuuuuucuaucucagcuuuuuagguaguagaaucacacucuuucaguauuagcuaugcagagaucuaauuuucucacccaugugggccaauuauaggaucuuuuaaauuuuccuagucccauaauuuaacagggaaccuggcuccaagaggauaaugucaucaagagaggaugguucuagccagcuucaacccacccaccuggauggcugucucagacucuaucuagauugcugggggaguuucuuucuuucguacccagguuccucugagcaggcagccuaauucuucugcuggggauucuuggacagugaggaugccucagacaugaaauuuucaugcauuuuagggaggagccucucaugccucuugggaugagacauccucaguugggauagcuggagucacaagccgagcuacagcuagagcuuggcgaagugaaucacccgaccuccuauaggcugauauuggaauuuaccucugcaaugacuacuucacauuaagcucuuuccuggguucaagugcuagacaaacuaggauaagcuaugcuacagcaucaguauuuauaugaauucuuggguacccucucauucaucuuagcgcuggguuacuugggcauuucucaguggcuuugagaagcuccugacccaaggcuagcucuugaucucuuuuaaggcauuagggucccauaagcuuugucuccacacugcuuguuuggaguugcacaccugauuugugguaacaguuuaacagcuuuauggagacauaauucacccccuccagcauuugcccauugaaacugugcacuuuagugguuguauuauauucauggaguucauuguaaucaauuuuaggacauuuuuauuaucccccaaagagacucaugccuuuuggcugucacugcccaaucccuuuucauuccaacugcuaggcaaccacuagcuuauucucugccucuauagcugugccucuucuuuacauucuuuagaaguuaaguugcaugaaacuugucuuuuugugauuuaugucucucauuuagcccaagguuuucaagggucauccaugcugucaauuccauuccauggauaucuuccauuauacuuaucuauugaucaguuauuacucauauggguugcuuccacuucaagucuuuugggaaugauguugcagugaacauuaguguacagguuuuuguggggacauauacuuuuauuucucuuggccaguuaccugggaauggaacauccaggucauaugcucacucuaggacaaacaucuaggaaacuaccgaacucuuuucccagaaagacuacaucuuuuuaccuucucacuaguaauauguucuaacaucuguauagccucagcaucucugaggguucuuacacugauuuucuuuucuauuaaguaauuuacucucaaguauugagugacaaaacugugucuuuucugcaaauaaugaagggcuacgccagagaaagucacugguaucugcucuuucauuguuggcuggaggaguacugcuagcccacaaugcacucacuucucauugaauaagauaaaaaaaaaaaaagaagaagaagaagaagaagaagaagcccagucucuacauguuuaguuagacgggcagagaauucuaucuggagacauuuugggcuaauucagaaauaugggcaagcccaagauucaagacuaggaaaggaggggcugacuaguguggugguccugguugcucuuuugguggguguuauggugugggaaagaaacucccuggacaggcaugcaagcaaugcugaaugauaguggcuuagccucaaauaagacaaagcuguggaucugguauuuuuuuuuaaagcauauggguauuuaaaaggaaaauauaacaaaaaagcugugcuugcauuucuacgagauccucguugcacccuugggucaucuggaaccaagucaaaaauucagaugccuaggcuccacccaagacucgcugaaucagcauuuacauuuuacccagagccugcagaggaacuguagaugaggauauuugcauacuggucugaugaaagagugcagccuuugccaaaacagauuggcuugccuguuuagaauugcuacacaauggcucacuuccccuccucucccuuuugugguugguuuugacuucaucacugaaugaaucuuucuggauuuucaucguaaguccuuuauaauccugagauaaacaugugcaccuuuaaauucuuagucccuucucuaacucaaaauacaaaccuucaauccuucaagucuuucuuucuuucuuucuuucuuucuuucuuucuuucuuucuuucuuucuuucuuucuuucuuccuuccuuucuuucuuucuuucuuucuuucuuucuuucuuccuugacuucaacuauuuuuuaaaagucugcuuagcaauaagaguacagucccugccugaccuaacccagaauaacaacaaagcauaucuucagauugaccaguaacaggggcuuugaguagcuuuccccugcagcuaauaauuuuaguugaacaauuuuagcuaguuaggaggaggaggaggaagaggagaaguagcaagagcaagagaaagagacagagagaagaacaaguugaguguuauugaauccucagcuacccuggaggguaaggaaaggguauuaucuaaguuaagaccugcuugagauacagaaugaauccaggggucauuuagugagauccugucucaaaaacaaaaaagaaguugcagauauggcucagagaaagagugcuucccuaucacaggggagguccuaaguuuaaccccuaagauugaaaaggacaaagacuaucuggggggugguggugcccaccucugaucucagcacucaggaggcagagucgggcagaucucugaguucaaggccagacugcucuacagacuguguucuaggacaaccaggguuacacagagaaaccccaucucgaaaagcaaaauggaaaaaaaaaaaaaaggaaagaaaaagaaaaggaauuuuacaaaaaggacaaggaggaagaagaagggggauuaucugucuucauacuagaaaccaauaugaaagagguuagagaagaggugagaacuuggagaaaggaagccagugcggaggucaggagaacacaucagcccuggaaggucuccagacugggaagacuaggaugauggagcugcucaauggcaucuaaaaggauuauguuggggugggcaugugguuauaaacccagaccuggucuuuagaaagacagaauugggauuauuuggagagagucugaugaauuuuaaucugauagaucuggaauaacgaauaguuaauuugggugcaguuugcaaauuaauucaggcaugcucuauuugcccccuuccuguuuucauaucaucaguugaucaaacgguuuaaaguuuuaaguaguaaaaguacuccaaaggagauugauaauuccuuucugaucauuugaacacaacuuuguuaauuuacuuauguacaguauguaccuauguggugauauaaagauaauauuguauuguuucgucagagaucacagggcuuaugaaacuaaaaacgguuugucucuaaagucugccaaucccuaauggaaggucuugcuucugaaaguguaaccugaggcucagcuuuuccugguagcuuuagaaauuuuagauuuugaacagcaauccaaagcuaggaaguugcagccugccuuuuaucaggagaugccgagguguuuggaauugcuucuuccccaucaguagacccaacucgggacucaucuaggccagcauacuauaauggacacuguacucucuacucuuaauuuauauggcacauaacuguauaucuaguuuucuauguuuggggacuguaauacccagacaucucaaacucucuagaaauuaaguucucauuuuagucuuuccagucuuuagcuaaaucucaguguucuaacccaaacuggaaauggucuggccugaggcugcagacucugguuucucuggcuccaugguccuuccaggaucucccuacauugauauggcucaaagcccucuaaugucuuguauacacuuauuugaagcacugcuucccagaggugcacagaugucuccuguuuauguagguuguauugucauuaaguugagaugugcuggguccuaagaucugaauacaguuugccucccuacaaagcucagcaugagauaugcuuaccauugugcgggugaguuugaagagauuauuggaacagccagaaggcuugaugccuuucauaggaccagaucagguauggugauugcgggcuauuauaaagcaaggcaucuuuacuuacuugcucuucuccuuuucacugggaguuuuuaauaagaggcugucaccauauguaacuuucuaccuugaacuucccaaccuccagaacugccaaccaagauaagucugguuucaaucuugcagucauggguguuugguuguagcaacagacaguggccccaaacagaagauugaguguuucuuuagugcaggggcucccagggucaucaguauguaaccgucugggaggggacugggaagaauauccucaacucacgauccacagaccaguacaaauuacaggaccacucaagaauaugugacguaaauacauucucagacccuccccuaggauuaaugaaccagaaacagaguccugauaaaguugugccuagcaauguguguucuucucacacagucauguaugagggucauucguucggacaauuucagaucaauuuuuucagaacaucuagcgaaagaaacucguguuucacuuaucauuuuaaugagaaccauuuacuugcuuuaaauuuuaggacaggaccuugggaaacaccauacugaacuuaccgaguagggacgagcacagcaggcuucugaggugaagucaucucuuggagauuugucucucagacaagcagcuuaucugcacacuuggguugagaaaaguuucuccaggucagcaggcagcaucuggcugaugcaaacacagauuuuuuuacaguggguuucuggagguuaaaaugugcggaaggcuggggagcagcccuggggcuauuucuucuccuaugcaugauucauucuuucagaauucucaucugugggagacugcuagucugcaggcagugauucucaguacaaauggcugucccugcguuuuagagcucaggccauuucuucucauucuagaacuucucccucggagucucuaggaggaacagaaauauuacagccucagaucuucauguaaacauucuuucuuuuuugcucccaguagguuuguaucugcuacauugucacuuagucucagagucccaguaacaauaagccauuugggagacugagugaaguugaaggagccacuauaacuuauuguacuuccuuugagagcugacugcuggggucaagccagugaaaggaguucaggacgagaaaccuucucugaccuagauuuucaucaagaauggaugagacaacugacaacuuugauucuuauacuucuuuuugggagagaaaauaaaacuccuaugcgguagcucacugcugucugcccugcacucugaaagcuugugcucagcuuuaaaauggcccggcccaccugaugcacguaugagcugcagcucugcugaccacacuuucaugaugcuuuuaaaaaugauaaaaagaaguugggguguagcucagugcuagagcgcuuagcaguugcaaggccccgaguguaagcuuucagcacagaaaaaaaaauuguuuagaggcaaaucacauuuauuguaaaagcucuuagagacauggcaagauggaaggagguuugccucuuauuuuccucugcacucuauuuuuucccuaaaaucacugcgcugaucaguuugguauaaacgccuagaaauuuuucucugugugcauuuuuauaaagacacaaguuguuaauaaugcauugccacacgaagcaacaaugauaaauacauggaguuaucuccuuugccaggaaacagaggcccaugagauauauggcuguacaagugagugugguacaagaaauaucucuguggcucucucccacccucacuagcugucagagaccguguguccucagacagggccuuggucuguggccuugcucaaagccuggcugcaaacucccuuccucucuucaauuuuuguugugucccgggcacuauuuguggacaguuaaguuaaccuuuuuggagggccauaugacacaccacaaauugcuuuuguuccaucaucugguuucacuuuaaaggguagccuucuuccuucugucugaguugagugggaacaguuagguuucagagcuuuggaaaugguccucaguggaaacaggaguuagcauuagcuaaggucccuuguguugugccgaugcccucgguuuuagguaccuguauuuuuccuguuccuacucugucucuaagaauuaaauaaugggcuugguucuucaaacuauuaagcaauaugaggcuauccuggaaaaacguauucuuuuuucuuuuccuuuggaccagagcgaugcuuucaucuauaaauuuauccuuucagcuuccuuccuuccuuccuuccuuccuuccuuccuuccuuccuuccuuccuuccuuccuuccuaccuuccucccucccucccucccucccucccuuccucccucccucccucucucucucucuuucuuucuuucuuucuuucuuuuuucuuaauuucuuucuuucucucucuuucucucuuucuuucucucuuucuuucuuucuuucuuucuuuuuucuuaauuucuuucuuucucucucuuucucucuuucuuucucucuuucuuucuuucuuucuuucuuuuuucuuaauuucuuucuuucucucucuuucucucuuucuuucucucuuucuuucuuucuuucuuucuuucuuucuuucuuucuuucuuucuuucuuucuuucuuucuuucuuucaccugaaauauggccacaauuaaaauuucacaagccacaugcugucuucauugucuuggcuaauuaaaagcagaguacuuggagacuaagggcgccaucuccucugccuagaauuuuccucuggggauuuucugcagaaguauuuaaacugguggugggacauugucccagaugaagcagcuauagaagcaaggcuaauucgaagaguucaugucucacaaguuuuaccuucccacgcuccacccacgacacugccaguuuuucuugaugaaaucaaguucaaugggcacauaggaacacucuggacagggaaaaguuagccuaaggacuguaguuggguacaagagguaaaauuccucagugagauagaaccccagucauccacaguggugaaccccagcaguugcccaguaagcaguaucauuuuggccuacccuuccuucuuugccucucuuucucuacccaucauuauacaucccccccaaauuaacuacuguauccugucuuaagaucugcuuugggggauggcaaacauuagcuaugauggaauuuaacccuggccucuugaaguuauuuauuuuaacugauaaauugauacuuguuagauagagauguauaaugagggguucugagauaggagcuuggaaguuguuuagguaggcaugaaacuaccuaaaauuuggugguucaaaucaauagcaaccaaguacuugcucaugagaguuuggucagaauuuaguguggaaggcuaauuucugaccuauauacuguuggcugugugccuuuaucuagggcugcuggauccaagaugacgcaauucacauauuugguacuucaucugcaauggcuauaccccacccccaccucuaugucuuucagucccuugugggucagaccaguaucucuguccagcaaacuaaauggacauguuuguauuugaguagcuucccaauagaguaaaagcaaacccugccaggaugcuacugaaaagcccaggucuggaacugacacagcaucacuuuugcugaaaaauuuuaaggaaaaugacaaggcagccugauuuuuagguuggaaguaauagcuaaaguugguagauuguaacguguaauagauuggaauaauaguacaaauggggggauugauaguaguuaacuuggaaagaacuccacucuaggacugguuugggaauggaagcuagagauauuaguuuaacauucuggguuguuuucuggguacauucugauucagugaugaacucuaaguuaguuauccaacugcuauggcuuagguaugaaauaucccucauaggucaugaguuaaagcuugauucccagugcaauguucagagguagggauuuggggaagugaaugaaccaugaagccccugacauagucaauggaauaauucauugaaaguucauagccugauggcauuauugagagacaauggaaacuagguggggccucauuggaguaaguggaccacugaaaacauacuuccaaugauauaucuuguuucuguauccuuccuuguugggucacucugucuccugaccaccacgaagugagcagcucaagucuccuaugcucucucugccaggaugcucugcuuuaccacuggcagacacugugaggccaaauagccauggacugaaacuucugagaccaugaaccaaaauaaaucuuuaugucguuuaucucaacacauuuugucacagugaugaaauguagcuagcauaccaaugguauuuaacucauccgguagacaacagcaugaagacagagaauguauucauggacgguucuuguacugaaucaacuggcauuuauggaaaugugcaaaacucauuucccauugguuacuaguacuagcacugccuaccuucccuucaaauuugcucucuuccuccaucaaugcaaaaacauuauuauguggacacuagcuaauaauacacaauagaccuaaauaugaagccuguaagaauucuugauaauaacaucagagaaaguguuuguaagcuugaguaaagacauuuuuagauauaacagcuaaaacauggucuacaaaggguacagggaauuaauugugcuucauccaaauugaaauuguuuacucuuuagaacauacuauuaagggaaugaagagaaaaaucagaauggagagacuauuuuuaaaugacaugucugauaaagggcuauuauuccaaauauauaaagaacacucugaacucaauaacaauaagcaaccccaugagaagauacuuaacauccucauucaccuacuaacaaugggaccaacauggcuaauauaacuguugcuuucaucuaccaaaaaugggaacaaagucaccuuuucuuuuuggaaucugacuuucacuguauagugcaaauacaacauguauguauuccuaucaagaagggauuugcacacauuuacuaucccuguagagagcugacuggcuauuuuauguuucccuuacuagaauuuaugugacacacauccacaaauugcuagccaggaacuuuaagaaaccacuggacaccagcaauuugaagcagaucauuuacuguaagcucaagaggacaugggugucuuccaccaugccuuucuaagccuguuuaggcugcuagggcucccuaaaaaccucccuucaucuacuucuauucucaaguacaugauguccucucacuucaaggaaccggccucguuuuggccucaugacacagggauuuaguaucguugguacuacuagcacauacaagauuuaaaucgccuugauguuuuucuucgaauucauuuauacuugguguuaaagucugaaauauauuauuuuuacuuuuuuucuaggaacagaugcuaaauuaaauacucaguguucaguaaggacacugauuuuaugaugaguaagaaauaacauuuuucauuuaguuucuaaauuuggaauaagaaucuuggaugaacagcugcaaugucccaaacaguuuuuuuuuccauuucugugaaccccaaaggcacuucaugcacuuaacauuccagaaauuccuagaauagaaauaaaaaagaagaccaugcagaaguuuuguuuuguuuugauauguauguauauauguauguauguauguauguauguauguauguguguauuguuucuuuuuaauaagcauacaaaguaacaaguuucauuuaacuaugacauuuuuguacauccuuuguuuugguugaucuuucucccccacuucucuuccagauccaccucugauuaccagucuccugcauuccacuaguccccuuuccacuucagugucauuuguaucacccucuuuuaccccucugauuuaaaccuucuaccucuccucucauguuccuguuccugguuuuaugacccaugaauauucccccauagacauaugcacauaaaaaaauucaguuaagauucacauaugcgagauaccauguaagcuucaucugccugacucuggaugccccccacuugguaaaguauuuuccagauucauccauauuccuaugaacuucaagguuucauuuuuaaaucuguuacuucaguaacuuuuucaaaagauuacucagaguuuggaguagcucugugcuguuucugcugaugccuaucccugcagggaugaugucuguaacgucuugauuacuggagcuuugcagugugguuccuccaaauuuacucuggcuucaugaaaucacucuagacauacauuccaacaaaaaucuugcugagauuaauauugguauuauuuuaauucuaucgaugaacuuggggagugaauugaugucuuuuuuuuuuucuuucuauuugaaauuuccaaccuaugagcacaguucaaaucuguacuuauuugggucuuauuugacuuuguuuauuaaccuuuuguugucauuuucaguuaaggagauaaaaacacauuuuauuggauuuguaaguauuucuuuuuaaauuuguguuucuucauuuuucuuacuuuuugaaugucuuuugcuuauuuacuugaaauuuaaugcaucuuauaauguagagagaugacuggcaugcucaucaucagaaaacucugcuauuuaaagagauaucuaguaaggugagagguggaaaaaaagucaaaaaggugggaaaugaugguuuccuggaaucgcaguuccagaggaugauaugucugucccuugcauagacacaaauuuuauuugguccucaaaauaaauauagucuugggggcuggaggggauacucaguagugaagagucuuuuugcugcucuuacaggggacccagguucaguucccagcaugcacaugaggcaaguuccagccaucuauaauuccaguuucagaagacucuguccccacugcuggccuuccuggucauuuuaugcacaugaugcacacaauggacacacacauacacauacacacacacucacucuaaauaaaugucuuuaaaaaguaaacauaguuucaaccaaaacaauuuuuuucucauaagacaaugugaauauauuugaauaaugaaagaaacauaaagugauugacuguauauagaaugcagaugcgcuucugauccacuagauagcucaucugagaguggacaagcaauccugccuguagccugugggaaggaaauuagagaauugggagaauucaguaacaaauuuaguaaaaucuuuuaugccagugaggguuuuguuuuuaauuaaacgauucaauuaauugcuuuggggcccccguauugguauuaucacacguuacacuccuucucaaugcaacugaaaugcucuacuuguuuauaaaagagucaucuuuuauagaagaacaaggcaggcuuccuuuuguaguauaaccaaguaauggcgcugucugcccuagaccaggcaggucauguacugagugguguuacuucaaguguacuauacuucuuauucaaucuaagccauuuuaaauccggaaugaaucagcuggguuuuuuuuucuuucaaauuuauuuauuuauuuauuuauuuauuuauuuauuuauuuauagagcacaugccugaguguuuugccuccauauaugugaguauaccacauagaugccauacccauggguuccagaaaagagccugugaugccaugguccuggaauugcaaugguucugugacaccaaguaggugcugagaaccaaagccuuuugcaauagcaguaggaacucucaacugcaaagccccuucuccaggcccagccucacaucauuuuguuaagcagacagcuaucugaaaaugacuucagcuuacuuccaaugauaucugaguuucagaaaacaaauccacauuaauacccagguuuuauucaaaacaucaguaagucauagccuccaauuuccuggcuccuuaaagucuuuuccuuuaaaccaacuaugcugccaugugcuucagcaauugcuuguauauaaaucaucauugaagcuuaaaauugaauguugaugcuucaaguagagcgucugugguuguuugagggagaacagcuuccauaggcgaacauguuugaguguuugauuuccaguuggugacauauuuagggaggauuaggaggggugaccuuauuggagaaggugugucacugggggugaccuuugagguuuccaaagaccaugucauucccagugaccucucucuuucugccuacugccuguguaaguaaggauguaaguaccugccugccaccacgcuccccuuccugauagugcuuuuaaauguugccuuagucguggugucucuccacgggaauagaacagaaaacuaagacagaaucuaaccucauaucuaagacuuuuucucaucuuaucucgcccucaucuguuuucuauguguacuccauuguaaugucugugucuuaauuguaaagauagucaauaagauagacaaauuccauaugcaaggagcauucuaaaagcuggugggauuggccaaagucauauagccaggugauaggguagauucguaguacuucacucucuugauuuuuauagaaaacguguggaauucucagacucuuguuucagagucuagcauagcgaaguauuuuuucccauugguguguguguguguguguguguguguguguguguguguguguaguguaugacuguguaugcaugugcauguuguucucugcuuuauuuaucaaugcagccuaucagcugaacccagagcuugcugauaagccuuguccagggcagccagcucccuccagagauuacccugucuguuagcauuuucuaggcuccgcccggcaguuaccuuacagggcaacagcucccugugccugacucaguauaaaaggggcugcuugcucccucugcucucucuugucuucuugcuuucacucugcccucccucucagcuuccccucucuccccaccccccucucuccacgugcucauggacaaccucugcuccucuacacucucccucucccucccuuccuucccccaucucucugccuuucucugucucuacuacccucugaacucccccuccccaugcccugaauaaacucuauucuauacuguggcugguuccccagugggaagggaugccucagcaugggccccgcagaggcacccccucccaccacaccuuaccacaccuccaccaaacauauuccuucuuuuuuuauuuuuauaaaacacaacacugacuuugccuccuggaauuacaggaaagucaccacaucaaccuggcauucuccugaguucuggggaucuaaaccuugugcuuccuguucacauagcaagcccuuuaauuacugagccauuucccaacugcuuaauacacguuuguuucaauggcaacuuucuuuccauaccugacaaguaugugcaagaaaaccaauuuguuaugcuaaaaaucaggaugguagcaggaucuggucauguucuauuuaaugauuuuaaugguguuacauggguauguucaguuuauagaaauuuauuuauagacuuguguuuguaaaaaaaaaauagaauguuuagaacucuggguauacuucaguuguagaaaucuugcaugguguuaugaaauuugaaugcaaaaugucccucauguacuuauguuugcgugcaugugugugugugugugugugugugugugugugugugugugugugugugugugcucgugcauauucucugccuuauucauugauacagccuaucaaugagaagcuuacaaggcgcucuugcuucucagcugauaguauggcuuuaggucaagggaccuucaagagugagaugggaguggaaugaaacugguagacauuuagaaguuacaucccagcccugauuccauucuuauaucuguguguccuaaccaguuauaaucugagaagcagcagcuauaacaccagcacuccggaggcugaggcagggggaauuguagguuugaggcuagcccuuacauagagagguccacacuauauugaaagacccuguggaagaugaaggagaaagaaaaggcauacaaaaaauggaucauuucaguaguggaugugcuggggcaacugggagaucagugcuguaugauccugaccccugauuuuuccuuggacuucauugaaauauuuacuagugccuugugcagugcgacaaguaaucucuccccuccauuauaaggauucacuucccuccagaagccuuuuauucugcucuccacagcacuauucccuccuggugccuacaugauguuugugccaugagugauccagggucuuaagaggagccaucugucacagagcagagacgaagucguaaccauguggugguuuuggccaccaccccacaaugcuugcuguagcuuguuuaauauucacuaucugugcuuccacaagccagggcacaucuguauuuguaucauucuugugugucuguacucuaggcuuucaaauaacaugugcaaugaagagcuugaagcuaauuuuccagaugauaugauagcucccaaaacucucucucucucccucucccucucucccucucucucucucucucucucucucucucucucucucucucucacacacacacacacacacacacacacacacacuaguuccaucacaugaaauuagcauccucugauacucuguacucucuucuuucccugucuuagcacaguaggggcaggaaccuguuuauaaccaccagcauauugaacauuguccaucuucucuuuccucuucaagcuguacaaaauuaauuuccauuugcuuuuauuuuauuuaugguaugggcagucaguggccagaacccagggauuauauuucucuuuaauuuaauuuucugcaagguauaacucuaaaguuuccuuaacauuuaauaaagugcuuauuuucuuacuuauuacaaaaucuagucuauagauuuaaaaacaaaacaaaauaaagcaaaaaaaauuguuucgauuuacuuauugauuuuuggucaaacucuugguauucuguccaggcaaucccaaacuccugaucuuuuuauucuuuuucuuuuucucucuuuucuuuucuuuucuucucuuuucuucucuuuucuucucuuuucuucucuuuucuucucuucucuucucuucucuucucuucucuucucuucucuucucuucucuucucuucucuucucuuuucuuuucuucagcuuuccuaguaacugggagauaagugccuccugugaugccugguaccuuugcuuuugcuuguuuguuuguuuguccuugcuuucuuuacagcaucuuucauagugucucuguccuuaaagcauggcucugaaaacuuguuuacauagucucaugcuuggugugguugauucuguccaggaaaagucagacuucuguagagucgccucuguccucuugcagaucacuguuuguugcuuuguucucuccccacccccuacccuggaagcuguaccuucaugauguagguagcucgcuggcugcucuuuccaaaaucuaugaagguaacucugcauuaagcuguguguacaggucaacaugagaagacacaagucuucaggcuuggauuucuauuaaacuccuuccuguauauuugaaagagacuaccagcacugaugcuuuguuugugugucaguuuagaacaucauuaaucagugcugaagacauccugcacuaucuucccucagcugagaugggcaguucccacacaugcauaugguucccugucacauggcugcaagucuagucucucugaggcuuucuacccaggcucuacucaguacccugagaccugguucagcuccaaguucuggaauaacaggugauuaauauaacuaagccaagaagaggagagagucaguggacagauucccucagcgcccauggcccugcauggguuguaucucuugcauuuccucaguggagaggaguccagguuaucucugaaaguguccugcuuacaagacuacuuucaggagcuucccccuuuuucuuuuauccuauccccuacuuuauuguuaugcuuccaagaaucaccucccaauggacugccagcauuuaauuucuugucucauguagggucuacguugggagaaauaaaaaccaugaaaguauccagucuaguuuacuuaacuuauuuuucuuuuccuaguucuuauucuuccauuaauaaaacuacacagagaucuacagaauaucuccugagaggauagugccuguucauggguuguggguuuuguucagucaguauuuaucgauauuuuuccaagacaaaguagaauagaguagacaaugaaaaagugcaugguacuucauguauuguucuguaaaacaaauuucaguuguauaaaucuauauguauuuggggucacaagagaaaacauauuucucacugugauuuacaauaaaaggcuaaaaauaaaucauuguucucugcuaacauaauucagcaaucaguacuucuuuaaaagaccggucuguguuuauaccauugcauauacuguaucaaacaugacauucuguaggggaaaccaaagcaaugaaugacuuuggagagguuuguucuuuucuguuuuuguuucucuuauuuuugagaugauaauauaauuacaucaucgcucuaaacccuccaauauaccuuccuuacuuucuuuaaaauucaugguuucuuucuucauuaauuacuauauauauguguguguguguguguguguguguguguguguauaccuaaauacauaaauauaaccugaucagucugugaaauauuacuuauaaguauguauguauaucauucauguucuuuucaaaccaauacaaauucaaaaucauugucauucuaaaaguaucuuucaauugugaaguuaauaagauauucucagguuauauccaaggguaaaacugacauuuuugugucuauaguuuccauaccccauguuuuaacaguuuuggguaguauccacuuaaagacuuugaugccgccuugaauacccuuaauuuuucugugauugugaggagguauuuuaccguacacucuccaauguucaggccuacagacauauuuucccuggaacuagaacuuggaguccauggaaaguaagcaucuguggucuuaaucuguggucuuagugcuauuaauuucuucuugauuggugccuuuuucuaaaauguauguuaaaacaagaaaauuuagggcugcauuuugaggaagaaguuuugauugucccagugaaaaacuguugaaaacagcuugugaguugucaguauugguuguguuuccaaacuuugaguuugcaucaggaugcucucaguccuugauguuggcgccuguaucagaugaucucccaaagcauucccagagcuaagacucuaaguucauuggcaagcaugacugcugguuggaagcccaaaugguucuucuuaaguacuucugggagaaacaaauucugauaauugcaaacaaaugaucaacaaaccuaacaaacaagcucuuugagucaaagggauuuuaauggcuaugguuuaaguuuuuaaauuaaacaugaagcagaacagaauauuuauaugucuuccuuauuuuguuuguggcaucagggauuugaucaaggaccucacacuaguuagacaaguauacuacuauguucuuagcaauagauuauuuauauaauaugaauaagguaaaaguacagcaagcaugucuauuugguaauuuaauaagaacauaaagugugauuuuguagugcuuauuaguucuggccagaagcuaugcuuuuuauaccuccucagauauaaccaauauccuaaauucuacacuuaccauuccuuuuauuuucuuuauauuauuaccaaauauauuuauauuucuuuuuuaaauguuuuacuuuuauuaaauguuuucuucauuuacauuucaaaugcuaucuccaaggcccccuauacccuccccccgcccugcuucccaacccacccacucccgcuuucuggcccuggcauuccccuguacuggggcauauaaucuucucaagaccaagggccucuccucccauugauggcugacuaggccauccucugcuucaugugcagcuagagacacaagcucagggggguacugguuaguucauauuguuguuccaccuauaggauugcagaccccuucagcuccuuggguacuuucucuagcuccuccauugggggcccuguguuccauccaauagaugacugugagcauccacuucuguauuugccaggcacuggcauagccucacaagagacagcuaugucaggguccugucagcaaaaucuuucuggcauaugcaccagugucuguguuuggugguaguauaugggaugugauaugauuaaaaacauguuuuugaccuuaguauaauuggacugaguguaugcuuuuugcaauuuacuuuuauuuucacuuaauaucauauucuuggaauuacuccucuuauugcaugagguuaugacuuagacaaaaguauucacuuuauuuggagagaucucauuguguaaauaugucauaguucaucuauguuacuucuugcaugcauuuggauucuuguugguuuuauaaaguuauaaacagugcuauugguagaauaaaaaucuauuuccuugguaaacugcacaggauuuuuuccagaaguaauacccaggaguggauuuccuggaccauagugcaugcuaucuuugauuuuuuuucuaguaaggccaaguuguuuacaaaagagauuauauuaacgugaacuugugcugccuguacuggacacccuuugucaacacuugaccagaucguaaggacauuuucugagucaguaaguaugaacuaguaugggcaucuaggggaagccagagaaggaggaacgucuucucuaauaugcugacuugaguggucucuugaguuugucuuccauaauccagagcuuaccagugcaugagaaucaaugcucuguuuuggcagcuguccucagaaugaaagggagccuuaauacugucuacccuggccagaugucugcugcuuuagaaguuuuggguccuguguguccucucuauuauucuaggcucaaagcaaaaacugaaaggccuuuguauuuuuuuuccccauccaggauguuuaguggcuuucccucugaggacaguccgaguggcucauuacacuacccaaaguagacuucuuaagucuugauuuuuuuuuuuuuagcuuaugguucauuuucauuguaucucauggaauugggugagaguacucuaguaguuugaauggcacauuaccuccuguaacugccuuccucugauucauaagcuagaaauuuaucaguggagauggcuagcccacaacuucaucaagaauuuauaauaaaaugcuccaucuuuguuccugcauuucuuuuagacugaacccccaccccaggcacauauguagcagagggcugucuuguccugcagagaccugauacaggguggggaauacccagagugagaccacucucagaggugaaggggaggguggauggguguagggacucugugaggggagaaccaggaaggagcauuguuugggaugcaaauagauaaauuaaucaauuaauuaaaaauuaagaugcaaguugcuaguuuguuaagaguuuagauuuguuuuguguauauguucaucaguagagaaaagucaugcucaccgugguuaccauucagugccugcuuuaauuucuuacuccgaauuccuugcucaggauuucacugaagugagaguggguuuaggaaacauucauucucugaaaaugcccugacauggcauuauaaacuuuucuuaauaacaaaaacucucagauaucccauuugacuauguauaauuuaaauauggcaugaccacuauauuacuauacaucauuuuauaagucauaccuauaaagcagacauugacaauuuuugugagggauggaaacauuccauguacauuucuuuuccuuuggauaacuuucauugacuacacugacucaauucaauaacuuuguaaauggccuguguuauguaccuuugccacugcuguguuaacaugucagaaagaacaacuucaaaggaggaaggagcauuaguucauaaguucugaugguucagucugugguuacuuggcuacauguguuuggcuaggccuggagugaggccagcugucaugaugguaggagcauguggcagaagaugcucacuuuauggcaggcaaaggaaggaaaaggcugcagaccauguguagcauucaaagcuaugccuccaguaaucuuuccagcaggccauaccuacucaaguuuucaccauuuucugaaauaauaucagcugagaacaaguugaacuuauuugugugcauuuguguguguauguuuguuuguguuuagugaaacauggugcugcuaugcaggucauguuguccuugaacugguggcccuccuacuucuguuuucugaauggugagaucauagaugcauaccaccaugcccggccacuggacuuuauuuuggccaacaaaucugaaucagguggugcugcacaaaauggccacuccauggugaaagacgaggaacaccuuccauuucccuccuugcuucucucuuauccuggccucauaucugcucacuaggauauuagggcauuuucucagaaagacucaguuuuggaaaagucaccguaagugugacugcuuccuuucucacugguucaugauuucugacagcagaccacauuccugcaaaugagcacuucagcagccccgccaagcucuuccuuauacagucuugucuugauguuggugcucacugaugaucuacggugcugaacgaaggacaagguacuuggcacuguaggcccuucuccagcaaggggcugagaaaaggccaacugguucaugggguuuuuguauugacaaguugccuugggagcaguuaaaaacaaugaaacaauaaaagugguaauguauguuuacauuugcaguuuuuaaacuuugaaagcuuugcucucuggauuugguaaggaaaaccaggacacacauagaagcauccaucucuauagucaggucuuuguugaaaucuugggagaaugaaauugguaaccugugggauggcuuuacuagaaacaaaaugagcuugaguguuguguccagggcaggggcuuacacaugugggaguuaggcgagugaccccauguuuaagggucacagaacuagccaagguacaucuggaguucuagcauuauggcuaaaaacaacucuaauggaguauauaggggaccuggccgcauugaugauaugauuuauaaggcauguccaccaguuuuaugcuagugugacaaaugucuuaggugaaaaacuaccagaaagaaagcuuauuuguacucauggucucagaaguccauggaugcugacuuggcccuuuuccuuugagccugaaaugguacaguacauuauuacaacagcgauuggcagagggauucucacuuuauaucauacaguugauacgaagggaggcaaggagagagguggacggugagacacacacacaggagagaaauagguaucuagauagauagauagauagauaaugagagaauagggaccaugauccuacuaauuaaugaaguuucaggcuaacaagcaagcuuuuaaucuacaacacauaauuauauaauuauuucagauaauaagaaauaaagauaucaguuaauaauuaaauuaugucauguugcuaacuguagacuucaucuagaguucagaguaauuaaaauguaaaagugcuuuuauagucuaugaauuguguguguguguguguaugaaagagagguuuuacgcaugcucucuuaauauguagaaaguccauuguacguuuugcuauuuucaggggcuuaugaguacuuaauguacuuuuucaauuccaaaauaaugacuuuuaucaagacgaaggcuacuuacuggguaugguggcacaggucuuuaaacuugucacuuaggaggcauagucagcucaauagaucucugaauuugcugccagccuggucuacauagugagcuucaggggagucaaggcuacagugagacugcaucuuuauaaaaaaauuaauuaauugcaaaaaugaaagaaauaaaagaugaaagucccacuaaauuauggaacccacuauaaguguuuuaaauuugagccucaguauuaucaguuugaaaacagaguauuggaaguaagcacuaggagcaauuucuaauagccuuuuguuuaagacacaauucuugagggcauaugacauugaacuaacuuugggaaggggacaguggcugguuuuguguaucaacuugacacagcuggaguucaaagagaaaggagcuucaguuggggaaaugccuccaugagauccagcuguaaggcauuuucucaauuagugaucaaggggaaaggcccccuugugggugggaccaucucugggcugguagucuuggguucuauaagagagcaggcugaguaagccaggggaagcaagccaguaaggaauaucccuccagggccucugcaucagcuccuauuccugaccuguuugaguuccuguccuaacuuccuuggugaugaacagcaauguggaaagugcaagcugaauaaacccuuuccuccccaaauugcuucuuggucaugauguuuugugcaggaauagaaacccugacuaaaacagacaguuuuauuguucuguuuggauaauguugacagagucaaggguuacugaaaccaaggguucaaagauauucucucucucuaucucuaucucucucucucucccucccucccucccuccuucucucuuacuuuuucuguuuugcucuucucuaauuguuucauuuucucagauuaguguucccucugaaacuuggccucagccauuaauaucaccaugguucacagcuuccuuauuuucuagcccaagagauaccugcugaaggaucugauuguuucaucugggcucaugucaucauuccuauggucaagggauuaaaaaaaaucccuuauaagagcuauguggaugauaugcgaguaaacacagaucccuaaaagaagagucuuguucccuuggaaaaacacaguagacacccaucauaccuagaaacagaagccccgggcacuguacacugugucuccaccucacuugacagauuuuuuuuuuaacagagucuaacagacagccagugacagucagcaggcaguaugugacugucaguuugagaacauggaguuaaaaacugaaugcuuucaaaagagagaaaauuuccagaaaagagaccgucuauuucucacuacaggacauuaaguaaaguguaaguguucuguuggggaggcagaaacuauuucagaauuuaaaaaauaucuuaaaugucuuuuagcugaggaggcuguaacgugucacuuacaggcauucauaauguucauuuuagggauuuggaggaaacaucuuuccacacagucucuucucuuucucuguaccauuucaucuacuacauuaaaauaucacuuuguagcuggcaauuaaggacugcugccuaccacucucugcacauaguacaacgauuuuauuuuacuuucuuaguaccuuucaucucuugaauaauccaguuauucucaguuuugccaugaucugccagaauuuuguaaauuauagcauugauuggcugccaagaacuauguacccaucacagcuuuauuuggacaguguuuuugaaccuuaaauacaguaucuguuucuguaaguacaaccuucaugaucucucucucucucucucucucucucucucucuguguguguguguguguguguguguguguguguguguguguguguguuugggcuguguccgcuaacaucuuaagaggaagaaccauuucaaaggggucuuguagagaggggcacuucacucguuccagcaggccaguaagagaaaagaacccccugucuuauuccaugaaguguuggaugcuuaccuguggagacagaaccuauauacuuuuaaaaugauuucugaaaauuccaaacaaauuaaacucagugcugauguacagcuguaaacagagaaccucaagggaaugcaaacucaagagaacugaauuugaaagacuugauaagagcagagauuauggaggcccacaccuguagcagagggaucaugaauuugaggccagccugagcuacaaaguaagugaaaacaugcuugagcauuuagggaauccaugcuuuaaauaauaauuauuauuauugaaaaauacaaacuagaggaacucgguuuuaaaaucuccuuuacaguaaagauagacuugacgaaaugccucagugcugagaacacuuguuguucuugcagaggacccagauuagauuccuaguacccacaugauggcucaugauuguccauaauuccagucccaaaagauaugaugcccucucuggcuucuauuggcaucaggugugcauaugguccauauaaaugcaugcagagagggaaaacacacacaaacacacacacacacacacacacacacacacacacacacacaaacacacgcacgcaugaacacacgcacgcaugcacgcacgcacgcacgcacauaauuggagaggauucuaaaggguggaugauggcuuucaugugggucauauuaaaggacaaagaaacaaagccaggcacuccuuggugugcgauggcaucgcauagugaugaacccaccuauacuugaaaaaaauaucauaaauuaaaucaaaucaauccauuuaauugaugcugagaucuuucucugaacugagaauauuuuuuaugaacaaaguagccaagagucauugcucucccaggaugacauccaaaucauugaacgagguugcacugaaguccuagaggcaacagaagugaaagaacauugugaauuugaaguuuucaauucaugucaguuguuuauugcauguuggguaagggggugagguucaaguugauucauuugacugcaguuaauccaaaugcaaacgaugaggguuggggggggguaugagagaauauaauuugaaauauacacuacacucuucuaccugcugcugcauugcauuguuucuauuaauucauuuauguauucacuuuacaucccgauugcaccucccucuucucccaguaaccccucacaaucgcucaccucuccuucucugagaaggggcaggucccuucuggguaccaaccugccuuggcacaucaagucacugcaggacuaggcauauccuuucccacugaggccacacaaggcuacccaguuagggaaacaggauucauaggaagauaacagagucacggacagcuccugcuccaguuguuaggggacccacaugaagaccaagcuguacaucuguuacauauccguagggggccuagguccagccuguguauugcauugcauuuuuucaggagggaauugaagcucaugaauggaaagcuuuuucagucuaagauguacauuuacucagguauaauaacuuaguaccuuuacucucaacacugcuuccuacuugagagacugaccaaggauagacaggaaagcauuguaucagcuguauguugcaugggacauaacaucuaguccugacucagucaggggaaacaaagacauccccagucagcccccagaaguucuuaaauuuuuagucuuccauucugaacaaagaaacaaacaauuaccucaacaaaucuauagguuucaaaauccaggaacucaccgccuugguuguucauuucacccagacacagagaaaggaguaauugcuauugugacucuuuuucaggccgaauccaucacuaauaguugaaaugaaaagaguuuugguugaaaaaaauugaguggcuuuagucauaaugcugaacgauaaucauaugggcugauggacaugguaauuaaaauucuguuauggugacuuuuucacaguacauccacuugaauagauacauuuguauugaucuuuaaccugguaaagcuggaaaagauaauguugcaacuaaaggccuaagacagaacugugcacacagauacauaaaccaacucaaaaugcaagaaucaguauuuuuucuaguuauguugauguacucugacauguucaauucuacuuuucuucucuucaaaaauacuacuuuugagugcauuacuacugugauugaugcuaucgugugaaaggagccagagaugguaacagacgauaaagggggcauaucagcuuguuccucuggaacauucuagugaaucuucuacccucaauggaaacauugccaguaaauacuuucuucaccuaugccuucugcuuagcagaagguucucuagaugccuuuuucuggaugcuuuuguucucuguauaacaaggcucuuccuccauacgcaucguucuguuucuuuaccuucgggguuuuaucuguugcuuaccauggauuuugaaaaacaaguuguacaaagaagagguuuuuuuguuuuuguuuuuuuuguuuguuugguugguugguugguuuuuuuuuuaccguuucugcugcugugaacacuugucaagggccugaagcaaacacucuguaaagcuuagguuucuuucaagcacugcuccuccaauaacuuggcugcccucuguccacccaucuuauagguuggcccuugauugauguacuacccuuugucuccuguuaccaucccaagcuccuuucacacgauagcaucaaccacaguaguaugcacucaaaaacaguauuuuuggagagaagaaaaauagaauggaaauauuggucuaguuccucuccugugggaaaacauugcuaauaaugugacagaguaauaaucguccaugugggacucagggcucugauuccccaaagugccccauguauuagaaucuccugcaguuuuacccaugcaggaaagaaagguuaguguucugcccucuguccacacaucuuauagauuggcccuuuauugaugucacuacauauguuuguaugcucacaggcauuacagacaaccagaagaauucaagaaaguaagcaacaauaucguucuauggcaagcauuuucuacuggcucccauuucagaaggauuuuuaaguuaugaaagcacauagcaaaccacuguuucaaaacauaaacuauuauaauaccuugagucagaaagacauuuuccccuaacacaaauuuuaucauugaauuuagagacuaaacuugacagcaauuuauuucacuagagaagauugaguuuauggcuuuuccugguggcucuuaaauugaguaaauacagaugauuuucugaaucauaaaucauauaaaaugauuuagacagggauuuuugaaaauacacagaaggguuugauagugcugagauucuuguguucuguguaauacuucagauuucaugaccaugauauaugaucaucauauuuuccuauuuuccccagaaacucauuuguaagcauacgguaauagaauccuuuaauauacauucacugaauuaaguagaaaaugcgaguaugaaucgucaaauuagagucugguaaacaaaccaaagauaaaaucaccucauugauuuuaauauaguauuuuaaguacauauugcacaauggaauaugguuggaguagcugagguuuagacagauaccaugucuauauuauuugguuucucggaaggagagauuuggaggaaaaugucaugaaauaugauguucuuuaggauucuuaagggacuuuuguaugauaaaagguacacuguguuucccucucagguuaauaaagaauucuacagccacauccuuggcuucgucuuuagauaacauuuccuugucagugcccuguagucuaucuuuguucugaagcuaaccaaauaccuuucccccuaaucagcagagaguugccugaaucuuugaauuguaacaaacucucuauagacuguuuuuacacacacacacauauauauauauauauauauauauauucauaccugugauaaguuuuuaauuuauaaauucugcaaagagauugacaauuuuagaauugaauaaucacaaguauaauguuaugaaaauaauuaccacuauauuauaaguuaagaaaauacagucucuuguaaacacacauuuaauaugguguuccuccuucuagugagaugugagccaauccaguaccuauaaggugagaugaaguaccuauaaggugagaugaagugagacuaauaauuauuagucuuaugauuauuaugauuauuaugauuagacuaaugauuauuagacuuaugcgauaguuuggcuuuugcacuuggagauagggcagguguuaagauuuuaucaauaggagauuugagucuauuauagaucacaacaacuucagcauacgagcuuuucccuuuucuaccuugggaauuuugacuuucuuuuaacucagagaaaaaccuuacaucuucucucuggcauauuggaguugccagcucccgugcuuuggaaccaucauuaagcaaaauaagguuacaugaacacagauacuaugauaccauaaccauugaucuuaaagcaaauagcucccaaaugaugaaugggugaacauuauaaacaacuugcauacucuggauaaaggugauuuaggucccaggucagaacauguuauuucauccugcuauuugggaugauaugaauuuaaagccugugaguuaaauauaccuggaauuuuccauuuaauuuuauugaacuucaguuaugcauggcugacgaacuacagaagguaaaauguucaucuccuucuguguucauaaugaucauguuuacagugcccaguauucacacgaggcuauugcuuacuagauccuguaguuacagguccuuuccuauugcuguagaaugugucacuggacaucaguagucuagaaaaaaaaucaaucugaucaaauguagauacauacuucuuuugcuuucuuuccuuucuuuuucuuuuuguuugggugguugguucuugacacauggucucacugcauugucuaggcuggccuugaacuuauggauacugucuuuucucagccucccagaugcuugaauuagagaagucacaaugcccagcauuuucuugcuuuaaauguguuuucucucuuaucccacacuaaaaagagcccaguauuaaggagguaccacauauuucuuuacagaauauuagcaugggaugugguaaggaaugcuauaaaagcaggacuccuaauuuuuuuugucacagugccuuauuaaaaucuacuugaugcuaucauauuuucuuccaggaaagugaguucauauaguaaaaaugaguucagguugauuauggaguaggugacagcacucaggugaggcauccauagugagugcuguccacuuucucagugacauuaguauaaaaccgaggaugugacuuuuaacgaaauauauugauauauuauaaauagaucaauaaauaacuaguaaauuauauuuagaauaaaggucacaagggggaaaauuccugacaaaauauuaagaauucagaacuaaguacaaagucacuaaaaaucaaaacaaaagcaacaaacaaagccaaccugauccuuguggcuggugguguaucacagaagcaauacaucugguucccauuauguaucauguugaaugaauaguucauuuaggcaacuggcuaggguuuuucauuggucucaaaucucucucuacuccccgccggaugcuaaggaaaguuauggcaugaggaaaggaacacuauaguucucuuccaaauucuagauccuuaaugaaaucucaauagaaauaaugcacaguacuuugaggccucggugauuuuaucaauguagggauuccaagugaaagggagagagcccaggaaaacccuucuuugagcaguggugaaguugugaguggcuacuuuaaaaacaucuuuugaauuagaguuuccugcaaggggagcagaauuacaaauggaauuggcuuuagguuuagcuaagggacugagucauccaugccuuagaauucccaauuucugagccaauguagcauuagccuuuguguggaagaagcauucuuuucaaagagggguaauccaaaccauaugcaggcugaggggauuaugucacauuuacccucaaguaagagauuucuaaagggaucaccuuuuauagagagaccuuauaagaaaagcccccuuuuucuuugcccccugccugcuuuuuccaccgcuucuuauucuguggaaaacuuuuagcuaauauguaugauucuucuuugcuucacaaagcccagcauccugagcacauugagucuugucguuuacuuuauugucucccuugggaugucuauuuuuguaaacaaguuaucagguguuuuauagggguugaucuauauauucagguugaauauaaauagaaaauguucuuagaguagcaacuaauacccauuuauuuucuuugagccaguuuuugaaauuaauaacugauaggaugccuccauucacguuuauaucagcuuggauguauucaacuucaagcaacaagcacuacucugcacaguagcuuaaacugaaaggacauuuauuguugauaaaggaagcacagagguaaguggaaucuaaagguuauuuaguugcuaaaugagaucaucagagaccccaggguuauuuuuaaauucauucauucuaccauccucagcugaaauaaccaauccuaagaauuugaaccucaugcuaacgaaauggaucggaaucacuauacauauacaauacccuccaaagcaugaaaggagaaaaagagaagagucuuguccuucugaaugugugucuguucucuuugggaacaauguuacaguaugauccuccauaaacagaaguauguuaaucugcuuaauacuaguuuccauggcuauugcuaaagcaauuauuggaaagggcaaucugcuugaacauggagccacgauuuccuccccauagcaagagaagcuuagagcuaacccauccucugaccuguuguuaagcaaugacuagcuggaucuucagugccagccucuaacuccagcaacuuaauaagcagcagaagcaagaagacuguaaggucaaagucugugcugucuaaagaacaaguucaaggcuaacauaggcaauuuaguaagguagagucauucccugguacacaagguucuggguucaguuuccaauauuaaaaugaaugaagaaugaaucaacuagugagcaagagcuuuuagauuugguccucagaacuucacaaaacagugaaauaaccccauuaaaauauggggcucagagcuaaacaaagaauucuuaccugaggaauaccaaauggcugagaagcaccugaaaaaaaaauguucagcauccuuaaucauuagggaaaugcaaaucaaagcaacucugagauuccaccucacaccagucagaaugucuaagaucaaaaauucaggugacagcagaugcuggcgaggauggggagaaagaggaacacuccuccauuguuggugggauugcaagcuuguauaaccacucuggaaauuagucuggugguuccucagaaaauuggacauaguacuaccggaggauccuguaauaccucuccugggcauauauccagaagauguuccaacugguaagaaggacacaugcuauguucauagcagccuuauuuauaauagccagaaccuggaaagaacucagauuucccucaacagaggaauggauacagaaaaugugguacauuuacacaauggaguacuacucagcuauuaaaaagaaugaauuuaugaaauuccuagacaaauggauggaccuggagggcaucauccugagugagguaacccaaucacaaaagaacucacaugauauguacucauuaauaagugaauauuagcccagaaacuuagaauacccaagauacaagauacaauuugcaaaacacaugaaacucaagaagaaugaagaccaaaguguggacacuuugccccuucuuagaauugggaacaaaacaccgauggaaggaguuacagagacaaaguuuggagcugagacgaaaggauggaccaucuagagacugccauacccggggauccaucccauaaucagccuccaaacgcugacaccauugcauacaccagcaagauucugcugaaaggacccugauauugcugucucuugugaggcuaugcuggggccuagcaaacacagaaguggaugcucacagucagcuauuggauggaucacagggcucccaauggaggagcuagagaaagcacccaaggagcuaaaggggucugccacccuauagguggaacaacaauaugaacuaaccaguauccguggagcucgugucucuagcugcauauguaucagaagauggccuagucggccaucauuggaaagagcggccccuuggucuugcaaacuuuauaugccucaguaagagggaaugccagggccaagaagcaggaguggguggguaggggaguggggggggggaggucugggggacuuuugggauaucauuugaaauguaaaugaagaaaauaccuaauuaaaaaaauaaauuaaaaaaaagaaaggaaacagaacuguccauaugaaacagugagaaaaaaagguuauuuguuuccuacaaacagagcaaccuaacuacaaccuuuuuauuauuguguuaugcuuuuaacuuacauauucuucaggaaaauucacuggcuaccagauuauccuuauaauuuguuaucauucaguguggauuaagaaagguaggaugaaauaaauaaguacuccuuaaaaaagaaaaagaaaaagaaaacaucuugcuguuaagugaaaggauaaacuaguuaggaaauagaagaaaaguucaacuguaaugccuuuaagagccccauucagccaagccacauaaaaguccucucucacaaugucaaaagauuuguagguaguggcaguuacggagaaaaagcugcucaaauuucucucugugacaagauacuugaggaaaaaaaaaucacuuuaaagaaugaaagaauucucuuggcucccaguuucaguucuuggccagcugucuugauuguuugggguacccgcaacaaggcagagcaucauuggaguguaugggccagagaaggcugcacacuucaugauauccaugagaggauaucaugggaugccuggcuagaguccaacagcccuauagucuucuucaagggcucaccaccaacgcccuagggacccucccacucaaugcuauuucuuaacaguuucacaacuguuuacaguaucgcaacccugaggaccaacuuuuuuuuuuauuuaaacauuuuuuauuagguauuuucuucauuuacaauuaaaaugcuaucccgaaagucccuuauacccuaccccugcccugcuccccaacccacccacucccacuuccuagcucugguguuccccuauauuggggcauauaaucuuugcaauaccaagggccucuccuccuaaugauggcugauuaggccaucuucugcuacaugugcagcuagagacacgagcucaggguguucuggguaguucauauugcuguuccuccuauaggguuacagaccccuuuagcuccuuggguacuuucucuagcuccuccauugggggcucuguguuccauccaauggacugugagcacccacuucuguguuugccaggcacuggcauagccucacaagagacagcuauaucagggugaggaccaacuuuuugacacacaaaccuuaggggaccuuucagaacuuaacuauagcagcaaaaaaaugcacacacucaucucugaguugguucacauauaucuuugcuaggguuuaguguagggagagauaacaugaaguuguaagggaaaaugguaccgaaaauauaggauggauugaaacagaacagaugugguggaucuuauuauaauugcauauuuaaaauucuuaaauaaaaaaccuaccaauagucacaaagaguaaugacccuucccauucaucuuuuaaaucucuaaaaugaagaguuguccacagucuaugcauagggggaucuaggaacuacgcuuuguaaacuuccuacuuccuaagcaccaaggaacagugaaugggagcucuuaaacaauguuugguguggcucgucuauucauagauauuuacagugugaucauuuguuacacaaaguauuugugguugaaaacaggccacuaugaaauaccucuuugugguucuuggcucucuaagccuugaacaacugguuauauuauuaugauaugcacgacaaaagugccuuagguaaaggauuugcaaauccaguccagcuaagagauuagacccaggcaccaagaaauguagccacuguaccagacaauuaguauuaaguacugugggcagggcuguuagagagcugcuggggaguugagguuucuuuucucgggauccacagaauacuaagagcugggaacauuuggcuuggcuuuugacauguuuuaauguagaaaagaucaacccugcaggccauauuugaucacaagauguauacuuugugguuguucaggccaauugucagugacaugccagacacccauacugucucagaauuugugcaaaugauugacuucuucaguauugguacugaaacuuggguauguggaauuaaaggaagugcuccuaauaggaaauacagcucauucuaaggaaucaggaucugugcuucgggggcuacguucucauuguguuucagagccacaugcacuguuaacguucuagugcuuggaagauugaggcugaaauuaauggauuuuuucauaagcacaggggacaguuaaagugagcuacaugaauaugacuggauuggaggaaaguguggagaaaaggacauaauauguggcuccaagaaacacguaugucuaaauggcagagcaauggauaagcugugcccagagauuguucaaaacagagaaaaacaaacaacaacaacagaacgaaaaacaaaacagaacaaaaaacuaaggaagccaguguggauaaaaauuuuauggaaugagugggugccaguucaugcugaauguucuggaccauuuaacugggguguugagcagauugcguguauguguguguguggucacugcucaugauguucuuuuuaagauaugcaugauuaaagacucacguggaauuucauccuuuccuuggaauagacuugcagcaguggaauacugcuguaucaagggaucugauaccaggccuuugauuuauguuccuagcuugcaucccuugguuucagguccacauguuuacucuuugaauggaacaaugaaaagucuuucacuucguauagccaagggcucagguacagaaaucugcuaccaagcagaauacaagaaugacuuccucugguugggaaaauuucuccaaauggucacguugcagcugcccuccucaucucgauuuuuguuucugugcucuucaucucuccugaagaagaccaguaaaaugggggcauuaaguaugagcucacccugauggagguucaaauacacuccuuggagagccuuuccuuuuucgauuucaguggaagguaccugggaaggaaaucuguggcuuaaauaguacugaccaacuauaaggguuggugaucaggaugaaauaccuacauuuaggauugcuauguugaagccugagacuacuucaagaguuaaagauccacuccccaugggauucauaucuaagauccucaaaaugacuugacuuuaccuuccaaaugaguccauuucaaaucauacugucucuccuccaccuccagccuauuggguuugagcguaguaagacuucuugagaaaguucacuuuagcuucagcuaggugagguccucaguuucaauacaguuuucccaaggcaguuguauauuucuuuugucauugagguaagacauuugauuucccuucuuggucuccauccagauucauuucagcagauggacuuauuuuagcuacuacaaacacaagguucuacuggguuuucuuugucuacuggaggaacuguggguugggucugagucacacacauuuuauggugucugcucuggcaugagcuucauauacauuggcaucgacucagagugaauuugacuuucuuucucuuucccgauuccagaauuucauauggcccuguggugauuccaaaaacagucugaggcucauuuugauuggcuccagccacuacagccgagccagguucacucugagagcucccugucccaucaugaauggccacagaagcuucugcucuuggcucugcaaucuaauagcaccucuugcauggaugaugccaaagcaaugcuuugaaauaugcgcccauacuguguggcuuuucuugcugcaguuucuguucucuuuuuauuguaggaucuggagacucaccacuagaagacgauggagucugguauucacacucucuauauaaaggugaauucuuugcuucugugcugacaaggacccgcugaugccaggagauauuucuuuaaagcuucgcagagcagacuguaauaaagugaccagacaacacauuggcuuucuaauugccugucuaggaaaauaaauauuuaaaaauaaaugugugugggcacucauccuuccaauaggaaaaccaagggaaggaaaaaaagaaaaagaaaucucaggagugcugccuuucagugccccguggucauuuuauucuucuaaaugucuuuacuguccucacuucugccgaggcaagcuguagcugaugauagugaaaaucaagccuuacucauacauuacagccggaagugugcagagcaaaccgcccaaggugggugcugcgcccagugcugcuaauguacugacugcacggagaagaggaaaccuugauuuucaugagcuuuucucaugcucuuucugagcccagccuggcuccuaagaugagaaggaaaaugugcuguugcugaaaugaauuuuaacuuagcuauaggaaauccaccccuccacugugcccaggcuccacucccagcagguaucuaaagccuaaggaagaggcuuucccuacuggcucagguaagucuauucacaacuccugcugcugcuucccuggagccagggagcucagagcagaaaggaagguaaauguaaaaugcucuuugucuacaacagcugccucucacugcagcgggaaacccucaaggaaacagucugguaaaguuucaauuugacauuuggcccaagaaaugcauucauacucuggcaggaaaauacuaaccuacacucuugugacacuucugagcuacucgagaauugaaaaaguucuggucagccuuugccuaaagacuguccuucaggucuuuucccaagaagugggggaguggggggaggaguuuuucuaaacaaugacugguuccugugucuagguguguuuccauauuugcuuugauuucugaauguaauagugccuaccuucauuguuguggcauuaagcaauccaaccaaucacaaauuucuagucagauguuugggguaaggagaugcucugauucauaaaacuuccugaaaguuuuuuuuuuaaguucuuugugaguccccaguuuaaaaagaguccuaacacacaugcacaguaaagagacuccuagacaguagugguggccucauguguccuuaguucauugugcuugguguccccuucucaucucauagccuugcaagauagaaaguaaauaauauauccaaaaauaugccuagcccaggaccugaccugaaugucuaagaauacauuuuuuucaugauaaauuauuucucuugucaguuagauggcuugccuguaggaaucaucacacuacacauuuuauauguauauacacacauaucaaaacacacuauaugccuuaaauuuuuacaauagagaguuaaaguuuuuuuuucuucuuguuauugugguuaugauaaagagcaaaccuagggccuauuauugcaagacaauuguucuguucaagaacuacacuucagcuuuuaagugucauucauuuuaaaauuuagagcucaaccaugauuaacugcaacuuuagcuauggaauauuaagcuccucccagaguguggcacagaguauauauucaauaacugauuugaauugagucaaauuuaaaagaagaaagaaagauuaaauagcauacauuagguucccaguaugugacaucuuauuuacuuauuugauuguauuuauuuacuuuuuugagggauuggggcagaauaaauguugaugguuuuacuugggauacuauaguauauucacacugcuugagggaaggggaaggcgcauagagaugugucagaauugcccgguauuuacagaaggccccaaggguuagagagaguaggagugaguccuguggcccucccucaugcugcacuugagucuggacagguguuuuggcucacauccaugaagcacuaguaguuccucauuagccugcugcuccaugcugccagcuccaccaacuccauuuaauuagagugcuuaucacauuggcccugggggaugcaaaggcuuuccugauuaaucaguuuggaugucuacuuugacuuacccauggugcuugucugcacuuuauaugcaaagcaugcacacugacauucccaucaucuuuacuaaagaacugauaaacuguucaaauuccuucuaaagaguucuuuuggaagauaacaaaaacuaaaaugccuuuugcaaauaaauaaaugcaagauguuuuucccuccccauggcgacaacagcacagcuuuuagauauguagucgccacugacagaagaauuugaagaguccaaauaagggagaaaaaucugcuaauugcaugcugcauucaaauaugugaauuuguuauauaugaaaacacacauagaucuuuuucauauagaucacaaauauacauaguacauguagacagccugcauaaaauguuccagaaaggaaguguugcaggaaggccuguaggccugcugugcgcucugcacaucugaaucuacauggugcaagugaauacauagucucuagggugaguccuuaucaucucuacccaggacauguagggaauguuacuugagucuucaauuuccaaucuacugacaacuuucugaaaagcauuauaugauauagguacuagccaaagagaaccaugaagcaacaguguaaaaaaaguguucaaaugccaaaaccugggcagcauccuuuagcaggguugcugagcguggggagaacauccuuaggagaacguuccuggggaauguggagggaggccuguguuccuuuguggccacaugauggcgaacuuacuccacauacugguuauacugguagcacaggugcuguugagggauaacgagcugggcagcuauaggaauguagcucugguucaauguguuaacucuacacccacccccgacuucagggaacuugucccugacccccagauagcguagagauacauggacuggcugcuucaggaacuccuccacuaagaagacaguuuugcacuucuuuugaagguuucuuugcaugguacauuucaaagauaggggagaaguucagcuuuauuaaugacauccuagguaugcuuugggcaguuguccuaguuugcuucucuguugcuaugcuaaaauacugagcaaagcaacuaggggaggaaagggcucuuuuggaaagcuuacagguuauaguccaccaaagcaggaacucaagcagagaugcugcaggaaugcuaacacacuuguucucuguagcucucagcuugcuuucuuaugcauaacauccaggaucaccugcucacaguuggcaccaccuucacccauuauuugggcauucaagaaaaugcccuauagacaugcccauaagccaaucugauggagacaauuccucaauuaguuucaccuuucuggguggcuccagguugugucaaguucacaaaaacuagacaacacagccacagcaacuagaacaccaaaaucaaguuuuccaucugaggggaugucaccccaaaugguguauaacuauugacaucugaaaagggggauuguuuccuuacuuggagcaauuguuccaugaguguaagccaaaaugacacucuauugugaacacugguauagcuuaguugaaauuagcaaacaugaguacugugguuugcuuuacagagaaauaugcauauagcugggaggaaaucacaguuaauugacucuguuauguauagauggcuagggugaaaauuuacuauggcaucaauuaguuucaauagaucaggauaucauauuaagggaaauacuagaaaaacaaaagcuuauugaacauucauuuuguucucagcaucgugcuaggugauaaauauacauacagucuuuaucucuuauaacauuagccaguuauugguguaucaacucagagaguugaugucgcuugcccacaucaaacaacuauuuaaaguaauuuagauucauauuuaauuaugucuagugcucagucucacagccauaacuuucuuaucuagagguuccuaauacacaggccagcauuggagguucagaaccuggaauguagccaaucugguagcacagagugaagggcugcauuaucuaaaccugucacuuguuauuucucccuuuguuucugccuguagacacuccguggugcucucccaucaaggugaaguauggggauguguacugcagggcaccuccugggggauacuacaaaacagccuugggaaccagaugugacauucgcugccgaaagggcuaugagcuucauggcucuucccagcucaucugccagucaaacaagcgcuggucagauaaggucaucugcaaacgugaguagacuagaccugugcugagucuucagggacaaaacugucuugcucugagaugaagcuuugauuuaaagcuagucgauuuuuauaauauaacagagugaaugugugcuccuuuuccaaagaaggguaugcuauacuguuugggggaaagaauagauagauuuuuuuuuuuuagcacaccagugauauuuguucaguaaauacaaaguuccaaagaguugcuggugauuuaguaguaaauaaacuuccagagcguguaacuagguagaggugaaagacaugacauggguacaggaagggcucuaaacuaggagcuccuggguaggagauuaauggaaaagaaaaucaugaaaaacaaauauccugaaggguaggauuuagggguacaagggggagucacugaagaagugauucuaagucuguguaauggaguaggccugggaugaaguugauguugcauuucaggggcaaugucucaaagcucaucugugaaguuccuugcuugcuggcugccuccagaggcaggcagacuaaugacauguucugcuucaugacaaguucuccuguauuuaggcuguagauggguagagcauuggugaaacccauuuuggaugccuuuauuacccaaagucgcuaugccuuauugaugacccaauguuuucuaagucuucaacauacguucaacauguuuugcacaguacauuauugauaggauugggccaagugcugcucaggacuauagucaugugguccagaauauguagauguuauaacugaguuuauguaguacccacuuaacaauguuucaccacauuucccugugaucuaugugagggccuuguuggauuucuucuuuucauuuuccccaagaacugggaugugagcccagggccuggcaaaugcugaaaaaaaucuauuguauuccuagcuuuaagaagaaaaacaaaacaaaaguuuuauguuaagacagggucucaccaagucaaaaggcuuacagcaacucaauuuguagcccaugcugguuuugaacaugccaucuuccugccucagucuccuaaguagcugggauugcaggcuggugucaccagauauggucacacuugcccucuucaacuuucuucagagaaaagagaaaaccucuuucagaaaauguuccugcugcugccucucuaccuacuucuuguuuacuuguuuguuuguuuguuuauuguagucuaggaaauucugugucagucuuagaauuauaagugugagccaucugcucaacuuuuuuuuuuuuucccauagaagagaaaagcucuccaaggaaugacugguaaaaggugguucccgguguggagugugaaugagaacugccaucuucccugcagggugcucuugacagagcaagcugaagcugacucugcucuccaugaccccuugcuggcgcucugaucaccauucuccccuuucucccuuuagucauuggucucccccuggcaacacuuucuuccuucucuucucucaggguucgcuucuggggaauucagucuaggacaguguuguggcuggaaugccaaagcaaccuauugugauaggaagcaucguguguucuguguggcauauaggcagaugccacauguuauuauugauuaaugccacaugcuguauuuuuaaugccacaaauuuuauuguagcaaacuguucacugcauauuuuccaagugucuggcuuuugaauuguuggacaaaaaaaaacuauacugcaugucugauucuauccuuuacagagaagcgauguccuacccuuaccaugccggcaaauggaggguuuaagugugucgauggugccuacuuuaacucucggugugaguacuauuguucaccaggauauacauugaaaggggagcgaacagucacauguauggacaacaaggccuggaguggccgaccagccuccuguguagguaagaaaauaucacaggcuucagggggcccaucuuuggagagaagcaaugggucuuuguuauuauaacacacauuaaaggaaauaacagugucccacguuugcaaccuaaauagacagcauucagucaguagccccacagguccgaaauccaacagcccucgaccucagucucuaacuagcagacuuugaugugaccagcuuccagcugacuguugucaguuucuagaccugcugcugcuacuccugggaacuuacuagaacugugaauucucauauccuccucugcuucccgaauuuaaaauccuggauguggggccaacacuuugcauuuccauaggcccucuaggaauuuuaagaucuucaaguagagggccaccaaccucagauauugcuuuucaaauuuucucaaauucucuggggaccuugagaaaacuacagacuugaagucagcaggucuugggauugauccuguaagagacaacagacauuuggggccagaaaauuuguuguggaccuuuccccuuugcaauguuuaacaguguucuuggauuuuacccacugagcguuuagugacacuauccucucauccuggcuccaguauacuuguagcuaucagaaaugucuuuagacauuuuucaguggcccuggggaggaaaauuagcccaucuguugaugaucacuugccuagggauaaugagugcaucuucaccauagcuacauguacuugcuaccuggguaccuuucaguagccuaccuuagagaugcugauucaaggagccugaaaaagaggcauuuggaggaggccaacagacuucuaaaagcaucucagaugauuuuccugcuggagauccaggaucgcugucuggaagcagcauuagcaaaauugcaaauuuccugccugaucugagacuggcaagcuuagaaacuccagaguugagcccaaucuacuucuagaaaagccaguggagguaauucucgaguaagcugaaaauggaaagccugcuucaggaguaaaaauguaggaaggaguuuaguaucuuuauacucaaacccauuguccucagagcagaagcaucagcaugaagaggaagacauuuagaagguagaaccaugagauccugcagcccuaaaacuggaucaugccuuuggguucugcugucucugucgacauuggggcaccuagccaucgggcaguguauucuguacugacugacacuggagucugaaucucuguaguacugaucuuguucugcagcuccugugcaagugcuugagcaccacuguugcagaagaucauuuacucuuaaacugugagagauggcaggcccuucucuuaaggcacaucaaaacccaaccccacauuguuuuaagauagaauuuuaucuauuccuugaaauuuucauacaaugcauuuucaacauauucaccccuagcucguuucccuagcucguccccaucccucuuuucuguggaggaaagcugagaccucacuuggcuugugugagguugcguagaaccaugcaugguccccaggaucucugugcugaacuugcuaaaucaagggauugauuugguccuaggaugccaaaagcagcuggcuauaggaauuuggguccuguccugccugugucugcccauucugcagaaaacugcuuaguucaguguccuaauaaguuuuaacauagggauuccuuaaauacucaguguucugggaggcagggauaguuacuuagagaucaagaguuaaaucugaugaugucucuggggcucaauaugagacagcgucucuggcuggggcuugggagguuuuccauaauggcagugcuguccauuauuuuuuauugauaauauguuguuauuacucugauguuaugacaagaaaucaguugaagauauaaccaauacccugccuuaacaguuauagccuauaucauagcuuaauccauuugaaaauaaugaacccaauuuauuuauuuauuuauuuauuuauauuuuuuauuaucaggacaaaaaucauuuuaaguuuuucaaggguaaggaaguguaccagagggacuugguuacaaaagcauaggaauagugagagagaugcuucagcaauugagaguguaugugugugcacuguucuugcaguacacuugaauuuaguucccagcacccaaguugguaggcuuggcugccuguaacucugcuccagggugaucugauguccuuuuuuguccucuuauggaaaccacauacacauggcacauacauacuuaacacacacacaaauaaaaaauaauuuaaaaacucaaaguaaaaguacaggaaaaaaugaaagaguaaaaucacaacuguauucuguaucaguuuuucauuacugugauaaaauacuugacuuugacaacucccaggaagaucuauuuuggcuuaugguuucuuucaguucaccaugccugggaggguagagcagaucaccucaugguguccaggaaggcaucuaggaaagucucagagagaucagagugagggagagaaagaggaagauaagauuuucuuagauuucuucuuuuucaaguuuuauuccauuuaggcuccagaguaugggaugaggccaucuauauuuuuaggguaucucuuucccauaguuaaucaccaucagaaauacccacauaggcauaagcaguggaaugucucaucaacucccuagucaauuaucaaauuaauggauuuggcugccaagauugaccauugcaauguuauuauugacaacuauuuacaggcagaauccacuauugaguacaggauagaagagcaacagugauaugguagagucggccacagcuuuucacacucuaaugauuuaacauuaugauggaugagaaggaagagcucaggaaauauucauuuaugguccuuauagaaauacaguggcuucuacugccuuucugcccuguuucucaugucagugagaccaguguagcacccagcugacgaagaaauauauacaauaugguauuaagauauaguccugacccuauggcaaacugagugccagcaaaauggcagaaucaucuuucucugauuaugcagggucuccugaauccuauuguacuuguccugagaacccuugcucagugaggaaagauagagugugcugagggggugagaucuagacaugcccauuacuaaguggauguguugagagaagggcaccucacagaugcugccucugguaucucccugugcuuugcuguaugcaaauuagcucuugaaaacaaaccagaagaaaccaaucaaaucucaguucccuuguauuagaaggaacagagauuauggugcuggagaagagaagcccaaaacucuuucugcuaagcaagcuuuggcagggcacuugagggacauacuguucagauuuccagauugugcacaacaauggaaagaaaaugcugauuguucucaaaaagcagcaagcaugucuaaagccagaccagauggcccuggaacuuacccagagggagagggaagaaaguuagaaaugaaccacaauuucaugcaauuuaucuucccauuugcugagacaagguucaaauauaugggaggaacggaaauugggcacacaacaaggugagaauggaaagggggcucagguacccaugaguuuagagcuccaugcuaaaugacaagaacagacaaaguaaguugacaaugugauuuuggugacagacaagcuggaguuuguccccagugaauuuuacuccaaagcuaucauuuacuccuuuggcuuuauuaauaaguuugcuugugugcuggcaagaacaaggcuuccuugagcauaaguuagaggcucgccuauuuucggagcugacacauggugcuugaguuguucccagguuuccacacaaccuuaaacagcacauuuuggccagaacugugcugagugcugagaaagcuaacugaguucccuuccaaauggggaaggaauaaggagaaugggcuuucuuugacucugagauguucaguucugaggucuggcuaauuuguaagugccacaagucaagcuaauucucuuacucagacuaaagucaaauucagcuauuuaagaaguggggagaaucagaugggaggaaggaaggcauaguguaagcugcaauggggugaagaacuuaagaagaccuuccccacacugacuggagcuagcauuguguguaagacauuuuaauuucuaucaaauuucauuaauuugguucuacagaacaauggacaguaggaaugaacacagaucuuaaguuaaagacuacauuuuaaguagacacaccuuuccgcuaggaaccaaaauauuuuccuacuccaaaacaggaagaaaaaauuuaaagacaguuuuaaaagcauguaugaagaaaaauuagcaaaugccuuuuggcaugaagagaguaccuauuuucuuuaacaaaggacaaaguaugaaccaaauugguuguugaaaucccucucuuuuuaaaaaauauuuccuccagaguaaauagucagggauucaccaacacaaguuaaauccaugaauaaaaaaaauauuugaaagagcagauauggaaauuuauggcagacauuuugcugucugaugucuugguuuaaccagugacugauggggauuuuuguugggcuacgauucauuuuuuuuucauugcuacaaauacuagcacagcuaagaauaaaugcaccagugcauuguuacagaugaucuuauauaaauuuucuccgggcuugcaaauacacacuccauuaggaaucuaauuucaguuuuaaaaccauuugguuuauggaaauucuggucacauuucugccucucaugauuuaccacuauaacugaacaguuaaacuuucaguggccgacucuaauauaaauggcguugugguugggaaucuuuaguuguggugcuugcucauugcuuucccuucuuguuucuuuuguuguuucuggaaaguuccuugaaggcauguagugccaaagaaauggagccauuucccagagcgguccacagggauuguccucuggcuggagaaaggaaaacaauugggcaaguuuucaaagagaaguuuuguucugucuguggcagucaggcacuccauguagccccaagagaccgauggcucuggucucugucauugcucucaaguucuuuuuuaaaauauacuucuauuugaaaugcaauugcauuauuuuccucccuccaacccucaaacucuuauguuuaucuuauucaucuguugcugugcaacaaaccagaacuaagugguuucaaacagcuuacuuacugaucaaagagacacagugagcuagaaaguugguuagcagcauucugugggggugcccgcccucugcuagacauaauaauagcucagaugauaaugauuaagugacuaggggaugcagaacaugcuuccagaacauauaaagaaagcacuuugacuugggaaagcuaaguugacuagucugauuaaaucugaaucuuucccucuugucucccaacaacccucuguuuucuuaccucucaccaugaacuaacaccaugugaauggcuuuacauggcaacugccuccaaaccuaugaaaucuaaaagugccauauucuguaacaaucaccuaggucugaggcugacagaggaucuuugaguuuauuguuaguuguugaccgagacauuguucccgugaagcucugccuuguugcaagcacaugucugguuaaacauguuaaagauuccuggguaaauaguucugcugccaaaguugauacaguacaauauauuugauuaucauacuuucuaacucagaaaggaaaggggaauacagagaagggacaucauuugucaaaaaucuccaaugaaugggacauagaacagaaagcaugaguuucacgagggcuucaggauuuccacacaauaacuggcuuugcaggcaucuggauguuaaggggaauaguaauuacguuucuaugguaacucgcuccauuucaugcauggaaaucuauccuaacuuaaaagaagcuaugguagccauggguaucuggggaauaaaaagcuuaguucucuggagcaucaauugauccaugggcugguccuaucaauugagaaagaaggcaguugcuuaaggaggcuuuagaauccagucuuucugaugcucuuuaagggcuuauagggaagaugugguaaacaauuucaaaagaauaugaacauaaagguugggugcaaacaccaagucaucgucauuaucgucaucaucaucaccaucaccaucuucaucaccaucauuuacaacaacaaccacacacacacacacacacacacacacacacacacacacacucacucugaaggagcauuugaguucuuacguuaagauguggaauaguguauuuaaacaucagaccuuaaggaaauuccaaaagagaagacauuccuuccaguguauaaaugggaauguuaauaauaguauuuaguaguuuacucaggacuuaacuuuaggugugaaaauucaauguauggaugcaagaggaacacuuuggauauauggauugggcacauagggugcggcuuuuauucauuuuguguuugaagaagcucucuuucugaacaacuaggccccuuuugacuggucauugguggacagacacaagcugucuuugagaaccucugagauucuucccccagauaaccuacuuugaaguguguuugcacugucauuucacuugguugacacaggaaaacaguguguccaccacauuuccuuugccugcugcagagagcaagaaucuccucuuauacaugcuaacacaauguaauuacacauugaaagcaguaaccuguccucagccccucugucucuguuuucccuuuuacauaagcauauuuucuagaaagcaacugucagcuaucucugaccaauaggaagcagauauucaacacuuguuuuucugguucacccaagacuuuggaacacuaaccugaaugaugaaagcaugucuuguauuacuuagcauaguaaaaaaaggggggauuauuguaaagaaccuagcaacugcaaauggacacuucagauagauuucagcauauacauaauuauuuuauuaauuuuuaaggcauagcuuucacauuuuaaugucacuggaguuaggauguuucuuauacuugaucaugacuuaaauucaaugaaauaugauaguuauucaauucagaucaauguaauaaggcugcaaauucacagucuauugaagcauggcauugggugaaagcaaauuuagauaacugaagguaaagcuguuugagaaaguauucaauauucacacuuuuuuuuacacuacauaaaaugagaacuccuuagauaagguacuggagaaaguaugugaagacauuuacuugaugucuuuggucuccagaagacaugauucaguaucagagggaacauuuaacuuucacucagguuguaauagcauguagauaauuagugggugaucugugaggcaaugcaaagcugacugcugaacgcugucuuuaaguauauucccuaccuucuugacaucaaagaccaaccgguaaacuuuauaauuuccuccugugauuucacuucagcuaugauuacaggcaacaacccaguguagaauuaacaucucauucauucccagaccucauuaucaacccaucuuguuaaggagcggguggaguaacucaaacacuucacugaaacccccgugagccucagugugaacauacguaaacugagagaggugggcuccauuacauauccauggcauucaaguuugccuuauccagaacaaugcuguacucugucuccuguuaugugugguuugugaugaaauaagcaccccaauacacuauaaacugaaagguuuuuagcaucagauucacuuccaccuccaaugccagcauuuggaaugacacccuuggauaaaguuggcauucacgaaagauuuguugcauccaauugaaucuaagcaggcgauaaugccuuugcuugguauucuaagugucuuuaaaucagucccuaaagcugaauggcuucuggcuuuagcugaguaacugugcuguugccaguucagugugcagaguuaggaaguguacacacagcacauguagcaagggcagaggauggcaggucugucguuuugcagguaaguccuaaauggucguuaaaacucagcaggcuggaaaggacaggaugaaaggauagaagagguuuccagagugaacgguuucuucggaagggcaaguaucuagaggucuuggcauuuuagacugggaguguaggccaccaguauaacauauuucuugauuggguuauguuuucaagaucuggaaccuccuagaaucaagugcccaagugugaaagaacguauagcugagcccaauaagcugacaguccggguguccugggaaagcccagagggaagagauacagcggaugggauucuuacugaguaaguuaaacaugaaacuuggcagcuggaaugcucccucucccuuucucucucuuucucucucccucucccucucgccuucccccucuguacccccucccuuuuucccucucccuccuugaagccuuauacauucuagguaagcacugguccugagcuauaucaccaaccuauguugucuuuuuggaaagucagaacauuuccugaauaugaaaugcuuacuaccaagagugggguguaucuaugccaauccauuuauguuuuggacccggaacucucuggucaccaucuaauauauuguagaguguauuuauaugauuuuuauugucugucuucauuauaauacauucaguaccucauuccuaaagauaagaacuguaccuggcacauagcacucagguaauauuuauugauggaagucagggagaaaaguaagaagggguagagggaaggaagaaagaaaggaagcaagugagaaagaagguagcugguuaauuccagaaucugcuuucuccuguugcuuacugaaaaggcuucuucucauguccaaggccuuccuaagcccccaaacacauuggugaggcuucuguguaugcuaagccaaaugcugugccgcucauuacucugugguuugaugcaguacuuuuuuuguuguuuuuuugcuuuucgagacaggguuucucuguguaguccuggcuguccuggaacucacuauguagaccaggcuggccucgaacucagagauccuccugccucccgagugcugggauuaaaggcgugcgccaccacacccggccaggugaugcaguacuuuuacauuccuugucuauuuuuuauuccugcuucaaaauuucauuuuuguuuuuaacaaaaugcccuuugagggcaucaaauacuugucauccuuuagcuucuucccugccccacgccuguuuuucugucccacugcagucauaguugaauguccagcugaguaauggguagucaccguuagugagacucagucacauguuguucuaauauaucauuuggaccuguacccuaacaguauuuuccaggagacccugacuucaugucagcaugcccauguuucaauuaaaguucauggcucacguagaucuacugacacaggucacauaccuggacaauaagcuucugaagcuucugacuuaugccauuuugggccaugaggcagcgacagaguuucuggaaucuugucaauccugugaggcucaagacaacagaguuuuauacacaauuauuaguaauugcauaucacuuacuaguaagaggaguuaaaucucuuauucacauuuuauuuccacauucuaauaaucccuccacuguaucaucuacuaaaaauaacaggauuaggaucuuucucaacuacaacuucucaaagauaaaguaugaucaguaaacauauuuacucuuccuacauauguagaucauaaacccccuaugagaaacuucauggaauugaguuuaaaagguaagccguaugaauaaaacaacucacuauacacacaugaacauuacuaugcaacauaauacacacacacacacacacacacacacacacaauguagaaaaucaagucagaguuggcauaauugugguuuuaccacuauccuuaauuugugacagucuuguauaaagccugacucagccccuugaauauagucaguucuuagauuucugcaacaguuaagucuuauauaauaaauucaaaacauaagaugucagguggccauaugacuccucauuuauauaaaaaucuuugucuuuuugaagaggaccuguuauuaggguucaaaugaugacacuuaacaaaaggaccacgguggcccccaacacucuguucagcagcuuagauguagucugugguagcauguguucaggaagucugacuugucccauguucaacucaugcuuggacuucuugcuuuccuagcacauguccugggacucuccuccccagcaucuuucccuaacuacuguucuauagucuguuuccaaagcgaaggguguauuggcaaacucugacauggguguuuauuuuucaguuccccuuggcaacuccuguuacuuucauaaugaaauagagucucagagaaauuggcagccacucauacaugagugauuacucuuucuggguuuaucugaauuuacauuugcuaucuaaggaucuuaaggcaguuaaagucaaaagugugcaacuucugaguucauaagccuuguaaucaugucacaccuaugugaacaguuuuccuuaauggugacaaugauaauuccacaugcccauuauuaucacauaucauaauuccuaggaacaggcaugagaaguuuuuauaucuuaaaaauuagccaaaagcugacauuugauuguguuuuaucugcugggaguuuugucagauugcaaggauagaugcuauagucaccccuuauugugaaaucuuggccaagucccuuagccuucuguugucuugguuuucuuacucgugaaauggaggcuuuuaucuaccccaaagagcuccaugaggauuaaauuaaauaauaaauaauaaaccgugcuugauaugcgugagauuuagauaaagcaaacaagagauuuugcucuuacuauuacagcguuaggcuagucaaggauucagagacuuuuuuuuuuuuuuuuuuuuuuuuuuuuuuaaccauuugcucagaaggucaucacugacggcgaugaaauaaagcaaagaacacucuaguacccauuccagggcaaaauugccaaauggccaacuaaaccguacuccaaaagaauuuuucucaaaaagcauugaguuaucugcccaacauacaugcaaaacauacaggcucagcuugaaauaaaggcccuuugccccgguucugucauacagcaacaaaugaauacacaaacaaacugaaucuccccuuagcuggggacuucuauuuuucuggcaucaaauuguucuugugaaacagagggaagcucaggggaccccauuccucucagagccucugugcugguuaaagggcccagaagcugcccuuuaacggaacuuuccucuguucgguauagacucaucacucaauaucugcuuuuuagggacacaagcauaauccuggauauuucugcuuucuuccuuaaguguuauucugaaaggccuuccuccgggcucaaauuuuccagaaggagaccacaagauugaguacacagucuaugacagagccgagaacaagggaacuugcaaguuucgaguuaaaguaagaggugagacugcugcuuccggaugcuuguccaguuacuggaacgucaaagagagaggggacagauucucaauccagagcugucugaaugccccuggucguaggacuacugccugcuauggauuagguuuucaugaagcuaagcaaaacaucccaucuuaaugucuggguuucaauaugaguagguuauguagggaaugggacuaguuucacaggggcucauagcuaccuauuuaagaggaauaauuuuuccuucauugagcuaauagcucaauuacuggcaaugaccagagugguaagaaguccccuccuuuaggccccuaaaaggucaugcucuuuguuuuacaaaucuuuggucucccugagaaaaauauuuuuaaaaaccuucguguuuuaugguuuaggcagcuugucaguauuauucgcucgucagagcccggucuccucaucuauaucaugagggggcuaaugccgcuauuucaaaggucucacugguaaggguggugaccauuaugggccauuugagaaauagccaucacugccugggacucauuucacuaggugauguauaacaucagaacaaacugagaucucaccuucucugguugcaugcucagggcuaagguuacucuggguuugugucuccuacagucagacguuguggcaagcucaaugccccagaaaaugguuacaugaaguguuccagcgauggugacaauuauggagccaccugugaauucuccuguauuggcggcuaugagcuucaggguaguccugcccgaguaugccaauccaaucuggcuugguccggcacagagcccagcugugcagguacgugugcaguucuuucucuagcuagaagcagaaucugaaacccccugacuccagggcaggucaauagcagcuuuagauccucuacgucauaaaauacagcaucaucucugcucaccugagugggugaacaaaggugcuaagucccugcugcagcucaacucaccugcauccuugucuugcuguugccuguuuccugaucacccuuccauaucuuuaaggaaacaauugggaggccaggacucagggcuagccuauagugguguuauacgucaacagacuguuuacuuacguauauccuucuauuuuacagguggaggaucuaguuuucaaugcuaguaaacuucuguauuuagacacucuaauuccugucuugcacuauugacuugaaugucauacacaccuugggcauuuggaauccuuccuccuuuguaaaaugagggaaccauaccucuuuuaacuggucaucuacugaaugguggaauagagcauugccuuguacaggauaagccuugaacauaugcccgaaguucuuacagaugaguagcaaucaggcuagguguagcuaagaguguaaaaucuagacuaccuaggacacucuagaccauuuuauuuuauuuauaugcuuccuuuuuuucucaaucccagguaucucuuccuuucccccacuuuaacucuaccauucaaagcaggugguugaaucuauucaauuucauauauuaaagcagaaaggucacauaacaucucagacuccucagcuaaguacuuaaugucuauuuuuguggcacugaggccuggaauaucuuauaaauuuuaugucuauauguccauaugguagcuacuagccauauauggguaugaagcacuugaaaugaauccaaauucaggaauauugucaguguaaaauauacaccaauuucaaagucuuagcacaauaaagaaugacuauaaagcacuccuaauuuuuguauugauuucauguugaaauauuuggauauauuggguugacauauuuguuuguacaguuauaaugaagcuacaagcaaagaacaaauuauauugacauuuaaauucuauuuauauugaccaaggcuguccuaggcugugaaccccaaagccaaguuuggagaaaagaacuggguuuuauugaaagcaguggcccagaaguuggcaccuagcacucacucaguauaguugaacacaugaaaacguaaaugaacagugauuuuuaaagcaagccucaaguuugaaacauuaacaacaacuucauaaaaccuauaagcuuguuuucaauuauuucuucuccugagccaaucauguggggcucuuugucauuuaucauuaguuuauaugucauaacuauaauuauaugacguuaacucauguucuccauggccauauugaaagaacaaugacuuuauguuagguuaagccucuaaguuuaauacaauuuguuagagcagcaagagaaaacuagugugcauccuuugcccauuacaguugcuucacaaauucacuuuuuuucuuaauuuuuuuauuauuuaaaugcauuuuauacaucaaacguauuaauaauauugaguauuuugagagucaaauaauauauaaaaauuuguucaacuuuuuauauucacauacuuucauacccuaaaaauaucacuaaugaacauuuaauacuaucaauaacugaggauccuauuucuaauguugaauaccaaauuguuucaaaacauacaaaauauucuuugggaauuaagcauaguaaaagagcauaaaauauuaauagugaaucauaaggaaauauauucaaaagcccuuauaugauaccaccuggcauagugaggagagcauuuaaagcacauuuuauaucuguguacauuguguaacuauaaguuuacuuucaaaaguuuaucaguguuucuaggagagaaauuauuuuaucaguaaguauauuuuaaaaauuucaaaauggcaaaaacucauugagguaaaacauuaagaaaaugcuaauuucauuggugggacucauguauccagcugcuuaguccauuggauggcugugagaaucccauuucuguauuugucaggcacuggcagaaccucucaggaaaacagcuauaucaggcuccugucagcaagcacuuauuggcaucugccauagugucuggguuugguaacuguaugggauggagccccagguggggcagucucuggauggucauuccuucagucucugcuucauacuuuguuucuguaacuccuuccaugggcguuuuguuaccugcuucuaagacggguagaaauauccacacuuuguucuuccuucuucuugaguuucaugugguuugugaaauguaucuuggguauucugagcuucuggacuucugggcuaauauccacuuaucagugaguguauaucauguguguucuuuugugauuggguuaccucacucagggugauggguccucaaugaaggagauagagaaagaccuaaggagcugaagggguuugaagccccauaagaggaacaacaauaugaacuagccagcacccgccccccuccccagcucccagggacuaaaccaccaaccagagagcacacauggugggacucauguauccaguugcauaugcaauagaggauggccuaguuggucauuaaugggggaagaggccuuuuguccuaugaaggcucuaugccccagugugggggaaugccagggccaggaagcaggaguggguagguuggggaguagggggaggagggguuguuuuucagaagggaaaccagaaaaggggauaacauuugaaauguaaauaaagaaaauauccaaaaaaaaaaaugaaaaaagaaaaugcuaauuucaagcacagcaaggaaaauuaucaguaauuuuucaugauguuuguagaacaugauuuuaauguuuucuuuuuuauuagauaucuucuucauuuacauuucaaaugcuaucccaaaaguccccuauauuccccuccugcuccccuacccacucacucccacuucuuggcccuggcauuccccuguacuggggcauauaguuugcuagaccaaggguuggccaacuaugccaucuucugcuacauaugcagcuagagacacgaacucugggggguacugguuaguucauauucuuguuccaccuauagaguugcagaccccuuuagcuccuuggguacuuucucuagcuccuacauugggggcccuguguuccauccaauagaugacugugagcauccacuucuguauuugccaagcacuggcauagguguggcuaucuucuuuuggguuuguugaaagauuagucucuugcuuuuuucuaggguguacuuucccuccuuguguugguguuuuccaucuauuaucuuuuguagggcuggauucauggaaagauauuguauaaauuuuguuuugucauggaaugucuuguuuucuccaucuaugguaauugagagucuugcuggguauaguggccuggacuggcauuuguguucucuuagggucuuuaugacaucugcccaggaucuucuagcuuucauagucucuguugagaagucugguguaauucugauaggucugccuuuauauguuacuugaccuuuuucccuuacugcuuuuaauauucuuucuucauuuacugaauuugguguuuugauuauuaagugacagaaggaauuucuuuucugguccagucuauuuggaguucuguagacuucuuguauguucaugggcaucucuuucuuuagguuaaggaaguuuucuucuguaaguuuauugaagauauuuacugacccuuuaaguugggaaucuucuauaccuauuauccuuagguuugguuguuucauuguguccuugauuuccuggauguuuuggguuaggagguuuuugcauuuucuuugacuguugugucaauguuuucuauggugucuucugcaccugagauucucucuucuaucuccuguauucuguuggugaugcuugcaucuaugaguccugaucucuuucuuagauuucuaacuccaggguugucucccuuugugauuucuuuauuguuucuauuuccauguuuagacauuggaugguuuuguucauuuccuucaucuguuugauuguguuuuccuguaauucuuaaagggauuuuuguguuucuuuuuuaagggcuucuaccuguuuaccugugcucuccuguauuucuuuaagggaguuauugauguccuccuuaaaguccucucucacuaucaugagaagugauuuuagauaagaaucuugcuuuuccggugugacgguguauccaggacuugcuaugguggagaauuggguucugaugaugccaacuaaccuugguuucuguugcuuauguucugaugucugccuccugccaucugaugaucucuaaugauaccugcccucucuauaucugacuggagccuguccuuccugugauccucauugacucagaacuccucagaguucagcaguuucagagauccugugauacugggauccugugauucugagauccuggguguuucagagcuccccggagucaagcugucucugggucccugaguuccuggugagaucaagcuucugagauccugggauccugggauccuggucaugucagagugccuggaaguggagcuucuucuggguguuuugggacaggcuguggaguuagcgcccaaggucugcucagggcaccucugaucuuaugauccugggcauguuagagcuccugggaguggagcuuccucuggguguugugggacuggcuucaggguuuauaaccaaggucugcucagagcacuggcccagaccagaaguaacucgugccacuggucgguuggaguuccugagugcaugggucccacagaucccaguuacucccagguguuggggcagauguccuccucaccucugauccuaugauccugggagucacaacuucccuuuucuaaucaacuaauuaccuuugaagucucauuuuaggguauacuugguuuuguaugggacuggcuagaucaagccagaacauagagagagcuuuggaacucaugugacaauuucugauuacagcgaugaaugucaauguuggugucagaacagcagcugcacuucuggaucaguuuuaugagaaaaggcgacuccucauuguaucuacacccacagcucgaaaccuccucuacagauugcagcugggaaugcuacaggugagacauggaggcagagccaaggugggagggagaacucugacaggaagaagacaggcccugaaaacaaaugccuaauccauuuagggugaguuugaggaaccaguacuuuagaugcagucauucauuucuggugcuggugcauaaucuuauuaacauugacuccccagagcuaacccaaucauucuccaaccagugaaguuucucugccuuugcucauaaguuuaauugacauguuguccagguccagccaaaaaacaauugucuuugcugauccuguccagcacauucauagacuggaggugauccaucaggaaucuucccaaggagauaaaaggcauccaaggcaccauaucccucccugggaauauccccaacucaaauggagaugauuuuuguugcuacugaaggagauaacaugccagggaaagguagaaacugugagcaucacacuaaguuuccugauuuagucuugaaguugcuuagcaaugauuggucaauguuacugaauacuaaagaggcaggauugcuacacuuacuucucuuguaggagaucuccuuuauuccuguuagaacauucuugguuuaaucaaagacagcaguuuacuacacacauuagcaaaaaaauaaaaugaauaaugagucuuucuuucacucuucuuugucaucugaacugguugcccauggacugggaagaaucauaugggaagaacuaaguuuacuaaauccguuuacuaaacccccaucacacuaccugcccuuguauaccuauguuuuaauuaggacugaagugaugaaagaucaugaccaaucccauuugguaaggaaaguguuuauuuggcuuuccuccaucaaucacuaauuuaaaaaauaccccacagcuggaggcauuuuuuuucaauugagguucccuccucucacacgacuuuaguuuauaugaaggugacauaaaacuauccagcacaaacucuuugcuccucauaaaaugcaaguaaauauauuuaccugguuuuauggguuuuggcauagcagcauggcauggccacauauuucuugagcucuucuuaucucuacaaaaagaauaagccaagaaacuugccuuucuucuacacagauaaaccuugguucaugcaccaaaauugaccuauugcugcuguguuuugcaaaauuaaauuuuaauagccacaguaaccuuuauucaucuguacauuugguuauggcugguuuaagauuguagugauagaguugaauuauuagguuaaaagccuuugagucacugugaacacuacuauuuauuaucuuuuucuuuugggaaaguuuuugcagcccucagcccuagaucaucccugcucccucaggccccugcugaauuguugauuaucucguuggcuaugguauuuuggaucuagauuuuuuucuuuaaauguauuuauuuauucacuuucuaccccaauaucagugcuccuucucuucccaguccccucucagaucugucucccaauccuccuccuguuuuccucugagaaggaggagccacacuuucaggguaucaucuccccccccccccccacacacacgcacacauacacacaucaagucacugcaggacucguugcauucucuuccacugccaggcuauuuuguauaauuccucuaggaauauaguuagguuuucuaggcacucacuuagccuuaguuucucaauuguuuucggagaaauuuggaguaggcaaagaagcacccacaagaaacccauuuccggggugccuuugcaguuccuuaguuccacucacaccuccccuguugguuguuccuucagcaagcacaguguggccucgaucuccgacaugucaccgugguggagcugguaggggucuucccaacucucaucggcaggaucagagcaaagauuaugccuccagcucuagcucuacagcucagguaggcaacaugcacucuguccuuaaauuucauuuccugaaaauacgcuugcaucucaccaugugugcucuuguaucuggucagguuuucagacuuuuuuucuuuuucuuuuuuuuuauuccuuuaaaaaacauaugugucagaauuaccaauuuugaaacaguuuaugugucucuaaguaauuuuagauagaacucauucacaaaucucaagguuuaaacuugaaagaaaaacccuugaaauuuauucuacagacuucuauagaaacucuauaagaaagaauuaugguaguaauguuugcuagguccucuguccuaagaauaguuucuccuaugcuggcaggaauggguuccauuuuuugcagccuuaaacauaaucagugaguggucugacacuccaauaauuuuugugccacuauugcccuagugggcauaucuuacaaugacagccauuacuguaacuugucauauucacagcuaaguaagacauuauuauuauuauuauuauuauuauuauuauuauuauuaguaguaguaguauuuucuaauaguguaucguacuuucuaacauugugaaaacuagccaguaaagaugaagcuuccagagugguacccaucugaacucucuaaauuuugugacucaaauauauuguaucuucagcauucuguuauuaguuuuuuuuuuauuagguaucuucuucauuuacauuuccaaugcuaucccaaaagccccccauacccucccccacuccccuacccacccacucccacuucuuggcccuggcguuccccuguacugaggcauauaaaguuugcaagaucaaaggaccucucuuuccaaugauggccgacuaggccaucuucggauucauaugcagcuagagacaggagcuccggggggaggggaguacugguuaguucauauuguuguuccaccuauaggguugcagaccccuuuagcuuucuauucaguauuuaguucaggcaaccuucagugcuuaauugcuuuuauucugggaguauuauaaucaugcuaauuggccuguuccugcaugucugacugaauuaugcagugggaaauugcuaguguuuucuucuucccccuccaaguuuauucuccucucucucauacccucccacuucuucugccucugucucucccucuaccucugguaugugguauauguaggugugugguggggguauaugugaauguguaugucugugugugugugguuugguaugcauguguguaugauguaugucuguauguguguguguguguguguguggugugguauguguuuguuuguaugugugugucuaugugucuaugcuuaucuauguguaugguguauguguaugcaugaauguguaucuguguacauauauaugugugucuguauguguguaugugugugguauguguguguguauguuuguauauguguguauaugugugcauaugugugugcaugugguauguguauuuguaugugugugugugugugugguauguguguguguguauguuuguauauguaugcauaugugugugcauguguauuugaauguguauguauguguguguauauaugcaugucuguguguauggguguaguaugugguaugugugugugguauguguacauaugcguacguaugugugugugugugugaugugugguauauguguguauguguauauaugugguauauguguguguauaugugugugucucuguguguguauguggugugguguguauauguguguauaugugugcacaugugugugcaugugguauguguauuuguaugugugugugugugguauguguguguguguauguuuguauauguaugcauaugugugugcaugcguauuugcauguguauguauguguguguauauaugcaugucuguguguauggguguaguaugugguaugugugugugguauguguacauaugcguacauaugugggugugugugugaugugugguauauguguguauguguauauaugugguauauauguguguauaugugugugucucuguguguguauguggugugguguguguauguguucauauguguauauaugugugugugaugugugguauguauguguauguguguauaugugguauauguguguaugugguaugugucuuuauguauguguggugcgugguauguguguguguauauaugugaauguaucugugugugugguguauaucuguaugugugugcauggggugguauguguauauaguguauaugucuguaugugugugugucuguauguguguauaugucaugugguauauguguauaugugcauauguguguguuuguguauuauguauguaucuguguaugugugugguguguaugugauguaugugugucuuuauguauguguguggugugguauguguaugcaugugugugugugucugugucuuaauaggagaggaggguaugaaaauaaaaugacuuagcaucaguugcugcuauccuuaggacagacacuaagcagcccuugaugucuuuuuucuccauccauccagagcacuuguuuauacccuugccuuaauauuuaucucucuuuucugucauacuucuaaagcuagagcacuaauagccagaccuugaguaauguuguauugaagugagauucaauagcuaaaagacaauuucagaauaacuuuuuuuucuuguaucuuuugaccacugugacauggguaauuaggccaaacuaacacuccuuaaaaucuucccuuccugcauaacuuuguucuuuuguacccugcaagucucugauuucaaggucccagaugcauccuuauccuuuagacucccaaaugguuuuaucgucuuguacauuaauaucugagacauccaugccauuucaguuuucugaaaaugaggaagaaagagaauaaaaacagacaauaguaguagucugguucuuguuauuuuaucagaauaccugagacaaguaacucauauaaauguuucuuuucaucaugauucuaaagucuauaauuggaaauagggaaacuccauucaaauugcuucaaguuucuaguaaaggucaccgaucauggagggagcauauagucucauaaauuguuuauauccagagccaggagacagagagacaaggagaccaggguuucauaaucuguuucaaggagauguuuccaaaaggccuaaaagccucaugguagacaucauuucucaaagagucuaccaugucccaguagugccaccuaagaaguaugcuucaacacauggucccuuggaggacauuuaaacucaaauuauaguuuaaucuuuuguguuuauccuuggaaauguuacacaucacuuaaacccccacuccacuggcuagaacuaaucgcauaauuaaaacugaauuucaagggaguuuuugaaaugcagugauuuaucuuuaugaaaacaauaagauagcauauggugaauaacaucaaauguguucaaaaaaguucacaaauauuuccuaagaguguaucacagagagauaccccgguuagauuuaugccaccuagugagagcuagcaucauuuggcaagaugaaaccuggauauaagaacuaaagcagagacuguaguggagcaaugaguauuggcuuucaccccuguccuacuuagcuuguacuuacagaggugauaccacccccaauggcuugggccuucccauaucaaucauaagucuaaaaaaugccccuacagacuugucuacaugucaaucugauggaugcauuuucucuauugagguuacuuuuuucaagaugacucuagcuuggaucucucucugucugucucucugucugucucucuguuugucucucucucacacacacacagaaagaaagagagggagagggagagggagagggagagggagagggagagggagagggagagggagagggagagggagagggagagagagagggagagggagagggagucauaccacuuaucaauuacuuagacaaaccuuguugcaggagacugaggagaugguucaguagauaaagugcuugccucauaaaugugaaaauaagagcagaugcucagaaccuaaguaaaggcuaagaaggcaugauggaccugucuguaacuagccuuggaagacagaggcagggaucucuggagcaagcugacuaucuagauuagccuuaucagugagcucugaguugaauugagagauccuaauuucaugaauaagauggagaaucauugaggcagacuccuuaugucaaucuuggacugacacaucaacacauauguuuguguaccugcauguguguauauguacacacaugcaaacacagacauauguacaccacauacuuguuucagaguuugugaaauuacuuaggauaauagauagaugguagacacagauacacagacauaugauauauacagauacaacauuaauaaaaucuugaugaaauuuugaacuguuuaaaaaugaaaaauagagaauucuacauuagggaaaagaucuauuauuuuauagccuguacauugggacuaauauagagcucuguaggcugauaaugauuuguuacaaauaagcugcuuaaaugaauuuuguggugguuuucaaauuuuagccuacaucauaauuuucuacagggugaaaauuuuguucuuuugcuugcucccuguauuuuuggauuugguaggucuaagguagguccuaagaguuuguauuacuggcaaguuaucugagaaccacauuucaagaacuacuugcuuaguguuuuaucaaggugucaguuucaaauaaaaguuuuccaagcaacuucuaaccaucaccuauugaauuccacgucuggcugcaguuaucuucauaagacauuccacaggcacaaaguacuuggcagauggaugucauacuauuuuucuguuugaauuacaacaaaaaggaauggccaugauuuacucaauaaauagaaaacaggaagaaagacaaagugaauaaguaugccuggauagucugaaaauucucuagucuggcuagaguaccaauuucaaauacuuguuaggccauagagauaguauugaagagaaucaacagaaaugaaaggcugggugccugcuguugccacaucaccacccaacuucuuccgugcccccauuucuuuuccgcuuaaauguguaagcuaagucaugcccuacuuagaguaauuuucuaucguaaggauaacggggaccaaaaagaauaucaguuuuauaaugauuuuauucucagacuucccaggaaggugacucaggaagaauugccaucugaugauaaucaucaugcuguucagaaauacugccaaccucaucacucaugccaaaagcccaaucugugaggugcccuaucacuuguuucugagacgucuagucucagcuccagcagggccuauuccuguugcuguugcuggugugaccauuucucaguucccauggcgguugucuuauuuuuauauucuguguuagccaauguacaacagucacaaggaacguguaguauagccuccaggcuguugucauucuggccucauaaguguuauagaacacauuguuucaucuagcuauccuaccuacaaacuccagccauagcaucccuugcccccuucuccuuccugccuccccuuaguuucucacuccucuauuuuuuucugggcagcccuugagguugaacuuaucuccaacacuuagacauuggcugccugguggaggcaguguaaucaucuuuuagucacuagacagggaauagcaagucaucuuuccacuggggaaaguauuaauuauuccucccuuucauaaaauggcuuuuuaauauauauauauauauauauauauauauauauauauauauucaguuuuuauuuuaugcaauguuauuuuuauuaguuuuucaaguuaguaugaaaaugaguguguuuccuuauggcauguucauacauguauguuauuauauucuuuuuuuuuucuggugcacuuuggguuuuuuuuuguuuuuuuuuuaauauauuuuuauuagguauuuuccucauuuacauuuccaaugcuauccccaaagucccccauacccuccccccuacuccccuacccacccacuccaacuuuuuggcccuggcauuccccuguacuggggcauauaaaguuugcaagaccaaugggccucucuuuccagugauggcccacuaggccaucuuuugauacauauguagcuagagucaagagcucugggguacugguuaguucauaauguuguuccaccuauaggguugcagaucccuuuagcuccuuggauacuuucucuagcuccuccauugggggcccugugauccauccaauagcugacugugagcauccacaucuguguuugcuaggccccagcauagucucaaaagagacagcucuaucuggguccuuucagcaaaaucuugcuaguguaugcaauggugucagcguuugaaagcugauuaugggauggauccccggauauggcagucucuagaugguccauccuuucaucucagcuccaaacuuugucucugaaacuccuuccauggguguuuuguucccaauucuaagaaggggcaaaguguccacccuuuggucuucguucuucuugaguuucaugcguuuagcaaauuguaucuuauaucuuggguauccuaaguuucuaggcuaauauccacuuaucagugaguacauauugugugaguuccuuugugauuggguuaccucacucaggaugaugcccuccagguccauccauuugccuaggaauuucauaaagucauucuuuuuaauagcugaguaguacuccauuguguaaauguaccacauuuucuguauccauuccucuguugaggggcaucuggguucuuuccagcuucuggcuauuauaaauaaggcugcuaugaacauaggggagcauguguucuucuuaccgguuggaacaucuucuggauauaugcccaggagagguauugcgggauccucugguaguacuauguccaauuuucugaggaaccgccagacugauuuccagagugguuguacaagcuugcaaucccaccagcaauggaggaguguuccucuuucuccacauccuccccagcaucugcugucaccugaauuuuugaucuuagccauucugacuggugugagauguaaucucaggguuguuuugauuugcauuuuccugaugauuaaggaugcugaacauuuuuucaggugcuuauucaucccuaccucucacuggccugcccaucucaucaccuuuguuuguuuguuuguuucuaccugccuuuucccuuuuguuuuucgagaaaggaucuccucuauguauauagcuguccuagaacucacucuguagaccagucuucccucauuaugcacagauaucuaccuuuuuuuugccucccaaguggugggauuaaaggcuugcacuaccacugcucggcucauuuuuaugcaaacaaacaaacaaacaagcaaacaaccuccgaaccauucaugauaggaaaacauacacuuuaaauucauacagcagugcauguucugccuguuauauaaccuagagacauuccaacagaaacaaaauccaggagaggagauuggauggccucauuauuuccccgugcucagcugucuaguuacuuugcucuuggcuuucucauuuaaauaugcugguauugauagaaaacaucugcauagauuaaauccauauguugaaguauagaaagaaacaccauauaguugaaaccauaccugacuauuuuuaaaaauuauuugugguacaaauuauaggcaaauaaguaaaagugccuagacguagacugaaccuacacaguucuaaaugcucuccugaaauaguuacugaauaggucaucacuauaaacuuuugaauguuacuuuaaucaaauuuauguugucgaggcuuccuccaacuuggcucuuuugacaucuggggcuggauuuguuugguuacaagguuguccuguacauuguaggauaaauauaucagcauaucuaguauuguucaauuagaugccaguaguaucuaacugccuucuuaugacaaccaaagguguguucagacuuguccaaauaucccgugaguggugaacagucuuguuguuaaucaucacuguuauaguccccuuguagcuacuuuugguuuauaguaccauagccagccugagaucuuccagaccauaauaaugcaaagcagauuugcucagccuuucuucugaauaccaauugacuggagauauuacaauauuccauauucugauuuguuacagaaugaggucagacaugagccaguguuuuucugagcaaauccuccaagcccacacuuugaguagcuugagugagggcauaaaaaggauucaauccuucauggcaucaagcauuucuguugcauaggauuuuccaagggcuauggcuggucccuuaaagucuugggauuuggggucaaacacagacaagucuucuuuuuguuucuuccaggcuguugcuucgaauuccucucuacuccuucagcauggugguaguggauaagcauggcauggauaaagaacguuaugucuccuuagugacacccauggcucucuucaaccucauugacacuuucccccugagaaaagaagagaugauccugcaggcugagaugggccagacuugcaacgucugaugugcuguuacauucaugguggcuccucaucucuuauucuauacuacagugccugugggaaggccuuaaaauaccuuugauguacagauuuucauuuguaauuuuaaaagucuauuuuauuaugugcuuucuuugcucuuagacauuggcacaaggcuuuuuuuaaacuuugaaauguuaaaaaaauacgaauauaucuauucuaacucuccuuuuaguccauuguggcugaugaaauuagaagcuacagccacacucaugcacucagaauauuccucagugugaaacauguuuuccuuuuucuuuuauuguuuauauaagucuuuuguuaauaaaauaauuugaagcaaacuuacuaaaacucaccuuuaaaaaauacucaagcaccaggcuuauuugcuuggcaugaucaguaguuuuaaaacugugauucuuuguuuaucuuaagaaagggaaacuaguccugucaaggggucaacugagcugagagagagagcuacguucccaagugggagaauagcaaauugaaaauauucagacaaagcuacaugauguucauacugaaacugaguagacuuuuuccccaauguaauauaaaaaaaacuauuuacaaaucacuucccucauaugagguacuauaaguaguccagagagguuuaaaguauacaaggggauucacauggauuccauguaaguacuggacgauuugauaucacaagucgaaugacuguugggauccuggaaccaaucauuccugaguuugugaaugaacaagcaugaugggccaguagggcuguauucuugacugcaccccacccagagaggugacaauucagagguuguacaucagaccccuuuucagauauuucuauuuuuaaaugauugagccuagaaaaaaaaucacacauuggcauuuaauaaacaauuagauuguacuccua

SEQ ID NO: 12587 - RNA, 12963 nt, Mus musculus
ugcaguucaacuuuuuauuuuaauaaaaccagaauaugcacagcacaugcagugcuagcaucuaaacuaauacaauaagcaacuacuaaagcuacagugacuugagggucaaucuuuacauucagcaaguuuaaacccauucuuaauuuugaaacauaacugaaaauauugcuugcugauaaaacuugcucaaaugcuauugcugaauguacaagucacugaauaugccaauacaacaaagauaaccacauguuugaggauugcaaugugccagacauucacugaaaaaaaaauacaacuaaacaaaacucacacaacaaacaucugagaaucuggacacuuuguaucaguguuuugaaguguuucguuaauaucucaagacaaguguaucaaaaccuuggcaugauuuaguuucaagucgccaauuuuguuuuuacuaacaucagaaaguuauggcuacaccgccaaugccgggucugcuuaauuugacuuaagaguuuauuaugacuuaacauuaaaagcucacacuaccccgaaauauauaauuucacgcauacggugacauucaacauucaagugccaguguuuuuguacugucuuuuggucaaguuucuuuaaacuuucaaagaaucacuuuuaggcuuacaaaaauaaauauuugucaaaauguucaauaaauauuacauaaaacuagcagcaaaaaguaucuagaaaucugucgugugcaaaguuuucuucccaacuaucauucccauggucccaaauaaauuuuagaaucuagucccaucccuuuccuagacaagcugcguucaacaaucuccaagagacaaaauaagauuggaaguuuaaggacacgcacacaagacauauauauaaaauucucugaaugugcaauaaaagaaguacuuuguaaaaaguuaugggcaaaauguacaagggccuaaaccuagacuaauugaaauagcaccauaacaaaugaccucaauacugucaagugcaccuacuuaauaaaaguuuuagaacaaggcacaauacacuugaaaaucuauugcacuuuaggaaauuuuugccaucuuccuaugccacuguaaaaagauugaacauuuugaucacugcauucuggucacaaaauuaacccagaauucccaguggcauaggcauuuuagugguggacaaugcucaucuuuggccagauuuagcauaaacagacuauaaauacaauggaaaccuaugcaacuaaaacugacuaaacugcacuguagagcagaauugacaccuugugcaguuauguacauauuuccaaccugugugaucucagauuucaguuuguuacucuucuggagccauuuguuuuguuuuuuuuuuuuuuacaaagucuauaguaagccaguuuaacaucucaacgcagcuugaacagaguaaugugaaucggcauuuaaaauaaagccugcugcauaauucuuccuguucauucccaucuugaccaaaaaacaucaacacuagcaugcguuauuagaccaaaaaucauccagagcccuaggugagggcuggucauugcuguggucagccauucuaccauuucaauuuuuuauggcaggcauuuaaaaagucuaaguagaugaauucuccuaaaccuauuucaaguuaucagaccuuuaaacuuucccuguaauaacaugcccacauuuggcuagcucauaguuaacgaucugccuaaacauugaaagaggaauugcuguauuuacuugcauuaacuuugagaacagugcuuugaauguaugcauguauccauacaucaccucaucaugacuggaauggcuuguuuaaagacuauuaucagguucuaaauaccuauccaggauagagugagcaaaucagaacuuuuaacuuaauacaguuugccacauuagaaacuaauuccauuaauaugcuucaagacguuuguuguuuguuuuuccccaaucugcaaguaucaaaagccuuaagacaggcuaccacuugaguuuuuccuuauauuauuuauggaugaaucgaugauuccuguuaaguuguaucacaccugugugccaagguuugauuuuagcccaaguucaguaaauuuauuuugucaaaaacaauuggaaucuugagcauuacugagccaacaggacaucaaaauaaaaaguugucuaaaguuaaaggcacaguacauuaacaaacaaaugauccucagucacaaaauuauaaaugcaguuugggauagggguaggcgggaggggcguuaauccaaacuacagcaaugaagucuucaaaccaccuucagacagggcugcugauuguuccuuucaucuuuacuugugaccuugagcucccuuaaaaaaaaaauuucaguggagaaucacagcugguaauguacugcgaguucuugaagcuacacaagguauagucuggcuaaguuacaugugguuuccauauuagcuuguuuggcagggugaccuacuacagagcaggcucaguuaccccaccagucaacccccugggaguuauaauucccuccauauccaucacuguuguaaaagccuccguagccaccuagggaaagauuaaaaaaacaaauuauuaagucaucaagauugcugcuuuuucuuucaaaaguuauguauugaacuuccacaaauggucuuauguuuaaaacaaacuaccuccaccaaauccucgacugccgccauggccaccuccaccacuucgacugcugcuugcacggcugcugcugaagcuggaacugcuggcaccgcuacucugucgguagucucuggcaccaaacccuccacuaaaucgacugcugcaagggguggaaaagucauguugguauaagcacugauaguuaccuuaaacaauacugagaaauacguucucaugccccuaacuaugcaucacguguauaccuuaccucuuagaacguccacgacugcuacccuuguagugguguucaaaagccauguucucuaaccaagaaggcacuucuuguuuugcuucaacaagaagauccaguaaauccuuugugauauuuauauuccuuucauuaaagaaugagguggcaagaccugaaacaguucacacacauacacaaaaccacacauaaauaaaaaguacuacagaaaaguagcuuagcauucuuuccuuacuagguaauaaaaaauauuacuauuagcuauucaacuaauaaauccugucugcauuguaggaauccuaauauucaagauacuauaaaucguaggcgggugugcauggauuaaacagcuucaauccagaagucuagaggcagagauagcuagauucuuuugaggucaaggccaacauggucuuaagcaaaaagcuauaaaguucuuuccugugcuaucacaauaaaacaaucaggauauccgguaacuaaacacuuaccaagguuucccacacggccuguacggccuaugcgaugcacauauucuucgauaucacuaggcaggucaaaauuaauaacaugcuucacauuugaaauauccaguccucuugcugcuaccugaaauguaacuuuuguuagagauggcccacuaaauucaaguauuuggacauaaucaacuuugaaaguaaaaaaauauacauacugcuguagccacuagaauugggcuuuuuccugagcggaacuggugaagggccucuucccuaucucucugagaacggucuccauggauacugguacaagcauauccuucaugguauaagaaauccuccagcgaaucugcccccuuuuuggucuccacaaacacuagagucagggaauccuugccugaauuugaaaauaaaguuuaucacuauuaguaaacaauacuuuucaaguauguauauagacaaauaaaauggacauaauggcauuuuaaauaggauggaaaaugauggugauacaaacauuucucacuacagagagcuaaugacuauucauuacauaaauacucauuacauaaguagucagagagcuaguuuuaccuguugcauuuagaaggucaagcagaaaugaccuuuugucuaucuccuccacccaaaccacuuuuugugugauguucucugaaguagacccaacucuuccuacagccagaaauauguacucaucuaagaaaucacgggccagcaucugaagaagaaagccauucuuuaauuuuacaguuuuauuacuuguguauauguuuaaguguagauaucaaaaggaauacaacuugaaguugguucuuucucaucaucauguagguucagguagcaagcaauuuuacucacuggaccauuuugccagccccacuauuucuggucaagugugguagcacauuccuuuaagcauagcagcaggagggucagagggcagccugaccuacauaacaaaacucugaaaacaucuacugaaaucuuuaaauuagugaaaauuacagaauaguaccuguauuuccuuaggaaaaguagcacuaaacaucauaguguggcggacaccuuuuggaggcauagugucuuguucaacuauucuucguaucugagguucaaaccccauaucuaacauccggucagcuucaucuaacaccagguaucugccaugaaaaaacauuuaguuaagauuuugagaagaaaucaaggcaauuuaguuuuaucugcuaauuuaaauaugaucaauguacuuaacaauauuuaauacaguuaguuacauuggggaaaaaaggacucuugccaagauaaaaucauccaagaucagagccaacuagcuuacuuuuuaaacuguuuucaaucuuuguguauaugcacaaguacaaggcacaauacaaucugcaagaguauguuuuccaccaugaugauggcuggggcaauagaaugugucaugccaccaggcuuggcagcaagcaccauuacuuagccaucuugcggagcacucccuuuguccucggaucuaguuacuacccuuuacuaaagcauuagcugacuuuucaacauugauugaacuaugauuauuugcauauucucaguauuuacaagguaacaaacacauacuugcagaagucuaacccgaucuucccucucuccaucauauccacuagacguccuggaguggcuacuaacaaguggcauccacguucuaagucucgaaucugcuggccaauuucagcaccaccauaaaccacgcaaggacggacucuagaucgguaugagaacuauaaacaaagaaccuccaucaaauucaaugucaagauucuuuacauggauauuaaauauuuuauuagaaucaaugggcaagcuaugcaucacugaaaugcacuuacuuuucuggcuuccucauagaucugcacugccaauucucucguuggugccaguaccaaagagauuggauacuguuuacgacggccauaucuuccauuuuccuaaauagaaauuuguuaauuaucacuuauuauaagaauuucauuucccuuugcaauuuauauauuauaccauauuaaaaaauagucuuaaucuucacaauaacucuucuuuuauaaagacuacaguggucauacagcucaaugacagagcacuugcuuaacuugcaaaagccccccaggccucauucccaacaccaaggaauauuaccuucauagcccucagagcuucuccuggaccaucagcauagaucugacucaagaugggcaagagaaaugcugcaguuuuuccagagccuguuaagagaaauauguucaucaguagaccacaauaaaacccucauuacuucuaaaucaacauauuuaguacuuuuacuuuauggccaaacuuccuagaaauuucucuuuagcugacuaaaacaagagucagcaaauuuaggaacaagguacuauuuuuaaauaaggguuaauagaauacagccauuauuuauguaucaucuauggcuucuuugacuacaaacaaugaaauucaguauugccaaauguucacuguacauaaaccccuaaauaucuaguauucauuguacauaaacccauaaauaucuaguaugugauuuuuuacuagaaaagagugacauuuaaucaaugagcuuaccuguuugagcacaagccaucaagucucuuuucucuuugauaauaggaauagcaugcuucugcacuggaguugggcgaguauaacgaguaagcucaauguuucccauaauaauuucucccaucucgacaucacugaacuaucaaauucaauggcauaaguagaaauguuaucugaagcuguuuuauauuaauuugugaaugacaacaaacagcaaaauuuuagcauaugauuacuaaguuggguuuuuacauuggaccuauuucaaaaagcaaauuacuuauaacacaaccaaugucucccuuuccacaaacucuaauguaugauuauacagaauuuaagaagagagcaaguacuuacacuuucaauguguggaggacaguuguugccuguugcuucgacuggaaugucaucauauuucucaaaguuaaucccaguauugccuccagaaaagaguucccuggaauaaauagauugguaaauucacauauaauaccaaugagaaagauuucaucacauacuuuaaaaacuuaaacuuacuguuccaaucguucacuuggugggaguggcuuugaccagucaucuucaucugauuugucacaccagcgacuauuuccaccucuuucaaauuugccaaagccacuucuaucuccacggccaccaaugccaucauagucuccccguccacgaucaucaaaccugaguaucacaaggacuaaaauuagaaucuuaaccaucaucagaucacucuaagaacuaccucagaggaauugaucaacuacaaauugugaacaguucaaaccaccagauuauaucaucuaaaaaucaauauaauuucuaaagucauauaacaaucuugucacauacauucuaucauuuaaaauuaaagcuuuaaaaaaaaauuuaaaugggcauguagcccaggccuucaaaguguuuguuaaaauauauuuagcaguaaaaauuuaaaaaaaauagcacccccaaacaucaauuguucagauuauagacauuugaggaaaaaaauucacaugauaacuuuuuaaauaagaaaguuuuuuuuuaaaaaaaauccuuaccugaauaaagauguuuguuuuaugucuguuugccaaaaaucuggagaugggagacuaaccauagcuauuaggcacaugaggucaguuugucacacuuguauaaguguuuauuuuuccauaagagucuacaaagagcucaagcaaauuaggcuauucacuauaugaaauuacuucuaaaacagauuaauauuagaauuagagaaauacagaaacugacuucauauuugcauuuuuuaaaagauuuauuuauucuauguaugugaguacacuguagcuaucuucaaacaccagaagaagguaucagagcccauuacagaugguugugagccaccaugugguugcugggauuugaacucaggaccuuuggaagagcagucagugagugcacuuaaccgcugagccaucucgccagccuuuuguuuuuuaaaacaaguguuggcuguccuagaacucagagaucaucugccugucucccaagcgcugggauuaaaguguagcaacacuguaauuucaucugauuucuauguaauagguucaagccugcagcuaagaaacugcagugacuuagguagauagaaugccuagaaugccuuuauccugauaggguaaaaacauuuaaaguacuauucaauauauauaauaaaaguaccauugaauauauguaacgguuucacuuaccuuccccuugauccacuuccacgaucuccaaagaagcuagacuucccucuugaaucaccccgugauccaaaacugcuguaugcauccuuaucuuuacuagaacuccacccugaacugucuuugucauagaauccuaaaaauaaaaaacaguaaaauccuauuaacacauggucuuaaucuuucugaacuuuaagccuacuggcucuuuuaucccucugguaucaaaugccaauguaaauauucuaaagguggcagcaaaagauaacuaagacaugcaaucugacagcguaugaauauuuggaacuuugccuuuagcaagaugacuaugguacuaucacauagcugcguucugccauucacuuuauugaugugaaugaauuuacaaggaaacagucaauuagcaucucagauuauuugguuuaguauuuuuucaguuccaauagcaaaacuauaaugccuuguacacaugaaucauaguccaaaugguaucacuuuaguacuuuauuuacaagcuuaacaauaucaaaaauauuaaaaaaaaaacucucuccccuauaugcucccaauacaaagucaaauaaaaauauuugccuaaguagggaucagcaaugacaguuacauuuaagacaauuaagguugaaguagcuucaaagaccucugauuagucagggacauuuauaagcuccuuuccuuuugccuuugucucuacuauuacccagccauggguuuucccuagcaaucaagaacuuaauuccuucuccagguauuucuuccagcuguauguaaaguuuaagguccugccucuucuaaucucuugacaaagaauucuggugaaucacuaacgauucacuagaaugugccugauaguuuaacuuaucugugcuaaguccaucuucuugucauguuaagacaacaaccuauuuucauguaguuuguacuacacacgauggcacacaccuauuuucucacauuaaaagcaagauguaauaagagacuaauaaaucauacaaaaacugugacacugaaggcaacuuuccauggugugacaucaguuaagguuuucaaaguuacuaaguuccaguacuuuaaaaucaauuaugguagaaauguuuaggcuucccaaacugucucaccuucccuaggcuuugacuaauuucuaaaugaaucaagaauuacauuuaccaaacugguauuaaggacucaccuuuaguagcuucucuguuccuuaaaugaggugggauauaacgcccuucuaaaagaacacaaaauuaaucaaaaaaugccaaauaccuucauaguaaagcuuuucaucaaauuaccuauuaaaaaaucaaauagucccaacaacuucaaaggguuggugagcaagauagaaguuuaagauagguauuaugccuguauucccuaggcuacauuuaaaagagaaaaaaaaaaaaaggcaacuuuaagccuaguaaguuaaggcuggguguggugguacuugccuuuaaucccagcagaggcaggugagauugaguaugaagcuagcuuugucagccaguuaguaauaccugcacaccaguuaacuggcuacuaguggguauuuauccuaauucuaauucucuuugcacuucugaauuaaauauuugaaagguuuguuaggaugauagguuaaaaagauugugugugugugugugugugucaaucacaggacaccucuguacagaugcauacaacauccugaaccaacuauucuuuuuuagcagugauagggaugguacggcuuugaauaugccauucaaggacaugaucacggaccuauauaugcccagcacuucuaacuucuagccagugaaagugcauucuaccaguauucguuaaaaaauucuuaacauucaaggaaaagcuaucuaguucugauugucgauacauccauaaaaugcuuuacuuacugcuugcuguacuuccuccacucugauuaucugaagaguucaggucuaggccagcaaacuauaaggaaaucaaacuguuuuuaguuucaacguugaaugaaaucaaagaaaaauacuccuguuuccuggccccacguucaaauaguugccucuuggagcccacacaguuauuaauaaaauuuagaaugugaccaagaacacacuaaaguauagagucuaacacaaaauagugccacuauaaauaccacagaaagcaaguuacaaaaucagaaacuggauccaaauucaauuccaucuuucacaauauuuguucuguaaacauuuuccauaguaaagcuccuuauuugagaaacuaaaacuuuguuuugaugaaucuuagaauuuuagccaggcaugguguguguguaugugugugugugagagagauccacugcuuucuucuggcaaagcauuagaugguacagacaggcagacacauacuuuaaauaaaaacuucuaagagguuugaagucagggcagccaaacaaaugguuuuaaaacacuaacuaggugcucaggcuuaguucaguuaguagagugcuagcccauagugaaggaucaagcccugauuuuugauccccaguauaguacaaaguguaacgauucauggcuguagucccaggauuggagaaauggaggcagguggaucagauucucagcaauauagguagccugcacuaaaucagacccugucugaaaauaaaagccacacguuaugaguguaggauucauuuuaaccauuuuuaaaaauuuucuaaacagcaccaacuuuauacuugguauuauuuaguuccuuuacucucaaauacagcacaaauguauuaaauugggauaauacugccuaagacaauuuuaucaauacacucaccacuuagcacuacagaauaaaacuggaauaauuccuguucucccacauuuacuguaaacucacagaacuagucaugaauauccuuugauguucuuacuaaagggcauuuuacuggcuuuagccuccaaagucugcccaucuccuuauacugguuaacaagauuuuacaaaaaugcuacacacugcucgaggguguguguguguguugugggagggggggucccucacuauguagccuuggcuagcuagccucaaacucacuaaagaccaggcugauuaaauucaggucgcuguggucaucacgcuugguggcagaugccuuuacccacugagacauauugucgauauauaacuacuaucuauuuaggaguauaaaccacaauugaaaaacaggaagaaaaaaaaaaaaacaggaaaguuggaacuguuacguuuuaaggaaauguuacucgauaaaucugugccgauacuugcaaacuacuaguaucgcuaagcucccugaaaacagaaagcagauguaaccucuuugucauuagaaaaaauguugccaugccuugauacuguaacuaccguuuaaagccgcguuuauuaaaaucugaguuuugguuuuuuuuuacgaguuuuuuaaaugugcucugguuugccugcagugugagggugucugaucuccuggaacuggaguuacacaggcaugaccugccacgugggugcugggaauugaacccaguccucuuaacggaugagccaucucucuagucuacguagguuuuuuuuuuuaaucauuugacauuaaucgaagcaacaaaguugccaaaugcacuguugguacucauuacaaacuugaaccacuccgaauuccuaagcuuucgaaguuaaauccacuaccaacuuaugaaaggcucuuggaaauauaauuuccaauauaguucaacaauaguaucauuuuaguauaaguaucauuuagaauggaaaauguuaccagugucccuuaaguuacaaugugucacaacauggaagauuuacuguagcaggucauaggucaggcagaaggcaccagacccucaucuccuuggccucuaaaucuagaaauggagucucgauuaaguaaucagaaaccaggccugaccaaucucccaauuuuacuucgauggcagcaacaaguuaucuguugccauauucugggcauuuugccucuagaggaucccagagugggccaucacucgcaaggcgcgugguccucccuugcgcccagguaaagggcgggcgugcccggcucgggccgcgcggucguuuccuggagccuaaggcugagcaagggccgcgccggguggcucgcgucaccgccaagcccggcgcaagugcgcacgcagcggcccuggccucccucccccuccuccccccgcccaauccgcccugaaauuucugcgucacaaaacuuuccacucgggaaccgcggccuccccugccgcgacgcaccgggccggcggggccgaagcaacccagcuggcuugcaggcgaacccgcuggcgggcagacccggggggauggggaugggggugggggggcgaccgcgcagcaccgccggccugcgccacacaaaggaggccgccgccauuagcccgcgcagaggccagccccccucccgcggcgcccccucccacauuccagcgccgcggggccacucggccagcccgcgcgccgccgccagcucccuaauuuccaaaccacagccacuggggccauggaagcccaaagccccggaaauccggggccaaaaccauccacccgggccccgccacgccacgcggggcaaucucccccccccgaccgccccgauccccaccugcgggucacuaaucaaccaggggacgcgcgugcgcccgaaugcgcgcgcccccucccccuccgcucgccugcgcacagacacaaaagccgccauugugcucgggccagggacaauaccgcgcaccgagccgagccggaggaaucaccggcucuagcacuccccccgcaagcauccagucccuccagagccccuagccacuggccacccgccggcccgagccguccagggagacgggaaggcaaaaagcagaacuuaaagagcugcgccacaaggcaggcuagggcagggggcaaagugaugcagcgacccccgcggcucaggcucaccugcugguccagcccgagcgcauuuuccacugccacaugacucaucccugaagaguaccgagaaaucggagucuuccgcugcugagcaaaggcugccucuaccgcaaaggcccucucacgggagaacugcggcuuug

SEQ ID NO: 12588 - RNA, 4207 nt, Mus musculus
caguuacaucucagaggcuggcgauggagggagcucggaacugaaagcuuacuucagccugcauuuuaagguaaggcagaacaauuuacacaugcuugacuagggaaggggaacauacagcaguaaaaauguuucugugugugcguguaugaauguuuucuuuuuccuguauuuuaacugcauuuugcagaaugccuuaauucuuuaacugccauuucucuugcaggagugcaugcgggagcugaguaagcugauuuaugauaacugcuuuaaacacuggcaacuaguaagucuguagugggauuuauuuuuuauucuugcauguuaauuuggaaggucauagaaaagaaugggccuuugacagaaaugguaguuugccguuucugaggaaguucucuagugguuacauuuuaaauugaauaugugauuguauguacuuugaaaugaucugguguaauaguuuugcucucuguguguuuaucuuuaguuuucuuuuguuucaaaguaauguugcuaguugaaagaaaacagcagccuucccaccugaacgcuguuguuaaugcuggaaaguaaugacuauucaguucuguuaaauugaaaagauagcaaagaaaaagcaguaaaacuauaucauaauuagucacuaaugucuaauucugauuuaauugagccuccaaacccaucucugucugcccuugacucggguuuaguguuuuuguuuucuuuaucuucuauuuaaacugaaaauagauguuucuuaugaaacagaucagauucaaauauccauauugaaaacuggcauugacuauuaaaauuuuuagguaaaagcuuuaagaaauucaucuauaucuuuuuguuguuguuaaagcaaagggaaaauaaauacauuauuuuuaauuagcaaaacccaacccugacucuauccuaauaugcaccuucugcauauuuuuuccagcucucaguacacuuaccuauuuuucccuauggcuuauguuacuuauauuuuccauagcugcaacaauuuguauauaguuacuucaagaaagcauuucucuaugaagcagcgggcagcagugagauuucuagaaagcacacagauggaaaacuagccuuguuuuuuugagcuaucacauugucuuugggcuccuuauuugucucaugacuccuacccugauuaacuuuuaaacuauuaauuugucucuugacuuuucaaagacaugagagaagaaaaaaacacaaaauguuuuguucagaauuuucagucuaaugcuacugaggaaauguuguuuuucuccucucuagauguauuaguaauuccagccaguaaugccagccaggcaugguguuguuuuguuuucuacaaccacuuagguuauuuuggccucugacagauuuucaagaugcuuaugacucaaauaccccuuaggcuuuggguaugcauuaagccuuuucuuuuuuuuuucccuagaaaagguguaagaauuuggaguugcugcaguucaauaugaaggacaacuucaguuuugcugccaccagcagaaacauuaccagcagccguccuuuugauaaucucaacgcaacuggcaccaaugaguccgccuuuaauugcucacacaaaccaucagauaagcauuuggaagcaauuccuguucucuacuacaugauuuuugugauuggguuugcuguuaauauuguuguggucucacuguuuuguugucaaaagggcccuaaaaagguguccagcauuuacaucuucaaucuggccuuggcugacuuacuccuuuuggcuacccucccucucugggcaaccuauuacucuuauagauaugauuggcuuuuuggaccugugaugugcaaaguguuugguucuuuucugacucugaacauguuugcaagcauuuuuuuuauuaccugcaugagugucgauagguaccaaucggucaucuacccuuuucugucucaaagaaggaaucccuggcaagcaucuuauguaguuccccuuguuugguguauggcuugucuauccucauugccaacauuuuauuuccgggaugucagaaccauugaauacuuaggugugaaugcuuguauuauggcuuucccacccgagaaauaugcucaguggucugcugggauugccuuaaugaaaaauauucuuggcuuuauuauuccuuuaauauucauagcaacguguuacuuuggaaucagaaaacaucugcugaagacuaauagcuaugggaagaacagaauuacccgugaccaaguccugaagauggcagcugcuguuguguuggcauucaucauuugcuggcuucccuuccauguucugaccuucuuggaugcucugaccuggauggguaucauuaauagcugugaaguuauagcagucauugaccuggcacuuccuuuugccauccuccugggauucaccaacagcuguguuaaucccuuccuguauuguuuuguuggaaaccgcuuccaacagaagcuccgcaguguguuuagaguucccauuacuuggcuccaaggcaagagagagacuaugucuugcagaaaaggcaguucucuuagagaaauggacaccuuugugucuuaaaucuguuagugggaugcauguaaucagccuagccauugguuuggaggcccacacaaaugaucuuuaaguggcaucaguauaauacaguucuuugcuuuaucuaaucuuuacuuacucccccgagaacaggaagucaaguagaacuguaaaucuuuauacuccaccagcuuucagugauagugccuucuuuugcugguccuuuggcaugagauugucauaugugagcuagaucuauaaucuagaaguaucugggggaauuaucccaacuuauaauuaacaacaaauuaugaguggugauuugacaucucagacuucucccuggaaaaugcuggcauuucuuaguggaguuuuuuguccauuuucaucagauuucuuuuuucuugaacaaaggccaauuuaaacuucuuauacuauccaaccauaugauauagcaugagaggugagcacuaaguuuagcaugauauacucuucuauauaugccauagguugguaguggcuuauucagucucuagguauagaguuucuccuuuuaaagaaauuguaaguuguguuccuuuuccauuucacucaaguauagcuuuuguacuuauucuacagcuacacacugagcagaucuagaauguagauuaaaucacacaucugucuuagcuuauucuugcaguuauagaaaguacacuauuuaguaaaacagaacugcaaugaaaaguauuuuaguauccacaaaacugaauauacacuuugaaaauuuuucauccauuuugacucuuguuuauucuauucucuucugaugauuuuugaauacaacaacaaaacacuguauuaugacacuacguaaaggucacuuuuuaaauuuuuaaccuuuugaacauggugcuuugauauauucaaugaugacuugaguuuaauuauucaugcuuuuguucugggcuucgucccaaaauaucucuuugacccugaaaaagagagcauucuuuaauucuuuaacuuuguaauaaagugcaaacuggcaugggaaaagguuaugucagacuggaaguuugaugccuucuuggggguaaacagacccagcaaauggcaaguuugguguccaacaaggaacuugucagaacaaagacucccuggggaguaguuugaaucugcauuucugggcacaguuccagaauguauaagagucugugaaggugauuuaaagcaagcccagguccacagaacucauucuuaacacgaguacaucucuuacauuagaggaauauaauaccugaagcuguguuaccuaaaguuuacucaaacuucucaauaaauauuaauucagaaguuaaagaugucauucucugccugucccauauuauaccaggucaccuaagaccuuccuggauugaugcugaccuaugagguagauucaaaguucugggaacuuaacauuucugucagauuccaggcguuuuagguugaagaauccucucauaccccuuccuuggaaaacccugauuucauguauucauguuaauuuuuaguaaaaacaaauagcuaaauauguaaucaguuaugacuuuguguuuuaagcaauuuuacacaaaaucucguaaaaauaaaaucauuacugggagacca

SEQ ID NO: 12589 - RNA, 341477 nt, Mus musculus
cuggguagcggcuccucucuugcucugucgggcuacugccagacuugcugagucucgggaccgcuccggcucuuauugccacucucucgugcucuccucgcucccccaagaagcaggauggccgggaccgugcgcaccgcgugcuugcugguggcgaugcugcuaggcuugggcugccugggacaggcgcagcccccgccgccuccagacgccaccugucaccagguccguucuuucuuccagagacugcagcccggacucaaauggguuccagaaaccccuguaccaggugaguaggggucccuugagcauuccccgcgcacaguggaaagccaaggcgcgcgugguggcucuucccagagcgcgcuagccugguggggccgcagcggccgugcucucugcugcaggauaccugggaaugguugcugugccuggggccuggaccaucuaccaagggagggaagcacaguaugggacucuguccacaugccccgggcucacgcugcugucaggaacugugcaagccagagcgaggaacagcagagaucgccuuucuagcgcccauuuuuuuugggggggggagggcgggaaggugggagcuggcuccccucugcucuuagcaaaccggcuucacaacgugaagacugugacucgggaauuuaucucccuuacuagcacgucugccuuagcuggacccguaguucuggccacacuuuauccaccguguguccccccaugcuuuccguuccccagucuggguucccgaggcuggccgggcccaagugcaggcaaaguugagcacaaaucuuugaauccucagaggcuagagaagacacagugaaggaaacuuuugaguaggaggguccuccaaaacgugcaagacugagccuuucccuucaaaacagcuucccuuaucuagguuggcaaaucucuuuaaaaaucggcggugcuuggccuacggagcacgaauccaaaaaggauuugacuccucccccgcccaaauucaucugccuugacaggcuggaccccgaagaggagaagauuuuaggcagaggaaaguuucagagcgccugccuuuuguucugcacaaucagaucauuuuguaggggcauauuuuaaccuuagcucagggcugccgcugucaacagaugaauauuaauugccuugugugauugacuguccagcgguugggcgcuuaacgccugccuuagaauccaaucagggcaaguugcuauacuaacaauacgugcaggaagaauggguuucgaaaagauuaauuuuucagaggugcgcuuggaagaaagcagccagccguauuugcacacagacguuuguggcuuccaggcucuccuuccgaagacucgugcauccagcuaggcgcucaucccgcgcuugggagacauugggaacaagccucgccacaacuuggcugguggcucucaacaagucagggaggcgggccggaucguuggaccaaguugugaaugcguaugcgcgccuugugggcgcugccagggagcguucacuggcaggagguuaccuaggcagccagcgcgcccucagccuuuucuuuagguugaugaaaagaggcuagugagccugcuguuuaguugcaaagguaauuggucacccuuuuuuggugacugaaaugcacuugcgcauauguuaaauauugccuugcaggauaucgcucuaagggaggguagaacuaccucuuccacuguuaagucuuaauaacguaccacgugggcgugugcaagagcuguaaggggcaaccuaugaaucaguucugcagagcugaaacaacgggcgaaucucucuccccuggaagugccaugguaauuagauugcuaaggcuagagaacacgcuuuuguugauaauauaaaaauugguccuuacaggcugagcccccacaagaugaauugguccaggguugggguugggcaguauuuggcugaugcaaagggaaguaaaauggugcuuaaagaaggggguaccgagaaaaguucaucuagauaguuauuagcaauccucuuacacacacacacacacacacacacacacacacacacacacacacagagagagagagagagagggagagagagagagagagaggcgcgcguuagcuugcuagucucucuccuucccccagcucucuggcugccugccucuuugcuacaucuguauaaaaguauugggaaggcccacacacugugucuaugagaguuggcuagggcuuguuuccugccucgcgugcuuccagccuaagaaugaucauacuuauagagagacuuauuugucuuagagaauuuuuccuguauuauuucucaaacucuaggaggaagcacuuuucuauuuguuuccauauaaacccagcacaauucauuaaaaaaaaauuaaguugugccccgcaccuuuagauggcaaacauggaaaacaagucccaaauucaaauaucgugauaaccauccagcuaccauguacuguggcagcacaggccuggaccaaacccauuuguccugaauuuuagucggcuaacgauggacgauguagguauagaaaauaugguaaagauccuaauguucaugugcacaaggagcucaucagaguuucagagaagagaugguaauggcagaccgaauacaauggcaagugcauaauuucaaagcgaauaaauguguaauuugcugcuguuucucacugguuagaaauugaaagagagcugcaaauuauuugauaguuaugaaccaucgcgaugaccgcuugacucccccucccgcaucgccaucuacagcuuaagccauguucaguuugucugcuacacuguguuaacugcauuaaugcuuucuuugucccagauaaaaugagauucgguccccacucaggaaauauccucaagaauguccuguuucacguaaggggcgcauuugggauugacugcuaacuuuggccauuagcagaauuggguuagcgugaauaagguacauuucuuaugcuaauauggaugagacuaauggcauuugaaaucagccagccuaaaaaauaaaucacugguuugcugaaggacuaccccagacuucuacaaagcugaucuaaacccuuccaaucgcauguuucauuucuuuuagaguguucaaaggcacuggacagccauuccaaauagcauguuccccaaauccaugaaucucuucagaccccacuuuuuuuuuuaaaaggauuuguaacuuggaaagcacuacagauggaaaccaggcacacagaguuagcauuuggcagggaaauccauauaacugacuuucaguacagcucuuuugcccuuauuuaauuuagaaaaauucagaaaaaagccaaugagcucauaagucuagauguuuauuuuguuuugcuuaaccuacccacaggcgcaaucaagaauggauacaauuuuaggcaagggaagugagcuaguaaucagacaaugauguuuccaauugucucaagggaauguuacagaagucugaaaaaaaauuccucuaaacaaaaaucaaguguaauucacuuuaugaaugccauacaccacuuuugugggggguggaaguugcaggggucggaugggaaugagaaaaaucaaacaaaccaugguaguguuacaacuccccuaagauggagagaucuugucuuggagagggccuuggaaagcacuagaauggaugcagaaggcugaaugcaccuauguguaaaaggcagccuccaaggaccaaaaucacucgcaguugcuggaaauugaugaaagaaaaaaaaauuccaaaggaaaauucuugaaacaaagaguuuguuuuuaaaugugaguguguuugugugugugugagugugcaugcacucugaaaacuagcaaaccuaucuguguugccagcuguggguccccaauuauuuugaaacaacuaaguccaaauguugggagagacaaugagaaccgagguaugggagaauuuuuuuucucuccucugagauuucacuagacauuuagaagagcaggugauuugucaaaacuuuucaaaaguuguacuguccugugcuaacuuugaggaguuuggaaaauucuuuuagaugugcucugaauguauuuagugcauaaauccuuacugagaaguuauuuagaaggagccaucauucugauggagauggcggaugauugguggggcuccuuggcaggcuugcuuuaggugcugggggugccgagaggaguaagaugcaguccccuuugucaaggagcuugcaguagagugggggagcacacgaguaaacaagcuucccaggaaacuuguaggauuaaagagggugaaagaggcuagaaaagaccuccaggaaauuggcuggaauggucacaauaggcagccugggcaagggaaaagaacagaagagaugaagugggagauagggagaagucucuuaauagagccuccaucuuaaaaagacacagaagaagguuuugauggaugcuagaugacacagauggugucaguuuugcaauguguuuuuuuuuuuccuuaugggcugguagauuguauccaauauuuugaugcaauauuuuugagcauucuguugcuuccaucuuuagaguugcaauguuugcuguucacuguagccuaggaaaagacugcuuauuaccaaccugggagaagaguccuggauuuuucuccuaugagacaagacagaaaauauguuuucucuuuacauggcagcuaucaaugaccaugccaacuuuaguguuugaugccuauacaaaagcaugggucuuaagaaggauuuuauuacucauuucuaagaaaauugaagauaaucacuuauaacuugugcacacgauacaucauuuggaaagaauuucacuggggaucauguugcucaacugaaaaguuuuggcgugcugaauuuguacauuuuuugugaaugcuuccuuuuacucugaucucuagcuuuuuuucugcauaugguuauuuguauguuuuagauuauaagcuucuuaaagggaaagcucuuugagcaguguugagcacagugcuaauagugccaugcggcauuuggcugauaauuaacaagaaagaauuucuagaucaguaaguauuuuauaugaacuuucgaauacuuucucaagcuuauuuuaaaagcuuaagcccaaugcuauggcacacucuuaggguguguagauaaacuuuguagucuuuauguauuuuggcuguagacagauccaggcuuauuucaguuaucugcugacucuuaauaacugguagggcuuauuaauauugaauacccaaagaacaaauugaagucagcagcauuguuaugccuggauuaguauaguuaaagaucaacaauuauuauagcacauaaaucaaaggaccucuccuaaaucaaguccuguuugauuuaaugucaaguagacguuuuucuaauguugguguugccauauuuggaagucaagcuaggagacaugcacagaucuguuguaguaccucauggguuuuuguaaccugggaucagaauuccuguacaggcucaacucaagagacuguuccaacagccaacaucuguugaacccuagccaaucuuguaaauggguuugauguauuugguaagcuaggcuauaaccggaaguaugggcaaaaaaaucccguaauuauuugcccauauuuagcagcaugucugaccugaaacaggaucucuagcacuccauuaagaaaugaacaucagaguuggagaaauggcucaguagauuagaguacuggcugcucuuccagagguccugaguucaauuuccagcaaccacaugguggcucccgaccaucuauaaugugaucugaugcccucuucugguguguguaagcacucauacaacaaacaaacaaacacaucuuuuaaaaagagaaaugaauaucagaaaaucgaauccaagccaugguuccccagauuggcuuuagacagcguuaagugagugggaauuuaccucuugagcuaugauggcagagagaacaugauucagaaagcagugcaacaauggccauaucagcagagaaaaugcauuuugaaauucugugugugaguggcgaggcacccacuggaacaucucaggcccaugcagagaccuuuuugaauaaacaaggaaagaagcuuuacuccucuacuuuaaauuaggacaauuaaauauuauauacacacaugcuaauuaucaaaauucuugucauuuaaaaaccaccacuacccccacgaacaaacauaaacccaaagugguuacaaagaaagacauuuuucacuuuggcuucucuuugugugaagauugucgaagccacauuugagaauuugcaucucuaguguucugaacaguuaauuacuucuaggagcugaaauuguauuuauaugccagauuaggaaaucuacucagcucuuugaagugugcuuaauaggcuuauauugauaaauaauugauaagaaaggagauaaaauauaggugaaaauggcgauaagaggggacagggaagucaaagccauuauaaaagaaacuucuauccauugcaugcauucaugcacuguaagaugaaaacuguucauuuuucaacaaaggcuagaguacuuaaaucuauuuuuuuuuaaguuuccacaaugaagcacguuuuguuauaaacugagaagguggcacaguuuuagggcaaaacuuucauugauccuuugaagucuuccuuuugaaaauaacuugaaauccugguuacaguaaccacaagguacaguuucacaguuauuccuaucacaagccugguaucucccuuagguuagggauaauaugguauucauuuuuuaugucuacauuuagugugaacaauagguacuaguauguauuuacugaccaaaugaaugcagauagaauguacuagaaacauacaauuucaauaaaguuaauauuuaggaguugauuuaauuuuacugggauuuuaaaaaaggagucaccuuuucagguuaaaaaaaauccaucuguuaccuauagguaaguaaaaagaguauugcuuuaauucaguugcuugugccuucauucccuggaagaaguagacuauccaagucuuacaagagggguaaguauuuuguucuuguuuccaaggcaauucuaaguaauuuaaagguaagguuauacacaucgaaacauucaugcauuuucuuuacuauauagaucuuuugaauuuugguuuaugacaauauugcucccaaguuucaguaaagaugugcaguucccuagcugcugcucaacauaccacuuucuuauagcauacucauuaagcuguccuuccuaaagcaaacugauuggaaccaagcuccuccucaguguuuacaauuucuuacuuaugccacuaagauugauguuguguuuaaaaggacauauuccgaaauauguuugcaggacaagaaauuuuauaugguaggauaaaauaauuugcauaguuccuuuuuuuaauuccaguucuguccccucuccaaccacugcuuauuuaguauugauaacuauguuuuaggaaauccugagacucuccauugcucuuuacaaaccuggcuuugccuaagugaagcugaagggaaaguggugaagggguagaguuagaaugacagacguggggaggacauuaagagcucacauucugguacauaacagaauauuaacuagcauagaacagacagagaggacuggcaaacaucucaacauggacuuuugcaaguccaugcauucagggauaauacagagagacaacugcaccacaagugcauuuguugcccagaauauuuuacccguacgucuugcuuugcauccaugauuuuaaaauauauagggaagucacaaccucauccaaaccuauuguucacugaaugcaagagccauauuugaauccugaucuccucuagacuggugaguacagugacuuguacagaaugaugauuauaauuuauuacauaguuaaccaacauuugaagagggauucuuaaggacuugacuauuguccagugaaagcuugggaugacauguaacuaggagaugcuucccugagugcuugguucucuaaacugguuugcagcagagaaugaagaaaggaugguggaguugaaacacuggcccugggaguccuguuggccuaagaagauugaagaggaggugacacagagauuuucuuaugguguuauuuaaauggugguauuugaauauguauaugcauauauauucauacauuacacacuuauauccauacaguauuauuuugauagucacaguuaauuacacauauuguuucagcucaaauuuguuguuacucuuaacaguggguagacuuucacagucacaguuuauauuugugauuugaaagcugugcuuuaauauuugucucugcagcacaguuacucauaaagugucugccgcuucucaguuccagggaugggccugguuccaacaugcauguacgugcaugugugucgaguguauucugcauacacacagauaauacagcuacaacacaagcaggguguguccaaucuguugcuugugggucacacacaccuauggccuaguuuagcuaugaauacagcucaacacaaaauuguaaaauuauucaaaaucauuaugagauuucuuuuucauaacuugauuguuugaaucuugagcaugaauucuguaaaugaugacauuuugucaaaacauccaaagguuggagaugucugauggagggugagccuaacucucaguggaaagaacuaaaggauacagcauuccacugaacuagggaaauauguuuuacauacguuggcuccaaauugcugcuguacugguugccacugauauaagagaccuacugcuuaguuaucagguuucaucauuuccccaaguguggagauguaauucucauuaaguaacuacagucagcccauacuaugacccuggaccauucuggaggaccgcuucuaguauuuuaaguauuaagcggguaguauuuuaagugaauggggcgccaaaggcacuuuccaaucucgauuucugaaacaauuaauauauaaaaaagugcuguugugugaggcaugagagaaguaaaggcuuaugacaaaaugaagggcuggagaguuagcucauugggccaagugcuugcccugcaagugugagggccuaaguucaaauccucaggacccauguaaagccagcauaauaacaugcagacucaauuccagcacuccuauggcaacauaggagauaacccugguagcccaagggccaacuagcuuggagcuguugacaacaaagguacugucucaaaccaagguggaagaaaagaaauggcaccugaggcuguccucuacuacacacaagccuuuacucacacuugcuaggugugcuugauggcuuggguucaaucccuggaacccaaagaaagauaggccagaaccaaaugcacaaagcaugucuuccagccguggccuaugucacauguucacacccauuuaucauggacccacacaucauagugaagugggagaggcuacauauguaggauguaucaguauauggaugguaauugaaguccugggagcuuaccaggaaaguguggaguguggaugaagcauaguugagacucaucaguauauaggcucaagugguucuauggguguggaugguauuuuccaggccucuucauuggacaugucuuaaaauauauuuugccaacaucuggugauauuuuaaaaacccagcaaaucuuucaagagcuuucuggauuaagaggaaguaugagucuauguugucauagucuaagcuagaagguaccaaacacccaaauguacauacacauggagaggggaagaggguuagacugaucgagagagagggaggaauauauaucuuuaucucucucuaucauuuaucuaucuaucuaucuaucuaucuaucuaucuaucuaucuaucuaucuaaucuuucacaaccccacuuugccauuugaaagccuuguuuccauuuaucucaucaaacaccuucuuucauuccaauaucguggcauuuugcuccuccccaaguggggacgccacuacucuauaagaugaaaguuguuacacuguuuuugggagaucuggcugagauugcaugcaggcuagccucugagacaugugguucuaagcaaagucuaguaauacuuguaaaacuagggugaucuuucuuucuuucuuucuuucuuucuuucuuucuuucuuucuuucuuucuuuaagauuuguuuaugucuaugaguacacuguugcugucuucaugcacaccagaagagggcaucagaucccauuacagaugcuugugagccaccaugugguugcugggaauuaggaccucuggaagagcaguuaguguucuuaagugucuucagaguuuuguuucugggugaggaaaaagugaggugucuuuaaugucucuauuguuuaacagguugccuucaccaggguuucuauuuucauuuuuaaagauugcuauuuuauuaauucguccaauuauaugucugcacguguuauguaugcgcuugcccucacaugccacaagagggcguccagacugucuggagcugaaauuacaggcaccaugagccaccugaugggggugcugggaauugaacucuaguaccagacaaaaacaccagguucucuuaacuaugccuaguucuacuuucuuuuaacacauacuugaaaacuccuuuguuucuaguagauuggggggggguguaucauuuuuagguugguuggauaguucccccauaugggacuauuguagaaacuaccuacccaguacuuacuguaugccacuugcaaucuggguaauuaaucacaauauauaaagccaaccugaaaaggagguggugcaugcccauuuuauaguuggaaaaacugagacccagaaagguuuacuuucccaccguuuguguaaaugguggcagcaggacugaaaucuagauuuguuuuacuccaugucuaauguucuuuccacuguaucccuauccuuuggaccgugaggaaaauaauauaauguccauggaaaucuuuggucugaauugucauguuccuuugucuuuugagauacuguacauucuaggucuucuacuugauucugccuuugcuuguccagucuguucaugguaaccuuugucagaugugggugcucagugccauguguccucugugcuucuccauugucuuugcuuacucauguaccuagucccauggcuuggcuaucauguuucaaugguuucuacaucuuuuaaucugccaucuccuuaacuguccaauucagaaucucacaauugccugcuaaauaucuccaucaggaaguccuuagugcuucaccuaugacagagccaaaacuuacucgccccaucacuuucauuuccuauuuccacuaaccucuucauaaacuucuacauuucuggugauggcuuuccuuuuugaugcaaagacuugaaaccuugacaucaucuuuaauuucucacacccuuugucauaccauguaugcccucuauuuguagaaacuggauucugaaccauuacugaaacacugcugcaguugucuguuggcuaaaucuuauagaccccuccccugucuacccaucaucgcugcacaauguggucuuaucuaaccuuguuuuuuuaugaacaaccccccccccgcccgagauguaauuguuccuuguuaguaccacgcuaucuucuaacuggauuaaaaucugcacucucagcaaggucucccagugauuuguauguguguuaaaaguuugagaaaagcuuccaagugcaaguuagaugagggucagaacugugcaguacuuguuagaaacauacauuaacaucuuaaacauaaauuaacauccuugucauuuuucacaucugugcuuugcccauucauucacugaaguggccuuggggaccuauaaauaagguauacaugacggagcggggaaagaagaguggaggaaggagagaggaauggggaugaccgauaagaggagagggaaugaaggaaggagaggagggagaaaggcuaaaggauaaaugaugaugggguaaugaacuagccauagagagaaguggggagagccaaacuugcaggagcaucucugaguagcugguaacuuugugacuacuuugggaaacaccuccuucaugguaaaagugcuguagccagggacaaauaucuccacucaugauauugcuucucuagggggauggaaugggugaaugguuucuuagggggauggaaugggugaaugguuucuugcuuuuucuuuugcuggcuuucugaggucuaucuuuucuggucauuuccauaagucacuguacaacuugaaaggucucaaagagucauggaggacugcauucaguguuuccaacagacccuucuauuuucagaaacaguucugcuuuguuuucaagcaucaguuuauuucugaaauaaagguuuauuuuccccacuguauucugaaggguuucuacaaauguuaauuucucaaguuuaagucacuucuugccuuugaaauuucagugcugugggucaauuuaauaacguuaacuaaaguggguuuuuuuuuggggggggguggugggacacuucaaaagccgccagauugguguuucuuuguucuuugaggaaguaaguuugccucauucacaaaaccugaaggugacagacucuggaauccagucauuuagagucuuccuucaacagcauccaguuuuauuuucaaguuugguccuaauagcacugacuaccaacugucacucagggguaaaauuccugaaaaucucaccaacacuucauagaucugugcuaaugagcagcccaaguuacuuagcuaacaccccauggcuaagggagacaagggacuuuacacaccuccagaucauaagggcccuccuucaucugucuccauuccucugcuucccuuccauccucacauccucccucaacggcuuauaauuuaaaacagaagguguuuuaugguuugcuauauuuauugaaugguuuuguguuucuuguucuccuaaaaaagagcugaguauaauguuuuguauuuuccucugcguuuuuguuuuaaauuguauuuccuuuuccuauagugauuuuucucccuccucucucccucucuuuguguccucugccuccuucucaucugccuuugcccagagauucugccccaucacugggcacuggguaccugguuacuuacuucucuugggauauugugaaauucuguuccuuauuuaguuuggaagugaagcacucuaaaaugucccucuuucuaagaauugugaguauuuaaaaugcuuuuuguauagacagaacaagguuauggauauuugacaaguagcucaugacuuaguguauacuugacauuaucucuaacuuuaucauaauccucagugaaggugguuugcaucuuuguuccugggacucccucuuucagggcuggagagauggcucacugguuaagaacccccccccccacacacacauacacaaugccuuuucuuuuucucuaaagauaagggagcccccuugaaauccugcuaacaucuguuggaacuaacaccuaucuuguagguuaaccaaauuacagucugcuucucucugaugaccucaccacauuucagggacccuguuuuacuugugggguuccauuguuccagucucaacccucacuucagguuugagauuuuguuccaacccgacugcucagugauucuguuucuuugucuuuauacuuaugggcaucuuuuguaugucuugugucuauuaucucuuccaagcuuggccaagguuaugaggugaugcacuauauguauaaauauuuaauaagauaaguuagacaaaaugugcuugaagaaauuuccgucuuucuccugucccccuccccacagcuugcagcuagcuuggucucucucucucucucucucucucucucucucucucucucucucucucucucucucucuuucuguauguguguguguagagucaacaacaguugcuuuaucucagauguuuagauuuggagaacauuccuuugcacuuugcuugauggacacaguggaaugcaagcuuucgagucaaccaggaccaucaaaaugcuagcgccaugucacagauaacauuagucucuuguccuauuuuuuuucuaacugguucccuaaauuccccuaagccagaagguuugagguaugagauuguguguuuuuaaagaaaauauuauggauaaagacuaauguucucaaggcaggaagaacaauuaguaccauucauuaaucagggaccauguuuugacucuggguccuggcuaggaaauauaaacugugaaagucacacauauauaugaaccucaggcaaauuuaugacuugucagccuuuuaagguuaaauucuuaaccccaaaucagggcuggcuuuauauguggacucuagcacauuccucugggccacugagcccgccccuccccagcccuuugcuuaacagcagcucuaggccuaaugagcaagaaggauuucugucucuuaucagcugccuaaagagcaacauuaagacugauguacagaguuuaggucaaaacuugaauucuugaacugaaaaacuacaaggucaguuaaaagcccccagaauugcgguaucucuuuagucaucaauaccugucaaguaaagcaggcagacacuugaguucaaacaaauaguaauaguugccaaagccaugaacagucuaauuaaguuuccuaauaguuccuuccuucuuuguuuaguucuucuauaaauagccuuccuauauucuuuaaugagcuuucagugugugccuggagguuguuauggucaugugggaguuuuugauugucagauggugaagaugaugaagguaagaauauuuauaauuuuggcucagauuuuuagaagggccugccagaggaaggcaaguagacaccuacuacuuacugccuuuguuucuuucugaaauggauuuuugaauggcugugaagucaacuugcuaugaaaucagagaagucuuugugccuccucauauuguacucacauuugaaaaaggagagaaaguuccugguucugaaaucugcuuggaauccaggcucagacucacacagaauaacuauuuuaggauauucacuacacaucauagugacuuucaucuucuguguuugcauuuuuuucagauacaauaaugaaaacauuuuuuuuagauuccguuuuguuauugaaaauccuauuuacauaaacaggcauuguuguggcuuagagaagaauguggggucccauucuuuagcuccuuguauaucuuugcuaaggcuugucuaaauagaaguaaugauguuuuagucuaagcagcuuuucucauuuagguaagcagggugguuugaaaucucaguuuacuagauaauugagucucuucuuaauuauuucaggcaugcagguugcucucuuuauaguaaagacccuaaaaaucuaguaaucuccucaggcauccauuugguaauaaaaucuagugcguuuucagggguuaauuuucauuacaauugcauguuguuucccuacccccaugcuggaacaaauucugcuaucuuuuagaguccaguuuccucacacugcaaaaucacacuuaaaaaaaaacaucuaagaguccuacuggaaacacuaagucuagaggaaauuuaaauggauucauauucaugcucauuacacaacuuucauuuagaguuuuuaauagccuugucauauuucuugaaaaaucauauggccgacuuugccagauuuggguuucugcuuugaaugaggaaaaaaagauugagaacuaaagugaagccuaaguauccuuaauuuguccauuucacacacacacacacacacacacacacacacacacacacacacauaaauaaaauaaaauaaaauaaaauaaaauaaaauaaaauaaaauaaaauaaaauaccaaagcucccaauccagucacccagccuaaaucccucagaagucaucuggugcauagcuagguggggaaaaguuugaaaaaaacagagaaagaaagaaagagagaaagagagaaagagagaaagagagaaagagagaaagaaagaaagaaagaaagaaagaaagaaagaaagaaagaagaaaagaaaagacccaggucucuuucacaucugcuagucauucaacuggugugacuucaauucagcaaguuuuuauuggacaccugugguggggguggugcuaauaaucauuaacauuuauugagccaggcacugugcuaagccuuuuaugggcagcaucucacuuaauccucccaacagcacuaccaggugguacaucuuuucccuccauuucacagaugaggaaaccaaggguuagagaggguuagcuccuugucuuugaucaaguaggagcacaaugaaguaaauccagugcucuuuuacuccagaaucccaucccugccuuuauugucauugucaugauagguugagcauuuuuagaaaacucauuuugaaaacugaauaugucugagaugcuaaggauucgaugucaaauacucuauuaucccugcuuuugacagggaaaggagauguauagauagaugcagcucucuuccuguugaaggaaaggagugcauagaaagaccaguggcuggaacucuuggaauguugccuucugaauacacucuuguagccuagggccauaggcaucucuuuccugcuuagugaaagugguucuuccccaggugccaaccucuuuccaucugugccucagcccacucaagccuuagcuaucuugaaaccaucacuccuuagauaugcaugguugggggcguugccccuaucuuuuccaugucacucucucuccuuuauuuccaauuucauugcaagcaaggcuaaaauuaaauaagacagauuauuccugaaccagaucacuguaucucaagagcuggaggcaaguccuaagaguggcaauccgagggagacuguggguccagacaaguguauucaacuagaucuggacucccaagagcucuauuucugacucacccacaguuugauaagagagucaacuucccacugggauaauuuuugagauuuucaguaaaauuauggcaauggaaaggaaaagccccaaguucccuguauggauaauuuauuuuguuuucauaguuucuaaagaaagcaauaaagaaaaaagaaaagacucuuacacuuuccucaguuuuagaaaauauuugguucaggcgaaaaugaauucaguucucucucucucucucucucucucucucucucucucucucucucucucucacuuuuccucucccccacuuccccccucucucuaugugugugugugugugcguguuugugugcuugaaaccauauucuuuggcuucagaucucagcuuaccaaaacccaugucucuagucuucuuguagucagucggcaauguuuuccuugucaacuccuuucuccaacacuuucuccucuaucaaaucucuuccauacaaaggggauaucaccagguuugcacuucaguaaaaugccugagggugaccaacuggugagaauuuugauuccuauuacuugggugaguguggggagguagaaacgauuuccauccccgcccuuuagguucuuaaguucuagcacaacacugugguggagacugauaacauuacuggagcauuuacccaguuauuccccaagauggcauaaacaccacagcacuggagcacgcacacccagucauucagauaaguugaaagaugagaaaaaugaaugauugauagcagcacuucucgcauaggguuagagagaccauuuggguuucuuuugguugcugucuucuuagaugcagugugugugcugcacuaacaaggcaaccgacuccccccaccccacccccacuucccacagucucuauccuagggaaagacgaaagauauaauagaggccgcagauuauuuacaguggcugagaauguaauuacaaggugcaauggcuugaaacugaaauguagguuagccauuagagcugggaaaagcaucuucacgguaaggacaauugggcauuggaaagauuugccagcgagcugguuaaauagcaucuccagaaaugcuaaggaguagggcagggggaugugaagaaaaauccaaauucaguguugggcucagguccagacucaugggcagcuuucauuacugcccagcuucccuucugauuauuuaauugcuaaucucuugaaagagauuuuuuccauguauccaaaacaagccuaauuuguuaagcacuagauaacaaaugccuuugagcacugagaaggaggcauugggauuggucccaacagccuccuauuggacuuucuggaauaugggccaacaacugaggcaguguuguuguuuuuauuauuucacuuacgcagggcuucuaaauccuuauauuauguaaguauugcaguuaaaggacaauuuguguuauacuaguauuauuuaucuugggggugaccucaaacaaaauuuggguuugguccauguuccauuuucaucuuuuacuuggucuuuacuuucuuuguuguugauuaaugcauccccuuuccugucccuuauauccuccgucucccuaccuccuggucuaugcuggaggagguucuuaagcagcaaggucauauucuggaguguugcauaucaggacagcacuugaaaugaauggcagaacacccucaggaugaaacauuuagacaacauuagguugacauuuuccuuuaggugagguagaaggggagauggcauauguguccuagggcugccacaacauguugccuucaauuugauggccgaaaacaaugggcccuguucccccaaaccugacaguucuggagaucagaaauccaaaggaaggcuauuaggcagcauugccuuucuaaagacucugggggaggauuuuuuucuuugcccuuuugagcuuccaguggcuccuuuucuguggcuauaucccucccaccucugccuccgucuucacauguccuucucuuaucaugugccuuuacaaagaugccuguuauuggauuuagacuccaccaagauaauccagaauaaccccaucuccagauucuuaauuauaucuuugaagacccaccccccuuuuuuuuucuccaaauaaggucacaaugacaaguuccaggagcuggacauagacauaucuuuuuaagaaauaacacucaacaaucuguagaugugggcuuucuaggcccucuugaaucacaucaucguaugggcuccugauacucaaagggaauuuguucaaggaauguuuaaaguagguugucagaugucaggguuuucccaagugggaugugcauaguaccugcuguuaacccauuuuuuuucacaugauuaaacugaggacauggggagucaaaaagucauuuuggaucaaaagaaaagaguuuugaagcacaauaggcuaccauguuauucagcauagauuuuugucuuaugacuuuggauuuuuuccuugaaaaagucuauuuucuuuccuaaacacuuuagccacaggaaagcaauuacugcuuauuaccaaccugaaaagccuuuucacaggaucugcgggaucaaggugauggugcacuuuuggugugcugcagcuucccaccucuuugugauuugcugcaauacuagcaacagggagauuuguaagccagaaacaucugugaaacaaaagacugccuuuuuagguacaggcucaaaauacagacauggccugcauacacagcgguuaauauaguuugugcagaugagcguuccacuguagaaacaguuucauauuuguuaugacaaagggacaaguugaaacauuccuggcuuaggaauacauacauacaucuauuuuucuucugaugggggaaaacuuagguguguaauaugacgaggaaguauagagagaucaccagaaugucaccuacugcagaguugcuucagugaucucugauaugacuauucaaauuguguuuggaugcuucaagagacaggagucccauuguugacuguucccaaguccaauagucagcauuuguaugaaccauagaccaggcuccuuuccauugcuuugcaacaaucccguuggcaaaauucugucuccaaaaauauuugcauuauaauccuuaacaguagcaaaauuacaguuaugaaguagcaacaaaaacaauuuuguggcuggaggucaccaccacaugaagaacuguauuaaagggucacagcauuuggagguuugagaacaacugcucuagaccaugacaagaaaugcagacaucgucaagauaaaguucuggcccauggacuugcacagcucauagcaggaauaagacaagaacaucaaugugugcagagcuuuucagcuugcaaaauauacuaucagauagacgcaaaguguauugaaacaaaucagagcuaucauaccuccuaggguuuauuuggagggaagggaaacauuuuaugaaagauguacaugagggagacuugguggauaaacuuuuaauagcugaaacagaggggguaacaaccaaagaaccaaaaugagcaacaugaggaagcagggcaugcauggagacauccauuuuggaaaucuuaaagacaaggcuauaacacaacagccacuggccacuaaagagccuugcaugggaccuugagcaggucacuucgucucuaaagcucagaugcaugccauccucuaaggaagcugacugucaggagauggcuucuggaaauacagauccuuaguccuugcaagcaaguugacauggagcuguugccuaccuuuuagaaaagauaaaaaucugggguuuagagaauggagaauauaaucugcugcuucuuuuuguguccucucaguaccccaucuugugcaguuagugaacacuggcuauucugugcuugcaaaauaucagcucucaaggccagacccuuagagaaaaaccaggcccagguuuguaaaggcaacuugccuaacucacagcucauuuugcaacagagcagaugauaacacuugaucccugaugugaaagacucucuuccccaacggugugaucucauugugauuucauagagaaggaagagcugagcccuuagguuuagacuaggauauugaaauucucugcuaucacucuggcucacgugcuugaagauugcaucucaaaaauuaaaaagaaaaauuauccaucuuuugaaagacaggaucucaaauacuuaccuguguaguauaauaauuagggagucacuaggggagacggugaaauuaccuuagcuaaauuccucuggaagaaaucuaaacuaaaagaauauucugcauucaacuccagagugacugccacaguucuucaguccaacucuagcuucauucuccaauucaauuuucauuacauuaagggcuuugcuaccauuuacauagccauggauguguguguguaugaauccuuucauuauuguaaaauuuauccuaguauuaucaaugaaucugacccauuucuuuucaacagaagucuccugacauucuggcauuaccuccacgugaaagggaagggcuucaaaccacaaucagucccuugagguacaaacaugagucagugaaaagucuuucccucaaggaacuaaaguccacagaaggcagauaaauauaacugugaguccaguuagaaugugagaaguaucaauaaaaggugggacugugucauguaaauucaaaggucuaaaacuuuuggagucuuuuucuuuaaugauucauauaugugagugaguacauuguugcugucuucagacacaccagaagagggcaucagaucccauuauacaugguugugagccaccaugugguugcugggaauugaucugaggacccuuagaaggguagacagugcuuuuaaccacugagccaucucuccagccccuggagucuguauuuuucugcucacaagaacauucucuaccaugggacuccagucuaaagacaacuagggauaaugguccuacaugacuccgccuuagcucuccuuuccauucuagucuugccagguucccuagagugccgaacauuccaccuacuuagagaucccccaauccuuugcuccauuuucuuggagaauuugaaagaaauagaaugauuugacuagaaauggauuguagaaaugucucugaccaauuaagugaagaaagagauaggcgccagaaguccacuuuggagguugugaggugaugagguagcaaugggaagaggagacucagggacauuuaaaaagcaggaacaggagcaggagcucagaguugagagcacaaacugcuguugcauaggaugagaauucaguucccagaacaugucuaaugccugacaguugacuguuuacaccaagucuagcgggucugacacccucuucuggccacugugggcacugcacuccuauaaacacacaccccuccggcuauuauauauacagauggagaaagucuaaagcagaauccguugaauaucacaauauuuggcuauagcagaugaagaugaacuaagauaucuagagugaucagaggucuaguuaggaauccuuagaauaaucuaugaacucuagggcagggacugugucuugcaacauuguauugcauugggcaugguucuuggcacaaaguuggcauucugugaaugcuggaagaaugacuuuuucaacagguggucagauugaauauaggccaugacuuugucuuuccagagugcaugucuauugaugguuggguaugugguccagaaagaaccacuuuguaaggaguguguuguaugugucugugugcaugcacgcgcacaugugggcaugcacacagaaaucugaggauuuaacuuuuccugggcauaaaaugauaggcagauaguuggcaguuggcaguacagauaaagguaguucauccuuuaauucucaagccuagagaauagcuuaucucuaggguugcuuuaaacuuccaaugcuccaguguaguagcgacauuuuggccugccuuuuauagaagcugagucuauggcagccucaggcauagucuuugauuuaaagucugagcucuugauauccaggugcacccucuacaaggucauguucuuucaggcuaacuaaccuucugcuggcuucccugagaucauuucuuuaucagcagagaucacuuuccccaaugguuucaaaugcagccauuucuuucaucuguauuccuagcuugauuagugagaaauuaaugagcauggaagauuugauuuagauaaugauuaauuaggggaaaaggugccagucuaauagcuagucacuauuauaugcuaaggaaauuaguuaauauuuuuggauggcaaauugacuuguccuuuguuaaauauacccuuuuaaaaugccugauacauuugauauauaauuuuaauaaacauguguuaguuuccuuacaagucaugaaguagccagguuuuuauaucauuaaauucuuuuguccaguauuaccucaugauaauacugcuauuuuauuuucagcacaguguuccuuuguuagggaaaaaaaacccacugcucauaaagcagaccuugacaaugaaaugugucaaaucaucacacauacucacauauauauggaaaagauuucaauuuucauuguuacugagcccugacgauuuuuuucuguugcuguuugaauaugcuguaucugcucuuagagaagcauaaggaucaaggucuacauggcaauuuuuucuguucuuuaugugcuauuuaguaugauuuugacaauuuauugucauuaguuaaaauuguagucuuauaaaauaaucaacaaauagaauauaauaaagguaauuagagaaucggaggacuugaagugaccuugagggcuuauucuguccauuucucaauuucaggcuaugugacucaucuuccuagacagcagucguugucauauuauuccccuugugugaaaacaucuaguuguucauuguuugcccgugguuagguccacaggucuuggccugcauucaagucccuucaaauuugggccuuucguacugauuaacuguagcuuacauugcagccugucucuggccaaguugaccuguuuacucuccuagugccucucgaaauccuuucuguccucuguguucuaacucaagccccauguccucuauugauggauaauuuguaaacaauaagaugcacccauuuuaagucaugacuuuugacaaacauguauaaacucuuguaaccacuguuucaauuaaacuauagauuauuuucaucacuucagaaaauguacugcauauuuugucacauaaccaugaaccaauuuaacuguucucuaguuauuuuggggugugaaagucuggucuccacaugaauuuaggcuucuuuuuuauuuguuuaauuugaauuaacacuuauuggagguuuacucuguagcaagaaggcuaagauauuuauuuaaucuaugaagcaaagaguguugguaaucccauuuuacagauaagggcaaaaaaacauauaaaggucaaguaagcugcccaggcuuucacagcuggcaaauggcaaggacuagccucuaaguaccuuaaccuauggaacaagaagaacuucuaccuguuccugcuauuaccacuuuuaauaaugcuggccuccuaucuuggaauaaaauccaauaggacugacauauucacauauacagagagucaugugcacucuccacucuaugcuguuaaugaugggaaagggguagaguuucuuacuacuucacagccuugguggaguuggcuaaggaagacuggggguagccaaaaaugucaggucuuucuauggaggcaacagaaagcgugaccuggguccaaugggaagaccuugggaugacugucaagaagguugagccgcagaugcccaugccuggagacaucaucagauguaaauguaaaggggcacguggaaaaggugcccaaauugagacuacaugaguagaacccuccaagagauaaagcugcugugcuacagauagcccuuuucaguuguaagaccccaaacuggauuccacuugcaagaaagacuuacgguuaaaauaauuagaaauauauguugcauacuuccuucaagugaaacacauauuuguguauagucaagaugcuuggaaauugcuuuuaugguauuuuccuaagaucaaaguuauauaauuauacagaucuaaaacugucagaggcaucuccacuacccugaucuuuaaauauaggcagacacauaguucuuguuagucuucucagucuacgacucucauuaauucaaaugguauguacaucaguugaaugagaucgcugagacauuccaaaggagaugagagucccucucugcucuuuaagaaauuauaauguagcugggcgugguggcccagcacucgggagucagaggcagguggguuucugaguucgaggccagccuggggacagccagggcuacacagagaaacccugucucaaaaaaaaaaaaaaagacagaaagaaaagaaauuauaauguagagaguacagcuauacuaugaagguauuuuuucauccuccaaaauaaaugaaaguuaguaacccuguaaugacuuuaguuauuauuuuuuagcauuugaggaugaaaguuuuuaagucuccccaaguugaccucccuugacuuauuugaacagugaagucuucuauuuauugccaugcuaggauguauuguuuaucacacuuuccauuuccaggugaauuucauucuuuacauaaaagguaugugaauauccuucuuugaaaguuuagcccaaaguuaguuuucugucuacuauaugggaauguuucccuuuuacccuuuugaaccucaugugcuuacagaaugcuucccuauuuauuaagucuuuuguucuuugcuuugaaaauuauuuuauguguguggguauuuuguuuugauaugucuguguaacacaugccuguaguacccauguuagccagaagagggcaauggaucuuuugaaauuggagaucucagacuguugugagccaccacuugggugcuggcaauugaaccugggucuucaggaagggcagcuaguacucuuaaccacugaaccagcaucuauaauaugucuuuuguugguggcaucuuaguucuucuauugaucuuuuggcuuuugccauuacaaguguguagaguauucucucaguguaucuccuuagccauuauuugccuuaggauuuacuugguauucauccuauuuuggaaucaguucuuagaguaauauuuuuaauuuaguugauggcauuccaucuaacuuucuucucaauaccuuuuugcuuuguuacuuuccugcaaaugcucacagcauugaagugguuaaauuucaguacuguuaguucauuuaggcaugaguuugucauacauugaauuugucaugaggguuuuuugaaguuugucuacagauuauaguaaauuuauuuacaacaaauuauuuuuuccauuagguauguauucccuuugauagggaauccuuaauccuuaucauuuaugauugucuuuauuuccuugacuccauagccaacccuuggucccugagacuaauuguucugguuuauugauuuaccaggcacuaauaauugaaacaaaguaaauauugcuauaauuucacauuuacauuuggacauaaauauacuuacaucuucauaauauuuaccaucaucccugaaaaguuuucauuuuagcuuuuauuccuuuuaaauguuuuuugcuaaccugaugagaugaugagguuucuuuuuuuucuuuuuuuuucuuuuauuggguauuuauuucauuuauauuuccaaugcuaucccaaaagucccccacacgcucccccaccacucccccacccacccacucccaccucuuggcccuggcauuccccuguacugaggcagauaaaguuugcauguccaaugggccucucuuuccagugauagcugacuaggccaucuuuugauacauaugcagcuagagucaagagcuccgggguacugguuaguucauauuguuguuccaccuauaggguugcagaucccuuuagcuccuuggguacguucucuagcuccuccauugggggcccugugauccauccaauagcugacugugagcacuucuguguuugcuaggccccggcauagucucacaagagacagccauaucuggguccuuucagcaaaaccuugcuaguguaugcaaugguaucagcguuuggaggcugauuaugggauggauccccggguauggcagccucuagaugguccauccuuucgucucagcuccaaacucugucucuguagguccuuccaugggugccucgcucccaauucuaagaaggggcaaaguguccacacuuuggucuucguucuucuuuaguuucaugaguuucacaaauuguaucuuauaucuuggguauucuaaguaucugggcuaauauccacuuaucagugaguacauaucaugugaguucuuuugugauuggguuaccucacucaggaugaugcccuccagguccauccauuugccuaggaauuucauaaauucauucuuuuuaauagcagaguaguacuccauuguguaaauguaccacauuuucuguauccauuccucuguugaggggcaucuggggaugaugagguuuguaagacuuagccaagggauaguguugccauacuaaauaacuguuuggaugauuguaucaauagcaaaucaaacuguugucaccauagcuuagaaucauucuuaaacuucugcaggcacauugaacaacauuucauuacuguauaagaucuuagcaacacagcacuuacuagaagaaaaaauucaucccuauuauuuuauuccucccauaaccagugcuagugaaaaugguugcaauacuaacagccagccauccuguagcuauagcucagccauucuacaaaacuggaaaugauccccaaggcaaauuagaaaaauacagagcuuucuuugucuaugacaauuaauuuuaugaacuuauguaaguucagagaguuuaaauacacaugauauaggcauugcuuucccaaggaaguaaaucaaaccuuguuaaaugaucagggaccuaguauauggaaagguuuacuaaauagaguucuauccccccccccccacaucuauguguguguuccaaccaaccuuguuuacauuuagaucagccacucuuccucaagggggcucuuuuccuucuugguccaguagacugaaucaguuuccacuccuagaauagcagaauguuuuguaauuucauguagaaagaacauaguuacaacuagccccgauuucuuuuugugucuguuugugacuauaaucauaaaaccuuuaagcauagacuuuauuuaaacuugguuuaaggcuuguauuugagauugagguuuauaggagauaaaucugaacuccaugucuucagaucccaacucguauuuugccauuaaauaucacuuucuuuccaguagcauaaauuauggugcuggauuagguuugcugauauguauuaucugcucucuccuuuacugcauuuguucccuucuguaaagggaagcgaagaacuuguccuuaauaccuuggacucaacagugaugaugugagaaacacauggugaugaauuucauucuuaacuuaagaaaaccuuagacacaugcauuaaggccacaaucaauuacaauuacucugaaacuugguguacuaacaugacaguuucuguuaaguuagggcuaacuagucuccccuccuuuauuaaauuucaaaacuuaaaaaaaggugccuaaaauauccaauaaugcuuucuaaugucacuaagauuuaaugaaccuuacuuucucuaggaucuuaugguguugggcagaaguuaugguccacauacauaguuuaucauccuggugauguugauuuauuacguuuauuuucuaggacuagggauauaucucucuuaauccauuuagaugaugagguccucuugggcagugucaauguuguaccuccaauauaugcuacagugcuuggcacauagauagcaguuuagaauggguuauuggaagacuagacgccaacuggacagguaaaucuaagccagcauuggacuggauguucauuaggauuauuaggauaaaaaauuguggaggaaaugaggggggcugcugaaggaggaugaaaugucauuagagcagaguacgggucuguccccccuaggaaggagggauaaaaaaggaaggguuguguaagaaacccccuagccuauaguguaaaauuaagaaacuuuucaaaugggaaccuuuacccuaggguccccugugagcaaaguucuaugguauacaggaccucauaucuuggccauguacaucauucaugaguugggagccaccccuaaggauuguggccucugcacacaugguagugaaaccagaaagcagcuccugggcuacuagucaauuaaucccuccaggaggagagcccacaugcauauguucauagccacauggcagguacuccacaaguguuuacugaagagagucugaguaaacgaggaguaucggcuuaugugugaguugagggguucgaucccuagucacccuuugccacaaacaaacaaacaaacaaacaaaaccagaaagagaaacaaaagccaccuuugcagauugaaaggaguugaauucaauacccauuaaguauuaauauuuaccaaugucuuggaggacaauugcaaugagauucuucccaccucugucuccaggcuucaguguugucuucuggaaaacaaguuauaaaucagagugguccuugcugcuaccauauuauguauaucacuuacuaacugcuauguaguaaacagcauaugcgucacgaguacacauugacaauuuggacauguacuccacaaucaaaguaaugaagguguccaucacucuaagaaauuuccuuuccgaucuuugugaucuuccccuuuguccucuuguucugccauccauccuuauacagccaccacuaaacucucugucuauagauauuuuccauuuuguagugccuuauagaaauggaaucacugggcuuggguuuguugguuuguuaggauguaccaggacuucauuccuguaugccauuagucccuuccauauuuguauuauauuuuauauaguagucaucuucacuugacauuuuguuucuaucuuuauuugacuguucuccucaagacuauaaaugccacgagggcaaguccauugguucauguauauuguuuuguguacuuuacacucauugugauuggcaaguaauagcaaccaaauaaauauuuguugacucuuguagaccuuuaguuaaaacgguaacaaagcuuugauugguauugauguuuugauuuuuuuuuccggaacaggaauauuaggcuggccagacauauauuucacucgaaaucauaacugagauuuuaaaaaauugucuuagguugugcucauauucguaaauaacaaucaggaaaaauaaauuaggagaaugaagauugauauuuuaaaagacaaauuaaauguuuguguugaacagcccguacuuggugcugcuauaaauuaguuucuguagaauuuaugagucagaccucagcaauuagcugacaguuauucaaaaggaaucagcgaugagggcaauuggaugaauugagauaaacaacauaaucaagaccuacuguauuuaaaaagaaacuuguuguuuuguccuguuuaauuuugugugugugaguguguguguguguguuugugugugugugugugugugugagagagagagagagagagagagagagagagagagagauuuucugcuuacugaaacaugaauaccuuauuuguuucaggaucagauuugcaaguaugucuccccaagggcccaacaugcugcucaagaaagauggaagaaaaauaccaacuaacagcacggcugaacauggaacaacugcuccagucugcgaguauggaacucaaguucuuaauuauucagaaugcugcgguuuuccaaggugaguuugggggaucauuuucgauguacuguucaauggcaucauuauuugggcacuaggcuuucaaauacuaaauauaauuuauaaauuaccauuccagcaugcaugcuugauauaaaaaccucccagugagagacccuggauaagaaacacaguuuuuaaaaggaacuucaauuuaaucuuugaaaaaguggauaauaggccgggcauugguguagcacaccuuuaaucacagcacuugggaaacagaggcaggcagguuucugaguucgaggccagccuggucuacagagugaguuccaggacagccagggcuacacagagaaacccugucuuaaaaaaaggaaaaagaaaaagaaaaaguggauaguauuaaaacucauuguccaagaagauuuuauuucccuguauauaaaaggcaaaaagcauugcugaagaaguccaugauaauuuuuucuguuugucuauuaagacuuuuuuuucaacccucacgaccaccaccaccaccaccaccaccaccacaacaacaacaacucucauaaauuccauagccaguuuucuuccagagugagucagauaccuguggaacacacacgaacuccuucugaccacuggggccauuuccauucaagaggaagcagcuggcucugguguccagccaguuuccaguuugugugcgugaguguguuccuccccucuucuuuugaaugucacuuuuuaccgugcuucucuaggaacugggaaaggaugggcagcaagugauuccacccuuggcaauuuacagggaaacuacagcagcacagggaagacuccuucagaucaaagaucaaguggagaugaugguagugauaagacuguacagaguaccaugugauuuuaaguaauuuacacguaucauuucauuuaauccucacaauccaccuaugggugggucuuuguuauccccauuuuauagaugaaggugcaagaccagaaugguuaggugauuugucaaggcuacccaccuaaaauuaauagugaaggcaagauuugaauccagcucaccugguguuuagaggugaugauuuuauccccuaacuuaggcuaccucuugccacuaggaagauuacuuguggauauggagcuucucuuccaucccuuccuuauaguuguauugggagguugcuguggacggcuauauacuugguaaugugggugugugcacauguauguacaugugcggaggucagaugucaaugcaugugcaucuuccucucucccgcucuaccuuuuauuuuuuuuuuuuugaaagaggcucucucacuuaaugugaaccuuaccuauucagcuaggcuaacugaccacuaagcuuuagcaauccuccuugguugcucuccaucuccagugaugggguuacaggcccacacugcuacaccugacuuuuucugugggugcugggucuccgaacuccuuacuugaccagcugaacucucccccuaaccugcguuucucccuucuaaacuaagaauacugaaucaacugccacuugccuuuaauguuggcuuggggucagagcuaacacuuuggacuauuugacauucuuaaguuucagauuaaugacaccuuuacaagaauuaaccuaugaauuauaaggugggucaauuauaccuuauuuuagguauuuaaagugaaauucuuagcauuagcuaaaauguuguucaaauuagcuaauaaaacauacauugccaaugguuucuugugucaaaagccccagggaauauugauguuagguucauuauaugaaguauaauacaaaagcgugaaaucuuuguuaaccuauuuaugcagugaggcucccgugaagcauuuguugagacuaacaauuuagugauagaaugaauaauucagaccaguuuaaaaaauacaugcaccauucauguacuucuuagauugguuuuggaguugauacacuggcuggaaguggggugauaaguaauguuacaagaggauugggaaaaaaaacccaagaggauuggguugaaguggacagaugaaacagucaaggcauggagguacuugaugagaauggaacauuagugacuucuuucgcuccuagaauaaccaagccccucauguucccuuucuaacauugccugcugagaugcaaugucagaaugauaaugcugguuucaaucuucagagcagcugguauugcugucugaggguuuuugucauuagaauuccuguagcuguccagucuugcgcuuugcauauuguguuucaggggacugaaacaguacgagacuagggacaaaaauaaguccugacaguguuuuggauugguguccagauacggcugcuauaguauagaagcugaauaguagccaacggagcugagaguagaaugcagagccaacaccuacuacuacugauguccucucucuguuucugucucucacacauacauaggaguagaagugugugcacacacauuuauuucuagaaucacagggacaggcagaagggcaacucuaggguuggagcauggagacagcaaaugaugccgacuuccucaugcuugcaaucuuacugucaugccuacuccuuuaucucuuuucauucugauuuuuuaaaaauuuuuuauuuuuagugugccucacuuuaaaaaagcccacaagagaaaaucaaccacaaucacagaccucaaggcauuuauguuaugcuuggagaagcauugaccacaaauucuuucuguaacaaacauuuugacgagggaaggcuucaaacaaggcaucagaacuaggcaauugcuacgaaagcugggcaucuauuuccuguuucucauaacuacuuauuauucccaugaauugggauugagggacacaauugguuuagcucaaaucuaaacauccaucccucaagauccugguagaccaaauuauugagaaaauugcccuacuacuuuguuuaugugaaauucgaugugguagcuuuugugagcuauuuccuccaccacgugcaguuggaguaagcuuaucuuaaucuuggccuagauucucaaucucuuuaggauucugucaguagcccagauugguggggguauuuuagcagggagagcacuuuggagcucugugcacaguuucaugagcaguccuuacugccucgauuuggauuuuaugucuuugauugcaggaagccuuugcccucauacaugagccuggggcccuuugcuaccgugguuggagugcucuaaugcuaaugcuguuuugauaaugauugaagcauuaaaaaaguuguucuuuauccucaaucuuugcauugccucguuuccuaaauuuaauuuacuuagaugugcuuaggaaaauggggcagcacaaucguuuucuguuucugcuuaauuaauucuuuuugagaaacuccacugaaaguacauuucccuuugcuuucuuuccucuccccuacuuuauacuaaugaggauaaagauaauggugaagauucaguaagugcuuacuguauggugcuuacuuuuacauaauuaucucauuuaauauuccuagcaacccuauggggccuguacuguaaucaucacuaguuuauagauaagggaagucuaagguaccaccgugccucccaagcaaucuauccuaugacuugguucuucuugcucucaggccaaacaaaaguacaaagcagugggauuuauggucccccugaagaaaacaugagauccaagucugacauuuuguaucucuaauaccuccucaucuucaggauuacagcucuguucucauucguggaauuucaucaugacuuugaggcuuacacuaccaggaaaucuuuagccauaugaccaggguuuuuaucaacauugaaugauuuuggucuuucccaaggugccaggugccagugacagagggagaaugggcuccuuagaaugcauuaacucuaugcuuuuacuggaaguugacugucccacagccugaacucuugaucagagcaagaaaccugugguuuagcugcaaacaucucuauaugaugucaaaugccacagagcuucuccuuaugcaguuagcucaucugagagcacccaggguccuugcuuggagccuacucuuguuauuaauucacagucuuuacaagcuucauuuucugacuuucuagcuauuaguggagaagcaauuggauggaaguguggcggagugcuauggagacguacauaggcccaauaugaagcaacauggaacaguaagaguagagagcauagaacuugacccaauaacucacuaaaugguaguuaggggcauuuauagaggguucuauauguauuauaguaaccccaaucauauagaaggcaauacaguuaguguucauaggugacugggaagcaaccugggaagaucagauuaaguucauuauccuugucuuaauacuuacaucuuaaaaggcuuaaaguaccagaagaaugcugaauuuaugccagugagguggcucagacgcugugggugcuugucaccaaaccugauggccugaguucaguccauggaacauacuuguuggaaggugagaaccuaguccugaaaguuguucucugaccugcacacaugcauuuguguguaccuccuaagugugaugaaaaaaguguuuuuuuuuuuuuuuuuuuuuuuuuuuuuuuuuuagaauacugaauucuaagucagaaaaaucuaguccaauucaagaccugcauuuacagcuuuggagauauuauuuagauuggauuauuaugccaaaucuauaaaauggggcuaaaauuuuagucauggagaaaguuuaugugaaaaugucuuacaacacacacacacacacacacacacacuuuauaaagacagcucuuuucuaucgacauuucuagcccagguggugcccaagaaauuaugggggccuuugaccucuuugaagauguacaucaugacauacuuaagcagccucugccacauuuagaugguccaguuucagauagcuccagugcaccagacccgccgguccucaugcuuucacaguuagcaccucccccagggagcccccuugacacugcccaggccacaccugaacugcauugucuauuacaguggaggcaaaggaaggcagagccccagggcugcuuggaggauuugcuuucuguggaugggaggagggcagcgguuucuuccugcuuuccuugcucucugcuggcuuucucguucuauaugcgcccauucuugucaguccugucucuccugguccccuaaaugaaacugaccuugguuaggacacccuuucccaucaacucugagcaauuucuucagucauuucugcuagaaauaacuagacucuuuuuuuuuuaagcagauuuaucuuacuucacaguuaauauguggcuaaauaauugcuugacugcugguaaacauguuuuaugauucuaucauuucuuaauuucgguuuuggugaugugcuggguguuuucagugacuacugagcaaguuuucuccauuucagaaauucccccuccuuaacuagcucugcuuaggcugagccccacugagucugaacuguuaacugcuggccacccugucacaccccgucuuuguugaaaacagugugccugagagaauaauuacguugacguuuaaucagaacuuaauucauuuguuggagcuaaauagaauaacauucaauugaaaagaagaauuuuaggaacacaaacccugaccaugagugagguuauauauccucaaaaaugucaauuauuaaucagcccacucgucgcucagcaaagcucugcuaaucccauuauaaaggggaaauuucucaucagaacacagaaggugcuggcucuaauuagaggacuuuuuauugcacuggcucaaagagguauuuugguuccgaaguuuaguuuuuguuuuuuguuuuuuuauguaauuguuuuaauuauuagggcuauuggaaaaaauuaacggaaaaccgaguguuuaaaguaaaucaguuuuggucuaagaacuuugagauuccauuugguuuuuaaauugcaguggcuuuagcugugcaggaguugagggaguugcaaaccuuuccugugcccucuuauugauuuaggaaagucagucauuaggcugaaaacuguuuaauaaaaagagcuuagaaaaaugagccagugugcaaguagagacgucuaaggucuccaaugaggugagaagauuaugcagaugagcccuuagcccuguucacugcagcaccucuuacacucaccaccacugcccaccuuuaucacuagcgugccccaccaagcaaaugaaggguccuucugccuucuaccagcuuccaggaagacucucacuuugccuagaguugauugcuccccacccugcccccccaccgggcuuuguuuacuuucuuaaaacauauguuccuccuccuuuuucugucucacugcguugcaguaccugauauggggguaaugaagcauauguuugagagauuucaauucuccugacaguugaauggagguagaaacaauuuuccucuaagcuggaaguggugauguugaaauuaaaaacacuuuuccuguggacugugagaugcuuccagggcuuagguccgaugcugccuuucuuccugguccuaccugcucuucucccauuuuuuucccccugcaucccugugcuccuuacccaggcucaguugucucauucaucaucugauguuguauuucaguuccagucuccaucaguucucagcuagaauaccagcaaaggcacagcugagucuccccuucuucaucgccuuugcuccccacuucugcaaugcagugcaaugguuauggauacagccuccaggccaggucaacuggccucagauccuucugaaugagagaaaauaagcaagcggauaugggguggaaaugauugugaguugcagggucaucgggaacuuccuucauaaauaggcaccgagagacuaagugagaaaagaagggaaagucuccugcucuaaccaguuucauuucuauuuaucuccuugaaaccuccccucaagccugugaaauugguagcuuguugguuucauuuuacuccugaggaaguggaggcuuagggaaauuacaaguccaaaguagccuagccaauagauggugaagaggaauuggacccaggaaggacagcuggagagaccacgcccuuaaguacuaugcuuuagccagacucccuguauuuugcuuugugguuaugggcagucauucauuucuaauuuucuuucuuucaagggaacucuguuccauuuuauuugaaaacuugcugagcaguaccuagcauguucaaaaggcaaguaucaagagggauucaaagagcuaaaugacuacauagcuaccaucagagaguucagaucucacaaagcaagacguuuuguacauggcuaacagggacagucagcacucuuagagaaaugcugcaugaaaagguuuacaguuuuuauaagguguuggaguggauccauauuugcugaggcuuucuacaguuuuagggacucauuuccuaaggaaggccauuuagaacacuaagcucucguaccucuucuggaaguagaugugccaagguggguccuuguagcucuuuucauuagcuucuuaggaaaucugccuccauagggauuggaaaaaaaguaaaaaaaaaaaugauuucaacuaguggcuggauauucuugauuaggguaggggaagauugucagugugaguucucuccacagauguggcuuuuaacugaagaugagagcacgugagagaguuagguaauucaucuuuuucucaaauccaaauuaucagucaucuuuuagauguacucuuccuagacuugcuggcugaccuugucaucugccacucauccuuuucucuuagaguggggacagggcuagugugccaaggaugugcucugacuuaagcaggcagcaguggaagugcagcucuguuagaacucuuuguguccaagggaaaguuccugcccuuugagccauuaaauaagaagggcugugaggugaaagguaugagggaagguauaggaaaggucuaugcugcccuuugcuacaaagccuagugauuacaaccaacucagacucaguuuagcuggcuuucaaugagacugaugauaguuauuguuuucuuacucuaucuuguacauugacauuuguaaaugcaguucuauauggaacaccuacuuucacuauauugaauggaauauaucugucacauacacauuuuuuagugcuuuuaaagcuuugauauaauuaaaaugaauauaagauuauagauugguauuuuagagcauuuuauguucauuuaaagaugguuucuucugaaacuguaccucucucucucuccuuaucccucucuaguguguuuuugugaguuucucucucucucucuguaugcgugugugugugugugugagagagagugugugaauguauucauguauuucuuuaagacuacaauuuucaaaaugguucccuaguggucugaacgagucucacauagucucucaaucuaaccuguaagaggaauaacuacucugauuucuauuggguuguauuagucgcauuaguagcaugacuuccuacucucaugucacaaaucacucugaacaaacuucaugcuacagggaugauaaucugugaggugggugacaugucagcucauccaaauaugcucuuguguguucuaccacauaagggaaaagaaagucgccuuucuuaaaugucucuuguggauccaccuucucagccucccuucacaaaggugcucuuaguuccaggaagaaaagagacccaguguguggucacuuaggcaaguaacuuuauguugaaugguaaguuuucaguuaucgcccuaccuuacagugugcuuccucacucucaacuagguuaguaguucuucuaauuugaggaccaugaccaugcaugugaccuuaccucuccuuagacuagcagaauaugcaggcuuuacagugaaagcacucaugaauucaaacacuccugcuuugcuuacuaguugcacagggcuuuuuacaaaauagggguaaugauugcagcccaauagaacugugaaaaucaagcccaaauuauggcaagcauaguuaccguuuugcuugcuauguauuugguccucaauaaauggaagccauuggugaagaaaagucuucucauucuauguuauagcuguuugcauuauaauaguacuuccuugaucaauuauaauauaagggaguuuuauuuaaauauaacaauuugaccaaauauagaggguauaaugguugacucaaguagaagguauaucagauaaauggugaacaaaauuauagagugaccauuaauuaaucaccaaauucucuuuaaauaagacaucacuguucauaaagaaaugaagaauuucaguugaacuuauuuguauguauuucuuaugggcacauuugcagaagccaguguggauaguuacuguugcuuauaucagugaugccuugaaaggcauuaaaguaaaacuuauucaagguauuugauuuuuuaaaaaugauuauuacacucucuuaaauauggccaguuccaugcacaaauaucacguauuuauguauuugagcguauuuccuccaaaccauucuauccuccacuuucaugcuuuuccguuaaccagucccccuuacucaaucauacacuuucccuccuauguuuuuguugucuucuacauacauacacacacacacagacagacagacagacagacaacuuuauauaucuguauaaaaucuaugacucacaaaugagagaaaacacaagauacuuguuuuucugagacuaacuuaauuaauuugauaugauuuauaccaccuugggguauuuaccuagaagaugccaagucaacacaucaccagacagcuuacuuuuuaaaaauuacuuuuuauuauauaaauaaaaacccacaaaggaagaacaaacuggagaauaaaauaucccaguucuaucuguuggagguuaauaacuaguaauauuuugacaugucuuauauaccuuuagucuguauuacauggcuguauguauauauauaaauauauaugcauacauguugauuuauauaucaauauauaaaucacauauaaguaacuaauauuaauauauaagauauauuucuaaauauauuauguugcuuuuauguaguauuuuaauagugucuuucaugucaauaauguaguuuuuaacacauaauagaaauuuaauuuguauucaguuaacaugaauaagauaaauaauguccaucuaucaucugacuaaauauaaauucauguccuuaauuauugauucaaggcaaauuccuggaacuggaaauuuuauguuagagguuauauaguuuuugaaaauuauuguaucuauuucauaaaguucacuuauauuuucacuuauacuagcaauguauacauguccauuuuucuaaccauaugugacuugucacuuuauaguaacuucaguuuggaugaaaaauaguacucucgucauuagggaaacuugugggucauuuuuccuuuuacuggguaauuuuuauuguuucaauauuuaaaauuagguauucauuguuccuuauuacaugccuauugauuuucaaaaacuauuuauauauguaggauaucaaaccauuuuauauguuauaaauugguuuuacugguuugauaauucaauuuuucauucuuugugaauguauaaaauucuuuccaaugcaccauuuccuuccucuguuuuccaauauguucuuuccuuaacaauauuaucuucaggaugaaucaaauauauauucuuuuuccuaccagcuacggguaaguaauuuaagauuaaaaaaaaauacgaagauuguagcgucugguccgccaaccucccggagcuuuugaagaugaaaagagguaauguauaugaaaacguuauugaaaacuugaauugagccuggugugguacuaccucccugaaauccagcacuugggaaggagagucacaauguguagggcagcuuggguuacauaguguaagucugggcuauauaagacccaucuuaauaaaaagguaauugaaaagauuauuguaguuauuuuuucccugauguuggcagucugaaugagcccauguccacucuacugacaucagcuguuaccuuuuuucucccugaaucucaaauauuucuggccaucauaauaggaaguaauuuugagauguaaauaaauacacuagaaccugugcccuaggaguuagaucagugcuuaguggcuggugaaauaucccuugccaccaaucucuuggccuaguguauaaauucuaaauauccuucccacauccucaacuguacguagagacccugaaaccacuguuugauguccucuauguguuuacuccuccauguucuacccaccaaaggcagcuuaggaaaccuagugguuccucacagagcacuaggugaggagaaaaucccauagccuucuauccacauaccuacucuuuggggacuugaaaaguaguacucuuuuggguccuugauaaacaguacucuuucuagcaauuaauauuugaaaaggauagaugugccuaucacauaaacugguaacuugaaauugucuuauggcacaaacugucuggaaagaguuuuuuguuggugaaaaacuuugucuuuuuuuaaauugugagaugaccaugauucucccuauccaaaaacaaaaacagaaacaaacaaacaaacaaaaaaacaaaccucagagggacagggaaaacaaaguauuuuguacauuaaacuaaucacuaauggaaaagccuaaguauauucuuucuaaccauuucuagccacaucugccagaugguugaaagaugaagaacuuaaaugauacauauggcaugucaaauguagcuauggugguuuuaguuuugauucaagaggaagaucucugaagaaauuaagucucuaggaaggucacaggccugugggaaguugaugagauuagacauuugaacucauuuggucuuuuggaaggaguaagaaagugaacuaagcuuacuaacaaucuacuauguaccacgaguaauuuucauaacaguaauauuaccauuaggcauuucccccauucuauagauguagaaacugggguuaagagcgauuaagggacccaaggccgcagcaugaguaggugguaagguaaccgcaugugaugaacuucgaaggcauugaccuuuucauugagcuacaguaugucucuuagagcgcuacaagauacagacgagauuccauaagccauucaaaugauuuuguaggcuuuugugaaauagaaagugcuuuuaggaaauuggacaacgauggcgaaauaaauaaaauacucccaagaauaggcccaaacuuauuuggcagaaggcuucaaauuccauugacaugaagaaguucccuguagggcccuacuauggugaauuaauuguaccccaaguauucuauggcugcauggaagucuuucuuauugcauaauaaagcaucgugcacacacccuucagaacucauuuuaauacuauucagccugacaucuaaaggggcugcuacccugacaaauacagucuggccagauguuauuauuuugcacuacauuuaauuucuuccugccaaagauuuagacuucuccccccaaaccccugauaaagaucaggggaaauugucugguauuuacaaaaucucauccaggcguaucuguuacaauguucacuuagcaagguuuauuagauuauuaggacuuuaaacccuugggcucuuuaguuauugaaauaaaaaaaaaaaagaaaacccaaacaucuucaacaaauuuaagugguauaauuagacccuggacuugucuuacaggcauuuuagaauuaugaaaaugauuuaacuagcguuugcuuccugagaaacuugcugaguuugacagggaugaaaggaaagugguuccgcugcuuugggccugggccuuaauggggaaagugauauguggaacugagagggauuuguagaguccuauggagaaaugacuccuguaaguaguuagcuguaucacacagggccucucuuucauggcuuuguuaaaacccaggcacuacacugacaggagcaggagacucuugucuuucccuagcucaugaagucuacuuugacucaccacuccucuagcuucuuuaaaugcuccuuuuuuuuugccuguaugcauuaaaguaaacauagaaagaaggcaguaguagaaaaguucaguaagugugagauauuaucuaucaauuaugauuuauagacaucacagcucuccucugggaauuucgauaugcuuugcaugcaaucccaguugcaagcagugccaauggauagauaguuggcgaugcuguugcugcuuucuucacuggauggguuuagacaugggaggcuugaggugguggcuugaccuagcccacauccauaacuaguggcugacuugggaacugaguuagcuaaugggauauauauguaagagugaaacuacaagaaaauaggcacaguugcccuuguucguuuuuagcaaguuggaugggcaggacacuuugcuucaccgagagaggauugcuuggagaagcucguugacgguaucccuucccuacgccaggcugagcuguuuuuuuuuuuuuuuucauugugaauuugcuugcugucuuacuggguucauuguucauuguuaaagcucggugucccagagaugacuuuugaaauaccucacagcuaagccuggcaguacuuggacuuucucuuauuaguuuuaaaguugcucagaagccuuuuauaugaaaauaggaggagugcaaacauccuuuuguacauuaaauauauaguuaauaaaugcugagauagcacaagugaccuccaaacaagagguaaauauuucguaaaaauuaaugcaguagagugaacucucauuaacucagacucuguucauuugaauauugugguaauuugacuuggacugaaguuaacuuucauugcauuuaugaagaaaacaucuacuaaacacauuaauaguauauauaagauugcaggagggcauguuuaacuugcuugaaggacuagagcaaacccauuaauuggggcugcuaauugcaaagagccuugcuuaccaaagcaaaccugauagagcuucaacugggaaacacguuuaucagccacaagauugcguuacuuuagguauggaaaaauaauaaagagcugauaauggauucuggaaggaauugacuuaguuuccaaucauguuauccaucuaaucuuacuauaacccuccauuuccuuaucaauaaaaugggggacaauaauacgacuuauggcuguugugaggaguaaugcuagaacguauugaaagcuuagaagauugccuaguauauaguaagggcuuagacuuagaaaagaauuguaaauuauaaccuacuaacuagacuuccuuuccuuuaacaaaucagaugacuaaagagcuacagaaaauacccuaugccugccuccauacccauccuuccccagcagauggaauuuagggcuuucuacaugcuaggcaaguaagguaccccugaguuauacuacaccagccuuaacguuguauuugaugauugugaauucugagaugccaucuguagacaauaauuacuguaccuggcacaaaaagagaugaucauuagaguuuaaaggcuuuucaauuucucaagagggaaauucuaauugagcagguuuuauaauuucaguugaccaugaggugauugaaguuuauuaugggaaccugaaaaguaccaagaggauauauguuugaugguuucauuauaauauuuaugguaucugucuguuugaccugucaauaagaauacuuuauuguauaaaucacaaaguucauuuuagaagcuaucaaauucugagaaacacaaaacaacaugaaaaccaccaugcaguguguaaaugaggcucaguguuagaauuccuacauucgaaucccagcacugagaauaaaaaaagacucacccagaguccuaauauucagaggugaccaugguuauagggguuuuguuguaguugauguuguuaaaccauuuucucugugcauaaaacaugagaaaaggagagagagugggaggauaucauacuugcagacauuaaaagccuggugauaaaccagagcaugcauguuucccucacuuauuuucaggugaauuaagauaaaauauuaauuuguagccaugaaaugcacuugaacuugaaaauuguguauaauuuuuuaucuguguguccuuuucagcuccuucuacugaggccaauagaaaugcagcacagagaauguggcuucaauuaucuucauagagccauuauaauucagaagggcuguguguggggcugugucugugugugcacccuuguacgugcuggguggagauuguucccuguuguguggucuagugaugagcauugaacugggacuaagaagauagggcucaugcucugacuccaucaugccucacuugauggccuuaagcaauuaaugucauuuuucuaggcuuuauuuuccccauauauaaaaugugguguuagaguggauaauuucugcagcaccucauagcucaaagagucuggaauuuaaaaaaucaaacgugccugucuggcugggagaaccugaggcucuguugcuaucuuccuagcaagacggagaggugaugaaucucaagugucuuuguugccagauagaccauaggcuaucauuuuuagccuaucagguguuugacuuuugaaagggcuaaauucuccauuaggaguaaauguaagagcugcggguuauuuaucgggacuuacacuuuccauuuauaacugccagugucaaaggcuuuguugacaucauugagucaaucagguaagcuguaaucaguuuagugacggcuaagucacaaauauaucaacuagccaaucguacugccaggaguucucuaaagcuugacugaauuauuuauuuuguuaugaugaaaaugucugggcuuuauuggguuuucuuugaagaacuugauucagcuugaagucuagaagauaaaagaucagugauugucuuucagauuuuuauuccaccuuccuuuaaggcuuuucauuuuucacaagccaaguuguuagcucuuuuaagucaaggugagagagcugcgauauuuuuuauccuagggguuuaaacauguggggaaacuuuugccuuugauuucuuguccuguuuuugucauggaggaacugucuaaccuucagaaaaccaccucacuugcaggagccucauuuucuucaucuauaaaauggaaugaaucccagucuugcugaagucucaaguuuugaggcucauuuaagauaaugcuagugcgccgggcagugcugguacacaccuuuaaccccagcacucaggaggcagaagaaggggcaucuuugaguuuagggccagccuggucuacaaagugagaucuagaauagucagggcuauacagagaaacccgguuucuagaaaaccaaaaccaaaucaaccaaccaagcaaacaaaaaagauaaugugaagguaucuuaguguuagauaaugcuaaugucauuuauaugaggauucauaauuguccuucagcuaaguccucuuaggucuuuuucagguuaguuagauguaacuuggaaaguuagacuuuccugaaaacuagauguucucgaaagguuaaguacagugcaguuuuucgaucagaauguaccuuugcuucacaugaugcucuuccauauauugccacaaaagaacuuguccuccaggggcauaaaaacuguaaagggauucagugaaauguaaaagaaaucacauucccccccuccuccucgucuucuuccucccacggauaacccacggaauccaauuaccgcuuccuguaugugcaugggcccuccacuguagcaugagcaaccuaccagugacuauggggggcgauuaugaucugaauacauuguuuucauguaugaaaauaccaagaacaaagcaaucauauucaacugaaagcuaaacaauuuucaaauaaaacaggagugccgccagucauuaccuaaggcuaaacagauauguauagauagcuccugaaacuccaaaaagggaagucauuuauuuugcuucaaagaugcuguggcaguuuuggggguaggauggagagggggaguggguggauggcaguggguggucagggagagaagauaagaaaaagacauuuuaaauauagcuauucuacacagcucuuuccaugccacccccaccgcacgcucguuauucuuugcccagacaucuuuaauacagacggugaaauuguaguagaaaugugccuuuguacucacaagaaaguuggguggccucucuaagccucacuuuuguuuucuuucuuuuuuuucccaccgagccauucagaggcucugauuaccagcacaacaggaaugaaaagagauaaauaccuaccaccacagcaaaacacaaaagaaggcagauuagaaaauggagaaguguggagggagagcacauuugagcagagcaacauggcugcuagagaggagagcauuggaguagaguacuguggggaugcuagagggaaggaggcccuucagguuuaccuauggaaucaguucauguuuaaucugggucaagcaugaagaauucccuugcuugugcuaaagccaauuugcauauacggagaauguacccaccgaaacugguauuuauuggaaauugaagagcugagcauuuucugucccugaugaggcaaaagcugugugugauugucagcaccccccccccaugguugugagguaacacgagcucagccuauagacaagccuuaaaacuauaccucaauaccucauaaauuacaggccugggaauguuuccgagcucugggaaccaccacaaaggucccuggagaacuuauggagugugaggccuuuucucaauuuguggguuaagcuagaucugcuugguacuugccccucccucucgccucuagcuccaugcuuccuuccauuucuuuagcacuuagcaaacuagaaauaaugcagagaggcuggggggauccugagagccacuugagagucucugucucuugcugccaccucaaucugucuuucuugggggaaaacauggucagcuuucuguagaagacuuugggacuuuaguucucuaaaccuuagauuuugcaucuauacaaucgaacaacuguaugcccaauacaaaugcauggaaagcgcuccaccgacugagcuacauuccuauccccaacacugcauuuuaaaggauaaggggaucuucuggcucagagcuuaggcaaaacagcauucugaaaaaucacuuuucuucuuauuuaaaaagauaaauggauuagcugaaguccaaggguggguuauaguuagucuucgaagccccugaaauucuguguaaagguuuuguauauguuauguuuuuuuuuuucaccaggggagagacagagagacaaaggcagaaagauacagagggggacagagacagaaugaauguauacaguuaaauuauguccuuaaaaaauagcccccaaaugguuaauaaucacagagcuagcugauucccccaaaugguuaacaaucacagggcuagcuagcugaucucuaaaacucccuucaacucuaauuugauucuaugaaaaaaaucuuagccugaaaaaauggauuuaaauuuaugauuauuuaaugggcucaaauaaguagucucaguuauuuuaacagcacuaaaugcaggauucucagauuuaauaauauucauuugaguacugauugcuggcauguucugcuacaacucaggcugcuacuuggcuugagggagcaacuguuauuugggguguucccccugacccuccccccccaccccugucuguuuugucagauguaguuauuuuguccucaccugugugacuuuuaggagugacuaguuuggggcuugcagaauuagcuuuguauaauuguuugucagcucagcacaauaaauuaccccuuaaggaaaucaaauagcaaccuugaagcucuagauuagcaccgaugaaucgggacuuagacugguuggaaacucacuguguguguucuuuucagaaugaagguacuguacaccauuuauuucucuugggaggugauacaauuaaaaugcuaacauccuuagcagcaagcucauucauucagcagugcacacugagcuuucuauuucaauaaagagaggugcaauacaaccauuagacggaacguaugggcuauguuuacagugaguagaauaaagagggggaacugucuuucaagucuguuuaagauccuauccauugcugacauuaggaacaggcugcugacacugugugugggcucaucuuggucuuuaggaggggaacaucuucccgccagaagaguauaguguuugggaaaagcguaucacugaguaggagguagacgguaacguuuauauucuaugaaggaauaacaagacuucucuugauuacugagcuuuuuacuaauuguugucuagggaccucuuccagugccacuauaaucuguuaauaauacugacaacaguagugagaauuucuccucacuuucugcuguauguucuuuaaucccugggggggugggauggaggguugugauacguucuucacuuuauggguagagaaagucgaaguucagcaaaguuaaguaucuuuuuuaagugcuaccaguaccaacuccuucuuggcuucuuugucuccuauagccaguggucaccaagucuuacgauagugcucuuuccucguaacuagagcuuucugcccacauugaacugggacuuaaaucacuucucaacugaugcucccaccucuaguuuugaaccuuucuccaggacaccuucccugacaacccacuccuagguagguuucacucuuugcugaccaauaguauuuugaguaucccugaucugcugaauucagaauaauaauaggcaguauuugaugcauauauagcaagugcuguuugaaaucuggggauauccaggaacguauauucucucagcaacauuaugaaguaaguagcuguuguauucuguuuuaaacauguucagagaucuguuuacagucacauagugauuacauguacauaaaauuaagcacucugaugaggcacgccguuaggaaaagcaaggagagaaugauguguagugacuggccuuaaaacaggcauuacuggcacauggcuuuggauauuucuucguaguucuaauuugcauagcagaaggugauaagcaaaaucccugacuucuacccacaagauuccaggaauaccaaaaauaucaccagucacuguuaaauggccuguggaggaggggccaacuucaccuauugcaaaccccuccccugaaagcucacauuugaaaacuggucuuuuaacucggauucuaguuuuaguuuugcucuucuucuguugaggcaaacuguggcccaugagauguuuuuacaagcucaccuagucuuuguuuuuucaguggugaccaaagagcagcuuacaagagguuuacugggggacuuuguuuauucaaucuaguuauucagugcuuucugauuuuccuguucuaaacaauuuuguauauauacauuauaugggugaauuugauagaaaagacugucaauguuuaugccgccuguaggcccuugugacucagugcuuucacuuaacugacuuuguuuguuucaagugccagauuugaaaguagucccuccacaauguuaaguguaaugaacucuuuauccauggccgcacaucuccacauucuaccaacuguggcuuaaaaauacuuuugaaauuacauuuuuacugaaacugugcccaagaaaucucuaguuucucuuugauuugagggaucagaacugagagaagcgucagcccuucagauaauacauuguccuaaguggacaaaaaaauauuaugaagagaguuucuuaaaaguucaucauguuggagauuccuuggguagagcugcucagauuguuuuuuccacuaugguccucuauugauucccaggaggcuagaugaaaaguauauaccuggacacagacacacacaugcacacaccugcuggagacaaagaguuagaaacccugaauccaucaguggaguagccagugauuacguuagaauccucacaauucagucaucuugaaauauucucacagaccuacagagugugcuucaccaauuuccuaggugucucaauuuauuuacuugaucgucacaauuagccauugaauacuauaggauccaguaauuuuccuucugggcauaguggagauaaaaaaucaccaacucauaaagacaucugcauuguccuguuaucuuaguacuauucagaguagcugagaugcagaaacaaucuaagugccgucauuagcccuuuucugucacuauaauaaaauacuuuaaaccagauacuuucuauaaagcaaauaaacauauuuagcuuacagauuuguaagcccauauaacacgaugccaucccugaagggucucuuauucauaucacgacauguggauggcaccaugucacuagcauacauaagaggcaaaacaucagauggcacaauuggaagccacagugagauugacauguggccaaacuuguucuuuuuaaacaacagucuuguaagaaugaccuagguuccuaugaaaaguaccuucagagaauagugugacaauaauuugucacaaauucucucuuucuuaaaacauguacaauaccucuuaauacucucacauuugcgaucaacaaaaucaaacuuccaucacacaaaucuuuggggggacuaaguacaucuaacuacuauagugcccguugauugcugaauggcuaaagauauaauuuaaccuuucaaaaggaagagaccuuggcagaauuaccuugucauagugcaugcuuggauuuggaaggugaauugguuagaugucucaaaaaugucucuuauuacuuucagaccagugcuuccugugcuccaagcaacuguuggguacauuuagcuuugcauacgguaguauucagcuauauuccuuagaacuuaggguagucacucucuggaugugacuucuccuuguguuauuuuuauguccuuaauuaaugggaagauuucucuuaauuauagaagaaaugcuucccucugauuuguguuuuguucugauucuaucucucgaacaauccucuuaaaauagguucguuuguuguauuuguuccuauucauauaaaucacucucucuauaggaaaacaccaaauuccguuuuugcagaaggcugggaaaucaguaguugacacaucaccauuugacugccugcagcccccacccucacuacaaacaucccagccacccaagaaaaguuuauuuagacuccccagccaaccaugcaaauaagacccccauggcuaaggagcucaguggaagaaaaggcccggauuguuugccacuuccuuacucuagguucagaaugcugguuuccauggggugauucacugaucauggcuugacuuucacuuucgugcugguuuucaguuccgcaaguuaggaaggugccuccauaauguuacaacaucucagacuuggcaagguccuuuagaagcauccuaccucuguucguuuccucuguguaucauauucuaaggaagagauuguuugguuugagaguuaaaacucugcugcucccuuagguagcugagacucuuguacuauacaggucacucuuauguggguaggcauccucucucggaugguggugucuacacuagcacaguguagagcacuguguggacagcaccuucuauggccuaucuccuguacuauggauucaggcagguaaugugaugucuaucagugcagaacuuacauucaagccacauccaccuuuggguuuugauacuuuauuaauaggagagcuuaugaaauuggaccccaagcaccugaguuuagaaguugguuaagugugucuuuuggcuucauguaauuuguaaaugggaucaguauagcuuuuaagcugcugugguaguguuggggaaaauguugaguagagcaggucuauuagcaucaugacuuaaaggcuuccuucuagaagguuucauuaacuuaguaacuaguaccuuugaacauaaacauucaaauuaaucaguggaggaaccagcuaaugguauucuugauagccuacagaagccugucuugaacauaaugguucacuuugcccuuggaucagguauauccagguacauucaaccagaggucuauaggcuucccguguuccaggaugccuauuaguucagcuugcccugauaugagauaacagugucauacagcagugucaaaacauuggauaucucuguuaggucuucuugaaagccagaaguuugucuguguaucccucugcuuuucagucuacucuuuuuuuuuuccauaaaaggaaaugcaguuaaccucaaauguuuuuuuuuaauaaaauauaacuaugcuaucuucugugaucaccuucuuuguucucacaagcacacaaaucgcccaauccucugcuggaugaaguguuuggaagucuugcuugagauuauuauccauggcagucaucaucuuuuucccucuaaggaauauggccagcagaugaaguuugguuuuuuuacucuccucuuuacacucuauacaccuuucuuuccacaugucuucucuucaccuccccccccccaguuuucuuccugcuaggcugacccucuccuuuucauuuccuuacaacacuacccuucaguuuuccuacguaagggcuacuuaguguaguaaugggugcucuuagccgacacgcuuuugaacacugccgaaaucccaacaugugauuagaauggugguaauuucaagcaccauggcagguuauuaauguaguguggguggcuaaaaccuuuuguuuccuuucaaauagguggcugcccacuuauacacuccaugcguggcucucugccaauuguguugggggcgauuucaagccaaauugauuggcuaauugcuuguggucaucuggcuuuucagcugccuguguaacaucucuggagguaauuagcacuuccagaguuggggggggguaugugaauuggaguuauucauggucauggcuuuuggagugggggcagaggcagccaggagcuucuguaaaucucuuauuuuaaaugauuacugaggauugaugaguuucuuuaacaauuuuuuaaaaauauauuauggaggaguuugauaagcaauugcuuucuagagucauuuaaaauuggcaguugggguguauauauuauguuauaaagucacuaguaggaaauaacuucaaaaguguuggacauuuccuaaaaagugacuggaauuucaauuguagcacuaacacacauaguaggauguuuugcagcuaagugugagacuaaaaagaacagaauucauuuuucauucaauaaaaaucucacaccacugauacuucuaacagugacuccuaaauguagaaucaucagaucaccaaugugauuuuuuuuuucauuuaaaaauaauguuuacagggagaauggcucaugaguuuagagcaaauacugcugucgcagaagaccuuaguuuaguuccucgcacccacacuaggcagcucacaacuuccugugaguccagccccagggagcucuacugucuucuucauaagcacaaacauacccccacacagauacacacauauacacauaagaaaguauaaaauaaauaaaucuguauaguauuuaugugggguuugcagggcagcgaauggcugagcagagcaucuugggauucuuccauuuccccccacaaaccuggcaugcguuaguguccgucggaucccaccugugccagugaaaggaaggccucuccgaaugucugcuuauuuugacuguucccccuucacacugaaaugggagcugauguucuuguauuuggaugauacgcuucugcauugcaaauaaacaguaggcuuggaccacugccgagcauagggcugggaagucuuggcucaaccagcuguuggauuccaguuguucucaggcuauucaggguggucuucuuugaccugcugacuggaguguacagacuucaucuuucuuuuagcauagcuucuuuguaucuuggguuaguaggcuuggcuaaugguagaauucagggaagguuagagggauaugauaauucucucucuucccaguguugagguguucgauccucuaguuuucagguagggaugagcgggcuuuuagauaagaaacguuugaggugauuaucucuugaauucuaacauaaggcaucuuaugaaagggacagaagugcuuagccugucuuucccaccagggcuucuaacuugcuuccucagcuuccuguuuccagcaaguuuugaguuuuacuuucacuuguuuucucauucuugucucugacgcuccaacacuuacuuucaaugauuguguuuucugaaaguagauuaaauuacacuuuguuggaaagaaaaacaauugcugucauagaugugugugugugguguaugcauauaucuguguguguguguuguguguaugcauauaucuguguuuguguaugggguguguguauguguguguguguuaaguguuuuagguagcccaugugaaguuccauccagaaguucuauugguccucucaguccuaaaacuggauucaaauauuggcucuacaucuguggucuugagcaagaauauaauccccuuauuuuuauuugacaaauuaguuuaacauaguucaaccuggucuugaacuuaguacccuuccuuaccaccugaguccaaggcccuuucuuuaaaauaggggauaauagaacggucuaucccaaguuuaggaucaaguccauaaauccagaaaagguagggagaggguaguggcagcaggacuuuuguaaccagucuauuuaguuccuaggagcagaccaaacuaggaaagugaagguuuuguccuuguaaggaaccagaauuugaccgggacgaagucacaaaccuaccuagccacaaaccauuucuguuacuagagaacaaacuacaucuuuugaaggugggguaggagaagcaucaaucaaagagcugucuucagcagugugaagugucaugagaauaaacagcugcucccuccacugcacagccccuccugcuguuaaaugacucuagggaagaggaaaccagucaucaaagacuucugcucccugugcacagcugguaauuccucaggucaccccuauagugacuugagcaguuucuagcaguauccacugguccaagucacugaaacauacauugcaaugaagcccagggacuucuuuuugacuccaucauccauccaaggagcaugagagugccugugagcugggccacagcuaguacaguuuguaagugggacacacuagaucgucuaugguuauuuugggaacuauaucccuugagagauucagggggaggaaaagaagaaggacuagauguucuuccuuccuucucugaagaaggaagaagacaaagucauuuccuuugaccuacuugcuuccgagugucagucucucaaggcacccagguuuuucuuuccagccagauuuaacuuuuccuaccuuaagcuggguagaagggcucaaaaauaaagcuagguuuguguugcaaguggggccgagaagcugauaacucccagaguucuggagaagggcagggacgggucugaaacugcauaauguuugacugagagugguagacaaagcaaacgacaacagagauucuggaggagaggcaggguggucccuaaguagaugaaguuagcugaaaaauacuaacacaacauggcugaggcacaucaaagaugagcacaauacaauguaucuggguacauagguuuaguaagaagggauaaaagguaauuucacaggaagaugaagucaggccuaggaucagaauuuaagucaagguugguaugcucaaauuucaagagcuauaauuaaaaucacucauucauuaccuuugaagaaacucuuaaggacagaguaguuuaaaucauggacuuugguguuaugaaggacuugggcuaaaaacucugcaucuuuuguuaaguuuuuuuuuuuuuaggccuuucaauguuccucugaagucacauguucauaggcucaaagaaugugugcugagcaaauuguuucugugguccgguggauguguccagcaagauuuggauugcugauaguaucuuuguaccugaaaguucuaagccauuuguuucagugcuugguuuugucuugucuaagaggauugggcagguuaccuggugcuaucuugauccaagguguaggagcagagauucagcugaaagggacaggaggcuagggaccagggaauaaaagcauuauagauacacugggggcagggagagaacucugagauaauugaucuugugaaaaaucaggaaaacugaaugcuuucacuuauuaaaacauuggugucuuucuaugugcaugccucuuaauacuaagagccacuaagcuacaagaaaagcugaugagauaaagaggcauuugaugaauuuugagugaggccaaguucaaugaccaaguaaaugcaaugcagaacccccaagcaugagaagaaugaggacauuaguggucaaucugcagaaacccaaguguaagugggaauuuaguuuaaauuauuguaccaauguuaauuuuaaaaauuugguaauuauuuuaugauuauauaaaauguccauauuaggggaaguuggcaaaacaaauuuuuaagcccuuugcgaauuucaaauuauuucaaaauaagcucuuuuuuuuuuuuuuuuaauuaagaggucaaacucugucccuuucaacugccauucauuucauugcagggugucuaaggacaguuuugagaauacauagaggacuuuagcacuacauauacauuugagcucugcccuuucccccuuagaaauauauuuauauuuuuacacgcucucaaaacuuccccuaaaugugauuguuaauauguacaguguguuuaaccagccccuuucagaugguuuccaauuuuaugcugauauaaauaauaccacaguccaucuauauacacauagcuuuguuucuuuuaaaauugagaccuagaagugaaagaccagugucaaggaagauaaacucaaaagauccuaaugccuaacaucacaucaugcuccagaaugaagccaugagcagugugcuugagccugccucacugcccagcuaauccacauaggcugacaaauagaagagaaugcucccucgugcucgcccauccuuaugcgcuuguuuggggagcacucauuucccuucuaugaaucucaguuuuaguucugcaguggauuuauaaguuugaguuuguuguuuuuuauuuaaauacauuuuuuguaguaguaguuauuguuguugauuuuucuuuuucaagaaaaaguguuuaaaagcccuggugcuccuggaaugcacuuuauagaccaggcuggccuuaaacucacacagauacaccugccuuugccuccuaagugcuaggauuaaagggugcaguuuaaaaucaauuuuugucaaaauauaacuaugucaguuaugucaauuaguacuuuuuguuauuuuuucaguuuagcacaccaaguaguagguuucaugacggccuuuucaaauaugucgguuuacuugucuuccucuuuucaccaaccuuuacagccuccccguuacccuucaugcugacuccuauagcuuuccuaucccuuauugguuuuuaaggcugggcauauuuuccucuucccucucuucuacacuuuacuauuuuuucaguguaaaucuucaagaugguagugcauggcacacaaguuuuuaaaaauguaguaccuuauugguaccuuaaaaaaagaaaagaaaauaccuuucuagaucucucacgcauucucccugcuucucauauuuucuguccauccacacguccauccauccaucuaucuauccauccaucuauccauucacccauuugucuauccagcucuagauaucauucaacuugagacccucuugccucagcccccaacgugcugggauugcggcugugcuaucccacugaacuuuaagagucuuuaacuucauuucagaugaauguaugaaguauauggacaaauuaacgugugugugugugcguguguguguguguguguguguuuaauaccacuagcgagaggagcugugaaaauuagaggauauggaauuacuacucacaggaguuaggagaguaccaacuugaugcagucuggauuuaauaaaauucaccaucaccuaguaucgggcacuccacacauguaguaaguaguuucccacugaaccuguauuaguguauuggagacaaaaggguuuagaauguguuuggugcuaggaaugacauuuaugcuucaggcuuacucuacugggucucuugaacacagagaccucacuggacaccagugguucuagugcauaguauaacaguagugugcugguuuccuuuuaugccccagggacauaucugucaaaaaaaaaaaaaaacaacaaaaacaaaacaaaacaaaacaaaacaaaacaaaaaaccaaugaccaagaaacagaaagcaaacccaagcuacugcugcuccggagguaguucuuuccgcuuuuguugcccuucacagucuucguuccucucguauuuguaagucugcuuuaauagucuugucuuguaauuacaucuggagacaggagacagcaucuuuugauaguucaaguccuaacacauuuaaauugcccuccuaaugcuguaaaagagucaaauuauauauucugcuuugcacuagacagcaauaaaugucaaggugccauccacucugguauuuaacuccuugaugccaucuguuucaggguucuucccacaaacuauccgcuaccguuucucuagcuccuggcaugaaaggaucagcuuggaaaauaaaucuacuauucaaaacaugcuaaaaggcagaggcaguuuguaaacauugcuuuggaaagcuaggcauagcaauaaagucaaggacaggaaccugauucuguaaaggaaacauuucacuagauugucaucuacuuuauuuuuaaagcugcaauaagauguaaugauaaaaaggccaaugaugcauuucagccaagugauaugaacucuugcuaaaccaauuaaacugucaguauacuaugguuucauauuuccuauaacauacuaggucaccucaggacacuuagucacuugugaauuuuuuuaaccaccaaugcaaaaucaauuugacaauuuauaaucuuauauuucauuauaaaaguauauuauccugcaagaagguugcuuggaaaauaaguucugaagcccguucacucaucuuucugcucaaauagucagagaggaauaaaaccaauugccucagcucguauuuugagacuucuagauggguucucauuuauaugauuaaagaaaagauguacgaagauguuaacaaucuccaacccuaguugcaaaucugagcauuggaugaaauugcaggcauuaaaacgugagaauuuugccugacaaguuuacuuucacacucauacaugcgcgcacacacaccacaucuuucuaaauguacuucagggugggcuuuagagacagggccagacuauucaguguuggcugaccugaaacucacuauguagacaagccugaccucaaauucugcugggauuaaaaguauaugccaccauggccaguaaggggaggcgguuuuaguguccuguguuugggguuuggcauuuuagcucuucuuaaauggaacgagagcacaugguuauucauauuuacuaccaccgcaguuuucagguugauuuuugggaagcugugaguuguagaaggcuaaaucagcaguauuugaaagagggcugggaaaggaguaaaggaaggcuugggggcuuuggacuguucuuauuaugaguuuccuuuggaacuccuuucccccuuucucuaggauaaacaugacacugcuuuugggaaaaaccaauggcaguaauaaaaugcacaugacagauccuuuguuuuaggcccucauuagugcaguagaggguaggucuguucucauaaacacaaacagcaaacaagagcaaauaauuaacauuggccauggagccuuuucuucuguuaugaacucaaugggguuuccuuuaacccucccacaaggcuauuaaucauacuuguaaaugcauuugcccccgaagcuuaaaucaguugugugccucuggcaacuguggcugcauuaacacuagaccauuuaaacuugagauuuaaacuccaaauucucuucuauuuuuuuuaagucaugguggcagagaucauggcuuaucuacucuauuaauuuacacccaguucauaauuuaguauuuccauuuacacaugauggaaaaaccauaugcuacucagacucuuugcuaucguuacugcuucagguauuccuguuuuccauggcaucuuuccuauuugcauguccuuucuuagauuucagucugagcuacugaaacaaacuaaaggaaaagagacacaaagagugggaauugaagaauuaaaacaaacagcaucaacacagagucucacuauguagaccagguuugccuugaacuuaugaucuuccuggcucugcccacagugcauuuggcuuguaaauacauuccaucccaccugguuuuaacucauguucucagcacaagguuuagguacaggcccuugcaccuacaccuacauuuaggcucaaaacaaugcuguaagacaggccaggauguucuguguucacaggugagagggcggguaggggagcaggguggugggaggggauaggggacuuucaggauagcauuugaaauguaaauaaagaaaauaucuaauaaaaaaaagaauuugccaaaaguguaaugcaaggaaaugucggucuucaguguccaauuuaaacccuuuucccgagcuguaauguuguacaucaggagucuuugucauugcuuuagucgaguucaggaugggauuuagaaagugggcaaaugaacaauuuuaggcaguuuuuaaaauuaaggauaauagguaucauuuccauucacuuuaggaaauggaagaaaaaugcuaagaaaauaauuucccaauggugauaagacuagagacaacuacccuuugucuuuuggaacacuagggauugagucuaaagucuugagcauaccaaacaucggcuguaccacugagauacacucccagccaauacccuggauuuuuauacaacccaaaaauacauugugaacauuuccccauuuuauuauacagaugucaacauggguuuaauggcuauucacuauucuuuuguuaggguguacaaguaauauauuuuaccauuccaucuuaauaagaaccagacuagcaauuugagaaugucccucugaugucacaaaauggcuugucaaugugcuuaguuagaauaaguguuccauuaguuagauagcuaugcauauaaugugguguccuuuguauuuuuauuacuuuauuuuauaugaaguaguaguuucuaaaaaauaaccaaaaagcuaacuuuuaaaguuaaggggaacaacaagugccuuuucccuugaacuuucauuggcaauacauaccuucuauguggagucacugaaggcuuaaguugaaagguaauauuuuccuguauaucaguguuguggucuaugcaauuaauuccugaacaucuacuaaauauaauuuauggagauguuaguaauuagguuuucaaaagagauuuuuaugauguugaaauagcauaaaugcuauuuucacaaauaauuugauauaaaauuauauauggacauauauguauacacacacacacacacacacacacacacacauauauauauauauauaguaaauaagcccccaaaccuauuuuguuguuguugcuuuuaguuugauaggcuaacagcuaauuauuuuacuuauuucuucuuuucugaguuuucuaaaaauuuauagcaaauaugcacuuauaugugcuaguuaaaauaaccuuacgugaggaagacaccaauucaguauguaauggucacagguuuuaaaaguaaaacuuuugcuccuucaccaccuucuuauacuugacaacacugugaugaagguauuaguguucauuagaggagcuuauuugcccaagaccacacagauuggauugugcauggggguggggguugaacuuggguguuauauuuccaaagccugugugagauaaaauauacuuggcucaacauacagggagguuuauuuuuauauuugucuuaagagguuagaaacuaagcagucaaagcagugcugggacaagggagggacaggguugagggcauuugugcuggugaaaccugggagguccuuuggcgccagggguuagcccaaaggcccuagaucccugggguuaauaauaucuaacuucauagugcuauugugaggauuaaacgagacaauucauguaacgggcacaugguacaggcuugcucaauaaaugguagcuaguauuauauuuaggacuuugcuuguuauagggauuagaggcuucaagaagccugaggcaggacauguuuacccuagugaauccugucacaucuuaauaguccucaaacauuccugaccauucaaaugccuuuuauuugaaccuuucaaauaaacaagcccuaaucagcuuugugaacccuaccagcuuguucagaaaaaccucucugcuuuuuggggguggguggguggguggugggggugguauuuauuuacucacugaaaauagggacuuugugugauaggagagaaggaagacaugauugguuuggagcuaaugggcaagguuuuuuuuuuuuuugguguuuuuuuuuuuuuuuaaacccaagaagacuugauugagguaacuucuuuaagacucuuggagagucugagaacugagagaacaaaagcucugcaggaaggccaccgaagcgagcaggcucuccaccaagcuuuguauggucuucaauuuuucauuccgguuuugucuucucuucagucccuagaauagaguggcauuaucuugaagccauggagauuuaagaaacaagcaaguuuggccucucuuuguugagcuuaugaaagccauauuuagucuucugaggaauguguuuuucccuugggaggccccucuauaccugcagccaucagaaauuccauaguaaaagcccacauuuaagucuuuacggcugaagucuguucuugugugucuggaccagguccagcugucagacccagauauuauugacuuuuucuuuucuagugagugguuuacaucugcuggcuccauuucuuuaccacuaauucugaaacaccuuguaagcugacuccuacugccucuguauuaaaauuguacccucgaaggguuacaauaacugacuuuuuggcuguagucagugggggauuauuuuucuucacuucuuucuuaccccuuacuguuacuuuuccccuguuuuuugacacgacaugaauuucccuuucucucuuccccugacuuugcuucucuccuuugggacagcagaucuuuugggcucuuucucacucauggaaaugugacuacucuccucuaaaggaugcauucaguggugcgcucauggcuuuuuacgcuucauucaaucucaugcuucuagcuggucccuccaugcaacuaggucuucaguuccuacuucuucugacccaugcuccagggcugcauuuccauugcacaaaaucaacugggauggcuuuuuaugagccacacauuguauuauguucuuccugcuuaugaauguugauaacuuaguauuaguaacagcugacauaaggcauauucacagcugaucuacacauacacauguuaagacaaugacuuugaaaaccacuuuaacagauuauuagggaaaauucaaauguccauugguggggacaguguuucaucugugagccuuauuugcauaaugcuacaacacuuacaaguugaugcuauaaaagaucugagagcugacaaacuccaugucuuuccugugcacgugacagaaccaccaggccacaucaguucauuacgaauucuccacauuccaaacugaaugcuuuacuucggguauuuuuaugcugcuagcaccucugugaccauuuuguuuuuacagaacagaaaucuguagauacuaucauggucaaugggagcaacgcagaacauuaaauuauaugcuauucuugugaaguugggcaaaaauaauguaaagauucauugagaaauuugggaguuuugcuuggcaugccacuuuuuuucuauuaauuaugagucuccugaaucgcauuugccagaauggcaccauugagucaagaaaauaaauuuauucauauuagccuuucaugaauuuuccuuuuugugugcauuuguggugcuguggcuagaaccacaggcuugugcauuggguugugacuacaaguuuuaggcauuaacuugcucaugacaugcggguauucuagauuugacaaguugaugacuaaaacuagucaccacaacuaccaugcucaagccccugguucuagcuaacauguaugcagacauucucuuuccacucccaaguauagaugugacuaauucaucuucacucuauacacagugggucuugaaggccccugcauuugacucuuuugggaacucagcccuuguguccuacaaagaaauuuggcccgaucugaccaguagccaagguuaccuguaauggucuauucuccucagagggaagcaauugaauagaaggcuaauuacagcuaguuuagcucauacuuugcuaagcaauucaauugaaaaugauugcagugcuuacuuaguguucaaauugugugaucucugcuauggaaaugugaucugccguucuuuuccccagaagugcuucaaggcaaaucagucacaaacaagaaaaguuaaauaaugguacaaaguaguuuccaaucauagguuacuaaggaucauuaagaaaaaauuuccacuuagaaagaacauagguauagacuaagacgaacucugcaggguuuguaagccaguuguuccuagaaauuggugcuauugcucaacauucacuuacuuguuacuguuuucauucaaacauacaggugguuauacaccauuuuaaaaugcaugcuuugaucagcuaauaugaugcugggcaauuuuuaauggcuugaguuuugagugggggcgcuucugugaaagacaacaaacacauacaaaacauucagccccucccccuuuuuacuagcauauaaugugcuucuccuaucuguccuguccuaccugucagcuuuaccuuaugcuuuagccuggagcauagaccagggauaaaaugagagcaggggucaaggaagaaaugggugcugugucgggcauggaucucgcagaagagaugaggaaugguguuuugggucaagcaccaucugggaggugaagcacauaaucaucaggagucacauguucccugcaugugcucaucuuugaaaagcuauucaucauuuuguguauagcaucugcucauucucuaagaauuuucuuauuucuugaaauuucugauucuaagccuuuaagagacaggaauggcauaggggagaguauucagguaagaacauggucccauaacgcgauauccagaugucacugggaauccuugagccaauguguguugguucccauuaguaucucuuauaaaauacuaugaagaagugguauauacaucuacucuuuucaagauuguaaaggcaaugcuguuugagagacauguauugguaggcucuuuacaauguuucuaacacaaacaaauucaaaacacuaauuuuuuugguauuauagacacggucuuuucaauuaccuuguaguuuuaaaugcagaauaauucuuuaaauuuacuccugaagucagaaggcuagguagauggauuaucgaguucaaggucagccuagauuacauaguaagacccugucucaggaaacaaaaucaaucaaagcaacaacaaaaaaaaauuacuccugaaauguaacgacucuaaaggcaagcaggaaugucaguuagaaugcuaauauugaaaaaagcagaacaugaaaguugcccccaucauuuagguacgaguacaaggcaaagggucagggagacaaaugaacagcccugguaaucuguuuuugccaugagugcaucaagauggcuacauucgaucucccaugcuggaaugucaaauauaaauauaggaugucuugauuuuagcaaaaacauuugggaaguuucuuuaauauccuugugcauaagauugggaaaugugacagcauaacuagcaaugaggcaaaaucacagcuggucgaaugacugauucaaugucaaccuggaggaagauaucuuucaggaagggucacaguacuguuaguuuagcacuggccagacauucacucauuuagcuagcacugugcaccuacaaugaacaaggcacccuguuagcaacaacugugaggaacaaaaaggggcguccagauuugacucuugcugccacggagcagccuguuggucauaaucgaucacaaagacaggcuuuucccaaugcagauaacaaaaagccgggugguguauuuucuuauccaggaugacagaauccagauugcaaaugaucucaaccuguaggaacuuuaguucaaaaccuacaagaugaaauuuaacagugauagauguagagucuugaaauuuggacugaaaaaaauauugcauaugcacaggauaugagagaugugacuuggcagcaguuuaugucaaaaguucuuggggauuuaguugaucacaaguuuaauacgagccaacaaugugguggagcuuauuuuuucaagcaaaaacaauuuuaggcuguauuagaagcaugugugcuacucagaccacaucuggaguauuauguucaaguauagucaccacaguuuacgaacuuugacaaaguugaguguauccagaaaacagugaccaggaugugucugaaaaccaugucaaucaugccaagugagaaaugguugaaagaaagaacuugugauauucaauuuuuuuaagccuuucuuuuuuauccucuuuucuuuuuuuaguuuagauguuucaagucccaguuagguccucuugcuauguaucucauuuucugcaugacaacuacaccuuccccaguagauuaggauugcuuuaaacagaauagagccucuguacuuauguuacauccauggggcacaguucaccacacaaacuagaguggguccucagcagugcgagucaaaugacuuaguggaguuucccauggcaguagucuugaauauagcuggagaaagugaugaauaacuauuguaccugcuucuagugucacuaaauaaagaaacaaacacaacaaaccccuuuaaaaagaauucauaaaaagauguacaaguuuuguugaucucuucauuggauuuuauuuuggugucuaaugagauuugauagcagacacucauuucugcuagcugcucucuucagaaagccuugucuccaaaaggagcauuuuuucaaaauaaggaaauuuuggcaccagaaugaagagaugcaaagaaaacgagacaucauuuuuaauucccaaauuagaaacaguauguauguauauacacacacccacauacauacauacauguguauguguguguguguguaugaucuuccuugccaauaauggacacacucacaacucuuuuuggaauagucaucuggcaauguguauuaucaaggguuuggaaacuauucauuuuuuugauccaauaauucuucuuuagggacuuucuccuaagaagcaucauuuugaagaaagaaacaaaagucuuacgaacagagguguuuuauaauaaaaaauuggaaacaauaaaaaaauuaauaauagaggaguuuguaguuacauaaacugucagguaugcaucugauagugugcuguaaaucuuguaguuuccacagaauauaaagcucuguauguggcgcaauacaucagcaugaaugcaaacaucuagacauauguaggaaaaguucugcaaauucuucuaccacaaagucaccaguggcugcuuuucaguagugagcucaucaauuguuuuguaucuucuaaaauuucccccugaaaaugaccagucuccaaguacgcguccuugcauauguaaguagaguuguugagguuuggauuuguuuucuucucuccuauccuuccuucuuuuuuucucccuccuuuccuucucuuccuuuucacacacagcaccauaccucagauugauguugaacuuaacucuguagcuuaggcugagcucuaauuugagguccuccugccucagccuccugaauacugggauugccacaccuccuguggcauuagcuuuguaacucagguuuuuuuuuuuuuuuaaacacagccuuguguaucuccauugaagcuaaugccauuauauaaugugaaggaggacuacccaaacacauucagagaaaauuugcuuuuaauucaaaaucuaaauaaaauuaauuuuaauuuacuguaacucaaagccuuuguaaauauauuucaugaacaauuuuugaucaaggguauguuaaaaauccucacaaagaaaauaugaaaagagcaguaaugaacuugucaggcagcuuuggaggauggaaauguccccuguaguuaguaggcauuuaaugaaguguucaguggcuagcuacuggagggaaggagggaagaacaaaagauugauugugaugaauuaacaucaaauugcuugauauguaguggaaggaucugaaaauaugguaucaccuuguuaaaucaagucuguuuggcuauuuguguagugcccagaugcaucaaaguucuagcugucagacccuggauauuguaaaaugcauccauuacaaguaauuugcaugaacccaucacucugggcauucauugcaauccaauucucaacugccaucaaaauuucuaauaguuuccccaguauucuuuuaguuucauucaugugcuaucuuuccuaaaggaagacauuccacaagcauguuugaugcaaacuucaucugugaugauuuuaugucaauuuuugaaaugcauguuagugaagcuuaucucaucuuuaucuaaugcuggugguucuuaagugacucaauucuuucacaccaaaaaacaacaaaaaaaaaucuccccaaaacaaaaauaccaagaacaccacaggucucugaaauaguucuguuugccaguaacaucagugauuaccaguaucccaacaaagagaaaaagccagaacaaauuugguuuuauucugauggcaugaagaaaggcuggauguucaauaacugaaguuuuuaugcuuauucauaucuaguggcucugcuuuuaauuccccccccuaaggugcgaccaucucccaucuuguuguuggaguaaaggcagaguauuuuucucuauuguuguuuucuuauaguuccuggcccugauguugcuguugguuuguuuuauugcuguuucuggaaaucuuuagacuuugauguguuugaaugccaccucuacacuucccuucccuuucaagugcaccacagaguauugugcacuuuuuuuuuuuaaucuugucauuguucuuuuaaguacaggaugaugaaauuugccuguagugauaaauuagauuugaucaagucaucuagcauagcuuucuccuacuuccucaucaaaugccuauggauggagaugcauuucuuccacaacgaucuuauccauguugauaaugccuuugcucucucuuuuuggggucaccaaagacuucacaccuuucauccuugucccugcucccuguuuuccacccagcacuggcaucuuuccccacucuggugccucggcauacuauuuccccgagaauaguuuuagugcucuguuaucacuucccagucuuuguguucuccuuuucccuuagcagacaguauacagugcucucaaggaggagggcacauuucacagaaggauccuuucaugaagacgauguaaaugcuacagugacaacuugguugucauauaguuuguggccagaggaagaaaugacagaagaaauacaaaacuccagcaucucaacgaagaaaaaguaaugugugagagaagggguugauacuaaguucacauuacauaccaauugaaauccaguccgauguaucucaauccacaaagagcauauugagaagaauguaaaugcccauugaguuauuugaaacaguucagcuauacuuuucuucuggccuguagcuugcacugggagucagcagugcaguguucauacaguuguccaggccuuaggaacuacccagcuagagagcuuguccucaaaggcaggauaggaucaggcagucugguggcucagcuuguuggucuuucuugcucacauagccacagugcuuguuauuaauuuuucuggugccagagauggaauucagggucuuuuguaaauuuagcacccauucuacuauugaaguacaucacuagccuaaacaauuuccauguucuuaccacagugugugccacccaaccauuacccuauauuuugacauuuguauucuaguuguuugcugcuauaaagaauaccaccaaugaaccccuccuuauaaaugcaggucuucucuagcuaucuagucuaguuuuauuagacagagacuuggaucuccucuguagcaagcaggccauuggaaugggaagaaagggcaagguucagcaguagggguggacaaugcucuguacuagacaagaauuucuauauuucugguagucagaaaaguuaggugcuugacuuaagucccauagcugcccuuagaaaucuggagguauccaguucuuugcucuguaaauucuacuucuaaugaggaaagacauuuuucuauuggagaauauuuucaacauaaagaauaaguuuaauauguucaguaaauuuucauuuaaguuagugccuguuaaucuuuuuaaauuuuuguaguggcuguuaauguuuuuuaguacauguuugguaaaaaguuauaauuauuugaccuaaagcaaauuucuaaaucaaaugguagaaucuuauaucccauuguguauauaucuauuacagaaaucgugcuuuaagugguuuuuugauaguauguuauugaauuauucaaaaacacaaucauucuuuuuguuugauuuauuucagaagcagaaacaggcuugauucaaaucaauuucuggauaacccaugucauuagcuuuuagagcaauucaaagucacauuuuuaccaggaaagacagagaccacccaagucauaauuuauauugcuccuccuccucucccuccucccccuuuuagaaagggucgcauuuuucccuugcuguccucaaauucacuauguagucacggauggucuugaacuccugauccuccugucucuaccucuaggaguaggcauguaccacuguaccuguuuuauguaguuuggggcugggacgcaaagguuucuacauguuagacaaucacucuaguaacauccucagcccuuucaaaagugaauacuucuuuggguagaaguucccucugggaggcaauugguaugccuuuugguauuaauugcuuauuauuugucaucucuccugaaccuagaguuuuuagaagcacguuuuuccuccguguaguaacuguuacuuacaagaagccacggcuuguuaauaaagcggagggaucacccugagaccuuugaggcuuuggcagaguaaguaggagcccuuggagaauguuuguuaggguccuaagcaagaguuccuuuucugggauugcuuucucgcuugucauuguguuggaaaagcaucagaaaaggauauugauuucuaguugacaggaggauguaagccaaaaagguguuuaaagaagaugaagccuuguaccuuuuguuucaucuuuuuuuggggaggggggguucaagacaggguuucucuguauagcccuggcuguccuggaacucacucuagaccaggcuggccucaaacucagaaauccgccugccucugccucccaaaugcugggauuaaaggugugugccaccacgcccggcuuguuucaucuuuauaauuuauuuauauagcccuucuggaggcaccacaaauauucugucucuuaagaaaaaaguaccuacagcugacacuguguucuugguauuacuaagugcuucuuuauugaacacacauucaguuucucacaguucuugcaaaggacucucuacgugccagcuaaucaauaaaugcuugauuaaugucuucuaaaugcaaauuuaacauucaaauaaggaaguuucccagugcccuccucgucuaacacuaaauguguguuaggagaaugugugcuugaauaguugguacccauucccgugagaaaauuggcauguguguuuucugcuucuguguuuaaguuuaugugaaccuuaauaaccucuaggcuauuagucaaauuacucagaagucaccuagacuaucaggaucuuccgauaacaggcagacaacccauacgucuggaaagauguucagcuaaucauugauuauuccuugaaauagaugucagagagguacugguuguguuuacuuauacuaauagcucagauuugguuggccuauuuuaauuguccugcugucugggauuuccugaagaauacuguuaaugacgcuuuaggggggcggcuuuaauggaagaaaugagugcuggaguugcuugggaguggcuguuaaugcaaggcuccuggggugcuugaagcugggcacagaaaggagauggggacuaccuggaggaaguagccaucaguaaccauguguuuuuguagcauggguagauguggucacagaggaccaaggcucugcucaaccauuugugccuagauugguuagggauaucaugaggccaauacacaaucagcucugugccccauaccaugugagacuggagaugauuauaaugaaccagacauauuaaacaguuuauguuucaucucuagagacuaacacauggaagaaauaucccuacagcaaugaguagggauuucaacaguuacaauuauuuuauuuuauuuuauuuuauuuuuggguaaaagaccuuaaucugcaaacacuuaacaaggucaaacaaugagauggauacaaaaugucaugcgugugucuuuagaaaguuuauuaugcugagaagaguagacauacaaacaaugucaggcaguaccaggcaguaccagccaguuguuuauugacugguaugggcuucagaggaugacgggcuccccagggucuugagucagucagaaaaguuuccagauucuuaaguaggcucagaggguugaggaggauucacaugggcccagcauguggccagaucagcagaaauguccuuugcccucuaagaagugucagugucugaccucccuccaaaacuccuccaccaaacuugcuuguccauuuaauauccuuaaagcacaccuggucaguaauuagcucaaucacaccuuguuucagucauuacccuuggauuucccaacgaugagcuuaauccaucucccacauuaaagugaguaccuacaugacccaaacucagcugaacagaauauccuugucucuaguaugucaauuuaaugcugcgguaauuuuauugcaaagaaagggguguuggguuacaauuugccacccaaguaucuguacagaaauuguucguguauguuguuaaaaaucucugaugucaaagggcucucauuucuccugaacacuacuuuaucugagggaagaaagaaagggaaaugagcugaaacucggacucguggaauuuaaaacugauaagaucuaauuuugcucauucauucagagauuaguuauucagaguuuauagcuuauaaacguauugaugagagauacagccccuugcuucuaugguuuuacagggcuuuaguuugcauuuuaacuacacuucccucaccucugaccugcugcuggaucugauggcacaaacugcugguacauacgcuaugcuaccaaagugagaagggagaggggcaccuuuauuagaucagauuacugccagaugccuggaccgcucucacugguuacuguuuaaaggggaggggggggcacagaucugaccacgucuaggaauggggccaggugucuauacuaaggcaacccaacuccagaaggcuauaaaaauagcccccaaguaguagguucugauuucccacggagcugaccaauauaaauccacccgccaguuaauuaaaaaugcuuggagagaaugugcauccucugugacccaccuguccuugugaacacuccgugcuuacaaaugggaggcuaccacugacuguuucaguuucuggguuaggaaacacccuucuucacuuucacagcacucaggagguuuaacaggcaugugugggugccugaucccaguccuccggucucaggguuuauuugaggguaaaaugaucuguggcuuccaaagaaacguguacuuuccccacauguguucgggcuuccuggcaccaccagaaagcagguuuagagaaaccaccucaucuuccaugauaggaguuuccuucagucugucaaaauuugauacaaaaaacauucuuucucuaacuacugguacuaggguacuaugggagccugauaugcugaauuuggaucuuuuaguauuuauuuauguaaacuuaggaauuccagguugauagcccuuuucagauuuauuuucuuuaauguuaacgacuguuuuguuugcauguguguaugccugcaccaguugcccauggagccccaaaaaaggguaucagaucuccuggaagugaaaguauggaugguugggaacuacaagcauuuuuauggugccacuuggccuuuuucacaucccuuugauuugccccugccccccuuuuaugguaugugaggccaggcugucuggaauucacuaucuagcacaaucuugccuuaaaugugugccaauccuccuacuucagcuuccaaguugcugagguuagaggugugagccccacauaguaccugaccugccaaauuaacaaaaacuaaaaccguacacaaaacgaucaaacaaaaaaccuuagugaggaaaaacuaggcaguagagaacuugccuaacuugcacaaggccccaggguccauauuuggggugagggaagagaacagagagaaggggagagaaugugugagagacggccacuugucuacucagauauccuguuuucuuuuagggcccugaguucaauguccaguacuauagaaauaaaacaaacacauaagaaacccaaccaaacaaguaagguucaguguaacuggugucucuugauuucuuugcagcuuugaaugcauuuuccaucacaacagccuaccuauuaacagucucucguuguuagagcacucaaaagauuugugucagaaaagaccuucuucaccaguauagaagagugagacaaacaauaugguuucaauaugggguuagcauucuaagacuuacaugcacacaagguagcauaaaauugacuaucaagucuggaaauaauuuuacauacaguuuuagaaaaaaaaaauaggagaaagaacaauuuacagccucuucggugcuccuaagagacaagaagaauuccagagguaaaaaguaucucugguuccaagggucagaggcccaagagcuugaaugggaggaucaaaaggucaaggcauuugauagggcuguuacauucuuaugacaucuaaaggcaaaaucuagcuguaacacuugugguguauaccugaaggaaauuagucagcacacacagagauaucuacagacccauguuuauugcugcaguauucaugagagccaagccaaagaagcagccuacaugcucaucagcagaugaauggauaaagaaaauauguuaaacugcaacuucauucagucacaaaaaaaaguuugcagggaaacuaguggagcuggagaucauuuuauucauaauauaaaugagauuaaacaugaaacacguucauuuuaaacaugaaacaaguuuauguuuuuucuaauaugagaaaacuuguguuuaucacugucuacaucuaucuaucuaucuaucuaucuaucuaucuaucuaucuaucuaucuaucuaucuauagauuaaucaaccuguuuauccaucugacaugaaauuaugagauaagaggaagcugucuaaagggagggagaauuagagaggauaaugggguaagaaaauauaaaauaccaugcuacauuuauauguagaaucuaaguuuaaauacauacacauaugugaccugacagaaaaaugagggcuauguccaggguaagaucaaugggcugagauauaggggaaguacgggggaaggcaguauauaagcaaggcacacuauauuuguaugcaaaaguuauuauggacauuauuuugucuauuaacuaaacauuuaaauuaaaaaagaaaaauauaaagaacuucaaguuuuuuuuuuaaaauagaagggggagguggcugcuuacuuccugauauauguguacacacacacacacacacuggcauggcaggauugugaguauugauuagauucucaaaccuuggggauuaacucauuuguccagugaaacuucuuccguacaaggaugccacuauguaggaguuggaaaccuuccucuauaucacuauauugguuaauuuuagaacaguuuguuuuugauuuuugugauuuuauuuuuuagaaugaguccuuugacugaggucuuccuuaucaauugaagauacugaggaccuaagugggguaaauguagugggaaauugcaaucucuuggagaucuuuccuucccaauuaggugcuacauuggccuuauacaccacugagaaaggagaguuuaaagauacuuaagaaauacaaguuuauuguaaguuuaaaagcacgcacauggcucuuggacagaccucaaaccugagacaugugcuugcuauuacugaggaaaguaaaugaagacgcauggaaguugcuuauuucuucugcccagugucaugcaagcgugccuuuuacuuacuuuuaacuugcacacuguuagcaaagcuuuuccugauuagcugccucuucacccuucuuaguccccucugagguaugcaugcuuccucauaagcacaucuggagcaucuggccccagggauuuauacagguaccucuuuagcuugcucuuuuagccuaaguaugucucccuccagccaguguaaccuuuucucuuucuucuuuucuuuucuuuucuuuucuuuucuuuucuuuucuuuucuuuucuuuucuuuucuuuucuuuucuuucuuuucuuuucuuucuuuucuuuucuuuucuucuucucuucucuccuuccuuccuuccuuccuuccuuccuuccuuccuuccauccuuccuuccuuccuuuugauuuuauuuauuuuuuguuauggaguagcuacaagguugucaccauagaacuaucuuugagccaccuugaucacuagaaaaaaaaaagaaauccaagcauccuguuuggacagguuguaagcugugacauuagaccuuccugguaugcagaauggcuuucaucacucucccagcccauucagcaagguuaaaggucucaggaagguauuugacuuguggcucugauuugcccugacugcugagcaaugaugggucuuuuucuugaaccacuuaggaggugcccuugggagcagcauaccagagacaacuagaaaaggagggggggggaagaguuacauauuugaaaugaagagguuacccgcaggagaguagaauauacaccaaaggcuuuggcgguaguuuuguaauuugcaggcucugcucaggaagcaaaauggugcuguacucuucuuuuggagucaggacgagaaguugaaaaguauuguaauuugcuuuuaauaaggcccucugcagcugggacucagccucaugcagcucacagagaagggcuuuguucacagagacacuuccaaauaaucuauguguauuuauuuauucauccaagaauaucugguuucuauauguaaggcacaucagaucauaugaucucauuccccccucccaucuuccuaaagggaagacuuuggguuugaauuaagguauuuuuuuuuauugagucagggaauugcuguauaacccagguaauccaggggccuuagcuuagcuuccagagugcuagaauuauaggcucacgccgucacacuuggcuucuugaacaaaggucuguuggcuucaggccaagucggcuugcugcuuugccacaauugacuaauguacuaaagcuuuaugaggagacugugggcaagugucuggaagucccagggcuguagggagaggauugggguuugccauuuucccacagggaaguagcagagcgacaugacucuggacccacuucuaguuccugagguggugcuagcccagugucugauacauauuuggcaccuaaaaguucaugggggaauuggaugucacccucucacuccaucugucauuucugucucgcuucagaaucugaccuuagguguaaugacaccguagguucuuucauguuuagaauauguuucuguauagacauaugugcugcaugauaguguuuuugaucaacaguagaccacauauauaucugcggcuccagaagauguuauugcuuagugaaguuaguuaccauauuugauaguaccacuauuucauaguuuauuaccgacagaaugaaaauuuuaaacaauuauuauguguacagauauuuugccugcauguguguuuguguaccacauucaugucugguagucuuagaggcuagaagaggccaucagauccucugaaacuggaguuacagauaguuacaucucuccaacaccuucuccuaauucuuugagaguuucaugcaacauguuuugaucauacuccugcccacucauuccucccuccaacuccucacagauccaccccauccucuacuucaugucuuuuuuaaaacuuuugauaggcuaucucugaguagauuuccuugucuucugccucccaaaaucuuuccaugcccucuucugcaauguucucugagcucuaagguuaugggaugcauuggagguguuuuauuuauuuauuuauuucuguaccuuccccucaucuggucuccauggugugaccaguuguugcugucuauaaugaucuccauuugcuguaaaaggaagcuucuggcuuucuacuguaggauugauuacagacuguguagucuuauguaaacacacacacacacacaucuggaguuuugacaggaucuuauauacagcaauagcguguuauuuuuuaaccagagucacauuaagauccauggagcccauguuuaucaguaauucuauggcuagauagugaagucuaguuauuucuuuucuacuacaggaagugacuggaagcguaauggagaguugauuccggcucacaugaucugacauuuuaacauuuccugagcugcaggaugcuugagagcaaacaacuugacuuuuacugaaaaaaaaauugauuauauugucacuuucaccuagugaugggccuuuguaagaggacaaagguauucaagcugggaaaaaugagaugguuagcaggauaacaguaacauaaaggucuucagucuggaggaaaggaucucauuaagcauugauuaucagcaugguguuaagccuuuuaaaaaggcuuacuacauucuauggcuuuuuuuuucuccuguuuuucgagacaggguuuuucuguguaguccuggcuguccuggaacucacuuuguagaccaggcuggucucgaacucacaaauccgccugccccugccucccaagugcugggauuaaaggcgugcaccaccacugcccagcucuauggcauuuuuguacuaaguaaauuuaaauguguagucuauuuacaucauaaauacguuuuguguauauuauaacagccuaauauugccuuaggcuacauccaguucacuuguuuaaacagaguugaugggacaagcccaacugucaccaggagucagucacaaagcuaagcuggcuuguguguugacaugcaaaucuggaaaugaagucagcuugguccaacaagaauauggauaguucauucaggaacacuaggaauuaguuuuguggacaagagaaacuaaaaacaggagaaaauaauugcagucaaaccccauuuauacaggauauaaauucuaggauccuucaugggugccugaaaucgcagguuuuguacacacacacacacacacacacacacacaaauauauuuguauguauguauguaugaauguauguauguauguauguauguauguauguauaugaaagcacucuauggcucagacacccuuuuucccaauuucccuuuucaugguuucaguuaccagaagucaaccacaucucaacaauacugauauugucugggcugugggucgaugcuagguagcaauguaaaaauuuuuggcacagcaaaggaaacagcgaagugaagaacgcagcacauacaagcagcaugggagaaaguauuuacaagucacuuguuuaauacuggguuaaauauucaaaauaugccaggaacuuaguuugauaagugauaaaguaaguaagccauucagaaaaugcgcuuaugaagcaaauagcauuucucaaaagaaggccuacaaauggccaacagauguaugaaagaugcugaacagcacuaacuuucacgaagacaaaaaguaaaacugaaguuauguaucagcucagcaauuaauauaauagggauacuaucaaaauaacaacaauuauuugugaagauuuuaagaaaagggacgucacauuccuuguuagugggaauguaaauuaaacagacauuauggagaaaaaaguggaagugucuauagaaacuaaauuaggacuauuuuaugcuucuguagucucacaugaaguuagauaacuuacucaagaagguuuauaaaaaggcacacucaucucuauuuuggcauuauucagaaguuauauauccccgauaaaauuuaauuccauucagcauuuaaaagguggaugacuauguccuugugauaaauggguggaucugguggucacuaggcuaagugaaauacaguagguacagacaggcaaguauucugagcucuugcuuauguuuguaauuuaaaacaauugaacauaaagaaucaagauggaaaauggugggugugagaggcuaaggacgauuugggaugagguuagugguuauuauuuuugugagauagauggaauuaaugacaaauauuuuaaggaguggacaugcucaaauaaaucauuucacauucuguauguguaucauagcaucucaugaguaccucauaaauaucuacaauuacaagugucacuagcuacugccauuggagaagggugaauuuaaucucugaugagauuaagacucucugagccucaauuuucuuaguguuaaaaugcauguggcacuaguuauuucacagcagagaagaaaacagugcacauugcaguguggguggcauaguuucucauuuugaauugccuuuuuaaaauuuuuugccuacauuuaauuguuaaaauugauaaaacuaaaaguuugaaugcaggguuuggaaauacaguagugucaugaaauacugguagagccguuauuggaagcaauauaaauaucagagaauaaucaauuuaggcaacuaaccaaaauuugaagauauguacagccuguguucagcaaccguggaaaccuucuuauuuugaaucuguucuuuuuuugcuuccuggccauugguuauaacaucuagaacuuagaacauuccgauuguaaaauauaaggccuuugugacuuuuucuagaauucucgucagaauacuaacauucuauuaguaacaugccacccuccuccugccuggcugguucugaucuguuaacagcuugaaaacuugcuuucagaauuuucuugcauucuggguaaaagcaaaguguuuaguucuuaaaaaggauuucacuguauuuugauucuucuguauucucgauaaaugaggaucccgucuaagagaaauccaaauaauguuuuggcaaccuugguaaacauggaaggauagucuuuuagugacugaaagaaaggagucuaucuauaugucauugacgggaaauaacccugugcucuacaguaaauuguugcacuugauuaaauuaaauauuacagcaaucaucagaaacuaguucacaaaaaagugacugauaauaugauguaaaauuaaaugguuuggcaaguggaggauuuugaaauuaggucaaaggacaguguuuugaaucaugaaaauuuuaaugccaugguaggaaugccaucuugauagagaagggaaacaugcuacuauccaaaaugucugaauauuuaguaacaaacacaguccucauauauuauuacacuacuaaaacagguuccugugcucaaaguaaacuaaaugucagagaguaucuuaagugugagcagaaaguugaacauguaauccacaacuuuuuuuuuucuuucugacacagucaauaaagaauguaucuguuauagguacauauagcuuucaugcaccuugguuuauguugcacccugacagggcuuucaggugaaugucacauuguagcuucggcauaaaagccuuugcuacauauugcaaguuaaauuuaacuuggugguaggauggcaaaaagggccacuguguaagaaguuuaaguagaugcuugcuagagaguauauagaguuuugaucuggccaugguaaguugcauucugucuacacuugcagaaaguggaaggaaacgguuuagcagggaguuuugauuaguaguguuucuuaguaacugcuuccauaaccuuguccaguaauuguauuggaaagcaauacaaauagaaucuguaaguauugagaggucuaggacaaaggaacagucacaauaaaggcguuguuagccuuuugcaggauuuaguuuguugaauuguuagagaaaggcuuuagaaacauagaagcauccacacauacccacauuucugaauuaagaguagacauuucugaaagggcaaggcucagaaccugaugguucuagaacaaggggaaaaaaacaaaccuuacacauguguuagagucgacuaggcuaacugacugauuauggagaaucagaugucuugggucuaauggcacauuaucuugggcuguuuagcugccuucauucacuuguucacuuuccugucagauuuaacacccugugaucaucccaugauaccuuuuggaauguuuuagcagacacuagaacaaaagcuaaggaugccaucagauagauagcaucugaagccuacagcagagacuucccugcuuugcucaacuuaccuacuuguacauucccacaaauguauuugagaagugcuuugaugguuaagucagauuauuagucagucucucaaaggauaagaaugcgccuuccuccaucacaucgccugccucucagaaggacauuuucucauauugacccuguccuauucauuggucccuuucucuuugcagaacguguugaggaucacauuaggaguuaauggcagauccagaucuauguuauaaauucuuggcaggcuaagaauuugugagucuuucugcgacuagggccacaguugcuaggguacuuuucaaguucccaguaagcacugauaccauagggggaaauccuuguuaauucaguuggcaccugaaauacaaugcuuuaaaaaauaucuuguggcuauuuccauggaauucaagccacaucauuuaucuuuuguucugggggaauagcugauggugcacccaauaaaugcuuucuauaguuuagugucuucugggcuuauauaagcacugucuaaacuuuagacucaaaagccuguuuugcaccaggugagauggcuuagugggcaagacugcuuucuaccaagccuaaaaccugaguucagugcuuagcauccacucugacaaguugucuguaacuucaguaagcaugguacacuuguccccaugagugugugcaugugcauauaccgacaaagaaauaagaaagucacgauaaaaaaaauuagacuguuuugcauaauagcaucuagaaacaauuuuagucaaggacccaauuuaagccauuuuuacccaggucaagcuagagauuagagaaagguggcagaugaaaucaacuuaaggucugucaccaguuacaaaaggaaguaggucauuggguuguguuuauaggaggaaagagaauggauugcuagauuguuaucacuggagugauuguggaggaaggggagacacucauuugaagcccuggcccccagacuaaaggagcccagagugcuuuaaggacucacacauaauugaccaaacauuccacaggaagaaggccugccucuggcuacaucacucugccuugaagaaauggacgggggaggagggagagaggggagcauuuggcauccugugaagaccuuucuaaagugucuccagauuuuccagccucaguuucacaacucugccuuggaaacuggcaaaucuuuagaagccucagcaaacaacuugagagaaaguugcuuuugcaugucagcaagcaguaggcacaugcaguuuauacacucuugauuuuguauguggacguuuguuguuucggaacuggguaaucuugcuuuuugacaggacucuucuguggugcuuaauaguuugcaacaaauacuuccugggacacugaagagagaaaauaaaggauuuacuuccucucucgaucccguuaagaucugcuuguaagcagaggaagacauaaaaaaagcagcaacucacuagccaggagccgauaauguguaguucauucugguaaaacauacaugaugaucaacaugaaaacaaacggcuaaggaguuuucauuaguaucuaauuagaggugauuugguugcuaagugcauuuucuaauucauuaagaauuagguaaauuaaaugugauggaaaugauuuaaguuugaaaauacaauaccaucuguauuaauuuuaacuuaauggaauaaaauccauuugcugucuucucccacccucauccaccccuuuccuuccaaauccuaugugguauagaguacagaggcuagaucucuugucucugggaaucaguuggucaguggagcacgucugucuaugucaggagaugagugccagcgacaaauggugcaugagcacaugaugcugauggggguuguguaugcaccgcaugagaacagggaaggucccuugcaauacugugagggauucaggaagguauuuuagaauuuggaggggcuuaaggcuugauuccgcucuugauauugaauugcagcaugaccaaaggauuaacaaacgugccuuucaugaaauaucucagggcacagagguucucaaaugauugcaaauugguuaaugacuuaagaaaaaacacauuacuucuguaaacaggaaauuuugaaguauuuuccuaaaugugcauauuuaaagcauagaauuauaugccaugucaauauacacugaacucaaaagcaaagugacuuuaaaagagccugaaaauaagcauucucauuugggaugaugcuuaaaagacuacuacuaucucuccuacuuuaaauaacaucaugucagcauuucucagugacuagaaaaguugcaacacauuccuguuccacuugagguuauuugcaguguauuucuagcuuuggcuagaccacauucacaaguuucuagagaaacaaccacagugggacauugcgugauccucucuaccauccuuuaucaaagcugagcagguaggcuaggcaggaaggacaucaguguggaaugggcuucucuuuuucaagaaucaauaaucagacaugcaagcuuguucuaagcugguugaugugaaagcaguauggugcuucuaguauucagucuuugaagggugggaggggauaagagacccaaacggugaaaugucagaacagguuucccaucucugagaaaguggcuagaguccuuuagcaaccacaguauuuuccagugaacuuauggugguaagugguagaaaguucaagugaugucuuugaaguugagcaaguaagaaugaguuaagagugucugguaaguaugaggaagucaucccccgucacacucugucaggauauccaaucucucugggaagaccagaccugcuuuucuagcacaccagggucugauuaccacugaucucaaaguaagcuacagugcugauaagaguuguauuuauucucucucucacagauacgugguuaucaacauuagggcagaaaugucauucgacuuuugucuuucuuaggagacuuuuuucuuucccauuauauucagacuuaggaaauagaauagaaaaauccccauaaaaggacaugcuugaucucuuuuguccuuuaaccagcuuaaaguauguaaaaaaaaaaaaagaaaaaaaaaagaaaaaagaaaagaaaaggaaaaggaaaagaaaaggaaaugaaugaaagagucuuugagggaagcaagauaggaagaguugagucccagugaaugaagagucuaauaaagcuaacauucccucugggaagugaaggcugcagauuucuucccugagauuuuuuuuuuucauuuucauucaucaacuugcucgacugagcauuugauugcuagacuucccaauaccacuuacuuuggaauuuacauuuacaucgauagaaauaauguccauauccucaaaaugucagguaucaucgaacuguaccauaaaagcuuuuauucuauacauaggaugaaacauuaaacgcugugaacgggacaauuuccuuauuucauagaauacgggugggaaucuaguuugggaggcaaagaucuuaacccaaugcaaauauuugauuuguugauauuccuucccuuaaaacaacaacaacaacaacaacaaaacaaaaccucucucucugagugcaguguaagccuuucuugaugcggcugauuuaguccuagaaaaccagagcaguuuuaauguguaaaauaacaggucuuuuguaaaacauaauuuuuacagucuccuguagcaugcgcuggucuuaacuuucaauuccccaacuuccaucuucuaaguacugggauugugguaugacuuccaugcucaaccuugcaauucuggcuuuugugucucuauuuucuacauuuuacuuauauaucccaguaucucuguauuuucaucagcauacauagcguucuagauuuacaagagcccuauucuccaggaguuuauaguuuuuuuuuaucauuauuuuuggcacaggauucaugucagugaugagagaaauucccuaaaucuaucuucuuuauauuuauuuuuaaaagcucuuuugacuugacuacaacuuugugguuuugucuuggcucuggucauguacuggucgugugggugugguagcugggucauacuaucuauucuuucacauguuuuacaaccaagauauugcccagguaaaacaaaugaggguuuuuuuauugcagaguuuaauccaugcuauuagauaaagaaaugcuuguaaaaagaaaggaaacauuacauauacaucuuccaguucauauugucuguuugagaucacaagaauuaauuuucucagcauaauuuuuuaaauuuuauuggguauuuauuucauguacauuuccaauagcauaauuuucuuuagaaaccuccuauuuuugguaucuuccacaaccaagccauuaaagucuccuggaaaugagaacuugaacaucucuaacaauaaggagaaauuacuuguuccuguuuaaguagacauuacuuuuccaaauauacaauuuucuaaguagaauuaaugaagaaauaucauuuaaauuauuuucuuaguauaauaucuacacaauagcuuuuuaacaaaauaucaguauuugagcuuuauaauaauuuuugaguauaauuuuuuuaauucuacccaaaguuaacaauguuuagaugguuaggauguuaguuuauuugcuuuuacucucucugucucugucucugucucucucucacacacacucacacacacacacacacacacacacacacacacucacacacacauacacacucacacuuacacacucacacacacacucacacauacaugcacauguguuauacuuugcauuacuuuauaugcauuguuuucucauaguaguaguuuauugaaaauuuuaaaaaaucuucaucuguacgaaucuucaucuaauguagaauuagucacuuuucuuuaguccguucucuauuaugucuccacaucuagcaguuguuauuauuccugguuuguagaugcaaugcucagguggacagauucaagacucccaugauagaugguacugcuugucuuuggauucuuugaguguguucugcagucuuucuacucugacauauagugaaggaagcaacaaugauggauauuuaaugauuuagcuggacuguuugucaagcaaacauaauguagccaugacuuuaaaauaaauucacuucugauuauuaguauuaucuucucuaauauauagaaucugauagacagggaggacucacuucccaaaggcauucuuuuauauugucaauauauuuucugacuuucacuuaaaguauccacuauaaaaguuauguuuaacugagaaaugauagccuaaagugauuuuacuauuguuuuuuagucacuaaaaacugguuuauaguauuauucuuuauuaaauaauagucuucccaguuaagcauuaagacauugagaagauuauccugucaggauuaaaugugguuucaaacuauuguaagugacccuuuaacaccuauaaaaaguaccgaaacuuuuguggaagaaggacgaaaaaggcauguguaugucagggcuccaaaaugagaugugaugcagcaauuaaagauagguuuguuaaaugagguacaaccaaaggaaauauagaaauguuaauaaaacaaaaacaaaauuaaucucauguuccaaaaccaaacaaguccauacugccagcagacaaacuauauuaucagucuucauauuuuuuuuuucauuccacauagucaauuuuuagagaagcuagaaacucuggucuuugucuggagauagucuuuucaaaacugaauucaggucagcaaggaaccaugucuggacucuggccuuuggcucuuugacuuacagaaucaaugggauaacacuguuuugcucuggauuccuaaguagauagcaggcaaauuagaacuaaaacauccacauucugaaaaccaagauaacauuucaucuuacuugagucuguuuucuuuaguaucaccuuacccagggagccccuguaaguguuuaauagguaccauugcuucuggguuuagaagugcauugccugaagacuucuuauuguauacugauaugccuuugggggaaagaagaccuauaaguguuaacaggaucucuauucuguuuuugguucuugcuauugcuauuucaaaucacauuaucuuaaugaaauaggagucaaugucauaggaauuauguuguguuugacaaaagauuaaggaugucuaggaauuaugaucauguuacaguaauugccgaaaaugugguguuaauguuccucacuucaauuguuuuguguugauugaacaaccuuuggaauagaugguaaagcucaaugccauuaguaauaaagaucuaaaucacuuaauaauguuucugaauguaguaguuuuucaguguuuuagaaaaugacaauuuuuuaaucaaggugcuuauauugaauucaaacaggauaauagcauagauucuuuucuuuuuuuagcguuuuuggauagcaggaacuauauuuugaauaaguguaucuccugaaauuagauuuucgaggguucuucuguuauacuaaguaccuugagauaggaauugaaugauggagucacucaacccacaagcauuguugagccucuacaaagugucaagcacucuccuagguagugugugugucugcgugugugaaugugugugugugguauaugagaucaaauuuuuggagggacuuuauaguuugggugauagaugcugucuguaugcauucuauugaugaaauaauacaaaauucagugguugaauauacucuuagcacauaugauacccuguguucaguuucuagcacacauguguacauucaaacacacacauccgcgugcacucacacacacacacacacacacacacacacacacacacauacacacacacacacacacacacacacacacacacacgaaggacacccauugugugcagaaauaguagccuggcaaauucuugaggcaagaaaaauauaagguuguuaagugccaaaauccaucugggcuggaaucaaaguuugcauaaaggaaauaguauggugagaaagaguugaaaaggaaggcagaugacagccuucucuucauuucauuuuccagcuguauuuugagggcuguaugccgaaaacuuacugaguaugaauaaauuuuaagucggucucuaauugagagcaacacccaaggagcaaaaccucgagcuaaucuguacaacauguggcauuguaaaacaauccuucagaguguccugccuuaaacauccucccuuuagucucuguguauaucauccgggccacccaaugagcucagcuggaaaugagaggcuuggguuagaaaauuuugccagaguaauuaagaucucauuggaucaagcugaccagcugugugcuuucgagaacacuaguuuuuagugaagugauaagaguauguuuuuggggguauuuggaaguaaaauucauugaucaaaugaucuuauguacaagcccuuuaccauagacaugguuauccauaaauggcccacacuuuucuguuuuuuguuuuuugguuuuuuuuuaagcaaugcucuugaauuuuacucuucaaaucuccuacguguauuuugugauguuuugacugaauuggcagucaaccagaagucugggugauugcaaauggcagauggagaauaaguuauuuauaagugacuugaaugauccauuuauccguguauuugacuaugggugagucugcuuuugaaaaucauucucaaacuaaauaaugaagucauaaugaaaaggucugauuugugcugcugagaggcuggccugauuccugcaaccugcugcaugcuggguagagaguaaaaacauugccuguuguucaaccuguuacuuacacagcauuauucuaagugcuacugauguaucuaacagacauauuuuauucuauggcuugcagcucuuuccuuuuaguuugcuguccauaaauauagaaaggaccauauucuggggauuuaaggaagaaaagucagaugcuaguauauagaacuguuagagaaagaacuauuggcauaaaauggaaguauuagaguuuguugacaugaacaaaucuuugcaauauugcaagaaguaaagauauugaaacaaaacaaugauauaauauucaaugcucaaaaaguuagugguuaauauucuguaaguacauuauagauaggaauguaauaauaagcuuauuauuuuuuacaacuaauauaugcucagucaaacuaagcaggaugaagucccaccaagaaugagaacaaauaguuuauauggguaaagacugugucaugcuuuuuuaaacugugauuucaguauauugcggugaaucagguaagccagggaauauggaauaagaguauuguaaaacuauuccuaagaaagcaguuguaaacagucuugcuccucaaccaaagcugcagaauuguuagaaugaaaauguguuuugguacaaaguagaucuccacaaaccuuuggaugcucuuguuauugccucauccauagacuuaaaucaacucgguaucuaggagucugcuccuggaccacaagauucaaguaaaauuaauaccauucaauaagcuaucauggguuugccuuuuaagauuuauguauuuuuauguguauguguauuucaucuacauauguaucugcauaccacauauaugcagugcccagcucugaguccucuggaauuggagugacagacacuuguaagcugcaguguuaguccuggaacuugguucuuugcaaaagcaacaaguaccccugagcgcuaagcaaucuccccagcucccauccauuauggauuuaaaucucaugaaugucauuaacacugcuuggggaaaacuauuuuagacccuuaucauuucuuauuugagaaauguugaauuuuguggcauguuugaaacaagcuuucaucauauagcccaggacauccucagauucacuauguggguuaguguggccuggaagguucagugccccuagcucggccuuccaaguguuaggauuuuuuuuuaucaguuucccauaccacuacccacuuuuaucugguuuuagcuucuuucagcuuaccuuuguuuaguuucaaaaucuuccuuaucuugacuguauuaggauuuggugagcucuguuuaccuagucaauauucauuuuguuucgacaaacugauaaggccccuccccagucuuccucuguucagauuagagugccuagcuguaucaccugcccucaaauaguagacuucaccaacucucuagaugauaaaaucuuucccaagcugcauucugucuugucacuuggggucucagaauaguauguuuuaauucaggaggauaaagcacuuuacuuagguugcuggcccuguguacucuguuacauuucuuuaugggugguuuacagcuuugcaaccuucuuuaggacuucagggggaggauacacccauugaaacucacauaguaccaccuacacuuuuuguuggcugaccugucugggagccuccagcauugucugugggauuuguuuaguggcagaagcaugucaaggauucguguuuaugccuggcacugauuuuagucuugcauuguacuguaguaguaaaccucugagauggccgccuuccaagagccauuaaguaaaguuuagaaaaauaugugguagggguuuuagcugucuguuaccuguacaguuccugccaguuagaagacuuucacuagggauauuuuaugaggguauaaaaacuucuuagcaaauucacuguuuauuagguaugguguagaccuuauuucaagaaaccaguuuguaccaggaaguguacaggaaggggaagagauuucagcugucucugugagugccuuuucaauauguuaggcaucuugggcaguugucacuaagugagggaggcagcuauuauuaaacauuugugauugaggacaugaaguuaagcacuauaauaauaaaaaaugucuuauaucuugguaguuaugccaaggcaugucuauucuacuuugaugcuauuccugcaugaugcucuagaaaucaaugguaccaggagcucuuaaacccauacagugaaaauaaacaagauggauaaaaaagaagccagucaauaaacguucaguugcauuagucaggccacuuacauuguuaaagcuuagaaaugacacuguauuauuccucucuugucaucuguauuucucucucucuccauccaucuuguguucccaccccgccaaaagacaaaguaauauaggagugagguaaagaugauuggguggaagaggcaaucauucuaauauuuuacuuacuuucuuacuaacuguuugugauuaaaaggaccacaaauuauauuuauaaagauaagcaugucuuuaaauaaucuucauugauuuagggggacaucaagaugccccaaaaagcaauuaggcaggaaaacauagaacucgcuuuguucugaaagaagugacauuugcguuccuuuacagucccuuggcauuuauauagcaaaggaaaacauccaaaucucacaauaauaugugagguuuguagguacugggaauaggaagcugugcuuuuucuuauugucacguuuuguaagaugagaaaauuuuuguaugaugugcuugaagacauuaauguauaaaguagucuguuauguucacauuccuuagguauuaaagagauuggacgucuguuuaagggcauuauuuuuuucuuauuggcaccaucguuaaucucuuuuggaagaaauguaauguauuuguaccacuucuaugauucuuuuucuuuauuugagauaauauguacugaucacacauacuaaaggauaguugacugccaucaaauagaaucucuucauuccuuacauuuuauuuuauuucccuuuaaaguguauuauuuucuuaccuggcauuuaaaaaaaaaguuuuauauguguauauucagguacccuucaagguaccuuggaggaaccagcagggggcauuauauucucuggauuaggagugacaggccaccugauuugaguccugggaucugaacugagggccuuugcaagagcaggagugaucuuaagcacugagccuacuauccaucacucuugccuggcauuguuuuuuaaaucaaagccuuuauguuuuuacaggggaauucuuuuggaguacuaugcuuugguugugguuauuuauaucugacuggcaucguuggcagagaaagaacguugacagugagagagacugggaaaacuugcccuguuggauggguuaguguuaagagaaagcuggauauggguaugagaaaaugguggucaugaagagaaucaacagggcguggagacuggaagcauuauuuuauuaauucucggaagaagcacaguaauggcuugaguagaaauagggaaauuaacugagagcaguaaggauuguugaguggccgccauaggaagaaagguaaugaaucucaccuuugucauguguugaguuuguaauacgaaugacccacagggagaugaccaagaaagagucagaaauacagaugcagagcucucaagaaagguugagacuuaccauuggaaguagaaaagguugccaaacagaaguuuuuagggguuaaggaggaauccauaaaaggaauguucagaagauucaaauagacagcaaagacacacaggaagaagcaguguagacguucgcagagauuuacagaagaggugaaagagaauagagguuaggaguggccauuuuugaagucauuggugacauuugagaaccaacuuccauuaguguaaugagcgugaaagucacaaaauugaaggcgaggaagugagagcugacuccucuugucauacguuugacaaugaaaggaagggagugggagauugggucaagaaagauacauggaaucccaggaaaugcaugcuuaaaaucuucugucuuaucagagacaucucacuugcuaagguuggggaggccaggauugcauuugggacuugggauauuuaggaagaauuuaaagugagggaaagcauaaauaauggaagaaaguggcaaaguaugacuaaaggccucgugaaauaucagccaggacuuggguaaaguuaagcugggugacugguuuauucuacagaaauggcaaaaacucaugacuuccuccaauaucgcuuggcagggaguggggacaauagucaugaaaagguggaguagaaaauucacagugaggaguuauaaaagggggggguaaucaauauuggaauaaaaaaagugauuacuuaacugauacauuuucucaccauucauucccuuugcaaggaaugaauucucccuguccauguggcuucaagaaguguucccuccaccccuuaacuuauuguuagagugaugacuagcccaucauuauggaaaaggcagaguucaguugccaugugugagauucauuggagacauaugggacagaaagugcugauuaguugcccaggacucagaacaaaggagggagaauuuguaaccuccccuggccagcccuucgaaagugcacauuucuauucugugcugguuacaaaaggaagcugggcuaauugccucuugaaauguguuuguguucucauggauuuuguuaauacucugucucacugugcucacaguuguuuguguucacugaacucuaacagguaugacuuagcacagacccuaagugaaaaaaaaaaugcaugaaauccuuugguuagggcuagauucugugugcacuuccugugaauuuagacuuguggccucugcuagguuuuuaaaauaagguugauuuugcaaggugaucuuuuuagaacgauuccuuagcucuucuuacacaccacacaucuucauaaguaagauggcuacuuguguuagaacacaagaaaauauuccauguagccucuacuuucugagcuaucuauggcugucauauuuaccucuaggcacacacagcuuccuacccuggcauccucuacaggucuucaggccuucaggaugugugcgggguuuauguggggaaggaaggagagcagggacaaaaagguaggugguuguugaugcuagaagaaaacuuaagcuuagugaaaguuacuaggaauaucaggccaaaauucaccuccauacaacugggguucugagagcuauuuccagaggcuuuuuagcuuucuuuucguguguguguguguguguguguguguguguguguguguguguguguguguuauuaaaccuugucuauuucccuuuaguuauuaacuguaaaacccuuuacaaaaccucaaaaagguuucugggcuuaaguagauacagauggggaggauggaaacucuauagcuguguucugcuuggcaguggcccaagagaaagcccgagucaaagaguaaguguugucagcagaggcgaggcagggggguuggcagggggaguggagaaugccagcaccuagggccuauugaagaggagagggucaauuugagugacucuggcaaagucucuggacagaacagccuuuuuaaaaggcaccuucucuggaggucuuucuuuccuccagcugguacucacuuuaucuugcucuauucuuucuguaucccuuuaaagggcucuagucuuuaguaucuuguaucucuuguuguuaucuuguauuuaguaguuacagucauguucuacauaaguguuuugguuacuaauggaccacacauacgauuacauugccuaauggcaucauaggcaucauaguuugggcaaguacaguucaugauguucuuagaacagaauugccaaaugguauaauucuuggaccaucucccauaacuaagcuucuguaaacauaccuagucuuaccacuuagacugggaacuccuugagggaagugugcucugugguauggcaucuauuccaguaaauaacugcacagacagcaaaaguaggcagcucgcgauauuuucccuauuguugucaaaacuauauuccgaaugcuauuauuuggaggaaauuggggauauuugaaaugggagcauauccuccagccauugcuuuucuagggagacaagaaagacuucaguucuuugcuagagggugacucguuccucugucuuccuauuucuccaaggaacaguuuuaacuaauacucucuuuguucugaaaacuauuaucaauucuuuuucagucauuuauucccuaggcccaggaacccaauaauucaauaucugguucagugaagacucauugcugagccugacgcugacaguaacaaaacucuuuucucagaguuacucagccauugcaagccuuaagggaacccuagaguaaauggucauguucgcggacuaaguagcagaauuguuguucauuuucuuaguagguucauccccagagacugacuuccuggucuuauuuaccuguuuucuuuucuaguacugagaauuggccagagaaguuuuggugccagaguuugaguucuaaaauagcacauauguucuuugaaaacgauuucuuuucuuuuuuuccaugcuaauggaauaguagauugguugguugguugguuggucaguugguugguguuguuaccuuuuuuuuuuuuuaaaugagugaagggauaguucuuucauuugcuaaauauauugugaacgggaagguauguugcuggagguuaagauaaccuagacauagaucuggaaaaucuauuucaauuaucuucagggugcuuuaguaaaaauaauacauuucaaagagcuaaggcaaucauaaaagaaaguaucaugaggagaguggcccucauuuuccacuuucaaaauuauauacuuaagguggaauuaugcacugccaggucagagcaccauuucugugcaccaguagcugccauggggaccugcugaaguaagggaaggggaccacuuucuaugaacacagagauuaaaacaugcauuuccugagacuccccaaaauaaauugccaccuaaugcucaccuggggacuaaaaaggaugcuguuccauauuuacaauuugcauacggaagcaguguuguugcucucauuuccauauauaagguauuuauacugguuacugaaagacgaagucauuuuucuuugcuuucucuugauuuaaguaucauuuuccuucucuccuuauugcucaaauaguggaaggcagaggaaauaauuucagaugauuuguuucugaaaaauacuauguguagcaucuuuuuuuauuucuuucaacugcucauacuuacauugucuuuauaccuuaguacuuuuaguaccuugcuacugcuuaaaaguaaaaaauggcaauuaguaguuacuugacaaagcuucuuaagugggucuaaaaugucugaaauuuuccuauaacauugucuaucuacuaaaaccagugagguccagugggcuuaccugggugaagugaccugguugaccuuguugguauacacugcugugaauugccugacccucuauaacagugauuaagaugcaauuccaaaauggugcuaggacauaauagcugugggcugcagauuuuguuuugguuguucugaaaaggaacuccauuuuccugagagcacagaaucacccgaugugcaucagcuuggaccuuguauaagaaaacuucauauagauuuuuuuuuugcaacagcuggaaucugaacugguuuccuuuucuaugagugcauuucuuuuccuguuuauuuguuaagaauuacagaguagguuccuuauggaggggcuugcuugugacuuuccaauaugagaucacaauggccauaugcaucaauuuaugaaaaaaauuauaaaaguuauuuuucaaaauaccauuucaguuguguuaaguacauuguuuuguggauuauaucuaaaaaguaaaaauaaugguuacuacauucaaauucaacagucacauagugcuauguuaucuccuugcgaaguuauaguugccaugauaggacugaauuugaaacauauagagggaaaagacauaaauauuaauuuuccauuuuuguggggaauauaaauaagaagauagcccacagauaauuguaauuggauuuuauugaaugaauagaacuuaugaauaggucaacagcuggucauauuaaguuaaaagaaaacccuacaaaguaauaccauguuucaagugugagugucuaggaaaaaccuuaaauugcaucuauucauuucaggaaggacagagacaucauuuucacaauugggaaggcuuuacaugucuaagugccaagugagcuuccagagacuacugaaauguaaggaaggaauuucagaacaaaaggagaacccuugucauuuaauuuguuguuccugagcaggcuuugccagcuauggcucucauaccuauauucccagcauuuagaagguucacaaagaggauuucuuugaguuuggggcuagccugggguauggagugagauccuguuucaaaacaaccaaaaaggcauaaacaaaaccgaaaacacaacagcacaaaagagcucuguuuuacccuugaauuuuaauaagagucucccuugcuuugggaauaaaugcuuucgguaacaagagaaucagauugaaugugagcaaauguaacauacuuucccauaaaauuucaaugcaaguuuagaauuguccuuccuaggaggaggaaaaaaaaaaucaggaaacagccaauuauucaguuccgcuugaguucuggguagaaggcugcugcugaugugagcauuacauauugaaagagauuaaggcgaggccugagcagugauggggccagguggaaaggcaaggcaaugggaauugcagcugcuuguguguacccaccaucauggcaugccaacagcuggagaacaaauuuggucuaaauucccgggagcuacuguugguuaaugugagccuuccaggaacacauaccaaauaauagccuacuuuccuaauucuauuaugggaaauuuuuucgaagucaaucccugugaaaugagaucaggaaugguuugagucuaaaccaugaagugaauacaauuuggguuucauggccuuuaaccuucuccugcaucuccucucuccuaaggggcccauuaucuuucaccuuuaaaauauugcccugauuucauccccccuucuagcauucugucuuccucucuuccaugcucucaucuucuuguccuuuuucuagcuaauaccuuguagucaagguuugggguuuguuggucuacccuucuuuucuucuaccuaaguuacuuggguacuccuauucauagagucgcuuucuuugggaaggacagcuugccaguauucaacugugucuccguaggaguggaaugcuuuucuguuaacuagggguauauggaagugugugugugugugugugucuguguguguauguguguuguguguguguguguugugugugugucuguaugugugcucucucucucucucucucucucucucucucucucuguguguguguguguguguguguguguguuuguuuauguugcauagugccuuuaguacaaaggaacacaacauaaauuauagccuuuguuaccucuguggccugcucagcccucuuuaguucucaccacuugugucccucuucucugucugcaaagacuguuuuugaauagaagauguuugcauccauuuauuuucuaucugccagaaacaacaguuuuaacaaugcuccugcugcccaguggagcaaagaaacuuugaagauuaacaaaaugcuuguucuuauuuagagagaaaugacaucguuugucaaaaauucuucuguuacuaugcuuaaagaaaauguuuuuuuccccuuagagcauuagucagaauacugaggcccagauuuaugacuaguauugacaagaaauuauuagacagauguuccauuugcugucugggggcuuaucaaaaaauaauugaggagcugucauuuucuacaagagaacaauuacgauugacucagcuuugcuuauuguuuucauuaaugcacuguaaacaaugaaaacgcugaauguuguuaaaaucaacaugagaaaaucaccacuaggaagugaguggccaccuauguguucuccuggugcugcugagcagagccaaaguucaaugcccauagaguguauacacuaaagcauguccauaaugaaaacaaaaacacccaggugacauuuaggggacuuaaggaagugcugagguaguaggcugaaauguacaagcaugaagaauuugcuuggcacauucauagaacaguucauaugaaaggcauuaaagacuugugcaagauauaaccguauuuggaaucucacacacagucagauaacuucuguuuugagaggaaugcagucaugauuuauuugaaaaauguauggcuaucgaauagucauaauuuaccccauggaaccuacccauaaagguaucuuguuuuaccuuuguuguaugguccauuaguucugaccaugaaccacauguugauacaucucuagauugaccacuaagaacaauauucucuuucuuucucucuucuucucccccagcucucucccucccucucucuugcccucuuucugucuuccuccuuuuucaucugucauucagucugucugucugucuguuucuguuuguauauaugugugcauauggaggcuacaaguugaaucauuguccaguuuauuuucacuuuauuucagacaggcucucucaguaaaccuggacuguguccagcaauccccagggaucuuucugacuaugggucccagcacugauauuacagucaugugcaacacacaccugcuuuuuacaugcaaucuacacauaugaacucaggucuucacuguuauucaguaaauccuuuaccaauugagcuuucuucccagccuguuccugcagccaaaacagcuuugugaaaugauuugugacauguacuaaugagaucggaaaucaggggugaccuauuaaauaggugcucuauucuccaaugguagaaaaguaagcaaaacucuuuaauuaaugagggggcgucagaaaugccuuucucaaauaccaagacuguacuuaauaagaaggaaauaaaaucucauauucccaugaguuuuguuuaaaggacugaaaaguuugguuugaaguugagcuucucaaauauugcagcuucuuauuuaagcaucucuaaauauguuuaguaauauuuaugauccauuccgcauuuaaagauacacccccaaacuccaggcagacaaauuuugaggcuguucagccuguugcgaccguaauucaaauuauagccuugucuacgucagcuucaucccugugacuuaaauuugguccccccauccauagcuccuuuggucuugagagcccagaaaccucaacaggaucaaguucaugggauccagaccagaugaagcuuugucuuuuacaaccaucuguagcuagaacauuaggccuugguaccuugguaccuauacaaauaaaacucuuuuccaauuuaauucaaauggauagccuaaggaaucuuuuuaaaaaugauuuaggaauaguagagaaugauuguuggugguuaggaacacuugcuguucuucaagaggacccaaauuggaauuccaauaccugugucaguuggcucacaaccauuuuaacuuuauuucaaggggauuuaauauuucuggcuucucucucuccccuccucuuucucucucuuucucucucucucucucucucucucucucucucucucucucucucacacgcacacacacacacacacacacacacacacacacacacacacacacacacaaaugagaucuuucaguucucuuuguaguagucggguccucuuuaggagacuaacuugguacauuuucagaaugggacgaaugauagaacuuuucucauaacaacugaacuauccuuauagcaacacuguuuggauuaaauaauacaaaacuguucaaaguauuuaucagagagaaauaauucuuuaaaugcuaguucuuaaucaugauucgaaaauuuucaaugucgcuugagugccucuuaguugcuggcuucucaauagucugugaauacuauguagaaaggaacugggcuuuguggcuguccagcaccucauccaaucaagaggaaaaggaauaaucacagcccccacauugggauguucagaauauuucaacuauuuacuagacuaacguggaugacagcgucagugagucaccuacucuuggucuucuguacauaugcuaccuuccucucucuuaaaacacagaauugccaaggacccaaugagacaauuccagcagugcuuugcaaacucaaauucguuuucuaucuuuuugagacauaaucuuguucucuggccuuaaagucaucaccuuccugucucagccucuacgguacugaagguuacaggcauguuuccauacucuuagucagaauaaaaaucuugucaugagugauggugaugcuagagaaggugucuauaaaucccugucaggaaccugaggcuuguagagacaugugcuaguucuucucucucaagccccagacccugucugcugaaguaauucacugucaugugauaaccagaauuuuuguuuuaucucuauaccccaauccccaacacacacacacacacacacacacacacacacacacacacacacacacuagaacugggcccuccggucccaaacagaguaaaauuccuuggcaauagauuucuuucaccuaagagcccaucugggccuucuaagggaauucccaggaaaaugggagauaacuacuuucagucccagagucacuaugcuccuggaaucccuguccaaggcauuauaaggaagguucccugggauggaaaaugggggccuuggagccaagucuccuguuuuguuuaauagugagccaaauauagcccuaguucucagauguguacuucugaucuccaaagguuucaguuaaacuuaccagauucaaggacccuuauuuccuaugaaaauguuucucaggacaaacucuuaacauugaaucugccuuagaaauaguacccccauccucaauaccacaugacaacuaugcuuuuauuccagcuuucaaaaugaugcccuuuacauucagcuagauggcugaaaucuuuaguuuuucuuccucuuagaaugaauuuaguuccaaccccagauucaaggagaaacuacauuaguguucaguuugauggaagcagugaagcagguaagacaggugugcagguguggacagcaauuagaaauuaauuugggcucugggcucugggacuaagagaggcugugagaagaaaggagaaggagagagugugggagacaggauaggagauggaguccauaaauaguuauaagagauugugucaaagcaacacaauuuggauucaagauaggaugggucaagugaagauuagugauaggaaguuacuugauaaggcuuccccucacuaaccucucuuccugaauuaccugcuguuccaguuauaacgcuacacauauaacuggcucucguguaccuagauccuuucauucugauaacaaucugaccuuccauuuaccaggccaucucagaacauugucuggcagauuaacauaucaccccagcucugugaauggacccuuauaacaagacuagcucccccuccucuauuuuauccuuuuaucuauaaguacuuuaaaaacaaggccugacagcuuuauuguugaggaguaauugccaaaaggcuuaguagacucuacauucugucuugggauguugauucuucugcuguacugugucauuccaauuauguugucauacccugagcuccugguuugugccugaugcuugaacagguagugaucaugugaauggguggauggauagcucauuuguacauagauagcucguuuguacaguguauuugcugcuucccaaauuccagcauauggagauaccuuuguauccaucaucugugccuuugagauaauccagucucuguuccuuuuaucuuaaacacgaaggaacauucccagaauggaaaugugacucacccaugaucccacugugggugaguggaugaggucaagacuggaagaacccaguucucccagcucuuaagcuggcucuuuuuagcuaauaacuuuacaagcugaccuuuugaauaaaaaagauuacauuuacauuugauaucuauguacuugugaaaucuauauagauagcucuguguagcaggaaccaaagaaugauaaauuucaaauaguucuauaaacugugcauccaaguuaauuaagcaaauuuguauugauuuaagagaaacugguuaaugaaguucaugauucauucauaaucaauuuaacucauucugaaaauaucugugguacaggcaagauagugagaaagaaaggaaccagggagcaagaagaauuggguagagggagaagaauuuagaggacagaaguauuguauguaauaagaggaguagauaaaguuuugagggucacuauuuaagagauaauuacugaagaaaagagagugggagaaauugcugagggcaaucuaaacagaauuauuacccagugucuaauuaaacuagccauugcugcuuguuaucugucuuccccagguucaaagcacacucccagugcugggacacucacuauuccaccaucccuuagaagcacguaggcauuauugauucucuaaagcacacacaaaugaccugcaccaaacucuaauccauagagagacugccuaaaaguauuucaaggcuuggugucaguagaacuagcuaauugaaauaacguaugccuguucacguuacacuuggcuaggucaccuggaacuccaguuucucauaauugaguucuagcuuucauuugugucaaguuacugcauauucacuggagaaaaaaaaucuaaauaucaugaauauaaagaaaguaacacuccuaccgucuugucacuauugaggaaaacuguuauuaacauguuaguguguauuuuuaugcauuuuaaucuuuuugaaauguuggaaguuguagaacagcauugcagagaauuuggcauauuaaaaauguaugaacagggaggggcagcuagagagcaaguacuugaaugagguucauaacucccaagucaggcaacuaacucacaagaucucagaaaccuguaacuccaacuacaggugagcagucacucuauucuguccccuaugggacccacauagugaggaauacagacagacggacauacacaguuguuuuugaaaaaauaacaacuuaaaagcugugaagauggcucaaguguuuucugcuaagccucccgaauuuugaguucagucucuuaaagucauauggcagaagagacagcugacucaugcaaauugucccuuggccuucacacacaugcauggcauaugcauguacacacauacacacacacauaaauguuuaaaaugcaugaaagggagcacuaaaauuaccuccaaccaguccaacauauuauauuuauuguuaauaacuugccacgucaucauucagucuuaauuuucuuguggaacuccaagaaaacaucauguuuuauuauguuaucaugaagcauacauaguuugaugcuuuccuaauuuacuuucauaguuuaucaaaaguaccuucccaugucauuauucauaccuacaaucauuauuucaaauggccauauagcaguuaacguuugcggauguuucacaauuuauuguggaagcuauugaguucauuuaguauuucuccuagcaguguaucaguggacucaugucaccacacauucauugcccuuuuguuuuaucuguugcuaucuuugccaauuugcuagaagaaugaugccacuucauugcuugaacuuucauuucuuugcuaaugggguugaaccuuaaaaaaagaaaauaaaacacuugucuuuugacguguggcuuucaacaccuacugaaugcacagcuucuagucaaaagcacauacacauauuuaggacucauggcuccaguugugacagaacaaagauugccuugcuaauacguuuuaauauagcacugggcucagugccacagccacuaaauaaaucauaaguuuccugacaacugggcccauaucuuaaucauuucugcauaccccauggcccuuugccuaaugcuugacguguugaaagcuuuaauauauguuuguuaaauggauaaggagguagagcuuuugugagggucaaugguaaguuacuaaaauagauuuccaagucuuaucaugugaaaaaauaaucccuagaguuaaaacuuaaaaccauugcuugaaacuugacuuuuuaugucauuuuauaaggaguaaugagaaaacagauccuuccauaccaggaaguuucauuuggccaaagaacuccguguguaaccaguuuuaccaaaucuacaaacagcacuuucacaauagcucaagcaaaaguauuaacuacuguaaauggccaaguacuuaaaagggaggugaaugguuuacaaagaaaaacaggacaaagucaagaaguagggaauuuucuuuucccauucuuacuuuggaaauagagaauugcgacuguaacccuagcacagauuauuguucauuuggucugauagggaaacucuaguaguuuauggugaacuggcucagccaagacaauacaaaucauagaagaauagaguuaggacugagaugaguaucuuuuuuuuucccuucgggauaucucuugacugccacacccuacccuucacagcaauguagcaaagcaguuuaaguuucuucacucuucuugcuggcuuuuuauuuuacauauaucucucuugaauuuuauuuaaaauuuauuuuuauauuuguuuauuugucaguggaugugcaugugugaguguguggaggggaguugugggugugugugcacacuugagcacugcuggguauucaugcaucuuuguguguuucuguguacuugcuacuugugugagggugucugaggacuuuagaagagagcaucagacucacuggagauggaguagaaggcagucacaggcugaugaggauacucggaaccaaacucaugucuucuggaagagcggacaaugcugucagcugcugauccagcucucuagcccucucuucuuuacuucucauucucugguacauuuccugcuucuuaugccuguguuccucaauacacugaauucuuugaguucaaagucuuggucuucaucucuauagcuugugcuugcuguauuuccuggcuuaauaugaauucuucagagagaucauauugauuaccaaacuugugcugcuguuuuuaucacucaaaacacuaaguaucuuaauuucuagucauaugaguuugucaagauauucaguugucccuugugaucucagccaucagguuuucuccuaauugaggcugcaucuggagugaggagcaauaacuauuguggagaaacuagagcaggcugagcaaguagaggcugagggauacagaauauuagggagcaccgcgaggcuggagagugaauguguuaggugcuuugaaggguaguaaccacuaucauuaauuugugcaucugccugugucauuuuacaagaacauauauguuacagaaauuccauguguaguuuccauucauuguacagaaagaacugagaaauguuaggugcuguauccaggcucuuguaguaaagaacagaaaucuaaagugaaaucugucccacacccaaaucugauuuaacccuaugucuacuucuccacauagcuucucuguacacaguaguaugucaccauuauugaaaggaauaaaaaagaggaaagccuuuuguuucuguaugcuauuuucucuuaaauguuuuuuaaauuuuuguuuuguuuauuugguugguuuuauuguucuuuuccuuaaaugcccugagcaucaguggcccauuggauuagugcauuucugcauugcagccuguaaaaaaccccauaagcuaaugaagaccuuugggauggcaaggggaggaaugaaagaacaccagacaccaugcuuuaucacaacaguguuagaacgccaccaucccagccacugcugccuucagcccauugccuauacauucucucucuuuuuuuuuuggcagcucauuagaagcgauuuggugcuuuucaggauuugaaaacuuaaggaugcacuuaguucccccaagaaugaagaaaucuagcuuaaaucuucaaaaaucccauuuuuagcuaaugcauucucaaaauuaagguuaauauccauagcaauugauugcaccuagcugacaaaagaauguuccagacccauugaagguuccauaauuauuucuguccuccuuucucgaggcagucuggcaccagcuuuaagggaacacaggaagaugggucugucucaaccuuucuacccuuugaaggccuuauuaaguuacaaacuccaucugcucccaagagagcuccaauugaaugaaauauucggucauuuaguagaauaucaugacucgguuuugucuuaaugcauuguaucaucauccuauaagauucaaaagcuuucuuagcaaaauuugagaaauguaauuagguugaguauauuguagguuauaagaccuaaaagggcuaugaauaagccauuugguucauccccuacuuaggacccucaacacccaaaucuuacaugagcaauggcuuuuggauuccacuuaaaaauaauuuuaagaauagauacuuugugggguuuuuuuuucuugucaguagucuguaccaguguuuaaauaugucucuuucauggucaugaaguucuuaauguuugaauuccuuccuagcuaugcuuuuaagcccaauugauaugagcaauuuagaagucuuagggagaugcaugacauugaaaugugcugaaaaguacuccgacuuggauuacaguagaaacaaugaggaaucaugccagccuguaaggauguaagcagaauagaaaaauggauagcugauuucaucauggauuugcaugcaaauaagaaugaagcaguguacagggagagagaaugaacagcuaagaacguaagucauuggaaaugacucaauaggggagaaagauuguaggguaauaaugugaaauuauuagaagcaguaggagccaaguuuaaagagguuagaaagaacaggcugaaaacugagaggacacgauuguaggcuacucauaggauucugccauggccaguguacuaggauauaggcaagaaaagcagaugcagggagauacugacugguuugccaggaugguguaaugguggucuacuaacuugagagcuaaguaauauaugaacuuuaaagcucaauucaaggaaaacugugaugacacccuuauugaacugguauuccuuucuaaagccuuaggcaagaacacacauuugagaagaguuucuuuuaaaugaagaucuacauaggcaaaggucuucccagagaauggcugaauacaaaugagaaguagacucuuugaggagucauuuuggaauccuuagaaaaaugaaggcacauguucaaucuugaauaguauuuuuguuucauccccaauugcacauucuggcuaaagaaagaaaacauaagggguggguaaagacgaucuguguccauggugggaguccaugguaaggaguugucucuaaugaggagugguaaaccuagcaaaugggcacgucuuguguagacuugaaauugcacugugauaaucaucuacuagaacucacaagauucugagcccaccgcuguagucgacuuuuguacuaauuucagaagguuuggcucaggcugacagcuguuguaagaaggauuaccaagcaaauauugcugcccuguucugcagagugauauuaacuauugaucccuacccccccuggaucaucugacagcagugaucucuucccauacuucucaggcuuuggacagguucugauaauugugugaaguuuuggaccuuugcucuucaaaucauuuuacaaguuacuguggagaaacuaaugagaauccugugaauuugcuggguuugaacuguaaaguuugaacuuuucuuuuucaucuuaagguguaagaaaguucugcuacguuuauuuaaaaaaaaaaacaguaaugaugaacauaucucgugaacagaauuuuaguauuggguuuugaaguuauuaguucagggcuugaagagaagguuauuauuucacccccuauacuauuuugcacagacuagaaagauggcucaacugcuaagagcacuggcaguucuuccagaggaacuaaguuagauucacagcauacacauggaagcucacgacugucuauaacuccaucuccaguagcaucuuucugccuucugugugaaccagggucauacaugaaaaaaaaaaucaauguacauaaaauaagguggaaaaacaaaaauauuaaaaauaguuugcacaauaaucuagacuugaaauuaaaaaauagguagcuacugaaguagauuuugaguggcaucuuuuaacaguaaaugacugacguucaccucauuuaaauguaguacucuguuuccucagucauagagauuccaaaugagcccaccaugccuucugcccucaagggacuucugucuggaugguggaaggcucagcccaauaguaaugcauggccaaacaugucaaauggagugagggaagcaagcuuaguccucugcaguuaggaguaugaguggugagagagagaccaggugaagggaguauuggaacaggggaucaggugacauuuaagugggccuugucuccagcacggaucaggcaggcaaggcacaggaaaugagauuuuucuuuuccuuuuuuuuuuccagauggaaaagauuugaacgugguugaaagggagcuuacauuuaaaaaaaaaaaaagacugaugaaauaaaaacauuuaccucuuucaguugaauacugauauaaugaugaauuauaaaaauuauuguuuuauuuugacagaucaggaugaauguauuucuauggucucucugacauuuacauuugcauuuuagaguucucaugauaauggaucaaaaaguuaucuuagacuucuggagucauggaguguauuguacugccuaguuuauuaugguacgacaaggauguguuggauuuuaaagcaucguuaguuaucuguaguaauccacccaaauauuuugcaagaaguuuuuagaaaaagauuuuauuuuuacucuacuuuuuauaaauaacauuucauguuguucuguuuuggcagagauggaggugagauaaguguaaaauauauuggaaggucugugaaauuuccuccauuuuucucuugccuuaaaaaguuccauuuaugugacuuucacucuguuuuauuccauacauucucucccugucucuugcucucuugcaucuauuuaguguaucagcuacuucacaacaguaacgcauaacuugcuggccuauaguucuaucauuacaugacccuuuggggaacuauauacuacaaaggaacguaaucuuuggaacuucacacuuucaacgacguucauggaauaaagacuaauauuggcaauguuccauuucuugccuguuuucaacugcuuccagcuuucuguggagaggugacucuacacugauaaaucgacagauuaucagcaugcauaccuuaauacuggcuuucuucaagaugaccacuucaguuagauugcaugaagauuguguaucuccuauuucauauccuaguccgucacuuuuuucuaucugugugcuacauggguggaaauagauucuuuuaggaaguagagauguaauagaguuuuaauuuuuauuuuauuuuacuuuuuuccccccguauauguguuuugccugccuguaugaaugugcaccaugugugugucugggacccaaggaggccaggaacgggugucggauccccuggaacugaaguuacagauaguugugaacugcccuauaggugcugggaauugaacucagguccucuggaagagcagcuaguauucuuaaccacucugcuaucucuccagcuuccagauggacuucuaaaaagauaguaaagucuugcuguguuucuugcuugcccaucacaaagcuggcucuagacucuucucucaugccugggucauaucuccccccgcccccaugcaagcacagagucagugauggugccacuagacuuugaucaauauucgaauaggaacuaauucuggauucuuggcugccaugaauguuuucguagaauucuuggcaucaucuuuucccaccuuugcuuuugauuaaaacggauugaacuccugugugaaauaucaaaguguuuuccuuugcucuuuccuccaccgcuuuugcuucguugaaguggcagcauugcuuuuuuuuuuuccauuuccagaaaaagcaggcagagucaugacucugcaaguagccguugcuucugucuuuucagaauacuaugucuuaauagaaaugcccguucucaugggcaacuucuuuuauacagucauagcagcaugcaccaaaaaaaagaagcuuccaguauuagucuugauucuguuuccccuucaacaagucagauucugcauugugcuuuuucucuguggaugggcaaaacccagaaaauuagcucuuucuuguuugguacaugauuguuucuuauuuuugaacaugacuugugaaaguuuguccugucuguagcucucuaccuauccaugcucggcaguaugguaaaacguuuuuuuuuuccagauuugagagcccugaacuggagagaugcuuugggaaauaaacaauggaaaagcccuccccccaaaucauuccaauuuaaugcacuucuuuccauuuauaaaacuaccaaagaggugucuugguuuccuuauucaucugugaauguacacuguugcaccugaaauuaacaguagauauaguuggccucuaugugguaucauauggcaguauaugauuuuaucuuaaaccauuuuagauuuccaugccauauuucugucauuucuauauuuuaucauauaacacacacacacaguauaaacauagacacauaucauuuuauucuuuaauuccacuuagaucaaauauguuggccugccuuuucuauguggcugaaagaggucacauacuagaggucucaaaauaaauggcauucaacaagucaaucuuagaaacaguaucuauucauucuccaaaggaacaaagauucugagggaacuuuaugggggaaacaguuguagcaacaaaguuuuguuugauaaaaugaguucaaagcuagugauagugaaugcuugauaugcaacucauaggcacaauaucccuguguaucuauuacugcugguuaaacuauaaaaacaaaguagucugcugguaguuagaaggagacuuaaaaaaaaaggcagaggagcucuuuuuuuguuuuuacagauuucagaaagaaggcugccuugcaccacugggugaauucugucuuuuuaugguggauauugcucugcuucucaucuugacugggucagaaguucaguauaauaaauuuaugaugacugugaaaccaaaccaucccuuuggagacaaauguggagaguaguggagaaaacaaauauguacuuuccuucgcccugucauguauaaaggaggugaauauuagaguauucaucauugacuucacuggaaaaugaaucucucgaagaaaaguuacgguuugaaggcccagcauaucacuggggugaaaagggggauuauuuccauauguguugguguuagcugguauuugaaguucuuuaaaaagaaagcaguuggaccucauuaauucgaaauucuguuaauuuguaaacaacaucgccugugggagcuuuuaaaccacuuaagagaauaaacuuuggaaacacuuaagaccuagcuccugguguacuaauuucaaauagcaauuugcaugugaaacaaaaauucuugcugggccacauuuuguucaguuaauucuuacuauggcaugcacaguaauuccucugggaauccaaaaucccuccaucaaaacuauagcccacgcagacuugcacauacauaguuuucccaccaugccaagaauuuuggauccugauuauacaaaucucuaccccuucacauuucaaaggaggaaguauuauggaguaaccucaagucaaaugguuucuuggaggguuaaagggaaaaguacuucuugauguuuucuuuguacaguggaaaagugaauuuacaaggaucucauuaaaacaaugagggaggaaagaccuagaaaguuuguagucagcagauaaugagaaaaggaagauaauuguacagcauucuuuagagcguauuuaccagcuacacuaaauaugauuuuuuuugcuuaaugcaccauuuuaauuuuauuuuaauuaacauuaacaacuauauaugaguucuucuaggguuacuuuugucuggucucuugaacuccaggaagaaggacacuuuucaguugaaaagaaauuccugaggaagcacaagguccuaagcuuuucugguuggcugcuucaagccauagccugccaucuucuuucccuuccugauugucugagaagcuaucuuucuccuugcaggucuauuauuuuugaacaaggcuguagguaucuuaaaugcuucucguauuugacaaaagcaagagaauuucaucugaauccccacuuucugcccagugcccagugucuagcacacuguuaccucaugaccaguuaucacuauacugaaucguuaggaaucaaggaguuggcaccuauacauuccucauuuugcucauuugauuucuuuccucccgguuuucagcuccuucuagaccuggguucuguucaucggauagauuauuaagucuuagcuuauauuucuuagcuuaucucuuccaaauuaguauauauaagcaaaaucauuucuccaaaccuggaaggcagcauccugcccaagcccaggaaggaugcgacaggaauauaaaaagggacuuuguaucucugcuccuucuacuguuaccuacagacuccugcuucgugaagugaaccccucaggccuugguucuacauuacucaauuuaaaacguccuuccagcaacagggccacagacugacuuucucuuaucuacagauuuuugaacuagacaugguauaggaguauggucuaaaaaugggaccacguauuugaaaucagggcuguucccuauaugcgguugcucuuguaacucaaccauccauaucuuuuugucacuuuccauaaacaauagagugagcgaagcugaggagagccaggggcuuugugaaauguguuugcuucucuuugaaucguaagaauaaauuacauuuucucuuucuuucuuccucuucauuuuuuucaauuuguuuuguuuugagcaaaauauauuugucagacuuaaguuucacaaagaguuaugucuagccacacaugugucuagaugucauuuacaaagauuuccccagauuuguaugacuagugaccucuuccugguguuuucauggggaauaaauacaaccaaccucaccagggaagauccaaucauggguucuuuuuccagauuuauugaauuaucauugaaauuaaaaguauacauguuccacauauacaguguggcaaguuauuuuauacauauucugugggauguuaaccacaaugaagcuaagaagcugguaccucacagacugaccacauuuucucaccuaaggaaaggagcucuuaagaucuacuuuccuaccacauuuuuauucuaugccauagcauuacuaauuuuagucaucuugauguauauuaauccuagcuccuucccaccagcauuccccaggccucagagcuucccuucuacccauccccagccauauuuuuaaggcucaacuagaagacucaaugaucacauuuagggugacuuuccucaaaggucuauuuugucagccauauuuuaacuuuuccagaagaauauggauuuuuuuuuccuuuagcuuugucuucuaggagaugugguaucucaagcuucaccagguaaaaggucacaugacucaaggaaaugcaauauggagauauuacauaauauaaagaauacaaugggaaguguagucuuuuuguaggagaaauguuuucacacugugaaggauacaguggaaaguguagucuuguaggagaaaucuuuucacacugugaaaugaagaggugcuaccaaagacuuccaguuguuauuguuuuuuuuuuuaauaucuaauuuaugugauagaaucacuugucuauugcugccugguaaauuaccuccacacauacaacagcaauaauaguguguuaccuuaugguuucuuuggacuuuggaaaugccuagguugugugauucuggugugagauuguaauuagauacagaucggggcugguagaugugcuuccauuuggcucacucacauggccaauaaguugguggugacuauaugugggaaucucuuuucugucuguguguccuucucuguauuucagcuagaauauucuugcacaaccacaguuggcuuuucaaaaaccaaacaauccaaagcaaaaugaaauugccuuuuuugacuuaagcugagaaaucacacauaaucacucuguugucuuuuaucgguuuuacuggccaagccugauucauuguagaaucacuguggaagggaccacccagggaugugaauaccaggagguaugcaucauuggaggccaucuuuggaaacuggcuacuacauuauauguaaaugaggaaaacucuuuccaaguacgaaauguaggaacaauaacaguaaacgcuacuuuuaugucuuauugauuuccauguagagaugucuuaugcauauuuggaucuggucucugcuucucucauugccucuauuuugaccaucacuuccauugaucucuucaguaugucuuuuucucagggacuuaucuuuggguucacuccauucuuauuauguacacucuuuaccugggagagcuccucagccuuagcacuaagacuucaagugugcaucacugcuuaaacuucuuucauuauaggcuccuaucuucaaagccauugccaaaaaauagauauaaaaugcucugucuuaagauagauauaaugaguaguauaauaaguugucaugcuguaucuuaagauagauauaauauguaguugucagauacuguuuuuaggauauaacugauauaaacauaacugauauaaacauaacugaucccuccuuuuaggcaugagugcuaugccuccucacuugccuguguucccacugagaauaggaacagcuucuaaucuuuuuaauuucucugaguagccugaugucuaacacagguuugauguucggauguugguaugugaaugaaaucuccauuuuuaagcaucauuacuucucagggagguggaaugucaagcuagcaaaaauaaucaaguugaagauaauuuuguuacuuuuuaaaaaaauuacagguagugcaguaggauuagauggagucaaaacaauaaucagcaucuauauaauuugcauugauaaaauacuuauggguuaugugggacacuuauaaacagagaggaaugucugaaaauugccaaauauuuauugaggucucaugauccaaugcugcauaaggaggcucauagucuugggugucauaaagauggaaacaaagauaugucuuuucaagauuuuuguuugguaccuuacaaauguagccuuuuggaaacaacucuuccugccacccuagcagagcccuagcuuuuugcuuugacccacacugugcuuguaguaaccugguucugagaggcuuacaccaaacguuccaucguugaaggacaggaaaagagagaaagcugcugcugcugguaguaagguuggaggugguggcagugccuguggugaugguaguuagcaucuacuaaguuuucugugugcaagaucauacugagugaucugaaugcauuauguuuguuacccuucacagugacuccauaggacaggugagacuaaauuuaaugccaaauuuaggagaaaagaggguucuaugauuacacagugaguaacaguuggauguaggcugagacugacaucugaauugugacaguuuuguaagcccaucccuaccucucacuccucuucuugcuuaccuuaauggcuacuacaaaugauacugcuuggaaccauuaguucagaaggaaugcuaacacucaugcaaguugccuacaaaugcauguaugcuagauauaggagucuauaauuucugcuauuccuuuggcuuuuuuuuucuucuaauuugaaacucucaacagcuccgugaagugucuacaaaagccauuaucaccaaugauaaggaaacgggacucaaacagcuaagaggcucucugaacaucaucuagcaaguuugugacaggacugggauuagaauuuaggucucuuaauacccaauucauuguuucucuucucuuuuagugcagagaguuaugagugcugagccacauuucuaaucaucauuagcuacuagaaacacauggcuguugggagagaucgcaaauuguaucagcuuuuauacugggagaacaaagggcagggaugguucugggcuugagaauuacccccacgugcuacugauuccuuugccuucaucucaacagcacuuugagucuuuuaaauagauuuucaaauuuagcuuuguuaagguauauuugggaagugaugucuguuuaagguauagagcauguugauuuuauacacguauauauuaugaaaugauauucagaaucaaguugagaaugggagaaauagucuuucccagggaauaggacaccaaauuucaguagcaaauggucaucucugaaaauauacauacaaguaacauugugcagacugagcaggauauauuuauguauuuaagaguauauauacacaagcauauacacacauauauguaagaacauuaaugaaaaaaagaggcuaugauuuuuaaagagaccaagaaaggguauaugaauggauuuggagggaauaagguuaagggaaaaugguguuagauuugaauuugaaaaucuauuuaaaagacucauuauaaucucacaaauagaaauuaagcaagaaaauaaaucuuauuugaacuuccgagaauguucuugggccucuugcaaacaauacaauuguuuccacaagggggcaccaaaaaugcuuugggggucaguuagaaagggcgaacaguagauuauuggguucuaaaagucugauuucauuuuuuggucuguuuguauagaauggcccucccagcacagucucaagaaucgagaagcagaugguguugauucugaugguaguggcuuuguacauguauacgggcaaggaaugggucuaaagaaacuugacucugggagauaaaaagcccuucccagcaaucacacacuaguguauucucauuaccuguuucuuuuuuucuguuacaucuuuguccagcaaagaugcucuuucauuacuguguguuccuuaacaccaggucaacaaguuugccacaugagcccgcugaagauguuucuagcaucuccuacucagggcguuaaagaaaaaauaaagaaagaauacagauuucuacuacacuauuugcauuauuugcaaaucaugguagauguugguggaauguucccucaggaauaguuccaguagcaccguuuucccuuuaaugaaaccuguauuucaguucggccaggaggaagaagagugguguggccuucacagauaaagugguuuucagaauccauguuguauauaaugaggucgagagauacaagcacccucuguaugugaaaauuaauuaagcuauuauuuuaauugacaccccgcugaucuuuucuuuaucagaaauauuuaagaaauguguacgugauaauaacuuucaaacauaauauuuccaaaugucaaguuaauguguucagggagcaagaagauucaagcacucaguuugagacucacaucacaucuguuuccacaaagugcuucugggagccuuugaagcggagccagugggggaccuuaaguuauuugcaagacauugaggugaagauggggaauaucccuuccccucuuuucagcucuaaaacuagaaauggagauuucuuagaauaagcuguugcuuccucacaaaauaaauuaggagucauuauuaguugcagaaauaacaauauguauaagugaaaagcagaauuacuuuuuaggauuuaggguagagguuauuaaaaugacauaguucugaauaauguugccuccccuagcuaagauguaauuacugaauuuuuuaaaaaccgaaaagccauaaucuaguaguucuaaaaauccacucagccuucuguaggcauucgagaaucacuguuuguuuuuugaaguggaaguaacaucuuuugcaguuaguuuuuggaacguggccauugcugaauaaaggcuuccaauggugcaccauaucucuucuguauaauugcacuaaaagaauacauuggcauagcaugugcuucauaaugagcugggggcaaauguaaaaacgccagaaaccuucaacugugaauuugguauucuggauauuguuuugcucuaacagcaauaccaugaaaauugaaugaaaaggguuuuuuuuuuaaauaaguuguugcuauuuacucugauaguuaaaucaaaggucucccagguacagaccugagaagugacuuagacguuuggauuuauucaaggaguucuuuacaaaguaguucggcuuauguuuaaaccugcguuugaagacaauagagguucugucuaaaccugcccucaacaacguguuggcuuaagucuaaauauguucuuugaucacugucaccccaagucauucaaggaugagaguaugugaccuggaggcccuacuugcuacuaccacauugaauaauaguugucaaacacaugcaguuguuauauaacgauuauuauugcacuagcaaucuuuuaaccuuugugccaagggcucuuuccuuucugauuccuuccauguuguuuuguaauaaagucaggaagugcagauugucaagaaaugugaagggucugggauuuuuuuuaccuugcuuguaagccagaaacuuagcuugagaccguuccuugaaugcuggaaagaggcacaaaacucuuggaaaagagaugaaggaacauuuauggggauagcagcaguagcaaaaacaucagcaauuuuguccuaguucucugaacucacuaaccaucaaaaugguccaaauaauaugaaaagggucagacuacauuauuacaaccaggaguaacauuuuaggggcauuccccaggucagaaguagugaaaucauuuaucaccagcaguaaguauaucagccucaaccuuagggaccugacaguauacugagucagagugaucuuuaucuuccaaggccaugagcacauuuguccuuuaugcucagugaggcccuaugccucucacgcaaggcucuuagugauacacaagacacauguucuugaaaaaaccuacccuggaacuacggcauucagugcuuuuuguuuauaagauaaugcuaaaauguaaguuaaauggagaaugguuugccaacacagacuagggccagggugguaucugaagaacugguggucugagccauccuucggacugaguaacaggacagaagacgguagcuguuaccaucuuugcuagcacucuuuccugcaagaguuugguccugaggcuacuucaucucuccaaaagcaaaugucuaagcuccauacugacuccccgcuuaggggaaugagggauuuaucaucauguuccaugaccugagguuggggaucccagguguccaaaagauaucaugugaacauuuccccuuaacaaagcaaaccaaacuaaacaaaaaccucucauuugacuuaagauuuauguaguuccaaaucagaggcuuaaaucauugaagggaaagaccauucuuuuggaaggagagauauggaauuuggaguuucaggccaacuccuagucccugugcaaaaauccaucuucugacauggccuuuaguaagauucuggacuaaaggggcagcaggcuagccaaaagaccucugucucuaugccauauuuuccucauauagaaacaaacgguauuuuaaaguugugcaaucugaaauuaacaaaaaugauuaaaguugaacuauuaugucugucaggaaaguccauuucuuuaaaaaaugguuuuauucagaaagcacuuucacuuucuuaucucuugucugauuuaggaauccaaucuggcagaguuguuauugccagauuacauuucauguauuuauuuuuuuaaauuacaaauaaucuuguggcuauggaauugagccaggaccucagagcugucugaggugcuagcuagaagaccauuguuauucuucucacagagguagcaggagcaggagaaacuugggccagaugacacccuacaugugcucauugguugacugugagaauuugcagcagucacgugucuucuccaucugaugauauuuaguauucugcuagcccucacaugccucuuuuaucucuaaauuccauaauauguaaguauuugaaauuuuugaaagggugacucauuuuguuuucuucauaacagaaguagcauauuuauuugggagaaaauaaaggaauauacauuuuuuuuaaaggagugauuuuuuuuuuuaguacuuuuguguguauuucauuucauacaugcaugaaauaaauuuuggaucuuuuuuugauaagacuccuuuuaguuaauaauguagaaugaucagguggugguggccgugcacaccuuuaaugcuaacacuugggaagcagagagagggagaccccugaguucgugaucagucugaucgauagagcaaguuccaggacagccuaggauaaacagaaauuacuucuuuuaaaagagguagaauguauaucuucccuuaucauuuggaguuuauccugaaucuaaucuucaggucccauacccucauccuugacugacgugggggugacagugaucaaagaacagauuuagacuuacaguauacaaaacgaacaguccauugcugggucugguauuucacacuuucaauaucagugauuuugaaggcugagguagagagauugcaaauuuaaggcaaacuuggaccugauaccaaaauaaaauuagauagagcagauccuauuucaaaauaaagcuaagugggaugaaggcuauggccugugguacagcagugauugcaugaggccuuggauucagcucuuauuaucuaucucccacuagaaguuuaugagacuucauuaaguaugaauuaaugauaauucuaguacagcuucuauauuaauagcacguauaucuguaccuuuaucugccaugaaaacaaauugggauggcauauggaaaauaauuaaucacguggagagucuuuaauggcuuucuaaucaaaaugaucaacuauacuugucaaaucucagagcacccccucagauacugacagucuaugaggcaauuuuuguacagguauguaauuucaacaaagcugcuuauauugcgaaacuuauuuaagauuauuucauuccaaaucaauucaaaagaaugcuuaauucaacaguguaaaauauagggccuuuaaaauguaagaaccaaggaguccaacaaaagggaguagacaggggagccaccauuuagugucuagacaaguccauccaagucuguuuccuagcagcaaaagucaacaagaaauuacauuggccuacauagcuuuuauuguugcugaagaaaauaauguaugcuuuucccccacacaaauuuuauccugaaauuuauuauauguuccuugcaugagggauaauagguuauagcagacaucuucaacuacaguuuuguaaaggaacaucagaccuacugaaauagauaauucuugucuugaccuuauacauuaagggcuggagugugauauuaaacuauaauucagguucgacauuuucuuagaggcuguuauuaugucgucucacuuauguuucugaugauuugauccagacuagugcuugaaaaucuaguggcugauaaucuaacuacauuuuccacuugauuauuuccugaauguaagaugccugaaagguaaucaccaaaggguuaagguuugcaugggaaccauauuguguaaaccuugguuuaguaacucuaagaccuugaguauggacuauguugcugcugcuuggcacaguacuagaaauggagcccaaggaguugagcaucuaaggcaaguucuccauuaccaagcuacaaacccagcccuccccauuuuuugaguaugcauucgauaaacgugggcugaguaagcaauugucucacucuuugcaacuuuugagcgacuguuucuacuaggacacaccaucuaugaaucuauuuuccuugauuugcguguuuguguggaugugaauguguuauggcauuuguagagagaggucagacgacaacuugcagaagucgaaauuuuucuuccaccauauaggguccaagguggagcucagcuuguuugacagcagacaccuuuaccugcugauauaucucacgagccccaaaucuauguuuauuuuuuuaauguaccauacaauuuuuuuaucugccuccccuuauacaauuugcauuuaccaugucucuggaaagcagcuguuauaggaacacaaacugcaugccaagaauuaacuccuacaaguuguguguguugaguguauuauauauuauauaauauaugcaaaauauauaauuacauaauauaauugcauaucauauaauauuuaauauauuuuuguauauagauacauaaauauuaacuccuacuaguuuucuacuagcaaacugccauuaauaaggacugguuaaacuauaaacagcaauaagagaaagaauaauaaagaaagaauaauaauuuuuaguuuaauugcaugaguaaauaucuaugauaaauuauaauugggagcaaaacauaugugcauguuuauguagguauauuaugauugccugauacauguuuaucuauccuauuauuaaucugucuaugcaugcauguauuauguacauaaguauuauagauauagauauaucuccauccauuuaaugugucuagcugcuuaucaagaugcaaagaccuagauagacacaugaaauaagcauacagcuuuggugggagcaauauuagcuagucuucuguuauuuuguauuuagauauuuuucuacacaaaacauggauuguccauguuuacacaugaaacauaaaauauaaaauccauugucauagaauacaauguccuucaguacucggucaaucaugcuccuuuggcuucuguuuagguagcucccuaucccuuccuauacacauugcaaacuccagccacacaaggccacuggaauuucccuauugucagccccucauggcagagugguagccauauauacaucuuuuuuacuuagugcagugucugacacuuggcaaguucucaauacguguuuguugaaggaaucaccagugaauaauacuguccucuugccccuuuccgagucacuaauguauuucuacacucuugcuuucaaaucauugcuaaaaucauguguuugaaacaggaagugguaguuuguuuucaaaugauggaccuuccagcauagagcuggcugugguauguuaacaugggauggugcuaaucauugagcgugcccagguuuguuuaaugcaacauuuauauauguucuuaccauuauacaucuuuuaaccucuaaucacuaucguucaccaccuacuucaugaaagcaccccuucauuuuaggacuacuuugaacacaucaaaagacauaauccaaauauauccuaaauacagaaacauccacaagauccauuucccuucaaagaaaauauaucuggcucuuuuuuuucucuccaaaaaugaauuuagaccuugaagagcucacuagauuuagacaguaccaccuaauuauuuuuuauggucaauuuuacuucaaaaacaauaauuaagcaugguucucuguaacaucuagucuuuuuguucccccaaggagauauuuugucuuacuccuucuuuuucauuacucagcacauuggugugcgugaauuaucauuaucuauucuggauuuaagcaaaagugacgugguaggaaccaaucuagugauagugcgcaaguuuacuuaaugugacacugucaaucagugacugauauuccauuuuguccccauuuauagcuuugguuucuuuguuuagacagacuauauuucuacucauuuuaugauuacuugcucuuguuuguuggagaauuguaguaguuacaguaaaaagagcuauaucuucuuucuccaucacagggucccucugagugucaggaauuguugaauccauuuguucauaagaguucagaucucuccuuuuacuuguuuauacauccaagucauuuggaaucauauccuaaauauugugucauuuauagucauuuuuauguauaaucucuaauaauuaggauguauaaauguuaggcaccugcaugcccuuuccaaagguagacaugcacagagucuuacuuaguaugcaauuacugccucacugagucaauagaagugaauuuaaagaugaccccuaaaucaugccaaaacaagcucagucucugagagcuccaguugguccuggagguccaccugagcaagcuguuccaaauaacagauugugaacgggggcgacaauuguagcauuacuaaaauauuugaugugaaggcuagagcgaugaaaaaggcguuuccugcuccccauuaucuguucccagcacccauguggugguuccaaaacauuucaacucuguuuccaggggauccagugcccucuuugccuuccucaugcaucaggcacaggcauauucuguauauguacaugcaagaaaacacucuugaacagaaaauaaacauaaauuuuguuuauucaaaacaaggucuuccuuaaagaaaaaacaacuuuuggauuuuuuuuuauugugaguaccuuccugauaaacacaaaacucuagugucaaugauaaaauguuuucuugaaauauuucaacacaaaugaaaagcauucauugguuaucuguuugcuauuugucacaauuuuucagcuucauacuggagaagguagguaguguauuuuuauuguguauaugagcaacuuaagguucagagacaucgcuguguaguaaguaguugaaccagguuuucugaauauuagacucaaaacauaucuauccuauauguaauugaagacaaaugggaauaaauguuuaaagagacagagauaagacaguuauccauuccacuauaauuuggacugaaguuucaaggugcuaaucuucccaagugacaauuauaauugacuguguauaaauauugugacacuguugcucuuuacuuaauguccaguuaaggaugugccagaauuacauagaaauuugaaauguuaauaaucggccauaauauuaacuaaaauuauuuguucauuccaguagaguuuaaaagcauguuaaugcacuauacauguugcuagcuggugaccuuuguaauccaauuaugguucauuuauauuugcaaaaucaucugguuagaaguuuucuuuuaacuauuaacuuaaugucauuuuucaauuauuauauguguagaaaaaauuauauucaaaauguugacauauguacgagucuauagacaucauauuacauauauuugaauguuaacauucuuuguuguuuaagcacagcccuucuugugauagucuaaggacuguaucacagaggcuggaaagauggcucagcaguuaagggcacauuuuucagaggaccugcaauccauuccuagaaucuacaugguagcuugcaaguaucuguaacuuuagucuuaugggaucugacacccucuucuagccuccaccaccaccaggagcacaugugcagagacauacauuuaggcaaaaauacccaagcacauaaaaugaaaauaguaauacaaaagaaauguguugaguucuuacuagaagcugcccauuggacuaagucugcagcaugcauuuucucagucacaccuuuggauacagucagcuugagacuaguucuagaguaucuaaucacauuccugagcugucucccacucaccagcuccuugcuuccauaucuuuuucacuccacgguuugcagacuucccuguaguuucaagagcaugugucaaacauaugccauugucuucuuugcuaaucccugaggagagauaguauauuauuucuaggagaaaaaguauauaugagaguaaaagauucaaccaaagcccccuagugaauauuuuuauggauuugcauuuguuauacaccaaaauacaaccccaguuacuuuuaaauuuuauaauuuuauuuauuuauuuauuuauuuauuuauuuauuugcaucccaaaugcugccuccccucccaguacaccccucacagaauucuucccccuccccuuuacaaccuuccgccuccgggugugucaugucuuuacaggauuaggcaaauucucucccacugaaucaggacaaggcagcccuaugcuacauauguguggggaggccuagaucuaacuccuguaugguguuuaguugguggcucagucucugagagcucccagagguucagguuaguugacacuuuuggucuuccugugggguuccuauccccuucagagccuucauucuuucccccaaacucuuccauaagggucccauaucucccuucagugcuucucugcaucuguuugggucaguugcuagaaagagccucucagaggacaguuauucuagguuccugucugcaagcauaacagaguaucauuaauugugucugugauuuaggcuugcccaugggaugggucucaaguugguccaguuauugguucaucauuccuucagucucugcuccaucucggucccuaaauuucuuuuagauuggacaacuguugaguggaauguuuuauggguggguugauguucuuaucccuccccuggagauccccucgccucuucagguuccacuguuaggcaucucagcuaaggucacccacauugauuccuguuucuuguuuugccuucugcucucuguauauugcuuugucuauguauuguauaugccccucuuuucuuccuuggcauccugauauccuaaccgaggaauccugaugcacucauauggucuuacaaacuuuuccagucuuacaaccauuuagcaauccaaguuuuaaggccccucaaagucugaguggguacuuucagaucccuucuugugacguugaauuauuucuguuacucauaauuaaauugcaccauuugaaguggugauugcaaaauguugcacuaauuuacaagacaagaauccauuagcagcacuacuagaaaaugaaggcaggauugaguguguaaguguuugucugaggcugccuucagcuuucucggaacaauuuccauuuuauccuuggguuuauguuacuuuuucuucaguuaaagauguuuucaugguaacauugauaacaaacauaacuugaauaaguaauguuucuauacuugauuuagguucucuuuuaauuucuuaaaauuauauuagcauaugcuacuuacacaaaauaauguguuucaauauaauccauuuuuuuuuuauuucuaagcauuuccugacuaggcuucuuagcugucaucaguugcucacaucacugauggguuucaacagcucuuuuguggauauguuuauugccacaaccagaauuauaugcuauagucugaauaugcauaauuccugcuaaggauacacagagaguaauaauauugggaaauggucauacuuuuuagaggaggagaugagagaaacauuacagugacauaaaacugagugauaaacucgaggacaaaaaaggucuuucagaaagugcuucaaggcuaagguuagaguaacauguugcuaagaaugcugagaguagguguugaaaugauauggauuguaguuugaaguuggcaaugaguaaacuugcuuaaacucauuuauucucagucuuaaaauuuugagaguagaaauaucacccuaauauuguuaugagaagcaaauaugauguucaauauuggaguaagcauugcuaugccugcaaguuacacauacagaagguaaugucuugauccaaaucaaucacacugcuaguauguggcagagugaaaucuaguacucacauuugcuugacuccaaagaucuuucuguucuguuuuuuuuuucuuuuuucuuuucuuuuuaaauagaacacuugaucaguuacuacuuggaaauacagauguucaggguuggaaggaaugucucugcuaccuauuaugccacugaugagcuauuugaauuccguucacaacuuaucucaacaaaagcucugccaagauuucacuaugcuucucuugaacaccucagcuuaucugucauugaccuaaucuguauugcgauuguacucuaagggaaaauaacaccgcugucguuuaagugccugacauguuuguguuauguugaggaugauaccggugugagagaagagacuaucagguagauaugcaagcagccuaggaaaguuuuuuuaaagagacauccugagucccuaagccaugguuacaggacauaaccauagaaagaccaauagaaagacagacagaugcacacaggaagagaggggaggagagagcaaacagaggcugggauaaagagacaccagaaaagucccguuuugacccaagccucacuuguuuucuuuuuuuucuucugaaauagggaagcuuccuagauuccuaugaagauuggagugauuuucauugucauagggaaauagccauaacuuuacaacuugcccagagugcagguaccuuuccucuauuagauuugucaggauguuuaaguuaauuaauuugugguuuacuuuccuguaauucauacuugauuauuggaacaauagguauacuuuagucucauuuauuuauuuauuuauuuauuuauuuguuuguuuguuuauuuguuuauuuauuuauuuauuuuuauuuuauuuuggugcuuaaggaaagcuggacauuuguuguugggguccuaauuuaaauucacauuguuuuacuuacaacccaguuggugcccucacuuguaguuagacuacugcuguaaacagccagcugauuuuagacugaggcauuggagugggugggucuccauucucagcucauuucaacuccauaucucagggacgauguuaugcagucuuguuggagguuguaauuuuaaaccacuuggaauaauauucuccuuugcuuuaauguuauacaucccugugcauguucuuccguaauugaaagggauaucgggcaaauuugaucugucuggcuuugacuuaugcuguccuuaucauggccuuugugucauuaagaaaaaaauugguauugaucuuggaccauaccacuacauugugcugcaauuuuucuuccuugcuaguggaauauaaaucgauaaaaggcagcugcuuuagacgagggccagauauggugcugucauuuauauauuguaaauccaaugauagcugaucaaaucagugccucuccuguuccaaacuugacaugauugaauugucaauaaaaaagauuuuacaguaagggaaggagagcugacaguguaaaugucugaaaacccaaugaagcucaauagaaaaugaaacaaugugcuaggauaucauuuuauaauuuccaauggggaaaaauauuuagugaaucauggcugggauugggaugaucacaggagaggaagcagcaaugaaaagccaccuaucuugcauuauaauuuuggugaaaucugaaaugcaaauuuacagaugcaaauuuucagaauuaugcauccuacccacugaguuguuuauuuacagacauguuucaaauacucuccaccuccucccucuuccacacgcacacuuccuacugauaauauccagcuucugggugaaaaauaaacauaucucugccuaggcauucugcugacauccaauagaugacucaggaacaaaucugauaguucugacccugcauucuucaagucaaucaggagggcuuuauuuucccuuaauccaucucuaaaaguagccagacguguuuuggaagcugaaaggacugugcuccugggauugucaagaaauucugccaguuuuucaagagaccucauuuguuccuuugcaaauacaagagcgugacacuuauuuguauguugagaagcauuuuaagucccacagggagagaccaggcugggaacugauaagagaaugcuguuuccuuuaaacccccuugcaugaaguucuugccucaguaguuguucuaaaugcauggaaccugauuagcagaaaauuugcuucugaaaaaugccaagagucagagauuuccacuugaaagcuccauugugaaccuguuggaauauguguaggugacaccauccaaugagcagggucccaaggugaaugaauaaaggagggagguaagcugagagagacccaggaucuuucucugguuucugacuauggcugcaauguggccuuccagucuugccacggcugccuugaaaugcuucucuucccaauucuugaguuaacauacucuuucauaaguugcuuucgguggcuuuauuuauuuauuuauuuauuuuuggauuuucgagacaggguuucucuguauagcccuggcuguccuggaacucacuuuguagaccaggcuggccucaaacucagaaaucuaccugccucugccuccugagugcugggauuaaaggcaugugccaccacgcccagcucauugguuauuuuauagcagaggcaagaaaaguagccaaugcauauacauacauauaauaaaauguaguauguauguuaaguagguacgguacuaaugaacugcaacaaauauccaaauauaaggaaagguaugugaauaugauugaucucaaaaauaucuugucuggcuauagaucguaacaaguucagcagauuauuuuuccuccuuucuuauuaaaucgagaacuuucaacuuuucacaucuaagaagcacuugauagcuuuucuuuaguaugcccaaauugucagcaucaccacucucaugcuugaaggccauuuugaaguaaaacaaggguuaguggagcagcagcaacaguugguccugauaacugaugacgccacucagugaguaacuggcagguagcaucuaaaacaaggacaccugacauauccauguucugggugggacagaacuggaugaugcaaacaguugcugcaucgcucagaacacccugaaaaugaaaacuuagguuuuacuuauguaugacuuucauuuaauaaucauuuuuuaucauugucuucuguaggcagcuagaacuaugaagagauacauaguagaaaguuguaaagaaaauacuacauuguuucauuucacccucaucaaaaucucuauaaaaguuaaucaacugaguccccagaggguggaccaaaugaggaauauucgagacucuugccccacauccaguuuugcuaaagugugacaacggagccaucagaggaaaugaaaaggugauaggugugguugugagugccagcauucauagcuacugaguggcugaggcaggaggguugcaaguucagggcuagccugggguuguauaguaaggcccugucccaaaagaacauagugaauaacaugugaccuuagaaauaaugaaaaggaagcguuaugacucuggagaccaagcagacuuuuugugaugccuaguaggaacacaucucucuaaugugcauucuuagauucuuuauugcugacacuguaucaaagauucuguggguagguauuaaagagccagugacucucugaagugugaggcaaacuaucauauacugacacguguucauuuucuagauauuagguucuuacguuuuuuuguaaggaugcauagccaaagcaaauuguacuguauuuccaggcucauagcuuaaacuuuccauuagacauuuuccacugacuucuugauggcaacauuaaauaaacaacaacaaaaacccuuaacuuuccuccuuucuucauaucaucucuguguaaauugcuggaucuuuucaacacccauacagccuuuaauucuucucuugccuguucuaccucuagcaugucacuauugguucuaagaucuccccuuccucuaggccuacaucauucccuuaggaccccuucuccugcuguuugauuuuugagauugcucuugcuugguucuuaaguucuggccaucuuuguuuuauaacacuggcaaaguuaaguuugaaagaucaccuucggcauauucagcugaguauuuaagaacauaguaucuguaggcaauggaauaauucuauaccugaauuauaacuuugaugcccuuuuugguaugugugucaccuaggugaagcuaacagaugucucugaucuguccuuuccccauuugggcucaccgaguucuaccugaaaggcuucuugggaaaguggagugagcuaacacauauaaggagcuuacuuagcacagugccagcacauuguaagcuuucagggcacaguuauuauuuucuucucaagaacagaaaauggcuuccuaauacauaccauacagaacagaaaaucuuucuguucuucccaacacuguugggacacgacuguuuucaguuuuacucugcaccuagcaagagaaaugucuugacuccuuauuucuuagauggcaucucaggccaugcuucagucccuugucugcauuuuuccuuaugugaucgcaucucagaaagucucacucaguuccuucugccuuccuucaagccucagugccuauacuuccuuaguaguuaucguuacaauggcucuuaccauuucuuaguuuuguuuguuuguuuguuuguuuguuuuucucucauugucucuagugcucaguuagugccuuauacaguauucugcauggucuguacuuauacguuuuuauguuucaaaaugugaaguugccuaucuauuguucuuagcauauuauguuguaguuuucuauucaaccaaaggaccauugcaaaauaaacaauauucuuuuucuuccuaagaguuugugguaacuauacaauugcauguucaucgggcugguuucuggaacuguaaaacuuuggaucagaagauaugcuauuaaaaaccuguaacacacuuacuguggagaccuggaaucucuugucgaguggagggacuugggaaaaccaucauccccuucuucucaguaccucguguagcucauucucagaaauauguuguuaaacaggcaagucaggcuugaugaacucucagaucuuuuuccagugcugaccucgaaaacuuugaugaaaguaacacucaacuuugcuaucugccuuugcccuggcuugcuuggguuuugacaguacauaguaucucaaacaaggcuuaugugccguccuuaaucgaaacuauuugucucuccuagugagcagacaaggcugagguuuaggaaaccacaucagcagauuucauuccagggcggggaacuguuucugacaaggaguccugcaaaguaugcacgcuucagagaaaagggaagagugcauaaacaaauccucccuuugcugaaggaggaugagaguuggagaucacauuauagcagagguauccuggaguguccuggguaaccagccaaaaauuugauccgguuucgcuuagcaugagguaacucaaccacaccaacugacauauuucuccagugaccucuacaucugaaaauguccccuaaaauacagcugucugcuccucauccuuugucccucgauauuuagcccaacagcucacacaauacgauugugcagauguuucuuucuccauuccuuuccaugagaguauauuagguuccuuuacauuucugacacuuuaaugacugagucaccuccuggagcucaggagccacuuucauguaccacagaccaucaagcucugagaaacuuuuguacuguguaaacagucucuugauucuguccaaucaccacugccacuaagugccuaguuaggguggacaauuuacugcaacuagcacuggcauucauaacccaaacucacugagaacaucacaugguauucucuaauauuggaggguucuacaucacauuucuuaaauucuacaucagagcuauugaugagauacugacauuuacaggcaagcugguuuuguuaugcuagccagagaaucaaaguuguuuuuuuguuuguuuguuuguuuuuguuguuguuguugguuuuuuuuucuggcuuuaccuauucuuucagaaaccugagugugucauuaauauuuaacgcugcauauaguuuucccaccaguaauaugcuccccagagauuuguccucagaguauaugggacaggguaauuaggucuauugauccuugccauacucaguguuaucguaauggugaucaauuuuaaaaguaagagguggaaauucauuuuagccaaggaacugggacagcucuuguuucucaaacauucuuugcccuagcagaggccuugcuaagcagcuaccagaucagaagguguucaaagcacuuuuuauagacuugauauaagaggucaaaaugaggacacacugcuucaccaagaaugggaaagucuuacacuuuaauagauuugggucaugguacaaguuucacaaaaccaaagccucagucacgggcuagccugccauuuagguagacaagugaauuaucugaaggaacauuccuuacguaaaauuuuuuaacauagauccagucucaggagauuuccuuuacuaauccucagaguagugcggguaauagcucauggcuggggauaucuucaaccagaugucuuugaugaccauauaguaauuugaagagggagauaaauuucuaaaguccuagaggaaugggcacugguuaagauagcuucuacaguugccaaugcauaaugucuuuccucuucgguuucccacagaaggcuuguuaaaaaaaaauuuuuuuuugagaauuucauauaugacgguuuuaagaccaccgacucucacuuauucaaagggaguagauuuaguuauauagcuagugggaacagaguuuagaggcuagaaacuauauugccaagugggcacacagccaaaagcaggaguccagcugcaagaggcauggucuauuggguugggcauggaggucaguugguagagugcuugccuagugugcaugaagcccuggauucugucccgaagagcucauaaaagagcucauugagccacauagcuauaaucccagaacucaaaggaucuaggcagguggaucaaaaauucaaggucauccucagguauauaagcaaguucauggucaaccuuggcuauauaagaccuuguaugcaaaagaaagcaagaugaucugcugaagaaaccuggagcuaaccccagacagcaagaucaguguaaugucaagccagggagcucugaacugaggacucuuuaucuuguuacuuguccugaaaccuuuugcuugugcccauugcccacguuuuucauaaggcuuaugcaaaucaugccuauugauuuccacacacacacaucuguauacauagccugagucaacuacagugagauccaaacucauuugaauuuaaauauuaacagcauauuuuuucccagauggcuuuggagugaacaaagucgguccuucuagcuagaaugguaaaugauuuugagaaaaaaaugaaucugucaucagaguaucuaaacauuuugaucuguuauguucauaucuuucuuuggcuugaaaaaauggaauugcuguuuguagaguucaauaaauuucuguugagauuuuauccaaguaauaugaauguuucuucagauccuggacuaugucauuaauuuaaauaugguuugggaucaucacaauaucuuguuguaaggauuuuauagucuagaagaggaagguugaaaucuuucaccauuauuuuagcaaaaucuccuuuucuuauuuacauuuaaguaauaaacuucuguuaguguuaucuauuauaaagaaaccuguauacuugucuacgaauuuuuuuaaguacuuucaaaaugaaagcagucacuuaagacuggaaaaaugcuuaagacaagguuaaacucacuaccuaaacugugugauuaguccauuggagugguuuguggauuccugaggguagauuuuggccuacaugagcaacuauguuaacuuuuaaacggguaguuuuuuccaaugugaacuucucuuaguagaaguuaggugaucuaugcuguauguaaauuaugugugguaaaacugaggucagucucccauuaagcagaagaggauuauucauuuccagauaugcaagucgcaucauaggauauaaauugcauagaaguguuuccuguauaguugugcugugcuaaacagaaaauaagggaaaguaacugaguauuucaauccacauagaucuugagaggcaccauggaucuuaccuuuguucuguucucaauccuguuccuuuugauugugcugcuuucucccccuuccuucagguauuugcuuccucuuuuccuuuuuuccuccagaaaugaagcucuguaacuuaaaguaugucauccggagacaucuaauuagcuagagcugcauacaaaguacagagcucccauuuuuuuuugaugacucacagagagauugacaauacaacuuauuguccaaaccagggcaauuuugagagagaaggaaaugguaaaaauaaugagcagauuuucugcucuaaaagguauaaacuuggccuuaggaaacuaaucuacauuccugauagccuauccacaaagaugcuaguaugucugguauaaaaggccacuaagaccaucuaaucuaucccuaguagaugaagcuaagaacauaccagcacucccuggugcugaccuaggccuuccaucuuauaggucaguuaucuucugacuacacacuguacuucacaacugagcauuacagaaagacaucaagcacaaagucacuuaauuuuuuuaggucccuccccgccuugaugaauaguuucuggauauagaacuucucaguagugaguuucaccacccucuccaaucacugcuuuacaacuaaucacauuuggugguacugguugaagccagaccacaauaucauucuccuauccucugucuuucacacccacaaauaaauaaucuaaacagauaccguagaaacauucagaucauugaaacucaaacguaauggucuuucuuucuuucuuauuggaagaaagggaaucuugcauugauuuuugagacacacuuuuccugaaaucuguacuugagugauuuaccugauaaccaacaagguaagguuaucuccugagauaaugagcauuggcuuacaccccuggguaauguguaagaaucagugaaacucccaguuguuacuuuuuguuaaguuuugaaaugguucagacuauagccaaaagaaauugggccagagacuaggaaucacuuuggaaaugaaugcaaugcucagugucucccauugcuguuacccugcacagucucauuuaucucugcucaggcaccagauccauaggaaaagaauaggcagcaacaacacaauuuguugugaaacacuucauuacauagcagaaauaacagaaaacauacuggugaguuuaaagauuuggggaaacaaugauuuauagaaaaagaacauuaucaaauccuaauggaaauguggauugugauugauacaaggcccuuaacguuaagaucaauaucuuacuucccuuuuauguauaguucaauaaucauuuauugacuagauagcauugcuggaugccaccauugauucccuaaggugacaggaguucuuccuuucauuugucuaauggcacugagugggggaauguucugcaguaaggaguguuagcacugcgauuugccuuaguaggaacugcaucaugggcucaacugagccuugcaaguuuccccucugucuguagauuuuuaucacuaccucccucuuaccuuucuucccaguugguauuuuccacccagugaauugguuaccuugauauuuuccucucuucuacaaaucaacuacuggauguccaggaaaaccagauauuuaccauccuaguuauagagauugaaaagauugaauaggaacacuggauaauuaacuuauaugggaacuuucuagaaaguuuguuaaugcggggguauauacaauuuugaaacuauggcugugguuuauuccuuuauuccugagucauuuauuucuguagaccucauacuccucuuacacacuuagcauuuuugauauuuuauuacuuguuccuuauuuugauuaauuuccuugccuagcuuuuauauguuugcagguuuuuuuuuuuauuuugucuuuucuuuagucaaaaucuucugucucuuccacauucucuuuaacuugucauauaugaguaaacagaaaaaauaauaauuugaaagguaaggauugacuuuaccuuuuauaugcuacuguaagugaaaccuggguuucugugcaugcugauaacccaucuacaacugaguuauaucacuaaccuuacaacucuaaaaauuaaaaaaaaaaggccuugaacuaguucaauuaaaacaucuuaucaucuguaugcaagacacacauuuauauuuggacuugcugaaaccaacacgcaugggcuucguuauguaugaaauucucucucuugugcugugcauuuuugugggggugggaaguauguuuagguggagacuguaggugguuguauuacaaauuggugggaguuaugguagcuauuugauuguuuucugguucuauaaugcuuaaccaaucauucauaugucuacuauccaauaaguaguagaagugagaguugaaaggagauuugucuggcugcaaggccacauucucucuccacuauacuauacugcuuccaaguacaaaugauuuuuaguuuuuucucuuuccaauauuauagcaaaaaaggaccacauauauuucccuacuggccucaguguucuuauauucaauuucuuuauaucccaaagucuuuugagucauuuuuauauuuauuaaggacuguaaucuuugauuuguauuuggggauuggacaaucuccccacauccauuuucuuuccccaacacguaugaauuucuuugaaaaauaucaaacugucauuugagacuaagaaagaagggcagaguauuuucaauuucuccuugucuugcaggcaugguuuucauuaggcuuuuugcauuucuugucagaaacaaacauuugggcccuggcuuauguuuaaucuuguguuuugcagauauagucucucccuaaugucaggaucuuuucaugaaugcauggugauucaguggccagguccuggcagugccauuauagugccuuagucuucaguacuugauugggauucuuaacacaagcugucucuucauugcuggcguguuaauucacaccaauagacaagcuagaaggccaggcagcaagcuggagaagacagugcacuggaauucuuuaacuugaucuugcuucagaauccccuugagcacuuguuaaaacucaaauucaguaggucugggguagaucccagcaagucacauuucaagcuagcuccuaggugguaacaguggugcuagucuagagaccucacucugagauucaugaccauaggaaaaaugggagauuagcuucacuacuugauucuuucucagacuuaagcacagugucuugguacagagucaauucucaauauaugucacugauucuuauucauucucucuguccuuuuccuagucaguuccauugcagaguugguuguaagagcaguaaguugcucugguccaguuuggcauauuuacccuguauuagguaacagguguguccaaauacuuuugggacaugcugucauauacaaucuucuuucuugagaaccauacaaauaugucacacacaaaaaccacagggggggggauugcgggggugguauaggggacuuuugggauagcauuugaaauguaaaugaagaaaauaccuaauaaaaauuggaaaaagaaaaaaacaaaaaaccaaaaacaacucuuucaaguauuuuuaugauguguuggaucgcauucauauuugaccuucagcauauguggccuuuggaacaucaguugaauacaucuguuagagacugggaacaugcaauaaaauuacccgccucugcacuuacauaugccuuccuaaaaaccaucuccuagaauuccauccaaauaaguuaucacauuuuucagcaaagcacuuauuuccacauuuuaaaauuaguacaauuaagugauauauaaacgagagcauugaugagaaugguacgugaagaccagguguucgcuaagcuugagcgacauaugacuuucuaguccaucuugaugguuggcucggugaagcucuucaaaggagcaguauuuuuaugacuauucucguaccucacuccuaucucuucuggaaauuuggucuucaacacuuuuaacugaaagagacaauuguaauucuuuuuuuuuucggugaucuuaucccuuuggcuuaguucaaccaguaagcagagugacucuccauaguugucuaguugcaaaagcagagaagacuucucauuuguccaguucucuguggcaccaaugucguaaaaaugagagcacacagaaaacucuccacacucuguucuuguucccuacagcuuagagaaccauaagugcuguauucgugcauuaagugccagaacauucagucuugcaccacauggaguccauuuacccuccuuauacucaaaugcaccaaauuguggcauugcuacaucuaacuagguauuaagcacaguauagucuuuucacaagacaugccucuuaaaagauuaagcuacucuacauaaaauaagugcuguuugacuuuaaauggacaaaaauggccauucaacaugauucuagccaauacuuuugggcaauagaguuugaaaucaaaauauaacaugauuccccgggaagcuguacagugaugaugauaauggaaaugauaaggauaacaacagccauuaaaaagguccugcuaugugcccuuuuaccuaauguggggcuuuucacuaacuccucucaacaacuccaagaguuaguacuauugcuuaauacuacucuguucucucucucucucucucucucucucucucucucucucucucucuccugauauuuuucaucuuuucuuugcagauuuccuugcacagguugcacauuuuguuaguuaggaaccacagaaaguaacagccacaagcaaaugccaggcuauauaugacacaugucaguuucccaacauuuuacuuugagggauauaggaauguauuacucaaggucuccgcuaaaaauuuuuuuggcucauucuuaguaugucuuaguucauaggucacuuucuacagauuauaccauaaucauaucauuugccucuuccuuuuccccccuccaaaucgacccacugacuguccaugcucucuuucaaauucuugacuuccuucuucauugauuacauucuucagcuagguccacccgaaucagggcugaggcuaggaucagccaucagugcugugaaggaccagaggauggagcugguuuuaguugcuauuuuuccauuuucagcgcuaacuaccaauaggcaaaccugccccuuuucuuuucuuuuuuuuuuaaauauggcuuucagggauuuaauuagguacuccacuguaaaguggaauuccagucugaagguccccggauacaaugaagaguccucaagaacaauggccucugcuaacucaguuaaauuagcuuuguuacccuggcauguuuuucauuccacguuuguguagcucuccaagcucugucauuagcuucuugcagaccauuagcuucuugcagaccacuagcuuggauccggaaguguugcuuucucccugaauccugcagagaggaggaucugagugucaaauuagugaggcaacucacauaagcccuauacaucagucaacaaaacuagauuccagcucggaucuagugauuuccaaaauugcgguuuucccaguucugucaccauucugauguucuaauugaauacaagaaauuuuguauugugaggcagaggaggcaggaggugaauuuggcaucacuaguggccagauucaaagauagaugcaguccuguaucuuugcccuauaaauuggcucguauucuaugguucccaagcccuacacugcuucuguucucuuuuaccuguucauuuaucuucccaggguauuuugggagacugaauucuaggacaggcuacucaucuuuauucucugcauugcaugugauggagaugggagguaauaaggcuuagggaguaggccaaguugaauuccuauaaaugguccacuuugugacacucccauaaccuucuguguuuuaaauauuuuauccuuuuauauuucccuuugauuugcaacaccaaauaaaacaucaacauaauuaaaggcuucggcuuaaaaucuuugcuuuuaugcucaccauaacuccaagcucaguuuugacccagauauaccugcuucagugcacuuuggucaguaaucacucucucuugcaaaggugaugaaagaacuagugucauggugacuccauugauaaggaccaagucucacuauauaguagcuaaugguaauauucauucucucucucucucucucucucucucucucuccauauauacauacauacuugugagaaaauauaauguaucuacuaaguuuuuguaaauagaaaagagcacauuguucuauaaaauggacaaacugaaaaagucagaaguccagagugguaaacuuuauaaaaguuugucaguuuuaaaauauuuuuaaaggaagauugagacauagaaaauucagagcccuuggcacucuuguuuauagaaaugcaagacaucuugacacaggcucuauuuucuaauauauucuguuaagaaagacaauuugaaaucauacuuaacaaaugaaaccguuuggagaagaaauaaaugaauuccuugauuuuguuuuggugcaguugaggcaccccugagaugaccauaaaaauagucuggaaugcaagaaaaaggucagggcuagaaagagauuucagaacauucaaaagaaagccgggaugauaccuguggaugagaugagccaaugcagauguuuugagacuauuaaaaauacagguuccuuggucuugccuuuggaaguucugauucagcacaucugggauggagccagcccccuuuauuuaacaagcuccccaggcuguuccgauuugcagccagguuaguucauuggcacauccaucaacucagcacuuggcuguugcuuuguugccuccaaaggggaucauaaaaugugaaagauucuucuccuguccuuucgaaagagaguaguuuccaaaacaaagcaaguuuaaagauaugguuuagggaaauauuuaugaaaacuuaagaaguaauggagccauucauuuccauuguggccuuugcuuuggguuaucuauuuauagaaaagggagcucuuucucucucucucucugugugugugugugugugugugugugaauuuagcccccaaacaggaaugaaugauuguuguacauuuuucaaaauuauacaaagaauuuuucuuuuuuuuaauuuuaguuuuacccaaauagaauauacuuagcaauuuuaauaucuucgucacuggaaaauguugcuugauuucaagaaauaugaccucauagacaagaaaaguuguauaugagcuuugagaaaaaucuuaccuuuggauaguuauauuaauaaaugauaguucuuguuugaguaaccugaaucagguaccagugcuaagccauacuugagguuaacuuuugaagauuuuacgguaaguguuguauccauaucugaggauaaacucauaacucuuucagauccauuacucaugugagacagauaaagcuaggaagcauuguucucacuuaccuaucuuucaggaagauagggggccuuuuuaaaggugcauuuuaggcuagcuauguaguccaguugaaugguaguaagagaaauagcuacugcaugcuccaaagagucaggcuccuuuacacugcaugugaacuguauuugccuuuucaguugaaccauaaguuuaguauagaaaggacagugguagguugggauagggaauuucacaaucuaaguuccaucuaauuuccuggcuguguaauuaaaacaguuuauaucuguguuggcuaucacauuggcuccuccuggaggcauauuuuaaaauaucuuccacugugauauuggaucuuuuacauauuuuuuagucuugaccucccucccccaaccuaucuagacuggugguuccuaauacauugccuuuucucuggguagggauucuuuuuuggugugggguaggaauucuuauuggauaagcuuccuaauggggaaugauuuccaaaaugauuaaucauacauuuuuacuguauaauuuacuuauguucagaaaauuacauguaccuuuuuugagaugaguuuucagaaauguuauaugcuaucuacaucuuaucccuauaaaauagagagaguaggaugggguuaauaccgucauuugguagacaugaaacugagacuugaaaugauauuggcacaaccucuuuuacauuuaguuguuuauuuuuauuuugcaugaggcauaggaagagggauagagcagguaauguauguggacaagcuuuccaaugguuuugcaggucuucaggugagugaucaucaccaucauuaggaauuuuucucauagaggaaaauuacaaagaacuaugugguuucucaaagccacauaguucauucaaguuuguggauagaugggacggagucacaaaguugguucaguauguuauguuguacuggugugaggguguauguauuauucacuuuucuguaaauaauaaaaaguguuugccauuauaaacuguacuuaagauuacauugucucaucgaaugcuguucaugcucagaccuucaauacacuaauuauucaucugcuugcucuauuuguauuaauccucauguugaagagcuuuaagacuucagagcuaugauuguuuauaauaaagucucuugagaauggccaaaaugcacugggagaaaucaguaaagguuucuguccccuucccagaccuauuuuucuguuucucugucacauuuuucacuaucuuuacacacacacacacacacacacacacacacacacacacacacaucuagauaauuaauucauucaugugcaauuaaaccuagaaugcagacuucauggagacaacacauaaaaaaaccaaaagcuuaagagaccuauuagugaaguucauuugagugccugagguauaaagaaucuuuauagccuugacaaaaucuaucuuuaaguguucuuuguuuaaccgcaguguacauguuauguucuauauuagugcucuugaccuuuuaauuaaaaucccuugaaaugaagauuucaagagaugacauagguuuuguugguuugcaacaguugacauuuguuaaggagaauaccaauuuuccuggcauuuauuaaaaaacaaaaacccuaagccucacuugcuauuucuuucccuaaaagggaaggcaaaaauggguucuguuguuguucaguuaguuuuccuguacaauuuuauuaaauuacauucagcuuuaaauggucuuccuagguucccaagcaaaaguaugcacuuauaaacauacugcuagcaaucauuuccugauaaaagaccuggaaacaucuacuuacuggaauaagaaggaggacagcaacagcggcguugcuuuauguccucucaaccgaaccugauuuuaaaaagcacaaccaaaaauguagccaguugggcugauuacauuagaucuaccuacccaauuucuguggcugcuuuaguugcaaaguucuuggugccaaacacauuucuucuuucuaacucucuuucuuuucuccucucucuucuucucugccucuuuuguccccccucccucuaggugccuguaggugcauaugugccccaguucaugggugaagaagaacuccauuuuagccuuuccaccuugcaaaggcaggggaccucucuugguuuugcuucugcacugcauauuccaggcuagcuauucuaugagguucuccauaguccuccugucuccaccucccuaggagugcugggguuacagauucggaauacugcaucuggauucuggggauugaacagaucucaugggauuuuccagcuaguaccuuuacccuuaauucuccuuugaauaaacccaccuacuuugugaacuuuguuaccacauuuuaugugugaagucuuucaagaaaguuggaaaauucagugaucaacucugcuuuuccucccacccuuugguuacuagugcuuuguuuuucuaguucauuuccugaagggauucuuguuuauucaauuagugggcuagugaguaagcugguucuacaugaguagauuucaaauggaagcagguguggcaagaucacagcuuggccuauuuguaacuaauucaauuugcuuaagcaaagugcccaccucuaucauuaaauguucauuucauauuugucaucacaagagaaaauuuugauuugggagugcuuuuuagaccauggaacgcucuuuagcuuaguggcuuuccaaguauucuccuggccgguuuccuaucaaacuggacccacuuacuacacacaguucuaauacaucuuuuccaggcacaaucuuuccagaaagcucuuaggacauuuccuacuuuuaauuuuugaaccugcagucugcuuuauaaugugcaaagccauuuacacaaucuuuucuauauuguuucuuuaaauguucaacaaacgagauuucaucacaaaaugagccaaaauaugcuagauugacaguaugcauaaacugucuccugacaucaagauaacuauguuuccacauugugcaugcuugauuucuauaaaacccucaaacaaaucagauuuaaagggaagcuugaacuucuuaauuccacagaaacuaauaccuggcuuauaauaccugguuucuagcaucuaaaaaacuagucuaaaauuaacaaaacguuaccuguucuuguguugaagagacagauuuuccuguagaacauuuaguaaugcugcgauugcauagaugcugaaugaguuuagaugaaggcaaaauauuuucaaaacaaacaacaacauaauuauuacuucaucuaaauguagucuauuuggccuuccuuccuuccuuccuuccuuccuuccuuccuuccuuccuuccuuccuccuacucuccaaggcacuuaaucuuugagaugcccaaagaagaaauuaguaguaccacacuccaaagaaaguauagcuuacuuggcugucacugaucacaacaguucuaccaucuuuagugguuccuaucccaccaacaagaaagcagggauuucucuacauaauuacauuguuuuccuuuguguuaacauacuaauuuaucagggcaccaggaacaugagagaaccacuucuuaugcaugauagguuagauaagaaaccaaaaucaaauuuugcuuuucuuucuauaguuucagauuuuugaucuuuggggcuccagagaaguucaagcuaugugaaaccuguuucuacagaaaagauauguguaugaugguggucucaaccuauaagaaagggucauaacaguagucuaugggaagaaggaggaaggggacaagaaacuugcaaggaaaagaaauaguuaaacuaauaggacaauuuagaagguaaacaaaugauaugaaaacaaaagcaagacauuucaagcauaaaaauaaguaauauuucaaauccuauuugacacuagaucucaaacuugcuaagaugaaugugauaacaggcccgguccuuguagaaguccagccaguaggauacuuauucugacucauuuuaucaguaaugaagaugacuuucucuuaaauucaacuucaagcuuuguguauaggacuaguuucaggagauuuguuugguuguugucuguuauuguuauuguuguuuuuaagacaguguuucccuguguaacccugauugcccuggcacucuguagaccaggguggccucuaacucauagagaucugccugucucugccuccagaaugcugggauuaaaguggugugcuaccaccaccugacuuagcacucaucagaauggguaaccuguuuuuuucccaugagguccugaacuaaugagagguccaaaacuugcuuucaaauauuagaacuugcuaccucaaaauucuucauauuuuugaagaaggauguacauuuucuuuugcacugagccugagaaauuaugaggcauacucuuguuuuugucccauacugcuuuaacaaguaucaccuuaucauaaaacaagauuuccacuagccuuuugucuuguguuuucuauggugauguaauaaaacaccgugaccaaaaagcaaguugucaaagaaaggguuuauuugacuuuccauauuguuguucaucacuaaaggaagucaggacaggagcucaaguaggaccggaaccuggaggcaggagcugaugcagaggccaugguggagugcuauuuacuggauuacucuuugcuuucuucuagaagccaggaccaccagcccaggggggacaucacucacaauaagcugggcccucccacagcaaucgcuaauuaagaaaaugcaugacaggcuuacccauaggcccaucuugugagaacauuuuuuuucuauccacaggacuaucuugugagaacauuuuguucaagugacucuaguuugugucaaguugacauaaaacuaaccagcauagcuuucuuacaccuuuucauucucuacgugccacuccagcuguguugcagagaaggaagccucagauaaaauucaucuauuccuaaguuuagaguauuuaauggguuuuccuuucaaguaccaauuaccuucuaaaagaggauagcacauaagccuagugugacaggugauguucagaggaaugcauuuugaggcaaauuaaaaaaaaaagguguuugugauguuacagaaacauuggugacauuugaacugugcuaguuacuaagcccguucuuuuucccuucaaggcaggguuucucuguguagcccuggcuguccuggaacucacucuguagaccaggcuggccuugaacucagaaauccggcugccuuuuucucccaagugcugggauuaaaggaaugagccaccacugcccuccaagcccguccuuagguaccauuccauucacaaaucaaaagcagucugaugguuucugcauuccucuacagauagccccaggacccaugugauaggagaaaaccaacucucacaagcuguccugagaccuccauuaacuagauagaaacauaugcaacaaaaauuuaaaauaaguaaugagauacacuggacaaagauuauuuguuauauacuauugguucuagaaaagugacaucacauuuuaugugaaagaguuggauguccacaggagaccuggaacaaacucuuuuucaccaacacugaggggacaacuguaauaagaucugcacucaaugaacucaaagucuggcugaggagguagacaaugacccagugagaauaucuguuuguggcugaggacaucuggcuagaguuaagaacuugaauuccuaaucugaggcucagaggaaggcccuuacuaaccugcagcaagggaguucauauaacccagaguucuguccaggaaacugagacucugugaagcaagguagagugucaagauuggauggauugccauaauugacuagggcauagaaaucauauaaauccaagcuuacugccaccaauacaaauguugcagcuggauaaagugucagagcaaaacuugaagccccaagggacuugauccugaguauuaugcuguccagccucuucuccaguuuccaagguuaccaugagaucuggcugaguuucccuaggggaucuaugaggcaucucauuuguagucacucaagaaaauaguaggugaugaaguuuggcuaacuuagcugaagacaaaauugaaagguguuacgauuuacagaacacuagagaaaaaauguuccauauguguccagccacagauaaauggauaagaaaaauguguauauacacaacagcuguuuuuguaaucauaaagaggaauaaaguuauaucaucucaggaaaauagacagucauauuuuuugagcaaggguaaaaaaaaagaaauaucauauuuucugucacuuuugguuccuagauuuuggaauggauaaaaguguguguguguguguguguguguguguguguguguguguguguguguguaagaaaaacaaaacuguauagaggaauaaaugaagggaaagggagauaagggaaaauagugggaauauuuucaacauaaauauauacuuauauaaagacuuaagaaauaaggaaguaaaaagauaaaaguuaucacugauaguuuguauacuacaccacuggaguuagggguuauuuugaaacaacggguccucuagaauuauuccuugagcagcaacuccccuaaauuaucaaggcaguagaugcugaaccucaucucaauaaguaguacccugaugcauagaaacagagaauguuucaaacuuagaaaaggcugccuuuuuaguaguuucucuucugguuaagauaaaauaugcucggcaggaaagaugguccagggagugcauaaagaugugaggagcugagcucagugcccagaaacaaugaaaagguggaagggagacaacuuguucucuggccucaccagaucugcaccaaacuccacauggucucccucccccaagccccugccucgguacaaugcacggaauuucuaguuaguuuacuuuguuuuaaaauagacuuucuccuguuagcucgccccauuccugguagcuuugguaacuuuguacacuuuuuuuuuuugccuuaucaugcaacauaguuaaacaaacaaacaaacaaacaaacaaacaacacgugcuccuuuuaauuguagaagcugagcugaaacuuacagcagcacaccagaauaaauuuucaacauuacucacgcaauguuuaauguuuuaaaaggaaaucuaaauuauggaaauaguaaacugugaaaaaugaccauagucacuggccagucacuuuugcucuguggaauauacuggaguccacguauuauagugauaaugauuguugauuguuuacucggaggcauuuaugaaagggcuggccuucugucuuucauacuguagccguccagagagauagacuagucuuccaguacauaacaugcuuugcaaaugucucaauaugauuuauaguacuuguaauauaaccuuuuaaaaucauauuuuaaguccguaaguguuuagauacacaugcaagauacuaaacuuguuuuacugguauuuuuuuuugaaguuuugaaugaaaaauggcacuuugcuggauuuuuuuuuguaacaaucuaucuuauuggauguaagucaggcuauucagaauagaaguuugaaauuuucucuugcuucaccccaccuugaccaggcauugcaacacgaauuuggaauugagaccaugugugacccuuauccauuuauuuaauaucuaauccuagcaaaccauaagcagacucagugccuuuguaguuuuucauggcuaugaccacuuucugugaguuaccacaaggggagggcaagcucccuggccagcagauaaagaagaguuuuuccaaaggacauuguaccugaggaauauaauggcuuuuaacuuccuugcuucuuuugauuauaucaguuguuuuuggguuguuuucgccagguguguuguagcuacuaaguuguuuucuuuuuuuuuuuuuucuuuaacucucugugauccacauaauagaugcuuuucagcugaagccaccauuucauugaauauugauacagggauuggaucauucaaccacaucuuuauuaaauguccucuuaagugucagcgcugugagguaaauaccaagucaagaagauaggaguccacaggcuagagggaacccggauggaugaauggcuauuugcaauauguugugauuagcucugauagggugcugcuggaaccaacccgaaaggacugugccuacuucuucacgucuguucuucuacuugaaaauccauuagcacauucagccacuaaguaggcaaccuaguuuuuggaaacaggauuaagggggagaauauuuacaacugagguucugcugagauccagauaaauuuaggcucugggaugccugaggccaugaugggagguagguuuacaacaccaauucacagcagugaaagcuggaggaggguaaagaaugggagagagcuauagaagccauucuacccgaagcaggcaaagauaaaaaaauugcauugcucacccguccacaugugugugccuucaagacuaagaaggugccugacccuggcguagacuugugcauuucuccuaagcuauauuuagcugucaaguccucaaauuucuacauagcaacuuacacacacgaggaggccuccucugugcuuagggacauucucaggcacuuacguuuugacucuggaauucacagacccugcucugguguguguuuuauugcuuucagcuuauuuccuguucucuugauuaaaaacuaaaaagcucuguagaaaugacaaguuuaaaaaggagcagacaccaaacauugcuuacugcuguccauucugcccaggugaagggacuccagagcaacugggaacaaaagcacuaaauggggccagcuuucugcaaugucuuguucaaagaaagaaagaagugcuugggaggcuuagcuuuucccagugcucuguggagguuuguuuuuccuguuaaguuuagaacuguuuauuuuuuuuuucuuucauucuaaugucucuugggcagauagaggagaaaccuccugcauuagcgucauuuaagugaugcuaaaagggcuaucagggggcaacugaaaaugaucagcuucgacagcucaagauggaccagcucuuucuuuucaccuccugaggguuuaaacacucucaacuuuauuaacaagaacuugcuaggacaagucugcuaagcuuaucucguuccaaaugaacacuuuaauucaucaccagcuuacagcgacucucugaagguuuacagaaggaauaccauacaaaaagcucucaggggugcaaggcagugaucugguacuggcccuagacaguguugguuuuauacacaaauauauaagcuauuuguguugugagcagucaggcagugguggccugagggguugugcuaaaauggaguucauaaaaagauaucacccaggguucagaguugugguauuucugaaugugguaacuuagaagaaaauuguugaaaaaagucugcgugguauaagguuugguauauauuuaauaaaagcauuaaaccuuuuaauuccacagaagggcauuguuaaauguauuuuuauccaucaucuuagcuagaaaucugaauaguuucagacacucauuaagcccuuaaauuucuuaauagaaauuuuaaacauaugcucauauauguuaacuguaauaacuuuuccuugauacauuuuuguguguuuguaccuuuaauagguaacaagguguuaaguauuuuuuauuuaauuaugcucuuuuuaaaaaccuccccaacuuauaauaugugcaguguuuaauuaaaaugcauuuuuacuaagucauaaugaaaaauuucuuggagaggcaaucaguuuuuaaugucagcuuacuuugauggcaggguguguguguguguguguguguguauaugacucuccugguguguauguuuuaacucaagcuaaucacaaaccaaaagauuaucauuaucauuuuauuacauuacucuaguuaaagagaauacaucaaaagaaaaaaugcauuuggaaguccuuugcauaauggucuuuuguugaaaagaaaccuagcucccucccuccccuaguguguauagaacaauucaggaccauucuggcagcuggccauggcgucugcccuggcguuggcaagaacagaugguuuuggggucuguuguucacauuugauuuccauguuacaaauuuugaaugaagucuuuacugaacccuuuguccugcagucugcagcucuucacaucagggggcaguuaggcgccgguccugacaugccaauuugacaccagaguacugcccuuuaucagaacuuggauuccccuagcucuggcccucuacuggaaggaagcaguaaguguggguauacugcccucugguguccagcucggggagcugccgaaggcuggaguucugcauucuaggaacccaggggagaaaacugcuugccuuggcuuucugaucaguugggaacagccucuuugaaugccagagccuuaccacaaaagcuccugagaugugaaugguacaauguuuuaggcuuugaaugcugggaaugacuuuaaucuuaagaucacgcuaccuuccuuggcucauuucagacauauuaauugagcauguacuauguaauuuacuauauaacuuuuaauucaggauuuuuaaaaauuagucuaugcuaaguacacagugcccuggcaugaagcauaugacagugaaaaaagaaugacaaaauccccaaauuauacugggugggggauggggacaaucaggaggcccuuguaagaagccaccaagucagaaaguaacaauaauggcaaucuuaaacuuuugcuagggcucugaagaaaaagaaaauuggagcucaagagagaugcugugugguagugauggaaugaugagaaaaaauaauuuccaagugguuuugagaaguuaggcuagggagacagaaaggccugaagucucccaggccuuuuguggugagcaucagauuaugauacauauuuccugauuccaaagcgaauauucuuacuucugauaugaaucuagguagaacaacccaagucacugcucagaugcuucuguguaucgggcagauagcucaaccacagcacaaacacaaaugacuucccucucguugaugaucugaauagagaauuaugugucugaaaaguaucuuguacauagaaguucacagucaccccuacgagagauuuuauuguuuauaugugcuauuagauacucuacucuuugggccuagcugauuguguguugggggaggggcauaugauggcuaugccuuagguuuccagagaagcugcagcauccgaucacuuagugcugguccaucuuguuagcugcagcaggaugaugcccccagugucuuccuggacuucacuuuugggguuaaguagaagcuaucuugguuugcaucgaaaggauccaagccaggagaacucuauggagggauggcuucuuuuguucaccaaaugaccaugguggucaacacacuaguaaacuggagcccucaugcacaugucagugagaacagacaugcccuuuguggagagcccauuccaucgacacuuugccaugccuuuggcccggucagcuuuuacuucccaacuuucuuugcaugaggcuaucuauaguguucuuacgacuucucuucagaagaaaauagccucuuuucuucaugcuuccuuuuuguguagcacuucaaagacuagcugggagaaugucucccauucaccuuuaaggguuaauuucaccauuauauaaucaacugucaugcauaaguguggguuguaucuagggaguuuuuaaaaaaucaacauguuugagacuauagagauaaauacauuuuauauauacuacaaucucguacucuucacugucucaaccaauuuagaggacagcacaggagacaauaaaauaugaugaguauaauccagaggucaguuuucccagggccucuuugaguguaaucacucuccugagaaaacaaucaccuccuccucuuucacaaaaagccugcuccauaugguugggggaggggaagaaguuccuucuuuaccuuuggcgccuccugaucaccaggaccucuuugcugaaaaguacuuuuccuccccuucaugguuuuuaacuuuauucucauucuuucucucuauuucuuuguuuuuccuucucccacuuucuguccuuagcugguaaauuagccagugagucuggagugaggcgcuuguuuguuuguuugccucugggaggacugguuuccauuucuucccuaucauucagccaacugacuccuuguccauggaguccucugguuaccuuuuucugagcccuggguagggggcgggacaggggcuccgcacucgcugaccucauuuuguugcauguccuggaucagaacucuuuuggaaauuagccuuggggagcuuuacaaaaaaagaaaaaguauucaacaggaguuccccaaauuuuuagcugacugagaauuucaccgguuuuggaaauucuucuguuaaguacucccugcucuuguucacuaaagccgaagaagagcaaaaugauccauuugugaugauugaaaaugacaaucacuuauguuugugcaguauuuucaaaaagacauugaaauucuuuugagguguguguguguugcacauaccauaguacacauguggagaccagaaaaaaaaccuguaggaguuuugaacugucccuccacaugcaggccccagggaucaaauucaaguugucagccuuggcuaccaacauccuuaaccacuaagccaucucaccagcucuuuaaaauuauuuugcauuugucucaucuuucuccugcaacaaccguaggagagguauaagugcaucucuacugggugacuaaccagugagauagagucaguugagauccuagcagacacugaaucagaaaauuugcuuucagcuuacagcucauagaaguagcccauguuuucuagugacccuggaagcaguuuguucugugguaaccaaacaagcaucaaagcagagagguaucucuggaagaucuucacacacucauaggaguuacgugccagcgaguauggaaggggaugagagcagcagggaucauuuugcagagucuguccaguagagcuuggguaucaaaaucuuagggaaaagagaacuccgcuaucuuuguggcaaaaaaggauuaugcgccuuuaaugccagcacuugggaggaaaaggcagguagaucucaugaguuggaggccagccuggucuauagagugaguuccagcacagccagggcuacacagagaaacucugccuggaaaaaaacaaacaaaaagaaaacaaagucacaccaaacagcuacauaaaagaagaguugugcaucaagcccaaggcagaguuaaacauccacugcaggaggagaccuguggcacaccccuucguuugguucacuuaccacaaugccaguguaguggucauaaggcucuugauuuggaacuuuucuuagugaagaggaaugguugguuauguuuaaaaacacuguccauguuuucacucuuucugugugaaauauguguucuuuacuuuggacaggauuguguuaaaaggagcuuuuugauuaaagacuuguaucuuuucuagaucuuuugucccugaugguugacuuguaaguuuuguaaaccuagguccuuaucaaucuauugauuucauauuagacuguguaggcauagguaucagucuauggcucuagacacugauugccauauagucacaguaaaacacugagucucaugaacugguagccuucgcaagggggaaaaaauaagacauguuggaauuuuaauuuccugagaaugucaacuuacugugccugucaagacauuaaucuggagcuacuguuuacuuacggaauauuagucuuauacacuuaaucagacauuguguuaucuuaugaaaugguuauccuucagagacaucaccaguccuuguauucagagccacaucuugccuuuugaugagguaagccuaugugucaguaagacaugaguaaugugaaaacuagcacccagcacuaaagacccaaucacugacauccucuagcauccaucugagagaguaccuauuugucugucuuucucaucucauuugauucucucagaaaaaagaucuuaugaaauuaacaaaaagagagcaaggaaagguauggaggagcauuugaagagaggaaaggggggggagagauuaauguaauuauuauacaaucucaaaagaugaaauuuuuuuuaaauuccuaugaacuaauaguaugacuugccauucacagaagauaaagaagagacuugguauucacauaaccuucugucccuaaaaaguuguggagcugagacuugggaccauguuuuuaccuagcucaagagcauacauggcuucuugcaaaaggaacugaauuuaugaaaaaacuuaggucaucucuaucuuugaugaacagacggguaagaucugaaccaaaagaggaagcaagagccaggccuggugugaaagcaagugaaguccccuaaagaaagguuccccaccccaaguuagucccccuuacuugagaaaucugcauuuuacgaggggccucucaacauuuccuacugacuuguuucucacagggaagaagccaguggauacucaaauaaaaucagaagcaaagcucccaagccaaaaaaaacaaaaaaacaaaacaaaacaaaacaaaacaaaagaguuuucugaaacagacaaacccagagagaaauagaguagguaguugccuauggcuggaggagggucugcaggaaauacaaagugaccauggauauguacagaauuucuuuuggaggugaauauguuuaggaaucuaagaguggugauacugugcaucuguguacacacacacacacacacacaaacacacacacacacaucuuuaaagaaguaauauuuaugguaugcguguuacaugucaacuuuuuaagaacagugaugauugagugcccuauccccuuccccuuccaccuccuuuucuaccacuuuccuuaaugucaguaccuucugaagagucugcuguuaagggagaaagcuccuggaaauggaaugucugcuuaaaguauccauauccuuggggguucacagugcucugggaugccauucguggccuaugacccuugacuaaagaacagagcuuugaaaucagcucugcccaggagcuggucgguaugggcuccuagcuuucagugcagauuuucuacucccugauuucaaguuuccuaucaaaagugugagagccaguucagguuuccccuucucugcaggauacgaagggaaaggcuguucuuuaccuuaugagaaaugugacuaguuagaaguguaacuucccucgaacagguugauuuaucuugaaguacagcaauuugcuacacgugcguuuuuagaaagcacuaaucaauuccaggucaggaucaguuaaagcgccccacaaauugauagugaggucuuaaaaaggcucagcagccuuggaacauuaaauuuacuugcuguaaauuuggaauaagagcauaaagaaucacuuuccagcaggaugaugaaaauucaucauguucauuauguguuucuucagaagcacacuacauuaauuuuccagcucaacuaaguggaggauguaggguuucucguuacuaaaaaacuugcucugauguugagaagggcgcuccaguuccauuaaugaauccagucugcucugacuugagaugcuguuuaauguguccuaaagcucuaacauggcucagugucauccaaaccaauaccagguuuucuccccuuaaaacagcggccaggaagguguuuauaagacuccuuuuguuuuccaagcaccgagugcaauagcuuacaaucagcucacgauuauccgugguagcagaggagagcaaugguguggcuccacuuagguuaaaaucuuuaucuuugagcuaugugcugguccacauuugccucuggggauguauccaaaugaaggauagaggaagacaaagcaauccagcaucucuuccuugaaggccucuccagaaauuuccuucacucuugagcauguuggagaaugauagcuuuccccucuccccacagagggggcuuguucgagauagcaagcaacauguuucucuguuugaugggcccuucugcugagcugcagccagcacagggaaguucaaaggaaaagcaaggcaccaggaugcucaggcacuguguccugucaucugcuuuacuucauuuugcugauaagaacuugaaagcaacaucagucuuccaagaauuacugacacaugcugggcuugucuuucuagcuguaagauguacuuuccaugccauuuuaaagaacccuccccaaagagcuuugcggauuauuccugggcacagaaccacuucgugcuuccugaagagcugcuuguguuguugagaagagcagcagcuauuaaauaacuucuaaaaaugcuagcugagagugcauauggggaaacagagguuacaccuaagguuuauaccugugcuccaguacuucuaagccugggguuauuuagagguuuuuccuugggcuuuuucaacuacauuggauccuaggacacuagaacccugggcuccuuuucaggcuuugcgucgguacagggggaggcuuaugaagcugauauccuuuagacucauacaggccuuuucggucaucuucucccuauaacccuuagguacaugccaaacuugcagcuguucaucuguauccuugcugccaaauguuuuggcagucuauuugcauauacaugauacccaaacuuguggucugcaagcaugagagcuaaacagaaaauuugaguguuagcucuccuguuuaaauuccacagucauuucguugcucuuugucaguggcggugacaaaaagugccgagcuauaaguaaucugaugggaagggggccauccaagcugcauuuguguuagagguugaacagacaugugcaauccaucaggcagucauauauaacucgaaacuucacagagucugguccugacuuguuuuaugguaagguccuaggaggggauaaggaagaggaaaugcaggaaaugaaaagcaugagagaaggaaagggggagggggcagaaauguggauuaggaaauuugaagagacauacugagaggacaaaugugucugugaguuaaaacaggggccagguguggggugcaagccuguaaucccagcuacuggaagcccugaagcaggcacaaugcaaguugauucaagauggcuuugaaaacauagugagacccgucuaaaaguaaaaauauuaagaacgugcuagagugugacucgacgaggaagacuguguaguaugcuuaaaacuccagccuuaauccccaacaaugcaauguguguaugugcaaauacacacacacacacacacacacacacacacacacacacacacacacacacaaucuacucacaccuuaguauaguaucuggcccagagcagcagucacugaggauagcaauaaugugguuuaguagugaugugguugaugcaggugauaauguugcccauccauccucuuauagaaagaaauagcuuugucucuuucccuggucuucuccagugcccucacuugccuaccagccauauuucaucagauuuccacuucuucagucuaguccaucuguggcaaaagcauugucuuugaaaucuuuuucaacaagucaauaagugcuaggcaauuucacagaucuugagacgaugagaaaaggaaaguuaauauuugggauaagccacaauggaaaaguucucugcaacucaguaugauucgucuauaaucauacaaaaccagaauucauuuggagcuuugcuuuuggaaguuuuuaagugagguauucaggucuuucuuugccuuucuuugcuuucguugccugugaguuaacaauugcauagguagcuugugcagagauugauccaggugguaguguugcccauucaccuucuacuagacagaaaacaacugaaccuaauucauucuuaagggaccagaauucugucaguagcugcccugagucugcugggacagccuuguguaagcaaguggguaacuuuggcaauuauuuugaggcuaacuaacuuaaacucaaaauuagcugaggaccauauuuccaaggcaucaguaacuacccaucucugagagaagguaaauaguuagaguauaaaauuuuuuucuauuaaauacucuaaggcagaaaggcaguuagaaugagauuuccccaagucuucuaaaaauaaggggaaaugguuauggcagggacaguuuuuuaaaaaaucaaauauuacuaaaaauauuucuuaagguuaaagagaaaugaacugugcuauugaauaguuagaaagcuauaaauaacuccuaaccuccaaauaacauucucuccagucccaccuuuuuaagauuagaaaaauuuaguggcuugucacagcuuaugagaucgaggcugaauuccauagcauugcaucuaaguuccugcccagccuggccccagccuccuuuuccauauggucuccauagccauuuuauuucauccacccauauggcauuuauagagagacaccauguggaagacauugcuagguguauugugaucuaacaccacauuacucccuuuugguaggggcuuuauuaguuccccauggcccuacuugggccccauuaaaaaaauuaugaggugcugagugucuggcaaugauuguagaaauggccugggggaaaauuggacacggauauggugggagaaggaagaaagacauugaacagcaaaauugauagguacaaaccacucuguauauuucagugaauuuccaacucccacaaacuuagugaaaaccaugcaaacugaaauuggguaagcagugugugauauauuaacauaauaaaacaucacauuacauggaaauguguaugugaaauaauguuaguaguaacaguuaauuaacauugaugaaaugcuuauuagaugcugagcauuguuguauauauggauaugauguauauguguauguauguguuuacaaauguaacuaucacauccgaacuuagccauuaauuuggcccaguguuacagguagacauaacaaacaucagaaugguuaagagccaaggucacauauuuaacacauaauagagucacaauuugagaugauauauguuccagcgucugugcucuuuaguauacaucugucucugugcaggaaaaaaaauuaccaaaaugugugugaauuuagcuaacuacauauaaguacauuuguaaaaacaauucacugugagacaaauaaacugagucaggaauuaauguaauagcuuuaaguaagacauuuggccugcuuagcaauuguuucgucaucaguaaacacuucucuuccuguacagcuaccuuuugaggauuuaaugagauaauuucuaccacauuccuugugauguccuuugauaaugagcauguuuuucaaaaccaaccauaauugucgaccauauuucuacuaguuagaaaaguaaacgcagaguguaugcgaauauuucaagucuucugcaguugucuaagguauuuuuaugcaguuuuauuuuucugcaguugucuaagguauuuuuauggucuucagauccggcuagauugcaacaaaauaagaaauauccuugauuuuuagaaggaaggacaaacaagcagauugcuaguuugauaucauggaaacaagguaauuaguggauuaacuagaaguuuucuucuuaaaauuuaaugguguccaacaugaaccauucguaucuaucuagcauccucugaccuuucaucgcuuugcuuauucuuuaauccauuaauuuagcgaacauagccaagaaccuccugcauacccaugucauaucuugacucuggaguuaaggugaaggacacacauagcccuugcuuucagugcaauauaguguagcucaggagguggauuuguaaguauguaugcuucaguguguauaauuuacuauaaauauccuaugagagugaacgagaagcacaggccaaaguaguuuucauuuucuaauauagcuuuccuuuucauuaaauugaauguuuagauacaucacagguaucuagacuuuaagaaacuaugguuuuuugaggaacugcaugaucaagcuuucugagcccuaugauauuuguacauggcuaaacuuccacgcaaauauuuugauaucaugucuggugucuuggauaaccagugccuuuguaacaucuuuauaugacuuaagagucucaccugguauuuucuaaucauacacagaaccuuuguucuuacuauauucaaaccaaauucucaagagauaccuaggcaauaggagaugagcuggacaaacuagucuuucugguuuagcaucuaucuguuagaugcugccauauguuugaagugaccuuuuucuuguucuuuuuuuuaaucauagagauuaugcuaauacuggaauaaaguguauauucaucuugcuagaagugagaauacuugggaacuuucuuacauuuuuagcugcuuaucauagcuaauaaucuauuucuuucaauuaaugucggucaccagaugaguccauuauuaauuuaauuucccaaaauuugccuguaaguuugaaacagcuuuaugaguuucuguuuggauggcaaguuaugggucaaccccaucuagcuaaagaggggacgucagacaagccaaggccuacuuauuagccuuuugucauucugucuuucccauucugcuuuggguguugguuugcccuuaauaguccccauuaagaagacucaucaaggaguugugguagcuuaggcaaucauguugguauggucaucgauacguaggagcaacaacacaccuagguuuguagaucuacuuauggcuuagaauucaagaaagaaagaaggaugucaauauggggaacaaaagauguauggagaagaggugagagcaggaaaauaagauugucuauucuuuuaguuuuuguuaguuuuuugagacuuuuguacaauugauucauggguauaagauauuaggagucgguuuaauacuguguccauauucugcccuaauuuaaacauauuuuaggagugcacagguguguugugugaguaugauguauauggggugacacaugccuuagugaguguaugaagaucagaaggcacuccuauuggguuaguucugucucuccaacuuucauguguguucugcagguugaacuuugaguugcaauugcuuuuccccacugauaagucccacagacaccacacucauuuuugaggauguucauugcugugagagaauaagaacccguccuggauuaugauuggaaugcgagugucucuuaagucacaggguguuggggauacaggcuuagucuuguccuggcccuugggcuaccacuaggaaaggcuuaagaaggaagcaacucugguggagaggcacaacagccagagaauguggacacagagauuaggagauggaaauagacguaaaaaaucuugagauauccagccccaaagacucagagauuaacugcuaacaaggagcgaaggggauugagcgccguuugcuacauauaauggagaagcuuuuuucuuaaugauuuuccacauccuccauaguuauauuuugcuacagcaguugaaagcccaaaauacaguugaugaucacuaaugcuaacaacagggcucauggaguucugugcaucauagggauggaccacacaugccugaggaaggguccugugaaggacuggaauuuguggaauguuuggugucauuacucagaaggccaggagggggcgccaaccauuuuguugcuucucugguguaacaagauuuuuuuuuuuuuuugagaaaguuuuccucagaaauaacaaagaauuuugcuuaccauauuaccccaguucucucucucucucucucucgcucgcucucucucucucucucucuugcacacacacacacaaacacaaagcagacacaguauguauguguuaaugguguauuuagaguaauagauaagcuacuaauaauuccaaaacuguaauucuaaacauucaagguaccauggaugcaaaagggccucuuugaugugacagaaaagaugucuuuuaccauuguuccuucuacucacucauugacauuugccaugcacaccauuuuuuuuuccuucugagaaguucuuuacuuuccauuaauguuggucucauccuuucuacagauaacacuuuaaaaaaaaaacagcucuggcuauaaaucuuuccuuaaacuuuuaaauuuucacuuguaaaugaauacauacuaauguuuggaguuaucagaagguauacuuacacuucuucuagaugucuagaggugcuuuguuaauggauuaugguucuguuuccaagguaucgcuuuugaaaaugaugcucuccgcacuagcagugccucugcauagcgaauuguucaugcacaauuaugucauuucuuagucaauguauaaagucuuuagcuuuguuauaaucucuuuacugcaaauuuuguuuuuguuguaauuguuggggaauuuuguggguuuuuuuuucuuuuuuuguuuuguucgguuuguuuuuguaguuaagagagcacgauuggucacagggcauguacguugaugcucuaguccugcuaucauuugugaguuacucugacuauguucuuauuacuagcuccuacacgcugugugucagagguuaugcauguuugucuguggaggaaugcgugugcauaugugcauguacguuuuccaacuuaggcaucuccccccagagacuuguacuuaauaaaaauauacauccuauucucucuuuuuauaucauuggugauuucauuaauaaugaguauaccaguugguacuacuuucucucuuucaccaaggagaaugucuggucucucauauugaauguuagugaagaaagcuagaugguuccagcucuguaccacuuaggaauugugacgguuugggcagcuuaguuuggcuuccugaaccugcauuuuucucuccauaaaguggugaggggaaccaccauaaucaccuuacuggaugguuggaaaaaaggcacagaguguguaugaggguugguggguggugauacugucagcccaaacaaaguaagaugaguccagcuauguugggaagaacaccaaggaaaugaccgcuugccggcacccagccuuucuucauguuuguacgcagcagucuuuguuuuagcaucaauacucacuuacccauguucaaacaaauuaauguucucaccuggcccaaucauuuuuuuaagcaaguuuaguagccacuguguaagcuggcccacauaaccccuuggcuuaaaaaaacaaaaaaguacuaucugccacuguacuuuuaauaagcauugagaauugacagggaaacuuuauuuuuuauauggacacauucagugcccuauaucuggcaugcucucagagauacaggggaaggagagcaaggucaaugcagagagagcaaagagcuauguggaaaagaagucugaauuaucugaaaaaguucaaagacaaggaugauuugaaaaccauuuacaucaauauuccaaugaagccuugguguuagggugaaucagaacuguacagcacgacuauuucuuauugcccucuaugcucagaucauuuguaucccaagaaagaauagaaaacaauggaauggaccucacugcuuugggccauucuggacuaagagguacugguuuaauuaacacccauauggagauuuuuuuuuucgaaaugacauauuugaauuucaguacaucucuuagucucugacuugaacaauaacuauugaagggauuguuuucccuuugcaaucaagacagaaucaucaauguugucaacuccacuaccccagaucccaugauuuggaagagauagcuugggucuggccuggugcugaccacugaagaggcaacagucaauguuaucuuccuuuaugcuggagucaagaacgccccaccucccacgccuauacaagugggcccccaggcaugguuaaggaaagugcucagcaacaggagcaggagacuucauuaggggaggcaacuguagcuguauuuuagcgauucuguuuaaaacacgcaaucucaaaaucacccuuuucuaggcauauugccaaauuacagcaaugggccauuuuuuuaaaugccuauuuaaaauaagcccccuugaaugcagcacuauggcaaagguccccuuggcagaaagccacuuuagacaucagcucgcuccaaacauuauuuuaaaucagugcccaggucuuucaguaauuugggaacuauugccuuugaacccagaaaaugucagugcacugagaacacagggaaaugguguuggcaugaacaaucguuggauguccuacccccuuguucaucuuuccggauugaaauauuuuccccugauuuaauucuuuucccuauucccuucagauuuaaauauuaaagaugugcuuaugggggcgaggaauaagguagggaugagugaggaaauuaaguugcaagcuuuauguaugucaaguacuccucaacaacgugauaaguacagggugccauugggaucugggcaguacaucaccuaaucucgcuaguccugaagaaggaagucauugguguauauuuuagcaccaaaccaacagaauucugagacuuaguaccacuugaacuuuugucuacaguaauuguuaaggcuuuaggcaucaccagaaauaggcugaaaaugagggaaaauucuccaaaaugacuuauccaaaacaacguaaguuugauugcucauucaguuacauuuguuuguuucuuaggaaugcaaauauauacaggucaugcaacacuucuaugaacaaaugucccauguccugcagauaagaguacacaaugccccccugucccacuggcccaccucagagauuccucugucuguacagaacuauaaagacuaugaacuguaacgcuaaugacuuaaagccagaugagcuaauggagcuacugggauggaauuuugggaccaagcaaaacaucuugcugucgggaagaucugcugagcgcaguuuggaggcuugucagagacaguucugaaaccaugcucuuugguccuguucaaauaaugacuuggaguauauuagaaguuuggugacaaauggaauaaaaaaaaaagugucauugucuguaaucuugcaaaucagaggcagcacuaggcgucugcuauccugauuuuagcacagaaccuggggcuuucuccaauaauguggcaucgauauaaugguuccuagggggauauuuagacaauauaaaacagggaagcuggaucaaguguuuauauuugugagagggcugcuuacaguucugaccauaccucucuucuucugaguuaugauuccauaguugcugcaucuccuuuccuuuuuuuuuucuaaccuucuauuaaacccaccucuaccuuuuguuacuguaaucaacuguccauaacuguucagaacaucaaauuccauaaggccaccaguuugugcucucuaaccccuucacaggacaauacggacagcuaagccauugcuuugugaggaggacaauguacucccaaggggcaaggaacgugccauugauuucacaguuauuuuauauaaccuuuggguuauauauuggugucuuaagaaauguuaauuucuuuuauaacaaauacaauugaauguuuacucauuuccuuucugggguggggggaggucuuuaaaaaaaaauacagacucucauggcauuccaggcuggccuccaacucaucauauuguugaggcuggucucaaacuccugauucuccugcuuuaacccccaaguguugggauuauaggcacaaaccauucugccuggcucuaacuaaugucuuuacacuugcuucuuaggcugcuuagacaguugcuaaagccucugauaauuacuaaagccaauaacucagguaguagcacagcgcccauugauucugugugaagaaguaccaauuacuaugugauucgggccuagauggauuuguuguccuaacuucucaaucacaauggcacuguauuuuucacuuuacuggugcauaguugacacacagaaagcauauucugcagccuaauuuggauauaaauacacagccauaaaaccauggccacaauuuauagcauaaauauauucauucuuucaaaagcuuuuucuacacucuuaguuuauugucauuuuauaauuaaaacgaaagaucuacuuucuuguugaguuucccuacaggcaguaugcuauauguuguauuccuaggauguuuuucaucuucuaugauugaaaguuuguacucuuuaaucaacgucccucuuuugcucucacccaggauaugacauccacaauucuacucucggcuucuaaaaauuugaccuguaaaaaagaucuuauuuauuuuaacauguaugaguguuuugcuugcccguacauugugaguacuuuguguguuucuggaugcccccaggaggccagaagagggcauuauauccccuuaaacuguaguuacaggcugcagugagccaucauaugaaucccaggaaccaaaucuugauccucugcaagaacaguaauguuuauagaauauaagggcaauuuucuaagggaaaauucuccaucucuuucccaagcucacagaaaagauguacaguuggcuuuuugauggcagcaauuuccagaagagccagggcuacacagagaaacccugucucgaaaaaccaacacccccccccccccaagugcuaccaaaucuggcuucaugugaguccuaggaaaucugaccucaaguccuuacgucugaguggcaagcacucucguauaucuuuaagaggcaguaauacguagugguuugguggcuagucucuggguucaagacugcaugaauucacaucucaccccuucuacuuaauucagcuuuuauguggcucaguuuucuuccauuagagaggagacagccguagacacuucuuauaagggaauuuugauaauaauaugaauuaauucauauaaaaugcuugcaaaagugucugacacaauaagugauccaagguugcuaguuccuuauuuauuauuccugaagcuuaccgucagggggcauggaaucuuuauccuugagggagaggaacauaaaguaacagcguuauacacauggccaagaguccuauguuccauuacugcuaccaugaaccccauagcuguauggcuuagauccagucuuaauuucagcuagcucaugugugaaauugggauaauaauguuucccuuggcuacauguaugcaccagugcacauacacacacuuaacuuucagcaaucgagaaggagggagaaaauuaaaacaguaccgauuuucaacaucugaaaggauaugugguacuuuacagauaugucaugguaacuuagcaaccuauauacucuguauauugaagcuaugaaagauucauagaacaaaguacacuuuucauauauacacagagcuuugugcucuucaacagagaugggcagagagauggcucagaggaccuggguuuuauucccagagcccacguggcagcucacgacugugcagaacuccagucccaguagaucugcuggccuuuucuggcauuuguaggaagcaggcauacauggagcacacacagacauacaugcaggcaaaccaucuauauacauaaaaaagaaaaauuguuuaaaagaacaagaaaaaguugcauaaaccauugacaguggaccuuccuuagaaugguaguucagugucuaagcaaguaaagaagaaaacagugcaaaacauacaugcuaauugaucuaacaucacagaagauccucuagguaguuugcucuuuaugucaauaauuuaaguuacauugagcagaaacagagauauucauuagcuaaagccacuaccagaaugcuuucaugccaaccuuuaaaugacacuacacccucuuaauggcacagaacauuucuucuuccccuaaaaggcaugucuuuauuuuucuaagcuuagguuagcaaguacuuaaagaaagaaacucuuuagcugugauucaugaaucaugauaauggaucauagagcaaaaucuucagaagucgaggugacaagaaccagaccuagaauaugacauaauugauuuuuuucguccaguuaacacauaauucauuuaguuguauccaacaguccauguggccugccauuauuucuggagaagggucuuuuccuuagagucuuuaagguaaugggucugugagcaggccuucaucguuuacuacgugaauucuugaagaaacuguaggacuuuacuucuguuuuaaagaaugaacugaaaguucggagaagaugccuuuugugccucuuuuagugagugucaugucuauacuguucuguccgguuucccaggaaugucuuaucccauaggaacauacacauuguuagcccuguugaagcuauucguacuaaacccuaucucauuuuaacguuguuagggacauuuaacuccaguuuuuaaguuguggguaacaucugcuaaugaguuccugaaagggcuccacucauuuauaagugggagggcuucuguaauugccagugcaguuaugagauuguaugauugcaacaauauuuuccaugcccuuauucacugacuuuuuuauuccucaggguuuuaaauguucuuuaagauuauccauaauaacugugagguacauuguaacuuaaguacccaggcacccucaagccaauggaaaauagagguagaaaagauggaguaagguuaugacacuaaacacaugacaugaaguuuauuaugcuugauagagagaggcuauaaauuuagcuguaagcuuucaagucauaaaugugaggagggaaaaauuaugaguuacaugacacacagaguccagaaggugaaagcaaacuaguuguucaggaaaacuaauggacaguaaaugauaagaacuaauuggacuaauggggcaaaaguguggucagcuguugcaggcucguaaauuuucuacuacagauuuucacuucuugccacuucuugcuucugaggacccuuguuauaaaucauuuuaagugucuucuggagucuguaauagccuuuaaaggaaauucuaucagucuaucuaucccuaucuaucuaucuaucuacccaucuaucuagucauacuccaccauucuuccaucuacuuauuugccuauccauucaucuauccauccauucauugcaucauuauccaucuguuuguuugucugucugccuaucuaaucuaucaaucuuucacuuaucucuaaugauacauucaaauauuucuuuuuuuuuuuccgagucaggguuucucuguguagcgcuggcuauccuggaacucacucucuagaccaggcuggccuugaacucagaaauccgccugccucugccucccaagugcugggauuaaaggcaugugccacccccgcccggcuucaaauauuucuuuacugcugguugaucucccucauauuuagaucccugcugugugaaagguaaaaacagagauuguguguguuuauaagcugcacaaauaaauaacauauuuaauagcaauuuauucuuaagcuuagucaguucugguuaaauuaaugugaauuguaaagcaccaggaaaauacaauagagcuauaggauuuagugucuucucuaugaacuauuuuuaaaaaacaaaaagccuuacuugcaacauaaacuuucuguuucucugugacugguuuucaaaaauaaaaaucauuuacuauucaaaaauaacugaaauguguuaccuguuuggguguuuugguccauaaacuuuuugcaguggguuuuccaacuaaaauuacaccgaugucauauggcaucuauugaaugcuaaaacuccuuuuuucaggaacaaaaugucagaccagauugaaggaaacaaagagggagugucuugacucuguucagugguucucaugacuacuuccaucaaagacugaguucuaaagugcuggcgcuuucaaaaauuaaugaccuuuauuucaaauaguuuuaaauuugaaagaaaacuuaaguagguaguaagggaagccuggucuuuggguaacaugauaaaauguuucguuuuuauaaggaacuaccuaucugucaucuaaaguuguuguaacaucuuguauuuccacuagauagccccguaucuguugaugcucuacagccuuauuuaguauugucaauuguaugacuuuuaaccauucucaugccugcgcaauagcaucucauucugacuguaauuuuuaauuuccuaaagauguaugguauugagaaucuuuguuuaagacuugugacucuuugugggggaggcagcuguucaguuauuuugccuuuuuuccaacaggguuguugguuuuauuacuguugaauuuuauuuuuauuuauauauucauuuaucuaugcauucacuuguucauuuaauugugcuuugaauuuaacccagucuggcaccucaggaguuuguaacuuguuugcguguauacauguaugaauuucugcuuuuaaauugaguccauggacuagaaauauuaccuguguggaccauaucaccucugagccucaguuuccuccccaguaaaauaaaauaaaacaugugcggccaugucacaguuaaaaggaggguagauuuaagcauguuuaccauggauucugcaggugccugggaagauuaauucucuuuuuccauccaaguaccuguacuugaaaguaaggcucgcuuuccauccaagccaucaugauguauucacccuuguaacauaaaaacggaaucucauaaagucgugccuauccuugcagugcugggaaaacugcuuugaaaaagaacagcuuucuauaacaauugcuuauucuccagaccuugaaagggauuccaugcuucauuuauuuuucuugucuuuuaaccccaaguauauucucauaugcccagcugucuaccaagaaggcaaauaaaagcccauuucuuuuaguguacaucugaauucaggaacaccauacacuaaggauagccaaucugcugcugugacagacuauauaucuuggggguacauaaguagaagaggguuuugaaccauuuaaagaaagucucuacacuucccccaugaaacuauaucuggagaacugugucugucauugugcaucaaaaguuaagaggaauacugauaacuaguaucuguggugaucaggauggugaugaaaaccuuuagaaaucuagggauugaacuggugagguuccuaagccucuugccaagccugaugacuugaguuugauguugauucccagaacucagaugguggaaugugagaacugauuccuauuaguuguccucugacuuccacaaacaugccacagcacauguguauacacacacaugcauauguaugcacaggaagucaauaaaaaugcaauaacaaaaggagaauggaaacuuuucuuuucuuggcauauuaucucaguuuauuaaauccauuuauuuccauccguagauuauaaagucgguggauguucuggggacaaauucuucaugauggcucugauuccacaagauuugcucuaguguucagugaacauaacucuucacuucauccaaggaaagagaaagagggaaaucaucucuagcuaaaguacacaugauuauuagacuauguugucaauggacuuacacuuccuugcauuuacauuccuacccuugacuuuauuucuugaacccucaagagacuuaagaaggccaagaaucacuuuucaccuagcauugcucccuaugaggccccgugaacccuuuucuugagccuguguauuuuggugauaaggaauugagagaacugggcaaaauccagagcugcgcgcuaaguuuguucugacauguagagucugcugucuacagcacucgaaagcuagauguucaguauggaccucagcccuuucccccugaaguauguguuguuguuucuguagaugaguucacgaucuucuguaauuuucuuuuucuauugauccugcaguaauggcaacagaccuuuuauugguaggagaaucuggggcuuuccuuccguguaucuuguauauuagagaaugaguguaucacaauucagguaaacuucgcuucccccagaauucauuucagaguggccuggaugauggagcucuuuagggguaaccugucugcaaagcagcuuucucccauuucuuacuuccugcugccccaaggcaaaggugaaagugcugcucgguuuuauuggucuucggguuucaauuucuucugguacauuuuuguucagagaugagugagucgaugggaaaaugaugaguugaaaauagaacuuaacuuucuacaacgauuuuugagaagguguuguagacucuuaaguuugagggcagcuagagaguacccaucacuuagagacacugguuggaacugauuaugucuaccuugcaacugugucaccuuggggaaauauguccauucuacugagacucaguuucauugucuauuaaaucgggguugauaauaccagauucagaagguuguuauuuuaaaaaaaaaaaagugaccaccaaaauguucuuuuaagugacuuuuaaucuucuauaucuccuguaaauguuucuuuuugagauaagggcucacuguguaaccuuggcuaaucugggauucccuguguagaucacacuggccuugaauuuggagcaguucugcagccucuauuucccaaauguuaaaagugagccacugugcuuggcuacuuguggauaauucugagacaagaaugguucaucagugaucugcccacagcaccuagcaagccuaauauguaaugcuauauuucuaccuaaaauuaaaaugaguaaauaauguagaauaucaaauuuucugaugguuuuaaacaauugagugacuggcccuuugcauugggcuaggugacuacauagcugcauucaacauauagauucaaggauggagaggaaaguaacaaguguagcuaggaagacuguuauaagguaaaguuucuccgaaucauuuacuucuaaacaaaagacagaaaacaagugagcauguagugauugauagcaaggaaauuuuugcuccagcaucacauaguugcaaaauggaagggaucaggaaacacuaguaccucucagugguacaaaagccguccucagaccaauagccaguccacauauucucagaaaccuuuguagauggcuaaguucuaauuuaaauucauuuuuggucucucguggcuuuggaaacucuuuagaauuacacuggcaacucuccaacagcgcugggcaugugaugagcuccagggaagaugguaaggaaugaguucuaccuugugagggaucuagggcagauggcagugguucagucuagagcucacuucugccacagaugacugaaauguugggcuaagugaucccaaggaauacagucucucuaguagucuggagguaguaauaauuugaauuuucaaggcucaugaauuggcaucauuuagaguacaucugucauggacccuugcauuuuagaaggaacuggauguacuaagguaaaauaucaggaaacucgacuaguuuuuuuuuuaacucuuucauuuguuuuuuaaaaaaucuuuuauugugauuauuuuuccuuuucacauauaauugugacacuccaguuauuugugaugacauguaucuagaauauuuugauuuggggaaaaugagauggcacauuacuacuuuauuuuucucaaagcagugacacuaauugggcuuuaugccauggggcugaagcagcagauguaaucuugaauuugaggucucuguagacuagcugaggcuuucaagccauguggaguugaacuuacgagaggagcuuagcgguuauccuuccagauguucagcuugcaguuacugucaguagcaaauguauagauaaguguauggauuguucuuuccagacagauacccauucagugaauaaacaccuuuuccaguccuggcaaucugucagauaacucccuuucaaguuguucggagaaagucuacccaaaauaauuaaauuuugguuaucuuuuguucuugucuaauaacuugcuucuccucugaguuugaacaggcuugaguuguuaagugaauuuauauaguguacguuccguuuugaaauauuuaucucugucuaaaaaugaaauguaauuaaauauaaucuuuuaacugagugaaucaaugaaagaaaaagaaaauuucucuuucagccaauuuuuaaucaauauuuucauguaaggccgaaauguuaacugaauccuggcaguugucauuugaaauacaguuuguauguuuaagaauuuauguguacaucaagguuuagacuucauacucagaaaggaaaauugacuuacaggagcaaggaacuauagaaauauaaguaauaccagcaauauaaguaauaccagcaaugaaugugagucaauuauuuaaggcaaauggaucuuaaucccaaaaacaacagagacauaucaaauucauuuacacccuggauuucaugguuuaauuuuggggcaugucuuuuucucuuauuuuacagaggccuuugaaauuguuguucgccaugccaagaacuacaccaacgccauguucaagaauaacuaccccagccugacuccacaagcuuuugaguuugucggugaauuuuucacagaugugucucucuacaucuuggguucugauaucaacguggaugauauggucaaugaauuguucgacagccucuuuccagucaucuacacccagaugaugaacccaggccugccugagucagucuuagacaucaacgagugccuccgaggagcaagacgugaccugaaaguauuuggcaguuuccccaagcuuauuaugacccagguuuccaagucacugcaagucacucgaaucuuccuucaagcccugaaucucggaauugaagucaucaacacuaccgaccaccucaaguuuaguaaggacuguggccguaugcucacccgaaugugguauugcucuuacugccagggacugaugaugguuaagccuugcggugguuauugcaauguggucaugcaaggcuguauggcuggugugguggagaucgacaaguacuggagagaauacauucugucucuugaagagcucgugaauggcauguacagaaucuacgacauggagaaugugcugcucggccucuuuucuaccauccaugauuccauccaguaugugcagaagaacggaggcaagcugaccaccaccguaaguaucagucuucagguuucaaaagaacuguccuucauuguggugguggguggggugaucucuccagcaacagauacugauagaaaaauagagaaaggaaaaacgacgagcaagugagaaugcagaugggcugaauguacucuccgagauagacagaauguuaaaacuacaggguauagaguuguaauacuagaucuagcuccacauacuucuuugcugccgaguauugggaacaaauuuuaucuuuaugaguuuuauguuuugaguucaugaaagaagaauagcuuguauuugagacauauagcaucugcgugguauaugguaagucuuuauuaaacauuagcuguuauuguuguuaucaggauccuuaugggaauauuuccucucucucuuauaaacaaggaaacugaagcuuaguggacuguauguugcacaggggcauccaguucuguaguuagcagaagagacaugauucggaaauugaauuuuugauuuaauuaucaucaccuucuauucugacuucacucuguggucuucaucacguacaucacauugccauucugaagggaaugcaaaauacaacuuaaagacaagagagucagugucuacugacuaaacccacaagagaacauaagaaaagcaucuguucuccgcauucauguuugcagccuuaauuauaccagucuacaccugaugggauuuguaaugggagaagggcaguuuugcaagugcaguagcagcuugcuuggcuuggaggauauucugucagagaaccacaagagaaaagcacuugugauguagaacagaacauacagccaagagcuuccagcuauguucuuuuaagacaaugauucucuacagcuuccagcuccauaggaagacaugccagagcaguacaauauacuacuaucguugagcuccugcucacaucuccaaugcgauauauauauauucauccauccaugagaugggucucgguaguguacccauugcauauaggagggaugaagauuagagaguguaaguacuuuccaagaucuccaaaaguuuucuaugguaggaguggugauucaaacccaggccuugcuggccuugcugacuccugcucuuaacuucccuccaguacauugcuguguagucugagcuauuaguuaaccagaauguugagagcagcaugggcuaguuagccuugucuuuaaacucggaagugcaagugauagggguaauugguuucuuuggugaauuaaacuaggagggaggacagaaaugauacaacccucagcauggccacuuacggagcuacucuaauugccccauucacaggguuggccauuuaaaacccauuugcugagaaaauauuuuauaguaaaaugaacagaaaugcccuaucuaacgaugguguucuucgauggcuaauuauucccuugacugcuuuauaauuugaggccauauucuggggucuuaugcaaaaguaaauugcacagaacuagaaaaaugaaaaguaagugcauucauauguucauucacuagcauugaucaagaguccacugugagucccaccccaaccaaaggcaucagggcgugaggauaucuacaauaagaggaaaauacgacuacuuuaauggcaagauguaugaguauuuaaagguuauccacguacauuuuuuuaacguagcaucuuccucccccaguacuuuuaaaaacaaaaagauaaaguuuugagugugcaagugacacaucccccuaguccucaaggacuagggcacgaggauugagaguuugaauagacuguccugacuaaucuuagacucagucuccaacaacaaacaaagagagaagaaaacaaaagaaaagagaagaaacaauugggaaacaaaacugugcacacuguuuuuaugaugucuaggcaugcagguuuguugagugaacauuuaucaacaucugcuuucugcaggaacuuuaucaggugcuagggauccauagccucccaagacaguucugaggacuugacauaucacaguuucacugguugauggaccugcaacugaauaaauuccacuauaaugaacauuuugcugugauaugaauguuggaaaggcagugugaaaauugagcuagucuaaucccauuucaaaaugaagaaauaaagucuccagaggcauauccaaaguuuuuuuagcuaagaaaagagccagaagcagaauccaagauauuuuucugcugcaaucuaauauucuuucugccauaucacucuguuccccaguagauccuuccagacuuuccuaaugguaaaaguaccauuaggauuuugcaaagacauaaauugcaugguuauuucaggcuuucagaccagcuacauuuuagguguguguacacauaagcgugugcucacacacauaccuaauauacaguagagggaguacauuuugugucauuaucguucaggaggaaaggccuuggcugucaggaggugcucagugaugcagucccuuucuguuuuggccauuaaggggcugauugcucccagcucccauauaguuaugagagcgugaagucugccauccccugggaaugcuugaacuaagccagaaagcauauguaugcugccucguugcuguuauaugaucaccaagucuaaguugucugcaucaccugguagcgauuagggaaucacuggcugggugugcuccagaccacacucuguacaagcuacaagcaggcagggcucuuuauuagggugaggagaacuauggguuugacagacugaagcacucuguucguguggacaaacccacagacagaaucccucaaaccaaaagcugguugaaaauuaaauguuaacaagauucugcaggagcacccucacuucguuguguuaacaagaugggacugucccacaguagaaccuugccuagggucaguugggcugagguuucucuuuagcaucgugccauuucugagcuguggggguggggcagcuuucuugacgagcuauauaagggauggcaugaggaguccauacaaggauguuguccaguuguguuggggguugguugcuaugauccaucucacauccugaagguggguuuggccuucuacauagguaugacaaucuuagacuuucguaaguauagauuguugguguuuuaguuccuccaagaaugauucucaguccuguagacuaccaggugaaggcauguggguaaauauuggggucuuauuacucacagcaccccugaauguagcaaauguucagcuccucaaauugacucaucuccaagucaaugggagaacuuguuugacauggcuggaguccaagcccagagauucugauaacacaacucuauggagucacuugccauuucaaugguguccuucuugauccugauggccccuuaggaacaucuggcuaucuuguuugaaagauaaaagaagauugagaaguuggcaagcggauaacccagauacuguaggcuagguuugacagagguagaaugauauguaucuaaaauggggccgccauaucagauguuaaaugaauuguuagguuuagaaaaaugcaaguacucacuaagccccaguccaaacugcuaaaagugcccagugaauaaugacuuuuccuuacaauuuuuaaagauuuguuuuuacuauuuuuaauggauauguguguucauguguauguauaugcaugugaaugcagguccccuuggaagauacacacaugggacccccuggagcuggaguuaaguguuuauguaggugcugggaacuaagagaacuaagguccucugaaagagcaccaaguacccuuaaccucugagcuuuuucuccaguccauuuauacuuuuaucuuuuauuacuggugaaugaacucaaagaaucacaugugccaagaaaauguucuaucacagagccauaacccccgcuccauacacucauuuuagaguaugauugacugauauuauuuuauugcaaauaaauugaauaaaaaugccaauaaaugauaaaagauaccuguaugcauauguacaugggccagggaaccaaaaguggaggaggcagaugucuguacugaaaauuucccuccaaaagguauuaauaauaauagcuccaauccgaucuucaaauggauugauuacauaucuuaccccaaagugagcacugauccuuugaguguacuuggguaaaauuugaucagcauguuauugaauuccacauuuuauaccucgaacuaaauauagaauguguuuacuuucagcacugcugauuaccauggcuucuuuuuuuucauaauacagagaauggaguccagcuuuguguacauguuaggcaaccacucuaccauucacagccccuguaaaacguauuuaaaacaucuauaguuuuugucucagagucaccuugauuaccauuaccauauaucuacauguagauuauguguauuucauguacaacucacucaucuguuauaugucuggcauuuauuccucucccagaauaguugccaaaauuuucuguagcuaaucucauugacugucuuuaguccacaauagaauugcucauauacucuuuuguuguuguuuauuuccaagaauguaauuuaauuacagcauuucucccuucccuuuccucccaccuaacccacccugcucucuauuaaguucacgcucuuacccucuugcuuggcugcuggcaguuuucuuuuuccauauuugcuaguguacuuugcugacucuccuuagcaugccccuggguuaggguuuccuggaccacaauuuuacuaccuugacuuagaccguuucacugaaaguuguacaaaauuucuuuguaucaccacccuuucucccuuucuucugucauugugacucacuuuggaacucccuggaagaguuucugcaaaugucuauuacacauuucaucaugcaagccaugugcuggacacugagcaucaucaagaggguagggaagcugagcauagaagauucuuuugcuccauuuagggggucacuaagccagcaggucucagaacucagauucagagcugggccugucugacucccaaguucuugcuuguuaccaugacucuauauugcucucucaaacacuuccauucucuauucacuagaaucuucguuccccaaacacagccuaaauugguuuuuuauuauauuauuuaauauccuguauuacucccuacuguuuuuccagcugcacaaucaauuuuugaauucauucucucuccauggagacucuugcucuacuauuucccaaugaagaacuaaaagacaugagguuguuuuuuuuccccuuuucucuuuuccuauuccuaacacuuaaaggaacagaauaguuucuaagagaauauuuguauaagcucuaccuguuaguguugucaauguugaaaacucuauuaaauuccacuugcacuguugaguccccacccacuggaacaacagagagccaucuugguuuuugcagcgauggaacucagggccuugugcauguuaaguguuugcuccgacacagagcugaaucaccagcuagccucaaagacaguuuucacgcuaucugguauuuauccugaauaucgaauuauauucagacgucuacuuuggucuuuccuuagguaguaacuuugucuacugaaagccuaaccuaugccaauaucugggcacacccauuucuuuggcuacaauguuugaagaagcaauacagucaguauuuaaucauggaugguaggaagcuuggaggcagauucucccuuugagcugcaauaauaauucacugucaaauucgugcauuuugcugucugugugagugacuguaagucaucagaauuuccaagauuagccuuaccuuucgucucugccuuugaaggcugaggccauuucucagaugucaguuuguccgagcuucucuccuuguccgcuaucacuguaccgucauuuuucagucucagacagagauaccuucucugaauucauagaagcugcucuccguuccgaagggauucagaagugauaaauccagcaacuaucucaguaccucauuagugucugcaggccagcaucggaaacugcaauaagcaauauuauucaaaugagguucguuucagacaugacagaaaauuuacauucugucaucuuuuuuuuuuuaacauucacaauaaaaauaguguuagugguugcuaucggacaaagguggugauuuggucucuuguucuguuuugaggauucuuucacagacuggcacugaacauaugguccuacugucucagccugagaaagguuaaacauagaugaccuaauuauugaaagacugacuacaaggaagaauugacgcuauugaguguuaauuucacaggaacuuuccaaaacuaaucauaugaagaaagcuuuugaauguuucauccugauguaaccaugcagauuuuacauuacuuuaggcaauaaaauaggcucucugcaaaucuagcauuguuugccuucaccuaggugagggacagcgugaugaugagaguugcucuuucgugcugucuucgggaauauguuucuaaaucucuuuuccaugaucaaugaacugauaagaugagaauaugcucucaacaacuguggaaagucugggauuucuccucaguuacaagcuaauacgucggucaacugccauuuuacggaagccaguuaaaggcaugaguuaagggcagaaccauugauuucucacagcaauggcgguaaccagaggaucagcauuugugucuaauucccuagccucaguugccauggggcaaggcagagagggcuggauaacaccugcaaaugcaaugcggugcuuuacuagagagcauuuucagccuagagaacucaaauguauccuuagcacuacaagaauaaaaccaagcaagagcgugaucucuuggucuaauggcuagauucucaacauugaaccuggguaacuuauuucccaucacugcuagugcucacuucucugaguggagacacuguagcauccaagcuacacagacacuacauaaagauacuuggaagagauaguuugcagcaaacaguggucaauguuuccauuuauugcuaccuuuggaugaugacaagacccucaaaaguucuugaugccuuuggaggaucaaaccaaggagauagaaacuaaagaacaacuaguucaacuuugucugguuagccauaaggcagcuuaugugcugccuguuggagcauagccaaagguacacacaaacaccuaaacuagugacaguguuagccauucagagaauacaaaaccuuucuaaaggagcacuugauauuguugcuucucauuagcaguaaaacucuauugcuuugaucuuccagcucucucucucucucucucccucucucucucucucucucucucucucucucucucucucucucucucccucucucucucucucucucugcaguuaucuuuuccuauccuguuuuuugaggauacaguguuauaaguuuucuauugcuacacaagcuggggaaguuauuucuuuuauugcacuuaaaagguggcagaugugauaaccacaggguaguuagcugacacuuauccaugucuccugguagugacagggagaacggauuuauucucaaaggauauucaguaaggguggauaauucaaggcccuuugcccaagagagcagaaguuaagaaagauacccccauggcccaacauuauaaggacccaugugcucccagggugacaaugaaugaguacaaacugccuauuucaaaugcuggcugcucagggagucagaggcuggugaaagcagccuuuacauuaugaaagcagaauagccucuggauauuuauucauuacaaaagccgaaaagccucagaauucacagugugguuccucugcuaugccuuuuccuuugccuggaguuaaagucugucuuggcaaauggagugccagucauucacuaaugaugcccccccaccccauccccuacacaagguaccuuggcccauuaaccucuuaggucugugcguuuuuugcuaucuugcucagguauucaggccaaaguucuuucuaccuuaacucucuucuccaaaaggcaagccucauccccccacccccacccucaaaauuggaaaacugaacaauucuggccauccuggaagcugguuuuaaacagguaggacaguagaugagucauuuccuuaagggagugagcaauugcaaugcuucaguuaaaaaaaaaaaaaaaaaaaaaaagcuacagagccaacaggaggugagucugcagcagaaucauccagugugcugcggccuucuggagaccaagugcaaccucguccuucucagcagcccagccuggcugagugcugagcagugcugugguccuuccuguuuucuguucuucuguguuguguguguguguguguuguggggguagcuaucaaugggguaaaacaagugaguuuuguuucugugaaaguacagauuucaucauauccuuucaacaaugucccuuugggaugugcaugauuccgcaaugcuguuuuccugcuuucuguggggucugaggugggggaaggaaagagccaaugcugcccccuuauuacccaauuuaguuccuuucugaagaauauucagaaagcgaauuaaguuugccuauucauuccacucagaaugccugaaccagauaaaauaggaagcagagucauuauauuugggugcugucuauuaucauuuaccgacucagagucuaucuaagccuuucugcuuuuugcagauaauuaauuuuguucuaaauggagggaagaaugauuguaaucaguauguuuguauuuucagcuacaaauagagccuaucaaaguuguguagaacaaauaaacccuauaaaauaugcagccccagcccugcuugaaguuaaugugcuaucucuuuuucaaaaggaaacauacguauacacacgcagacacaugcauagauacgauuuuugaaguucuucuugcuuuucuuucacaguuaguagguagggugcucuuuuuaaacucaagccugcgcuguaaauuuuauuuaucaucaaaucucauguggcagagcugaaggggacuuugauuuggugcagaaaucaaguugucaacauauacacauuucucaguuguagaugcgaauuucccuuauuauucucccaggaaacuaggagcggucagaucccacgagcacaguguuucugaaagaggaugcagugugcauuguucuccccauaucuccagcuaagcccuagucugagcccaucccuucucacccucuuuuaggauuauaucguacucgcaacucauucauucagucccuguccuguguuuaaaggggacccuauuucugcuucugcuaguauacuaguacauuuguucuauugaaaaacaaucucaaguguuaacuacuuuauucuucaaaauaaccuguuguuggaguuauggcucuaauaaacccauauacaauacauacccaaaaaagaaaagaaaagaaaaagaaacaaagaaaaacaaucuacgucucuugagaaauucuuuuuugccagaaaaaaaaaaaacuucuaaaaacggaaguaagguggcucucagccaauggcauccaguuguauggagaaucagcugagugguauccugcaccuuaugucuuaagucuccuacuaugagaaaugucagaucagaaaucagaguuuuuacauaggagcucagucuuguacugccauggucuuuuaaaaagcaacuucuuaguuucuaguucggaaugugugcaagaaagaagaauguggacagggcaggagggaugaggaggagacaacgauuauuagaacguguuguaugcuucauggagaucgaagcucuauccauggauggucuccuuugguuuaugguaaucacgagaagaggaggauuauggugauugccauuuuccugguaaaaggacagagguaaagagacuuggaaguaggugcuagcuguacagcugcuucagcuucuauguacagcaggaguccccaagguacaucccucaccucuggcgagaacccguuguaaaauauaugguaagggcuaggccuugguugugcacugacucuguuagugggaagaaggaaggaagggaagccagaaauugcucagggucuauuccuuccugccaacuuucucaguuauuauucauccuguuuucuacauacggccuugagaauugcaugggaacuuccaaugggccucacuucucuuccucauuuuuguauuaauuaauccuaauuagauuuuucaaagucugcuuagagcucaggcuuccccugggauugucgccuuuuuaauuuaccuuuuuaaaacagaaucuguucuugacgagcuuggguuuuuuuuuuuuuuuccuuaaugcuuuaaagguauauagcagcuauguucucucccuuucuguuaaaauauccauggugaaauaugaagcucuguggcuuucuuauuuugcacuaaaccuugaaauuaucuuuuuccaaauguggaaggagucgccuauuagguggguuuuggagggauucaacugcucauucccccugaacacguccuuauuguaaaaugaauggguaacuugucuauaaugaccuccuagcugacuucuuuuuaguugugagcauuuuaaaaucauuuuuaagcaaucuuuacaaguuuucuagacaugauguccuuuagacaaaauacuaggagccuaaacuagggcccucggucugauuaacaauugguguuaucaauccugacaggaacuggagaauccaugcuagguagcccgcuccucugaaaaugaugucaaccuuccuuggaucucagagggcaaaugaacacacuggaggaacucuuucccucacacaucuguguuuaucaagcuugaaagucuauuuccucccucgccauuucuccugaaucuguaaugcucugauuaagaaaaauuaauaugugacucaaagugcucucuauucugaaaggcuccauucagaacugucacagcucugguuauuauuggccagagacugugugagauaccaggaaugagaaauuacaacaaagcuucauuuuuuaaaauugauuucugaaauagaauuacaucauuucccccguccuuuccuccuuucccaguuacccucugucaaacuccucccaugccccuacucucaaguugauagccucuuauuuauuacacacacgcaugcacacacaaccacacacacacacacacacacacacacacacacucacucacucacacacucacucacucacucacauauccauuuuguuguuugugaguauaugguuucaaggcugagcacucugcacuggacagucuguauggaaacuuaucuauaggagaggcuaauucuccucccaguccauaguugcauguagguugaagguuuugaaauagcaaaaggaggcuauaccuaauaaaggcauacacucaguuuguccuugcauggaguacaguaagaaaaguguauaugacuuggaaggaauagcuugagcuucaggaguuacagagagaagucuuugcaucccugaauauguuuaaucuccacaaacuuuaauuguuucauauauacauuaagaauaaaaacacugacaaaaaugccuugcacuuaaaggcaaugggaaaccucuuaaauguaauauaugauucacuuuaccuacugugaaucaaagcagucuuuucucccuauguguuccuuugcaugguggaauauucuucuuuuggguccccauaguaccaguaccauauuuacugaguuccaaagguaaaguucuuuugcuggaagguaucaauauaaauaucaagaaucuguuuggggaugauaaaccaauugaccuguagaaguauuucuggauucuuuuccuaauguuacuauuguucuuucagauaaagaugcuugcccagguucuccacagguuuccuaaagacuuaaauuuucacuacuugcuacauuuagagcuugaugugucuuuaaaacaaauaucuuuagcuucuguagcuauagggcucuuccuauaccugccuaaccccuaccaagaagggcaaccauguuuucccaaauguuaaggucaauucccaaccaagcagaccaacuggaccaucuacaaauuugcuggaugcucacauaggucuucccagaggacugaugagaaaagggcagcaaaauguaccuggaucccuaauggggauuguuuguugguccauuagucuguuguuuaacauucaucuuuugcuguggcuuauugcugaaaucuucaagaauagggggaggacucaagcuguguuuauggcuccuuugauuugggaguguuauuuauguauuauaacgcuaaauugcuuuuuacuggguaccacuguuaaaugaugauuaaacuuagguugguauaaaaaugaauagaugucuauuauauaucucugggauaauuuauugauauccucuugguuucaaugcuaagcuuuuauucuauugcuaaaaugucuguucuuagccacucugcuugcauucuuuuccccuuuuauuacuuuucugacuuuugggguuuggguuaccauucuauucucugauaaaaagaaagauuagauaccggauucucuaccccaccccacccguggauacauugaaauauaggacagaaagaaaccaugccucucccacaauuaaaauguaaaaguuuugaugcuguaaaucucagguugaucccugucaaagaaaaaauaaagcaaaggaugaggagaaaaguaggaagauacagaaacaagagcagucugagccacugugggugauacugacuguguaaagaccuccuccuccuaaauggccuauucuuuuucauuugggggggggggauguugaaugcuggaagacaaugagaccagugcagucaucugcauauguucucugauaucucccuuuauuaauuuuucuuauuggacucaucauaaaauugauuaaauguuucuuaucacuugaaaauucauuagccuuaccuucauuuguuaaaauuccuuuuuuugagauuauaauacauugcaccauuuccuccuucugauugcucccuccaaacccucucauauacuucuccuugcucucuuucaaauucaugacccauuuuucauuaauuguuguuacauaaauuuauguacaugcauauuauauauauaugccuuuacuguuuaaagaauugucacuuguucuuucaucuaaguuuugcauuuucuuuuucccucaaucccauaacugcucuauuucgagcagcccguguguaccagucgcgaucucugacuuucuguuuugcucuugacucccuuuuccauuccuaaauuacauucucacccauuacugucugacuuuccuggugccuauggauucagcucccccucugauaauuccauaggccugucguagaaauuucagaggcuccucaccucuugcccagauuaggugauuagauucuuggucuaguguuaguuucagagauucuugucugggucccugaaccugcagguuuccccgaagcucuaucaugucucuguucccccuuucauuccucacaaacaucuuuugcuacaggaguuagaccucccagugccaagaaacaaccggaaucaucaccaacacccaacauagccagcucuccugguucuucaucuugaacguugaagagagaaugcaaaaggggaaaagaaagacucauuaaauguaauauucaagauaaaaugcaaauuucaagaggcugcaagugaggaugucuauuugggagcuuuacucugccaaaugaaagcagcuaguggauaaaaagaaaacaaaucuaucaguccggcagccaggaaggcuuaacagacaggaaagacauuuccuuguuuuaucuuuucaagccagaggaaggagauuuaauugguuaacggugggaaaacagccaacagucuaggaaggugagagcuaaaacauggggaacuaugcaaagggaguccaaaacuuucuguuccuguuggaaagacagaaaacaaaaaacaaauacaaaguagguaccuauguagcaucugugaguucuuggaucaaaggaaagaucuauaacuacuucaagauguuugcuuuguacugcuuggcuaauuggacaaaugagaaaucaacuuacaggggauugugaaacacuucaguguauaaauauagauaauaguacagccugaaauauauacagguguccauaaaauaagacacugauaacagacucagaacuuugcuuuucuggucugucucguggcauuuuuguaagcuccaguucuuuuccaucagagaugcuccaggaagcacuucccaauucccaaggaugccuucuaggcacuccagagggaaaugcuggccuuaagcugggacuuuuguguguuucuguuuuucuuucuguuaucaacuccauuuucuccugucugguccugcagccuaucccauucucuugaucguucuuuuuuucuuaccugcuauuaaaguguaaaguauuuuuuucuuauuuuucuucaaguggucuucuuccucuuacauuuaaaucagagagagauuuuggaaagaucucuaaagaucuagccuuguuucuucacuuuuaugaugaggaaacugaagcauaugaucagaagaaagguguuugcuaaagauguaucaguuuaaggcaaaccagggcaaaaaucucuggcuucugcccaucaguccaguauuguuugcgcuguaucacccaucucuuucaaugauucugucuccuucuaccuaaaauauucaagcuggcgucugaaguuacuuccugauuugcuuuguguucugauuguagaauucccagagaucacaauaggcacaucauuacuauagauuucagcacacugggcauuaugaguauuuuucugugaagaacagaaauaaaauaggcagaggaugaaauuucaugccaagauaguuuugcaucuguguugccugagaaauauuugaugaggagagaaucaaguauaaauacgcaauugaggcaaagauguggugguacuauucacgauagcaguggugaauagaaacuguuguaacagucugcucucucccucuuccaacuugugcacacaucuaagcauagcaaugaaaaacuguugcucaaaauguguuucaguuacagucaauuaaaggucagcaggcguaauuuacauguaauggauaagcaagaauaaaagcuaucuguugggucgugaggaauagauuccauuucauuugcaaugcaugcugcaagggcuuuugaaaaugcaugaugugagucacuguuguuauuuuuuagagagcauuuucccagguuuggugucucagccuguuacauucucuuguuugcaugcaugccauagucauuaguacaauugaauuauugaaugaccugcauugguacgcugguaggcugcuugauugagucuaucuuuauaauggaaaucagagaacacuuuuauccuuguuagaguuccacuguaucauugauuaauauauaaagaaagacauaaauuucacagugagcuauuuauuccuagacagucuugugaaagcaguuugggugauguuauagaaacuuucuucauaccuuugucaggcugacacuaaugaucgugauuauuucugagacuuucaaagugucaguguuaauuaaaugaaugcuuaaaauauagauagaaaugaacauuuaagugguuuucuuaaguguuugacaguguguaugaacauucuuuuguuaccuaguuacuuucagagaacagauuucauuugauaaggguuuuuccucuaguagcaaauacuuggcuaaguggaugagccaauguuaucaaggucacaauuucacacagauauucagugaguaucuuaauacguucuguaccaaguauuauggaucucuauaauagaagcggccaacaccuguucucaaaaagacuuucuaaucuagugagggauacagugaccaaaagagaaaucggucaaugcacaauauuacagcaacauagacagcaaugggcauuacccaaccacacuugagaaggucagaaaagguguccuaggggaguuguucaccacaacaacaagcaaagggucuuuaagaaauacauagcggguguuggaagacaacagaaccuuagggcuugacuagaaacuggggaauaauacuggaagaagguuuucuuucucugauucagggcccauucaauagcccugauaauauaucuuaagccacccagguccuggaacuuacaugaacucuggaaagaaaggcuuucuuucuuuuuuuuuuuuuccuuuaaaaaaaaaauguugccuuuucuccagcuacuuuggcagcaagaaguccccagcauggcuggaaagaucagccaacucucacugaaccugccuuguacauacagagggaguuugaggagaagggauuugaauguuugguagggccuagacuaguuauagaaaaucaagacaaaaaguaaaaccugguucuaaugaaaccaauucuauaaaaauguaucacugcuuuuagauugcuauuaguggaguguagaacucauuaagagaccugagcaucauuaauaauuuuccuacuugaguuuuaugaguacuguuuucuuuaaaagcucucaugaaagcccuguagaagagcuaauguggaguuuuucaauguauugcccuucgagucucagguucuaguuaagcauaaauugccuacaaauagcuaauugccagcuuccacaggaaaaugugcuuauugucucgggaugcauucacaauuuuaaaaaccaggcuauagccaaucauuauuuuugauaaacauugcuaagaaagauguuaauucaaagagaugacuaaauuguuucauaggcuuuaagguacuugggauagauuuggacaaacucacugaguggagcaagacaggggugcagggggugcuuagaggcaaacucaggaccuuguguuuccuagacaaauggcacaugccuuucucuggagaugguuuugaauaaacucacucauugucaguagcagagauucauauaaugaguucugguguacacuugaggguaguauauccuggaaggaaauuacuuauguuuccuauuuaaauagccccuucuaguacucuucuuuuucucugccuccacccuccuuucauugcuuuuuuucuuccucucucuucuucuccaucucugucccucaaggaaaaugcacaauggaagacagaugauucccauuucauuggacaggaaaagcugcuacuaagugguuugucucuagcaacagauguuuguuuguccaggaagugaagccaaagggaucucuauugccccacgggccacuguuugcauguggggagaacuggaggcaaccucacacuuuuccuuugccuuuaggagagguugcaggaaucaaaguggaaacgcaauaaaacuuucagaagccaauaaauagaaccuagaaggcguucuucucuggggaugggaaggcaccauaugucacuuucauguuuuuaaucuaaaggccaaggcuucacuagacuguaggaauaaggauuuucuuuguagagauuuucauugaaauggcaaaugucuuuuuuuaaacuauuucucaugcauugcccucugaucagaaaacaaauaaguacaaagcaaaaugcccuuaagaaauguuagaaaacauacuguuucuaagaagaaguaauacuuucagcacugggccccugggaaccacuagaacccaggcuauugguuacaacguuccuuucaagacccuuagaaauccuuaguauaaucccauuguuucaacaacaaggaaaugagaaguucagauagaguagaggagucaugagacagccacgacaucaaauaguugggagagaguuaguuaagaagugcccuaaugauuuuaguaaguuacaggauaggauguaguaaaaagaagagaccgugaaaagcaauggcugcuuauuaagugucuuuucuagguggcuucauuccuagcauuucuguguucuuucauguaaccuucaccuuagccucauagagcagagcugcucuccccaccccccgccccacuuuucuggaugagaugcagagaauuggaggaacaacguaauucuuccucuuuaacaagaagcaggagaagugagaccaaacagcaaucuuucuggagcuuaaguuagacaccuugcugccuguccacauuuccaaguauuuaaccuaggaaaaacuccaccaguauacauuuuagcuaugaaggcaauaaauacagagaucaggagauaaggaggcuagguguggagggagacucugacaaggagaacgugugcguaccuagcacagugguaaaguacaagcccauccagguagaaugugucuucuuuggauguauggugggagccagcagaaagauccaugaacauggagguagagggcuuggggaaagaagcuguauuugaacacagagaaucaaaaguaggaagguagagagaugacaggcauguggcagccugagagagagagagagagagagagagagagagagagagagagagagaaagagagagagagagagagauaucuauacacaagaugauggagggauuggggauuguauaucagaugaguagguuaggaaagugaaugacuaggcaauacagaaaacacacacacacacacacacacacacacacacacacacacacacacacacacacacacuccagagaguucuucccaaccugguucacuuucucgacauuuauaugagggauauuuuuaugacaugaucuagaugacugaauacuaauuccuugcugacauacauuguuucuucuuuuguaugucuuuacgaucuuuauugaauuccuugcuuuuugaauguuuaugaugacucauuaauuuggauucccuagccuggaguugauauuugaaacaguguccuaaggggcccuacccaguguccuuuugcauagcaguaauaaccugaaugcuacuguguucuuuuguuaccauacuggcaaauguucaaaucaaaaccauccauucucugauucauguauguuauuagcuccaguuggguggcaagacgugagucagauaccguuuuauauauuagugaagccuagauaagaaaacagagaaugaagagaucgccuuuauuagaaaaagacagcuuuuauuaugucucuuagcaccaugcagugagguuuuaauaaaacugaauggauagagcgcucaugugucuggcuuuagucccccucuuuuggugccagaugcaugugauuucauguuucuagcaagagagaugugaugcuuugucaguuaaucaaaaguuguuaaagaaaagucaauacaaaggaggcuaaucaucaagcugucuuuuccuugugacuguaggacuucugguguguggguuacuuguucucuguggcagcauuaccaacaguaguacuggugcccuuucaguaaauggugagaaucucauuuucuuucucuuccuugugauaaaagacuggagaccaacuccuuggaaaagcuggaagaauauuaacaccagcuauguguaggcaagcaucacuuuuucucccucucuucuuuagguauguucacaguaauucauuucuuugucacacuuguccuccuccaaacccaugucuuugaugccuugugcucauucccuauaaauugacuucaaaaugaaguaauuugauucugcaaguggagcaguggguuucaugugucccuaacccaaacgggccuuugcaaugccaucuaacccaugaaaccaugcuaacugugccuaucaaucuuuccuaaccaagggcacuuguuuggugcaagcaaccccuacaugaugcuaucggaaggauuugcuucuuuauugaauguaccuuuccucgggaagaaacuugcuuagaaaauucucguguaaaaggcuagaugauuugugcaaguugccacacugacauuauuucuagcugcaauauucuggccaucauuugaaaucaauagaagacuguacagccugaaucucacaucucacccagcuuccagaggugauguguucuccuaauacauugcagccccacugcucugauggggccucucaucccccucccccaggcauagauuccaaguugcuuauuuuacaauacugguuuucauguccaaauguucaauuaugaagccuuucuaagacuauagcccagagaacuaggucgcugugugggugucgcacauuuuauuauggcugcugaaauaucuccagagacaaaaauggcaggaugaugggaaaggguaacuugaaauuccuucccaguccuuuauaguuuugcucugagguccaucgaauuuuacgaugcugcaguuggaggggaucauuugauccaauccucuuugcuguauggcugacauaacugaggccuagagagcugggagugccccuagaagauuguaaucucacccuguagcuaugcucuuaauucuguacuucaaaaagaauaguaauuaacuugguucaaguuugcgacucauaagguacauuucacacaaaggcgccaucauucuucuagaaauuaaaaauaaaacaggcccuacuuuuuauauucuguucuguuaacuuauaucaauuaucuauaaugauaggugccacuaugauguuuucauacauaugaguaauauauuuugaucauguucacuguccuuauucacauaucuuguucucuuccugcuuccauuaauaccuuuuuucugcucaacucuuccccuuucuaguccccugugauuuuguguauauaugugaaccagcgaguuucaugaagguuguuuauaggagcacaugcggguguuaaguuuacaggaacacaugugccuugccaguaguuacacuauugaaaaacauugguccucuguccccgugugaaaacucaugcagcacagcugaaguuauguaacuacuuggguuaaaugacaagguuucaugaugguauccccucauuaagagacugggcaaagagagaaguaagucuuggguaugaggaaucaugacugacauuuaaggagcucaucggaagaagaaauuggagagugaaaauagcacacguagagaagcagagcuguaaugauaggaauguccagugcucggucacagagggacaugccuaagaugacgcagagggaucugcaggagaggagucucucagagcuauuucuguuccgaggucacaaugcugcucaauucaccugauuuucucacuccuuucaaucauguucuuuucagaacuuaucucacaagugguucugauuagaacuuuggcuaaaaccaaucagugaaggucuaucugcuguggagggcaaucagcaaaggcccaagguauuggucagcaaggaugucuucauuuagauggacaguggcuaaucagugugacugaagucacaaucagaacaaucuugcaacagcacugcugccuaucaggugcacugccauucauacaaucuuaggaauggugugugguugaauacaguagguuuuuauuauuuccuuacaaaaagauuaugaaaaugaucuaagguguguuuuaacauuuucccucuuaauucaucauuuuguauuccuucagccaguaagaauuuacuugcagugaagaaaauaagaagcaaaguugacugguccugacauccuggacucuguggugaugcccuuguagucugggaaggcagaaauguuacggaguuuggugauaagguugucuguaagauuacacaguacucugcucuaauuuuauaugccauggauuucuagaaacuuucaaaucagacucgagucuaaauuguguauaauuugaacaagcucaugaaaaguaagaaguuauaaaaaugaagcacaggcgcagaauuuguaccagggaagagacaaacaguaaagggcuucaucagacaguggccauguguguauuauuguuauuuuauuguuggguuacaagagcucucuauauaaucagagcaauagacccuuaucagauaaaugauuuuaaauuaugauuguagauugucuuuucauuuucuuacuugaacaauuugaagcauaaaagucuuuaauuugcauacauccacuugaucuguccucuacccuccuccccuuaguugccaucgauaaggaaauagugccagauuuaagacuacaaaaauuuagaucuauguguccucccacaguuuugauagagauuuugaacaauuaaaugugaguugauacugacuuugaguucauuguuauauauaauguguguuaguuagcuuuuugucacugugaccaaacacacgaacaaccuaaagggaggaguugucuaauuuugcugaugauuucagagguuucaggucauuucagugccugaggugagcaugauggagcagcaaugcuguguugaugguaccaggaagagagcagcuacaugcaguagcuguagauucaacuuggaggcucacaaccauguggagccucaguccagggaauccaauauccucugcuggucuucuugggcacuagacauguaagcagugugcagaugugcauccaaacaauacaucuauacaaauauaauaaguauuuaaagaauaccucacauguacucaauaguagguuuuguugugugcuguagaugucugugugaucuccuuagaauuuuguucuuccauuuccuuguugcuuuucugcuugguuacuccauccauuauuuaaggagauaauggaaaacuaaauauuacuguugaauugacucuuucucccuuaaaauuuaacaguuuuccuucacauaacuuagcuccaguacauauacgcuugcguuaucuuuuggaugaguugacacuuuaaucuuuuguugucucuccuaauaacuuccgucugucugaagaguaucuuauuuuauauuaccacagcuauuugcuuacagaugguaaugcuugaaucuuucccugucuuuuuacuuucaaugcaaauuguaucucuuuguaaaaauauagacuuauaccauguuguuuuggauucagaggauucaucucuaccuuuugauuggcacauucaaugcgcauaccauuaauauacuuacuggucaaauagaauuuguagcucucauuuugcaaacuguuuuucuaaaugcuuuauaccuuauuuauuucuuucgcuuuuaacuuuuaccuucuuucuguuaccaguuuguguucuauauuaauuuauauaaugaacauguucucuuauggaucuggcuauagcaugcagcuuuugcuuccaugugaucacuggcuggaaacgcuggcaagugcuuuccuuaaagggaggggcuugcacauucaguucugaggaaaugccugccaguauucaaguugaagacauucugugugccagccuuccaacuaaaaacaguguuccacaacaugaaucuuuaguucauaucauaacucaaugguacauguacguugccuccgguugacuaucauaccucaguaugugaugggaguacauugaauauacaucccauuucauuaugcauguaguauucaaaaagacauauagucaagggucaauugaguuuuacugccuguucaauuguauucuuaagugagacuggcuauuuuuuaaggauagugguuggcaguaaaacuacagugacuugcaguuucaugucaccaccuuuacacaagcuacagugccauuacuuuacccaucccccacccuagagcuugcaugcugucauugcagaaucauuugagggaacucugaaucuuaaacccguuucagugcuuuuggauacuucaauacuaguagugccuuauccuccccaccccaacacgcacaugaagauuucauauaauagaccuuggaagaucaauuacugcuguaaacaaauaaauagcaacaaaauaguaaccgcagcccacguuugcggguucauucauuugcagggugaaaguacacucuguggagaauauauuugcuucauuuuuacauuugcaguucagacuuuagucucucucucucuccuucaaaagcagcaagacuucaucuacugacuuuuuccugagcuggcauggagcagugugaacccugcugaguuuuauuaguuuuuccccuguuguguacacuguucuggcaaauauaacacagugaguuaucauuucagauauuucauugacuuuuacaacucuacuuugaaaacagugaacaguuuugacuuuuagaaagcucauaacauuuauuuuacauauugaauuccauuuucuuuaaacugagaaugauugaauucaagauaccccuacagcuuagcuuggaagguaauaccguucuuaaauguuuucuuauagaaaacauaauaacuucaauuacuuguauuuuaauauauguguuuauucuuugagaaucgaauacaauguauuuugaucauauucuuucccauccuacaacucucccuagucccucccccuccucccuacccagugaacuucauguucucucugucucccgucuccauacauccuguauucugaugaucaaaccuaguuauucauacuagaauaguggucuacuguggaccuacaucacucacccccauaacuuuguuucuuaauuauaauuguaaucaauauauuccucucuucuaugacaacuuuuuuuuuggauaaaggaacucaauauguaaccaugguugucuuacaacuuucuuuguaggccaaacucacuuugaaaucagagagaucuaccugcuucugccaccuaggugcucagaauaaaggcaugagccucuauaguaauguguuacagauacguuuuagaaauccaguauuauugaaaaauaaacuacagauguaugcauuuccacacagauaaacugaagguuauaaugaugacagccagacagugcuacacaccuuuaauucuuguauuuguaaggccaaugcaggagaauguugaguugaaggccagcacagaacauacaaauggccuguacaacaaguugugucugaguuugggaccucaaauuugcauuucacacaaguccaugaagacaacauugcuacuuguuuuaggaccacaacuuugagaaucucugguuaugggucuuguuacucaucuuagaccacagccuaagucuacugaauagacuucuaugugacuaaaauuccugaacgauuuauauuuauauuaaaguuuaagaaguacacuggaagcaauuuaaaagagacacaacaacacaccagguaugacuguaagaacuccucugaauggaauuaauaauagcuuuggauguacuugaccaucaaagccaggacuguggcacacugaggcaggcugccaaagguaaguaggcccaacuuacauaguagcuacacaauaaguuagucuagauaggaguggcauuaccuuuggauccauuguguuacuacauccuugucuugcagucaggcuuaggaggcauugccuuugccuccauuuuaaagaugcugaagcuaagagaugcaaggaaauuaaauaucuuuucugauguguugaaauggucagaggaugagcugugacuaaaaccccaggcguccugauuucaaauaguccuucuuacucuaauauggugauaugccucaaauuaaagacaaucugauccuuaggacauucagguuuuuuuucccuccucuuagauuccaauuucaagagaugacuuauauaaaauguucaacuaaugccaccugauuucuuaaaauagcucgauuccuaauacacugcaaauuauuagagagcuuuuacuuuaauggccuggcaauuaauaaugagucacaguaaaaugucugugggguaggggaaaaaaaaacacauuggcacuagggucuguucauuauccucucugcucuauauccagaucaaucaauaguuaauuaauaaugaugugcuuccucaaguacaagguuauaaauuaauuuaaugcucauaugcauaguuucuguacagaaaaugaaugggaaaaugccugucaugcccaucucguuguauaaaaaccguauguaacaauuacccacauauaauaagaaugguuggcuuagccaaauguuuguucuuuucuguucgucaggauucauuugagcuacuuccaugcaguuugcagaagcagugcaaucaguugaguagccuggcagauuuaaaucaguaauaaaagcccuggggaaauuaacaagacaaaacguuaaccacagacuaaacauuaacauacauuagcauuuuuauuauaccugcagaauuguuaaguagguaugguuaagacuauuuaaaaguugaucauuucaauguauauuuuguuugaaaccuuuuaagauuuaauuaaacauaaguguaccacaacacagaauauaguuuaugagaagaaagcuuaguguuuuaacuauaaacuuuuagaauucucauccucagucuaagauacccccaagcaaauuucauggacaauauuuguucaaaguaguucauaagagcccaguucauauuuaauauacauuauccuacaggaaaauucauuuugaguucuucuggcuucuaaugagucagccuauaagcaaagacuaaaguugacaaauauugagcaacaguucucagaaaauauucauugggaccacaguuaucagaccagcaaaaaaagguauucuauaagccacuaaaacugcagauaccuccagaggcuaaagagucaugguggccucagggacagcuccuuaaaaaagagauuacucugaucacagaguccagaacuauagccuucauccccuggcaaauucucagguuuccaagggcagugccauucagucacccauaaauuuuugaucucugcuuauuuuuucccucuucucucacauucuuuccuucuuuuauaaauuauuaucuaaguuagaacacauacauuuagacaacccauacacaucuauaucuuacauugcagauuuucugucuaggguggggcagaagugaacggcagauaucucccuuaauaguuugucaguuuaauuuuugagacaggaucucuuggugaguguacugcuccaucaguucaauuaggcugacuagccaaugggcuucagggauaugccugaguacaugucuucuaacucuggggaugcggucaacagguuucaugaggaugcuagguauccaugugucccuguucuugccaucacuggcacuuuagugauugagccaccucucuagcucccauuuaauuucuuaagaaauaaaaucuaaagguuccuuaggguuagugaagaaugagagacuguacuuagggaaaaaauagccuuaugcaacccauuaaaauaaaaccaaguggauucagggccagcaagauggcucaggggcaaagguucuugccucaccaacccccauaaccugaguugcaucucaagaaaccacuagacaaaaggggagaaauaacucucacaaguuguucuuaaaccuccacauaugugcugugucacaugcauacaacuucacuacacaaauaaauacucauguauaucugacuucaacaaagagaaggaggagcucgagaaauauauauauucaugucauaacagcauccuuagcuccaguuuuguacuuuagacuaugacaguuaaagcuucagucugcugacguuuuguuaucauagggugagcugggaaucuccauuugggauaaaucuacaggauacacuuuggccagauaucaggcuagaguaaguuaaaugauagaaauuuacaaaagauuuuuuuggcugaaucaagaaccuaauuucuucaagagcaaggguccagggacauacuggaggcagcagauggugccuucuugggagcugucucgucaauggaacuugacacccaaugcuuuaguauggcugcuaauugacucuuaccuggcaagccaaagagguuuuaaaucaucccacuauuagcuacuauuagaaaccuugccugagagcuagauuaaaauuggaugcccauuuucuguuugacuuaaauaacuguaccuuuuuuacuuuauuuuuuaauugguacucuucucacauuguggauaauuuuuuuuuacaagauaucaaucagauccugaccaaacccaauacugggauaccccugaaccuguguuguugaugagaacuuagggcacagaacaguccauggaaaauaaaaauauguuuugaagaaggaaaaaccaguguaaaaaaucccagcucugccuuuugcuagaacugucuuuaucaaaagccuaagaauuuaaaaucuuuuuguuuuuccugaaccuaaagcaaagucacagaauuuuuuuuaauuuuuaauuuuuauuuuuuaugugacuuugcuuuagguucagggaaaaacaaaaagguuuuaaauucuuagacuuuggguaaagacacccaccuauccaauaaauuuauuucaacuagccaaauguaaaaguggcagcauucucgaccaaguacauuacucaggggauagaaauuggauugcauuucuuauuuaagaguuuaaaacuccuaggcaggcuauugauuuccaaaacaccacuugagagccuggcuucuuucaugagugcagcucaagagugagaagcugaaaggccaucuuccaugggaaugccacaucucuuuaaguuaggauuucuguuagugucaguucucucaauaagcucaagauauuugccuccaaauuagagaguggagaugaaugaugguuuugguguaccuuaagugggagugggccaucccuggcaaggcaaaggcuuugugugagagaagaauuggcuucaugguagauugcuggaagaaaguacagccugccugauaagguaugguacaucuuaaauaggagcuagaggugucagcaagaauccaucauuugucuuuuaucccacacaaugccuuggggacucuuguugauaaugccagacugggaacuugggaggaaagaucagacuacugauuggauacuuuguucuuugugcuuaaacguccuacuuuugcuucaucugcuccacaugcuaguaggcuagaguccagagugggaauaaauacaaagucauguucugguccaauaaaaauucgaugauacaaaggaucaauauuccuuggaaagggucaucuuacagcuaaguuuuucaacuagacagcauaauguaauagauuuucauuuggguguuguaucuggcacacauauacuuaaagagaacccuggucugggcaccugaaugugauugauauuuugaacccauuaaaacagacccucacauugaucuaugcucaugacauaacauauaggcacuugaacccaaaaaaaaaaaaaaagguuuaccugcaguuuaaaaauaguaauaagcauguauuugccuauggacauaaacuuacaauguacagucugccaguuauuugugucuacagcauaugcuuucaaaaugaauagaaaccaaguccuaaguacaguuaggcagccccuagccuaaaacaccguaccagacucccgagguagaauggauucagagacuguagauucuuuacauagaguuagaauuagcccaagucaaauagcauggcauaggcacaugcaaagaugucaauaucugucaauaugucagauggaguacuuccuaggaucuucaguuuguuuuccagguuaggauaaaugauugaggagagccaguuugaacauaaauggaaguaauucugcugcucauuuaauauguuuucuaacucaagaauuugugugggaagccuuccauugcuaugcaaacuaaaugacauguaugcgucuuugcacacauagauaauccaguaaaugcuauugggccauccugaaauauccagaagccaggugacuacacagaagcgaugguuuagacugguauuugaggcuugguauaguaaauagaaaaucccuucaauucacuuaauuugccuacaagacuauaaagucaacucugugaaggcauggaagugacacacaaucuguuuucacaagaugcuuccaauacuuucccggaacuuuacagccuauacauucaccugagcuguguuagucggugaugugccauugaagguugguaaucuuuauuuccaaaauaaaauguaaacaaauaaauagcaggcaucauguuguagggaggcaguauuguguuaagguuagaagucagguuaaugguuucaaagguagucaaaagaauccgcugucuauuugcuuuaggcaagucucuuaaccuccuugagccucaauuucugcaucuacagaggugauauuauuuaacauagugccuggcacagggaguaauauaauaaagaugauauucauacuuauauauaugcaauuuauauggaaguuguuuuaggcauuagucugcaaguaauauaaucacagaaauaaguuagaauggagcuaagcaagcaaggaagcagguaucuuauuuuaaaauucuuugccauguaggugugaaggaaguauccaauaaauguuuuugaauggcugagugacaaguagcagaaaggaaggagggaaucuggcuuucuuaaguaccuuugcucuuuuaaucaaauccugcaguuauuuaggugauacacagcucacagcugaugauacugccuauggguggguuguugugcuugcuucccucauaccuuuguaggacaugcacaugaacaacuauacugacaguuuuccaaagacuuugagucuaauaagacacacuuguaagaacugggcacacucugugcccagaaggcugcucuucuaucaagaggccacucaaugccaccuccaaaaccauuccaucucccauuucagauggucucaauuuucuaaauugccuuuugugaacuucuacauacguacaaacaaacaacaagugccaucaaaagauaucagcagugucaggacuguguuuucccuuucuacuuaagcaucugaguagacugcacucagaaugguuccauuacucuucauccaucgagugccuucccuuccacuucugguucuuugcccuaaaacuuuauuucaugauuugacucuauuaaugacuguucucuuugaaaggaaauugagggaggaaauuguaguguauuuccaaaucuguuucugccaucauauccauggaaugauuguacuauuauauuacaucucucucucucucuuuucagauuggcaaguugugugcccacucccagcaacgccaauauagaucugcuuauuacccugaagaucuguuuauugacaagaagauauuaaaagucgcucaugucgaacaugaagaaaccuuauccagccgaagaaggugagagaauugccgcccgcccccccccccccgccgccgccgccauuucagcauacaauuagccauuggauuuucaggacaaaaaucauugaaguuucuuacauacaugauauuuaguuccucugaguaagaugcuuaauuaagaucuauaauuugucucuguuaaagaaaacugcuacugguaacuaaggcauauuuaaguguaaacuuuccagguauaaauaucuaguugggcaacaugggguagagugagcuucccuaaucaggaccccuuauuuauuuaaaaaaaaccaacauuuucuacuuacaagaucuuauaguucaaugaucuaucuuaugguuauucucauuauuaccaguaaguucaccagagggagguuagcgagacacuaugaacauacaugaaacauuuuacacagaacugagugugucuuucauaguucuuaaaacaucagucaggagccaaaaugcagguucucauccccuuucuucccauccauccccacccuuacucagguucucuccaacuauauucaagcuucucuggguuguaguuaagagguagaaaucacauuagaagccuagcacaacacuuaagaaaaucaugcuacccaaagaauuguccuuaggaccaacucuguuguuuagagcuguuuuugagcuugaaggcaacuuccaaauaaaugaaaugauaauaagagaaaaugaaaaagcuauagguuuggauuaauaacaagauucuuuggggugaauguuauuagaaggguuuccuuuggaagaauguuaguaccuguauacauuucuuacuaugaucaguucagcauuucauacgcucaagaaaaguggauccaaccuauggacagaagcagcugaccucugugguugaauuagggaaggcugaaagaagcugaggagaagggcaauccuguaggaggaccagcagacucaauuaaccuggaccccugagaucucucacacacuggaccaccaaacagacagcacacaccagcugauugaggccccaacacacauacuguagaggacuucugggucugcguucauucagagaugaugcaccuaauccucaagagacuggaggccucagagaguuuagaggucaugugggguugagggugaaggcauccacguggagacagagagguggugaggaggugugggauguggaaaguuggaggguggaggggggaauaaaauauggaguguaaaaaaauuaauuaauaaaaaggggaaaaaagacgggcgugguggcucacgccuuuaaucccagcacuugggaggcagaggcaggcggauuucugaguucuacagagugaguuccagggcagccagggcuauacugagaaacccugucucauaaaaccaaaaaaaggggguggaguaaaugugcucaucuaucagcuucaacacccauacccaagaucuaucaggcuuuacaaacagaacaauuagaagggaaugcuguuguaguguguguggaaguugcaagcaagcuaucugggucugauuauaaaucgaaaagaccuuugcuuuauuaaaguaacagcacacaaagaaacacaggauuccuuuggcaguauucagaaaucaucuguuuguuuugucugcccccaacuggguacuuugcagcacacaguuagucuuagaaauagcguagcucuauuuaaaggcaauuuuauacucgacugguggucuguguacaggaaugaaguuuucuuuaaggaauacauguugaaaauaucuguugagaaauuuagaccacggaaggcagaauacugugcacucauuaugcaucaaaauagaagcaaucugcucauuacagcccuuuccaccacugauauguucaaugcacuuggguuuucagucucucccucuuuguuccucuuaauuuguccaucaccuaccucacuugugauacugcauaccugguccuuugcauagccuagauacuguuugguauaacacaugaguaauaccuuuuacuuuucaaauccagaauugguaguugaauaguccacccagaacccucacaccaagcuucuggcgcaaaugucaaccugugguaaagccccuccacccuuguggaauucccuauaaauauuggagccuccugcuuccuguaauuuccaucugacuuagucugaagggucaauggauuaggaaccacuaguaagcuacacagggggaaaaaaguagaaggugaugucuccaugauccaaaccugaggcaaauuccugccuccucucagaccacugcucuaaguuuugguaggcagccuuguaaguucagguguaucuuucagucuccgcuggaagcaauagaauauauauugaaugagccaguauugaaugagacauuauccuaccccacauaagacuuuagaauaaaaagccuucaaccauaucuacguucaagugcaagacuuaggguaugaugaguaaaggaacccuacccaguccaguuaaggagacagacauacaaacuaauaaugucuuauauugaauuugagucaccuaacagaacuaccuagaagacaguaacauugucauagauggaaggauggaucacagccuuucugggaggaucaaaaauggcuacuuggaucggguagcuuuuaaaugcagccuaagagauaagcaggaauucaagugauaaaggacagaagggguguuucaggcaaagggaaugggaagagaggaagaaugauaguaucaguagcaacagaaagauguaguuuguggugaaaguggaaaagucucccuccauuagaauuaaguaugaucuugcaccauucaaauuugacuugguuugguuuuuguccuuuucugucuuuucaauuucaaaacaaaacaaugacaucguauuacuuuacauuaagaaaaaaaggaaccgggcuggagagauggcugagugguuaagagcacugucugcucuuccagaguuccugaguucaauucccagaagccacaugguggcucacaaccaucuguaaugagaucugacgccauucugguaugcaugaagacagcuauauaguguacucaaauaaauaaaaugaaucuuuaaaaagaagaaagagagagagagagagagagagagagagagagggagggagggagggagggagggagggagggagggaggaaggaaggaaggaaggaaggaaggaaggaaggaaggaaggaagaaagaaaggaagaaaggaagaaaggaagagaccuuacugagaagggggagguucagaaucugaggucggggaugaaaggcucuguuuaaauugcagugcuuuccaauuagcacugcuuugaugccugcccaaggagaucaaugugagaaagugaaggcagcccucuccuccacaucugaaauuggggaugcccucccuggaaugauggaugccccuuuggaaaaucacauucaccaagauccaauacuuucaaauggcucaggccugcaaaggaaccccauccuuuaguuccacauuucacacacuaaaugaaaauuucuaugaaaauaccauuuccuaagcugaaaugcuguaaguaaauguuggaguugucacacgugagagccauaagcuguacccuuucuaugucaaugacaugucauauuccuagauuagaaucaaaacacauuccuuugaagucaaauuauaucuccauucucagccgaacaggcugucuuaguucauaaguugucuguauggaguaccaacacaaagacaaaaaaucugagaaaauuaacaugccaccuaguuucaagggucuuucauuaaaaaugaaaaauaaaaauagucaacauauugucuuuuaaaauuauaugcaugaagaugcugugaagcuucauuuaagaaaagauaaaaauaaaguauacuuagcucucauacuagaacaaguuugagcagagguaacagaagacaaaggagaggagaaaugaaacacagcaaacaggagguaaaugaguccugccauacuuggcuaccaaggugucagaggacauuauuaccuguugucacuguucuuuggaagcucauugacucucccaguuuacagggucuuuuuucuaccuucaaaaguaguaugacugcaucuguuuucaaggucaaauuguuucuugggaaccauggugauacaaaagacauugcaaagcaauaauccaguacucuaacagugucuuuuggggcucugagggauuggucaguauaguauauguccuaaagacccagucuuaauucucuaaaagacagauagcauuuugucucacaaagcuagagagcagcuuuauuugagagcagcugauuugugacauuaaguucagggucuugcacauucuagguaggcgcucugauacugagccacaucccuagccucuguuucauaauuaugugauuucucuauaaacaaaaucuuagaauuuauacucuaagaaccagaaaaaaaccuaaugauaaaucaaccacgaacauaaggcaguauauccacguaucaacauaguaauaguaucucuagguaguagcucuaugauuuuuuuccuucuaccuucuuuuuguuuuugguuuuuugguuuuuguuuuuguuuuuguuuuuguuuuuguuuuuguuuuuguuuuucgagacaggguuucucuguauagcccuggcugaccuggaacucacuuuguagaccaggcuguccuugaacucagaaauccgccucccucugcuucccgagugcuaggauuaaaggcgugcaccaccaugcccagcccuucuaccuucuuuuauuuucuaaauuacucaaggugaacaugaguugcuuuuacaauaauaaaaucaaaagacuucauuuuaaaagaugaaggaagaaaaggacagaaguaaaguugaagcuuugccuguuaucucagcuacuaagcaggcuaaggcagaggcaucagaaguuuaagaccugcugggcaagauuuugcaccagucgggcagugguggcgcaugccuuuaaccucagcacuugggaggcagaggcaggcggauuucugaguuccaggccagccuggucuacagagugaguuccaggacagccagggcuauacagagaaacccugucucgaaaaaccaaaaaagaaaagaaguuuaagaccuguuuagagaauuuagugagacuuugucuaaaaagccaaaagagagugggcaugcagauuagugguagaacacuugcaaggcccuagauucaaucuccagugcccacccccaaauucuucucauuucagaaagaacuuacuuaugcuuaugaauaugcaccucaaaggacgugcggucuuaaaucauguugcacaaguguguuaccuggauguugaaguuuaaaaauuauaaaacuuauguagacuauaucauuucauauguaauacauagugucccucagauucaugauuauuggagaaugggucaugacuuacauuaugaagaugacugauuaugugugugggcacuguaguggugggaguuaacaagguaaucaacucacauucauuguccauugaaucaucacagcaaccuugugaccuagaugcuauuauuaccuucauuuuaugacaaaggaaaucaaagcucagacaaguuugggauguaccuaagguugcauuucugcguaaguaaaaccaaguuagcauuuaaaacucagguaggugagaugccaaaacccuagcgcugagcuacuacucauggaacauuggaagggacugcucugagaacccagacacaaugauaacaugguugcuuagugaaaugguguuccaaguugacaaugacuaauucuaaaggaaguuuuaaaaggccacucucaugugucccuccucguugaaagaagauauauggagcaagaugacuguuucucuucaagcuucaaaaccucucccucaguuccagaaaccaucuuagguuuucucuguguguguguguguauguguuugugugugugugugugugugucugucugucugucugucugucugucugucugucugucuuagguuuauugcagucccuugucccuuugacauuagguagaaccucaucuggaucuuccuccacuugucaguuaucuuuaugagcagcuaagaaagcuucaaggguugaaaggcaggggaaaagucaggaucccuucguuuucaacuucuagggauaucaaauuggaaggcccuggcauggguuccauuuuuauugcccuguuccauguuuguaagaguguguguagagguaggaagacgccuaaaggaaacucuuucauuaaaaaggacaucuuuuccccuagacugaugcccacguuccauuuccucauggaguaggggaaauuucucagccuuagccuuuagucuuugagcuuucacucucgggaacuggauuauuaccuuguaaaacagagcaucucuccuauuagccauuaauugaacccaucuuucuccucuugagaaacuguaguguugacuuuuauuuucagagcucuguauugagccucuuuuucuuggagauugacagugcucagauaucaggcauagccaggaugugagcaugcgcacagcaggaagcaaguauuggaguaucagucauuccuuaugucccauaagcucuucugguuguuauguccaucacucuggcuucccuuugacccaagcuuuugugggcauguacugaaaauuaucucuuccugucacacacacacacacacgauaaaauaauaguuuuaugguaaauacaaaaauaggaugaacugcaagaucauuuccccaagucuuccagucucagcuguaucugagaacauugcugggcucaugacuucuacuacccuucaaauggaagucacaccuguggauccuccuaaggccuaugcaucaggucacuccauucuuagccuguacagaguguugaauaauugcuccucugccagaaaaagaccaaacuuggacuuaaacagcauuguugcuuucuaucacaggccauuguuuugacuuuuuaaaaauguguguuuauucuaaguaucugggcuaauauccacuuaucagugaguacauaucaugugaguucuuuugugauuggauuaccucacucaggaugaugcccuccagguccauccauuugccuaggaauuucauaaauucauucuuuuuaauagcugcguaguacuccauuguguaaauguaccacauuuucuguauccauuccucuguugaggggcaucuguguucuuuccagcuucuggcuauuauaaauaaggcugcuaugaacauaguggagcauguguccuucuuaccgguuggaacaucuucuggauauauacccaggagagguauugcuggauccucagccaccaaaugcaaacacuauugcauacaccagcaagauuuugcugaaaggacccugauauagcugucucuugugaggcuuugccagugcuuggaaaacacagaaguggaugcucacagucagcuauuggauggaucacagggcccccaaugaaggagguagagaaaguacccaaggagcugaaggguucugcaacccuauagguggaagaacaauaugaacuaaccaguacccccagagcucaugucucuagcugcauauguagcagaagauggcguagucugccaucauugggaagagaggccccuuggucuugcaaacuuuauaugccccaguacaggggaaugccagggccaagaagugggaguggguggguaggggagcggggggggggggaggguauaggggacuuucgggauagcauuugaaauguaaaugaagaaaauaccuaauaaaaaauugggccgggcauaguggcgcaugccuuuaaucccagcacuugggaggcagaggcaggcagauuucugaguuugaggccagccuuguguacagagugaguuccaggacagccagggcuauacagagaaacccugucucgaaaaaccaaaaaaaaaaaaaauuggaaaaaauuuguggauaucuauuauaaaaauauuuaaguauauuucauaaguauauucauuuauauaguuugauaacauguuauauauucauguauagccgaaacaagauaauaggcaaaaagucuugcuauauuuuauuucuguauguuuaucuacuuuugcauauuauaugugcuccuuuuggcucacuuuuauuaucauaaacagcauagaaaugaaagcaaauaaaucauaauacauacuacuacagcccuuuccccuuugcucugugucacaagaaaaauaguauacagacaaaagaacaaagcaaccuucuuccucuuagcagaugggaguuucucuaacuguauaaucaggagaauuucauagagcuuauaguauucugagcacccuaccauuuggaucugcugccauuagccagagccuuuauggaaaggggccaucucuaggguaauagcauuguaaauuacaaucaauguacucaauuacgcucagaaaccaaaagcuauguagugcucuggugugccuuguaaucagcaccuuugagaauguagguaacagcauucugaauggggggaaaaaaaggaagcugcuguacgugugagaaaauggauguuggaauuauaucauccucuugauaggaacagcaucuucuguggaaggcaaccuucccccaccccuacuaucauuuuauugauuuuuuuaaagcuaaauuguggccuuguagcuaagaaugucuuuaaaaucauuuauugcucuaaucagccuggcagagcuuuucugucaugcugauaaggaaauuaaacuuuucucauacugugcucacuugccucugaugcacagauguuuuguuuuccuuucagggaacugauucagaaacugaagucuuucaucaacuucuauagcgcuuugccgggcuacaucugcagccauagccccguggccgaaaaugauacccugugcuggaacggacaagaacuuguggagagguaaucuuuugugaaaguuaguuauguguagcaacauuugacaacuaaucauauccgaagauugauuaaauugccuuccuucauuaacuucauaggaaaaauucuccacauaacauaccuauaagcauuuauuuaugaugguccaaaugcuguauauaacuuguagcucucagagaauuugcucauuuugaagcccaugaagaacugcauauucagggauauuugacaaaguauaaagcauauggugaacuuuucuccgucuucaguuauuuucaucuugucacuagguggaccauuauuccuucuauaugaaacaaucauauucaugcugacugcucucaguuauugggagugaacuuugcauuacacaccaugcuaaguaauuuguauauauuaacuuucuuugcaacaauccaauggaaugaaugcugaaaaugaagaaaacaagaaagggaggggaaauaggguaccauuugcugaaauguuugcucauuuaaggacuuuuaguauaaucuauaguaacugucauaucauuguuuauaaagaauuugcucaucacugacaagaaaagaauauauucauuuauuuagcaaauguugaacaccuuguuaagugccaggcaucuggaauugagcaauacagaugagcaucuagcaggucaaugguucuucaucuccagugugccauguauagaguacuagcuuguaauuagagugaaaucuacaugauagaaugcuuaggagccuacaaccugcuuuuaaagaugugcaaguuuuguaagcauacaaagaggagaguauaaaagagacuuggaauggaauucugagucuuugcccugacugguugcuuaacuuauagaaggcaaccugaucucccuaaaccagcaguucucaacgugugauucacaaccccuuugggggccaaauaucagauauuucugcauaucagauauuuacuuugauucaugacaguaggaaaguuacauuuaugaaguaacaaugaaauaaauuugugguagagggucacaugaagaacugauuuuaagugucacagcaucaggaaaguuccacuaguucugcguguuuuucuuucguuguucaguccuucauacacucaaaauuuauaauuuucuuugucuuugucuuugccuauuguuuaauuuuuaagaacuucaucuauccuucuccucuuccuucuccuuugcuaucuccuccuacguccaauuccuccucccaauuuuucacuuguuuuaucuauugauuuuuuauuaauuuuuauuuuaugugcaugaauguuuugccugcauguauaucugugugccacauauguucuugguacccauagaggacagaagaaggagucagaucucuuggaaguggaguuacagacaguugcgcacugccaugugggcucuaggaagugaaacuagguccucugaaagaacagcaaauucuuuuaaccacugaguuaucucuccagccuccucuucuuuaaguuuuauagguagguagguagguagguagguagauagauagauagauagauagauagauagauagauagauagauagauagauagauagauagauagauagauauuaaucugaucuggugcagcaagccucugaucuuagaugcucuggaguuugagacagaaagcucagcaccugccugaguuacagagacacuacauguuaaguacaaagcuagaugcuagggauacagguaaaagacaaauucauguuacuuccuuugaacagcuuacauuccaguggacucugacucagguuggugaauaaaauguauuuacaauauaguauaguauaacagacacgggaauauucuggcggcaaaggaacuuguuugcaucuuaguucuguguguugccuuggcacagucagguaaugcagaaggucuucagguccuuuucuguaagggaagggcauuuuacaagguuaccuugacgcuaaaguaaggugaagcuuguaaagugccccuuagaagacugguacguacugcaagcuccauucaugucucaucucuuuuucccugccuuuuuccucuaacucuuuucuuuacaaugcaagauaaaagacaugcccccaaacagcuuguuucucaucuaaguaauuuuucuaacaugagacaaaagaaggagauuucacgccacccuagaugauggacugaacuuguaugguguuagacuccuuggagaaaauaugaauggagcuagaaagauuagugacuccauguagcauccucaugcuggagaaacuauguuuauuugucaucuugaauggucaagaguauuaagcagaaucauaaacauguacuuaacuguuaugacaauuuuuaauugucaagaaaaaaaaggcaguugguauuggcuuuauaaaaagcuuauacuuuaacacacacacaaaaaaaauauauaguacuuagaaaauucccacaagccaaauacagcucuuaucuaaacuugaugagcaaacacccuagugacuuguuccacugcuaugauagcaugaaaagaaaaaaagaaaaugcauuccugaauaugugauaauaacaauggucccauauuaaaacaggcauuuuaauuuaaaguauauuuaguaaugugccaguucauucauuuuacucuaaugugugagcaccuccuauauaucaagucccaauauuguuuucuucauuauuauaauuuuuaaagugcauguaacugcaccacaugugucuucuaauguuucaaggaaauaauuagaaggucuagucugaacuuauucaaaacaguacauuuccaagguguuugaauaagcagaauauuuuuguuguguccugaucauauuaacuacuuucauagaugguagacacuuaugaaggaugcugccuucaaaucaagaaaguaaaaagaaauuuuuguaguuuucauuuuaagcuuuagguggguuuuuuaacaugugcauguuucauuagcuuuucuguugcuuuuaucuuauacgaaugaguaugaaaacuaggcgaacacauuuuugugggguuagcuuguuuugcguagugcugguuaccuggcacucauuuuguagauuagacuggacgggaauucaagagaaaucauccugccccccccccacccccgaaugcugagauuaaaggcauaggccgcaccaccuguccauuuuaagaagucugucaacugaaaacaauugcaguccagaggcuaggacucagagccucauguaugugaggcaaacauuuuaccacugaguucaaauaccaagcucuuguuaguugaaaauauuuucauugaguuuucuuuccuuuaaugccuucauguauuagaauaaaauaaacacuugaauauggagaaaaguuacucuaaauucuuauuuuuacaucugaaauauuuuuuuucuggucacagcuuuugugucagacuaucuaggaacaaaagauaaaaaggaaggggggaagaaauaacauauuugcagacagaauaaggcuaauauaaaccaggaagcaacucaucuuugguuaguaaccucgggugauaauuaaccuguucuuguaucagugaccuaaugcgaugaugagacuagggaauagugccgaagucaauuuuuuaaaaaacuccucagaaauguacacuuaaugauauaaaguucuuuagcccgaagacaugugugcccucuauuuaugucauuuguaaagauuagcuuuucacuccugucucaucugcagugagaauaucuuuuacggaguuucuuauuuaauuuagucuucaguagaagucuccacuuauaguaccacugcuaucuuuauagauucgguuucuauuccuuagaaacgauuuuacuuuuaggcaagagaauuuaugaaaaugaaaaggccugacagagaaugagacuuggucauuggagaaucauuggagaaucauugaucaaauggaaaauauagaugcuggauauccugagcaaugguucugucugcugaggagucagugcuccuaacuuuccgggcauagccaccucuccccuucucaagaauuaagggagucguuuucucugcagauuccuuucuguuuuuaucuccugaaugcaaucaauggaaggaauguuuucccagacccagucucagugaggggcccuuuacaccuaucauucguucuucuuacuucuccaauuuaucuuuauauaacaugagauuucaggauuaaacugagaagucuuugaauuaacaaccuuggcccaguugagccaccuauaauugcagaaagcagaauucuuccagcuuuugucuuugugagacagaauuacaauuagggacucacggagacucagagaaaaaauaaacaaccccaccaaauuaacccugggauuagcaacagauaacucugggguucuacugcauugucccugaaaauacauaaauggagagccaaauuguccagucaaccugucugaguaauugccugacaucuucauucuuuuucuggagacuuugucccacguaagcccaguuucacuguuuaauugcagcgaucuuuaauguauuguaacgugggccagcaagguggcucagugggucaaaacacuugcuguucuagccuuacaacuugagaggccauaguggaagugaagaaccaaccccgaaaaguaguucucugagcucacauauguacccacacucauucagccaacuuccucauugaccucauugaccaacaacauguccauguuuuguugcaguuguucucucccaagucuuuucuucucagcccuggguauaaaaucaguuugcuuuuuuuaauaguuagcauugcuccuagaaacguggaggauaaccaacagcgcggagauagccacuugaauuuuaucgugggugcugcucacuuugauuuugcccuagaugccccuauugcuccuuugugacguagcugggcuggauggaccucagaccaggugucaguuccaggaaugaucuuuuaucuuuucuggcugagaguuuguuacuucuguuuaugggaaaucuguauucaucuugcagccugaauggcauagacucucacuuggggcaucccacauuucagagcaaacucuuugagaucuacagagagcuaauuacagugaaggugccucuucuccauguuuugcaaucuuucuuugcauuucaacugagaaauuauauaugcacgugcacugugaauucucuuucugauuuccagccaucagccaaaccuucucauguuuauaaugccuugccaagauuucucugaaaauuggaaaggcagaaguagggauaugcaaaacaacuccuuuaguccucaaaaacuuguuucuugucuuaaaaccuuauggguguuucaaaauggaauaaggagacauuuuaaguuuugaaguuuggggagggaggaaggcacgcaugugugcgcgcacacacaaguaccuguguuugugugugugugugugugugugugugcgcgcgcgcgcgugugguguaugcacaugagcauguagauaaacacaaccauggacaaguaugaggaggccgguagagguugggugucuuccucuauugcuuucuaccguguugccuuaagacaaugacuugugcugaaucaggaacucaccauugcacucaggcuggccggccagugcgcuccuaugguccacuuggcucuguucuccgaugcuggagcuuauagucauguacagccaggcuuggccuuuuacaugggugcuggacuccaauucagauuuguuuucugcuugcagagcaagaacacauaccuucugugccaucuccugaccccugaaguuuucuuuucuucucugcuagguuacagggcuaaacugugacauaucagcaaguaggaaugaauggaaggaacuuuaccaaccaguuccugacagauacugcaaaauacuuuucaaaaauagguuaauaaaauaguuuauuuucuuccaugaucuaggaaaggcuguggagaagacagccuugauccugucuuuauacugcuaguuuaagaggaaaaaaaagucuuuugaggacuuuggugugcgaauagacuucuagcacugucaacuaucaagucucucauugguuuauauagcaagcagucaucaaaggaaugaaggaaggaccucaugccauaguaugugcauauuuucugucugucugucugucugucugucucucucucuuucacacacacacacacacacacacacacacacacacacacacacacacacacacacacaauguucaucucauuccagcugcaugagaacaggccaauagaagggagcagauacuauacauagcucccacgcucuuguuuuaaaauagacuguuuauuuuuugauguuugggcuuauuuuuagguuuauaguguggcuuuuauccaaagaacccaaagcagcaugcaugcugcuuuaaauauaggacugccaaugaagcagcagugugggaacccugggguguaaauaaauggaagagccagcaauugccuagcaugugugagaaccugaguuucaguccauguacugcccaaaaaaggacaauagggaagcaaauugauaggacagaauuuagagccaacaggaagggaggacaagagaaaauuaaauucuuggaauauggaaauggaacuaguuggguugaguugggccauuugguucagagcucccucaguagcacccuaagagaacucuaagagcucccuaauagcacaguguagcuaauacuuacucaguagcuagcccaauaucauuugagacuuagaaaugaagguuuacccuuuaacucucuggcucugucuuuucacuuaugcuucaucaguuucuucuuguucuucuguuuaugaauggauggauagcggguaggagagcaaacauggcauuuuuuauuugguuuauugcuagcucuguccacaauucuaagucucucucgaacuuccuuggauuucauucaucaguucuccaggaagcagaaucaggacccucuguucauuccaaccugaugaacugcuauguauaucuuagaauaaaagcauggagggauccagcuguuugcuaguguagcaguuuacauguuugauaucauccuagagcgcuaagucaauacuguuugugaaaaagcguugagagacaaaugcauuacacagaaaauuacuuaauuugccaccaugaaauauuauugauggcugcuaagaauuuuuuuuaaaaaaaauuaugcuagaacaagacagauaugucuggaguguacgcauguguaaugauccaucuaggggauuagauugcuauauuuuucaucauagauuuaucucaaacauaguccuuagcgacagcuauuuaucaggacucacuccaugacaauauaguaacauuuaucccuuaagauuauuuuauggugccacacacaguagcuuuaccuucaaaacugaaugagaaaaaaaaaugggucauccuguugacugauggcuuaguccccucccugugccucacacaaagcacacugccuuugguuggaugucauguuuuaaauguuaggagaagacauccucaugcaggguauggcugugccuguggaccaucuguugaagguuggaugguuuaguauuuucagcagaguauguuuguccuuggauuacacagugccagcaguccauggacuccgaucauuuuguuauacagagagcauuugagugucuucuugguagguccccaucauauauguguccucgauaaauaucauuucuucuucaucaagauucaaaaagaagagucuucucucaccgccacugcaccuggaaaggugaagcagcggaggcaugaagggaaaugacuacuuucaaagaaauuauuaaagugacauaugugagcuccugugucuucaaagggcaaaguaggaacuuuguagguuacagacugauuucguugguguucuccauccucccaauauuauuuuugcaucaucuuuugaaagagaccugcagugggaagaugaaucucaggcagcggauugucacugguacaugcuaaggguucuaguacuaagaaccugagacguuaggaaacaugacccagguaagggagguauuuugaagaaaguacagucuuuagaaugauccagauagaucucucaacucucauucaaacaugagcucuaugcugugguggggcauuuaacaccaaguuacuugaaagaugggaugcuggugccuccuucccaguucagagaugucuucuggaauguaagcacaaccauuggcaccacccuuaccauucauagcauaguagagaggaccgugcaaaagucaguaacaaggacaacauuuaugggccaucuucuucccuaauagguaaacuggauuuggguuuuguuguuauuguuguguuguguuguuuuguuuuguuuucuaaugcuuaugaguuuugggaaacggaacuguugaaugggauuacugaccaagcaggcuuguaucuuuuggggcccacuuagucugagagggugaaauaauggagcuguuuguguuucggacacuagcuuucaaugagcuuuccaaagaagaauucuuagaaugguucuagugauauccguaugaauggaccagcaggccuggggccauauacauucugguagcuaauccacaaauuaaaaugcaccccucagagagcuuguaaauuagguaaagaacugauucaaucuugggugcuggauaagucuucucaccuuuccugauaagucagauagucaguuuccuuuaucaccucauuagaauacuucugaccuucccaaauaacaaagccuccgaaauacuuuucuaauuacuucugguagucagcccaugagugucaaagaaaauggagucuuuggacuuggagugccaagcauagagagaaguauuuuuaaggaagccauuuuccucgcgauggcuugccauuagagccuaccuggucggugugauggcugucauugugguucugggguuggaauggaaaugguuggcaguacccauucuuuauacuuacugaccccacguuuugccucgggguacaaaccuuuggugguuuucuuaaaagaaaaugacguaucugauuauuuguauugcuauagauacaaacaguugacaauuaaagaaaaguaacaaugaauuuccaaaacaaacagaaaaccggagacacauuugaaagguacgugguaccaugaagcagggcuauugaggcauuuuuggagucaacaugucuaggguugaauuucuauuccauauaucucagcuuguuuucuucuccaagucccagcuuccccacuugaaaauaaagguaauuguucacuuagaagauugcuaaugacuuuaacaauauuguuaaaaugugccaucaaaaauauuagcuauuguugcuguuaaagccguuaaucaagacaucuuuugauuccaggguguggcucagggacagaauaagcauuugccuagcauauagaaaacccuagaaucaauccucagcagagaaaaaaguaagcacauuuauacaaacgucacuaggccuggaugcagcagcuccccuugaggacccauuucucaggaagagcgugaccugccuccacucuuuuuuuuuuuuaaaucuuaucucuucugcaaaacgugaauucucuguucuugugcugagugauaguccacagccaguuuagaaaccagaauaggguuaguuagcaguucagagcaauugcuuaccacucugaacuucuuccugucaccuuucacuaaacaguuguggaagaggagacagaucauuaacgucuggcaugacuucccaauuuuucaagccagugaacuuuauaguuuuacacaaggcuagcuucgauccuuggguuugucuccuuuauuucugggcgaagggaaugcaccuccauuuguagcucgggagucagggcagcuuuccuacuguuucccuguaaucucagugagccacguggggagauggaacuuuaaaauaauaauaauaauaaugaugaugaugaugaugaacucuucuugucuuuucuuacuuuuguuuugaggcgggguugcacagccuauacaaccuacuauguugcugagaaugccaaugaaaguaugauccucuugccucugcuuccgaugugcuaggauuacaucguguaugcuacaauagccuguuuauguugugcuggggagugaacccagggcuuccugccauccaggcucuaugcucaacccucuucuuguuuugagcacuucaucaccucuuucuuagcuucuaggugccauucugggaucaaagcuuggacuggucccuguucacaggaacuagacuaaugugucccauucgagauaaaagcuuggaguuagaggggcauauauccgguuaugcucuguaaauauucauacuaaagugcuaauuuucaaaaucuauuauggaaaacuaagacaaggacuguccuagaagggcuuagaauuucaaagcuguagggcuggcccaccucuauuuauccugaacucugaauccucugccccaugccuuaguguccuuacaucucagguuccuuuagcauguucccaguugcccugcccagaaauccuuuacauggcugugucuaauuucucacuauguacuuaaagauaguaucguguguucuguucguaugugucaacgucccguuguaccuggugcacucuaugccccauugugggggaaugcaggagugggugggauggggagcagggggaagggggagaggauggggagaggguguuuuucagaggggaaaccagaaaaaggggauaacauuugaaauguaaauaaaguauccaacaacaauaauaauaaaagggugaagcaacacauuggcuuuugugaggagcaggcuugaggacuagaccuagcauccccuuggggacacugcauccauuccucgggcaggucaccugaacuuucucuuuaaucucuuaagggguuguggugagcccccaauaaaaucaugcacaugaaauggauuuggaaguugaaagcaccuuucauauacuagauuuuaauguggaagagcaggucugauacagggagaacacugcccugaguaaauggggcugcacacuagauggugagcacagcaucacuggcuucucuuugcaagcacgcccuccucaagcagccucccgagcagcucucucugugcauaucucuaaauuuauuuuuuuuuucuuuaagcaaauuaccuggccccacagauuucuauuuuuaaacaagucagcccguggucuugaauaaagcaaucggucccggauuggaagcuccucagagacuggaggugucaguuguaaagaacaaaaagucugaguaacaucauuucaaagaaggagcacuuauauuacucucaaacgcaaguaauaauaguguuggggacggaacuugaagcacggaugagcuaauggaauaaacaaaugagaaucauugauaaugaggcuauuguuguguuacuguccugcgaaggaacagcauuuucagacugauuaucaugcccccugggaagccuauuuaagauauucuucuuccuuccuggacacaaagaauuugccaguuuaaaaaaaauccauauccauggauacugacugauagcucagcuuuucucaaugacggcggacagcaccuagcaacaaugcacugugcuuugguuauuaaaauauaaaaauaauaaagcaauuuggggggggcagaauuugauccucagcacugcauaaauugagcaugggaacacagagcuccauuuuugggcacugggaagguagaacaaggaaagucauccuuggcuacauagcaagucuggguuagccugggcuacauaaacccugucucaagacaaacuaauucacccugagcaacaaauguuucaggugccaacaguguuaaguuugccagucuaguucaccugggacuuucuacuuuuuaacauagaaguucgcagguuccacaaaucccuucaguuuugggcaaauugccaauagcuagucaccuuuaggcuccuaugucucuagcaucuacuaaauauggaaaaaaaugucauuccaaugaggacuuugcuuccucguucuguugguuugucggcuuuuccucuuuuaacaccucugaccuuccccugccugaaggauucccaaacgcugcuaucuuuacuccuacauccuuuccaaguuugacacuucacaaagcaggacucacccaguagacaugguuagggaugauaauagcucccuuugcuagcaugcucgccaucugccaggcccugugugcuauguacuuuguggacauucauuaucccaacagccuuuguggugggcuguaccauuuccccuccucuucccauuuuuacugauauaacuaaguguauauuaccagaggaugcugugcuaauaaaguggaugaaauucaaagccagccagccagccagccagcucaugccuucauccacucuacugcucuggcuggaagaagcuuggcucuucuuugggguucagaacuuuaugcuuucuucuucuugauagaaucucuaaccuaaguuugcuuucguuguuaguccacuaaggaugagugcucugugcagguaaaucuaguccuuucuuugcuccucgcccuacccuaaguuccaaacaagguccaucaggccuuuccaaucucuccaguuuuuuuuguuuguuuguuuuguuuuguuuuguuuuaaacaaaauagagagcucuuugcccuacagcuacuccagugcccagcuagagggcgcccuuugcuugccuuugcucguucuuccuucaaccucuuuuagacagguaacuuucuuuauucuuuuuuuuuuuuaaaugacauggggccuaggcugguuuauggggguagugggugggaggauuugggagggaacugggaauuugaaaagaagaaugccaugcagccaccugagugacuuugaauuucuacuucuguuuguccuuugauggcuucccagauaguccacaucgaggguaguuaaacagagccccgagguauaaucagucucauuaggaacucggugaguucuucauuucagccuuccagcagcuaacaggggagcaggcaggccagcugucugagauguugucacagucauuuucagguucugauccuggagaguuuggggugggauucaaguaauuaaaucuuaaagaaaucggcucccuuagaggaccacacagcucugacgggguuucugagcagaaagaaaugcaauucaaucacuguugcucugaauaauacaacugcucggaaugaaaaucagacacccucuagccacagagccagaucagugaccagagagcucuaucuagagaggugccaaggccugaagggcagguaagaguggaggaauacaaaguggccuagcaaccagaggguggaagacaauuuucacucucucuaagaacuucucagcuagagagcuuggguaguuucugacccaguuguccuugugugaauugcugcaugcuuuuuuaaaguauuuaugcggcacuuuauauuuuaccaagugcuuuacagucacuuuuauuuggcuuaguaaaguuuuccuggacucccaucugcucuaggcucacucaggagacucauuuuguuguuguuugcuuagcaccgccacgccugcagccucacacaaugaguggcuuguucugguggcagagcaggugcaaacugcuggggacaccugagcgagcagcuuggggagucggaguggacccgguucacgcuggagcucucacccacuuucccucuguuauucuucgacucgacucucguugauggcuggugacuagaaggugccagcgccgggcccaagaguugggcuagucugaucaggagccgcuggcggugacaagcucuuugucuagacugguugucaccucucucugugcucuacauugucacuaguccgccagaugaagacucacugaguguccuuucucccugcugcuuucggaugucgguucaggaauugaaacacugauguuaagagaaggcaaugacagaguagucccgcagugugugauaacucaggguucugggcccagguucacacuggcucccucacccuugcuagccccuuucccgcugugagaagcacacuauuccaguccgccggaugcugcgcuauagaaaccuuuaucuuuuaguacuucacaaugugaacacuaaaauucccaaguccugccucagcauccggagcuuccugaugcuugauaggaugccagcauuggaagcauuccaccccugaccucacgugaugggucacagccaaaauguagguacacuacaaauaccccauaccccuaggugguuugaauuauguagauaaagaauauaggaaacaagaagaaauuuuaugugagucucaucuacaggauaucuuauuaaacaccagacaauaucccaaaauugggggauggggugcggggaaauccaaacacuuccaguccugagcauuuuggacaaaagauccuccaccuguaauaaguagaguuauacccuccaucacauguugacagcggaagucccagaugugucagauuuguaucacaaccaccuuuuaaguggcacaaaccucccauugcuguuugaacucaagauguucuauggcuagcagguuuggaagcccagugaguagucugaagggauggacaugaggcuggaaggagugggcugugggcugugggcuguggccaucucucuggcuagucugaccaagugguaugugccauaccacuugaaugguaacauuuaguaaggcauagaaaaguaggucuggggcuggugagauggcucaguggguaagagcacccgacugcucuuccgaaggucaggaguucaaaucccagcaaccacauggugacucacaaccaucuguaacaagaucugacucccucuucuggagugucugaggacagcuacaguguacuuauaauaaauaaauaaauaaaucuuuaaaaaaaaaaaaaaaaaagaaaaguaggucugucguggagaaagcgacgaaucacuaaaguagggugacuugauagguggaagagacuggcugggagaccagaaggccagucaguguaaggcaggcccccagucaaagacugcagauccagcaagacuguuugauuagaacuauaaacugagcuuuguuggggggaggcccuccaccucgaaucagccccacagaccucucuacugaggcccuaaugucugcccggaaacgaaguagaggcauagguggauggauacaagugagggaaaugggagagaguucaggucagagagcccagagaaauaugaagcagugcuaggcaagaggaagucgugccugaacacccagggcucacuccaagagcaugaaagaauggcuuugaggaacaaggcggaauuccaaagccuggggcuugccaggugagucagcuaagcuaacaccuuuagcagcucuguuuccucuggcccaagaccuggagcagaggugggagaguggagguggaggggcaauaacccugcagguaaaaggguuugagaccugcccguaacuguagcuaagggaacggaggcuuccaaacgauaacaggaauguuuaucuuguaaaggaucucagcaguucccauugcuauggagucagucugcccuuugcucuagaucucuggcaauucauuuggacauucaaaacaacaugaugaaguaugaagcacuugacauuccuggccaacagguucuuccuugauagacacugucccuuggauagguuuggguauuuagugccugucgcuuagccaucagaguucaagugcaaaggcaaacaaagaaaacucuucaguguucuuuuaccuugauccuauguucuggcccuauagaaccagacugaagacaacugaaguguuggguuucucucagugugggcguggggaaguugaaacuucuccuaaguauuguucucaagguucauuugggugcucucaggaaguucuuugcaaauguuuguugaaggucuacuaucugucuaguacugucuuucauacuuucaaaagagcucuccacuaaaacauuccguguucuaggcacaguuggaagcacauagccuauauaaucucaacucaauagcauuugucauaucaacuagucccccacaacaugcuagugacauuauuccuuaccuguuugaaggagagccaguuuuauuuuuauuuggggacugaaccauacaugcuaggcaagugccuuaccagcccucuuuuuuuuuuuuuuuaucauuuuugagaccuggugucccuaaauugcccaggcuggucuuuaauucaccuggaauuccagacaggcuuugaaccuacagucuuccugccucagccuuuagaguaccaaagauuucaggccuauauccccaagcccagcucaaaccaauauuugaaucuauaucuuugaauauaagcccaauuuucuuucuaccacaugacuuggcccuuuuguaaacauguuauauagggggagggauguauagugcuugccuguaauccuagcacuugggagguagguuuccuugucacuguccuggauccuuugauggcuagacugagguacagguggugcugucccugucucuaucauccccucucugcugagccaacugcuucucccagccacagacucuaauggauaauaucaauuucuucaccggcuagaaacuauucacugcaucucuggauuuaagucauugauauuccaagaguaaucuuuuagcccuuucucaagugagguuuaaaacaaggauagaaaugaauugacacucacuuacucuccuaccauguuaaugucuucuaaaaugagauguaaauggcuuugcauucuucugauuccuuccacagcauuuucuuucuugcuacuaaaaucucuguaauuucugaaaggcaauugugugaaaacacagguauuucuuggaauaucguggaugagugugcuguuagcauugaaaauuugcccugacguuguuuauaacuguuguguugcaguuagaaaaaaaugaaagugaugaaauauuucucuuugacuauauccaccaaaaucuagguuuaaugcuugcaaucaguauagggccagcuuaauguacauacugcaagucccaggguaaccagggguaaaaacuauuaccuaaacauaaauaaaaaaauguccacaaaucacuaggaaaaauugucacuuucuuuauuaaacacauuuaaaaucucagcuaacuucaucuuuacuuuuauuuuuguguauuuaugcaauuaaggcugcaucuccaacagaaaacaguuuuuucuuaaagccucuuaauaaguugcuuuuugcuacucuguguucuagguuuuuuuuuuuuuaagcuauuuguucucuuuaaauuuuaccauuuuccccuagugcuuguaagccagaauauuuuucaaggaugacagaccauuuauugucaugccacaguuucuccauaagauggugcucugagcaugcaugaucuauagcuuuuuuuuuuuuccuugcuugcuuuuucuuuuucuuuuauuuuuucuuucucuuuuucuuuuuucuuuuucuuuuuucucccagccacaaucaggcagcaauugaauguaaacuuuugugaaaucaaauccuuuuagccaggagucaguccuucugagauuuguucacaaacccuuaccaccauucuaaugccuagggcaagaaggaaagugaagucucuagcaagccccuugcccuaaaucagaaccagcaggguuaggaaugcacgggauauguuugagggaccucuaaagaaaagaguuuuauucugaguaugaaacuuguaguauucgcgguuugaaaagucccuugcugagucuguuucuucacguacauggcaaggggguuggacccgcuggucugugaaggcacuuccaucuccagcguucuccauuugcaucugcugauugccucagccagugcagauuuaggaagaaaagcucgcccauuuuacgcuuguuugacucuauuccucuuuuacaagugcucucuuugcuucaacugucccaggacaagcaugcccagauguccuguuuuaauuagguuccuuuucucuuuaaggcuuuuacacagguuuccucccccccccccuuccccuccaggccuuaaccaaucugccugaaagggagaaacauucuccuuuucagugcacaaauaggguuuucuuaguaucacggcagucauuuuugugcugaauagauccaaacaggaggggggggggauacugcacgaagugcuuaaagguaacaccucuaacaucaugcuaaauauauacagccaagaaagcacccuguuucgguggaggugggcauuucuauucuuuuauugccagaagcauauuaaaacuucugggaagaggcaguugugaaaggaggaggacaauuaaucaagccacagaaaaguauugcuaaccagauaacgcaccaugaaaaucccccgaggcuaaugaguguuccugucucuggcauccccuaagaauugaguggggcagaugaauuggggcuaugauggcucaaccucauucaaagacuaucaugaacugcaggcaucagcagcacugcggagacccauggaagugaaaugcugaaugaauucauuaacugcaaacuccagagacaucccuagcugauucccuuugggcuuugacccucagaguacacaugucccaugaaauacccugagaacacaccaucugugucccuuugcuauugcagggaggcacaugugcuuaaaguaaacacagucaauuuuuuuuaaguuauugaacaaaagaaaugauggagugaaguaauggauagauuaaacuggcuuuagaaaucguucacuagauauacacauaucugagcaucacaguguacaugauaaauacauucaaauuuugucaaucaugguuacaaacgcugaaaaaaacugaaguuaacugugaugugcaauuccauuuauuuuuuuuuuaaaucuaauaguuacauagguuuagaaagcucacaggagggacugaggaugugacacaauagcaaaggacuucuccaguaugagcaaggcccuagguucaguugucagcaccacacagagaaacaaaaauccaugguauaaaauacagaagauaaaucaaguuguaaaauacauaagcaagucuugcccagcacuuauugaaaguaacagcugccacuacuuucuuguuuucuguacauauuugagcaguuuuauaacacaugagaguacagguguucuccuuuuguaaaagauggauccuaggaccccugguugguuccuuaaaagaaugauaguacugaaccccacaugaauagucaucucucuauguccaaggauucaaucaaacacaguuuggaaacacaauuaggaggagaagauuggcaauauagguuugaccucaugcuuagcaggcagaagguccuaacuuugaucuuugauaggaugagggaaagaaaggaaauguuggucagugggagaacccuugccugauaugccugaggcccagcacugaaaagaaaacgaacagacaacuauuacaaaguuuaguuuagaaauuagacaugaacagauuaauaaucauaucauaaaacaauucuagcuguguauuacaguaaaaguuuuaugaucucuccaucacucugaagucaaucugacaacuuagacuuguugaacacagaaauaauuuauauccuaggcaugaaugaguggaugguauagguuuuaucauacuuaaaacaaaacucaauuuaaaacuuaugaauuaaugauuucuguaguuuuucacuuaauguugucagucuauugcuauugcugugugccagccagugauucuauagaaggggaagcuguagacagguggaaaaagccuauuauaaugucuguacaaacccauuuuuaucacaaauagacccacacuggacauucucaacuugugaggucuuuguuguuuuaauguaucuuggccuuucuucucuaucagugcauacagaucuacuaugcucuuuuaauguaugcuucauauuccauuaugacagucauuacuuuuaaaaucugguucaguguuuuuuuuuuuucccaagcuaagguagaaagaaaggauagagagauaagauacaggaaaagaugugaggcagaagaguguaccgaguaccuacaggagaguauaaaaacagaguauuuaaauagcgucacugaauuuuagcaaccaugagcaacaguuggaugaguacauuugccuagugcuuuguacagaaaugagauaaaggagagcuuuaugucuaaaccacaagccagcccuucccaacacuucuguaaccagaaaccaugcuucauuuacucgagcuccuggaggauuuaaauagcacgugauacagugcaacagugaacgcuguuucaacugucagaacaaaauaaaagagaagagggagcuuuuaggugcgcugccuuuuuuuuuuuaauugagucaccaugggauuguggagcaguguugagcuggccauguuuaguucuaauucaugacuagaaaaugagagaugagaaaagaaaggagaacuagaggagaggcagagaacccuccuacaagagaaucaccaagggaucagcuaugagguucauuagauuuaauauucauaauagcuuuagaaugggaguccaggaccaaauugcuaagcuuccaugucuuucuccaauucuggugaggauaaugagcuucaggaaaauguuuguuuuguaggaaggcacaaaaaugugcuuggcgagcuuugguauggacaaguccauggagggaucuuuaaaaacacauuccugagguucauuucugaauuaauccuacaucuucaucugugcauaggggcucuuccuuaggcaauagcaggaggaaagaaagaagucggaauugguaucaucagggaagaagcacauuugcacagcacucuacggacacaaaagggguggcuaauacugagugcacuguuugauaaagauuccaugaaggcaguuggcucggugaucugacaauucagugguugccuuuucauucggugccaggaaacuacaaagccucuaggagcugaccauauguauacgauggauucucucucucucucucucucucucucucucucucucucucucucucucucucucucucucuuucucccucccucccccuuucccucccccccucugucucucucucucugucucucucucucuuucucccucccucacccucucccucccccccucucugucucucucucucucucucugucucucuuucucagcaggaauaaacucaacuguaagugcuguacaaaaaguauaacaacuuuaaauccgcacacaaggcuauucuuugcagcauuguuuguauuaucaaaguuuuuacaaauaauuuaguuuaucaguaggagauuggacaaauaaauuaugauacagucaugcagcauaauaagaacaaagcagcucaguauauucugaaauggaaauguucacaguauagauauuaggacagaaaaugaugcaaaucaggauguaugacaggauucuaguucggguuaaaauuaagaucuggaacuguggguacagaaaaauguccaaucaagugggaaucacugucccgguugaagccagaaaagccugacacuggggauaaagguagaaugaauggcuuuggauuacaaaucaucccccugcuccuccugaugaggacauccguagagaccuuaauacauccuucagcucuaaagccaagccugugauuccccaugcaggacaaugucaacaagccucucccgagccaugacuuucucuuccguggaggcaagcuagcaggcauaauguaugcugcaucggguugaaaaagcucccugaacagaaaaacaguuccugugggggccacaggaaauuaugagacgagggguaugaggggaaggcagagguaaagagcaugggagggucuuucuccuucaaaugagugggaagcacaggcagagcuagucuuuaaugguguuuuucacugaccgugaccuugagcguccccgggcacagugcuuucuagucggccgucucauguucuaaaaggcaggagaaaauuuauagucaguugcacuguugguacccaauggagucagucucguugauugggacucucauugucaaacuuucucuuucccuuccucucuauagauacagccagaaggcggcaaggaacgggaugaagaaucaguuuaaccuccaugagcugaaaaugaagggcccugagccggugguuagccagaucauugacaaacugaagcacauuaaccagguaugugucauagccaacagaaguggaacugcaaaagaaaucaauaugaggcagaugauuuucauugcugaaacuaauauuuaggcagguggggaagcagcaauuauucauguucuucaaugauuuuaccugcuaaaauugacaucuuucacuccauuuuuaaucauugugauauugcaguaagagagaaaucauacugguaucaccacaaugccuggcuucauaauuuuuuuuuagucauacuacacugacaacacauucucgugcuccuauuaaucauuugcuguggccaaguaacauucuguugucuguucaucaugauugauagacauccuaaaugauuccaguuucauuccaucacugagcugccucuuucucucuagcaccgucucuugaucagagaugauuuucuuacaagccugugcuguugcauuaaggggugugaauauuuccagugagagugugucaguuuucacuaccaccagcaagaucuuggagacccugcuucacagccccuuugccaaauucugacucaucccucucauuuccuugaccuauacacauacuuucccccucuuguagggaguuuuacaagucacaaauagaaguaugguuguaccaucugcuugugauugcuuuguggccacauacuuuuaaaaaaaagccaccagaaaggccaccauaugccacagugacaguguuucugggccaugccauguuccaugacugggagggcccagguacugggcuacuauuuguagcuugggaagaauugaaugggacuaaaauguuugugcacgggcagaggguucugugugaagacacaagccuaauuuuauuuucugugugaacauuagugaauuuuuagcauucugagaaaauuguuugcaagggcuuucuaaugauagcauauuucacuuggauugcaucaugagcauacugaaagcacacuuggaggaacucuuccagugucuccuaaagugcucugagcucagugagcacuuaauaaaugcuugcuacugcugcugagcacauggccacagcagugugauuuuuuuuuuccaaaugugucucaaaggauacugaggcaaagacaaugugaccacuuccccuaggagugaaggcagaauuggucuucagacuauuuauaaugaccccaacuaacuguaucugggugagacuacucaguuagaauccugcauuuggugagaccaaaacuucagggcccaucacugugccucuacuccugaguauagaugucaacagacuuuaaggcauaccugguauauauguguucuccugggucccagagacuucugagauugaaaagaaauguaguacucuguuuuaacagccucccuggaugagaacccaagcauaaacaucucaagaaagauaaagugugauaggcgauaaagcgcguagagagaugcugcucacacuaguuuagggugaccuggcagaaacacagaguaagcuaggcuagggggaagagccuuaaguggaacaaauguuaagagcugcuauaaaccaugugcaagggaggacuauguaaagagaaguagagaggggcagccauaaagcaauuucagacaaagaccuguggacugaauccacuugaaaaggggaaaaguugagaagauacaggcuuaaauaugaucuaguaauuaccaagaugcuuacagcaagccuuuuuguaaaggcuucaguuacaguuaaagaauaugaauuugcuuccauauugggucugaauuauguauuuuaauauauauguauauauuauaaguacaugcauauauaugugcuuauguauauaaauuaaauguauauaaauauaaaauaaauuaaauauacaugaauaaauauauacauaaacauacauacaauauuuauaaauauauauuuauauuuauguauauacuauauauguauuuuuaauauauaaccuuaggcaaaucagugcuuucauuaucccaucagugguacuccugagguaguaguagcauauucacaaauauacauaugcauaaauacaaugguuuuugcacgccaggccuuuauuaaaugguuguuccagagcugcuguuuaggcuuuucccuguaggcgggacuuaccuucgaaagggagcaucgguacuuuagccacugaguuuuaugugagugcagauuccuuuguuacuuugcuucuguucgcucuuaaauuuuuuucuuucaucuaacuuucagccacaaaacacaaacuaauccauggagagguugagguaaacaaagagagggcaaauucaccaucagcauuccuuucuucucccuccuugcagaacagugguacacauucuccguuucuauacaaauacuauugaacaauugauugucauugauagaccaguuuuaccuguuaacauuggucuggcuccaaacauccacacugacuuucuuuuauucucaccuguguugcuuuauaugcauaaaacacaucuuuuccauccuuagcuaaaacucaccuuuuggccauuauucagugugaaagugagauucuuugggaaaaugacaaaagaacagaguuuugauugggaugauaaagauguuaacacugauaaugcauuagcuuucuauagcacuuaacauuauuucagucacggcauguucucaagacuaguuguuuagggguaggggaauccaaccuggaauuguaugagauauaauacucucauaaaaguauucuuuucaagaauucauuacccuuaaagauuuuuaucauccucaccaagugauaaauguuuauccccucuuuauagcuagagaaacugaggcaaggagccauuagaggcggugcaggcaugcugccaagcaucuagugaguauaguugaaaauucaaucaauuauccagauguuguuucuuauauacugccaaacaucuggauucagugaaugccuggcuaaauuggccuaaacuuuuggcagugaggagguagaaucaaguuaacuugccuauguuugcaugugaauggagaauccagguaauguuacuuuccaucguuucugucuauaaaugcagagaugucuuccuaucugggcuuguguguccauccuguugaauuagagcauuuaugagcaucucccagaguaacucaacuucucuuccacagacauucucagcugccuccuuucagauuaugguucuguugauagagcggaaauacuauacucacuaagggaauaaaguaacauuauuucuacauuaacagucccauaguguaaccuugaggggauagguucaggcucaguccugggcccauuuccugggaaggggcacagguguguaauauacucccucuuccucauaagccacauaguucauguguaagauucccacgauugaaaauaagguccuuuuuauuucuuuuucaguuucuaauuuaugugagcauuuauuaguuuuuguuaggggaggaauugaaccacucuugguucucaguauuaguucuggaauuuacuaggcuauauuuuuuaaaccaacuuuuguuucugcuccagacuccuauguggagcgaagacuucacaaauaccaagaauguucauaauaccucccuacccagaugacgcugugggaaacugauucucuagcuuaguuuugucacuagcauuuuuucuguuuuaaguguauuuauaaguuacaacuaauuuugcuguucugaaacuaccacagaaguuuuuguccucaaggaaauacuaguaauuuaucguguugcccauuucaguaaagguucaaaugaaauuccagaaauuguuuuccugccuguuguaaagaguugaggccagagcagucaauaccugcccauuuggugucaagaauuucucauucaaaguaggauaaagucucaucuguuuaggaugguguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuauuccucguacaauugcaaacgcauuuguaaauuuacaauggggcauucauauuacuuuauaauccucguuucugcaacugguuacguggccuuaauugguauucauaacuaccuuccucuacuacccauucuguauuuccuucuccuucagccagcaccucagcaggucuuggcucuuuuccuggaggauugacccauaccuucauuccugaugggucuguguccuuugucauccugcuuggauuaggcuguuguaguuucccauugacuuuaaucacaggacaugguaguacuaagagacgcccuaagggaucuccuacacuccagacauaaucuugcuuaccaccauugugaagagguaauccaauuuccccaugguaaucuggaucuaucaccccuccuaacacuguuauuccuuuuuuagccuguugguguaagggcauuagaagcccaaaaugaccagggggaagucugagcuuccaguucaauggaauguuuguuguagcuccugguaggagcacuccccucucuggagccaaaacuucuaggccagcagaaccuagaguuauggggacaggaagcaaaaauuuuccuagagggucacuaggagugauaguaaguggaacuauuccauuuuccaccccuugauuccuggacccaugaauccuggcuaugggugaaacuguaccauauaucgagcgcugauucaaagcauauacugccuucugaagaacucuaccccagccuuccaagcuguuaccaccuaauuggcgcuguaacugcgucuucaaaaggccauuccaucuuucuaucagaccagcugcuucaggaugauggggaaugugguaagaccagugaauuccaugaucgugggcccacugucguacuucucuggcugugaaaugaguuccuuggucagaagcaauacuguguggaauaccaugacgauagaugaggcauucugucaauccaugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucugggacucaguguugguuucugcuguuggcagaucuggcaaucagcagcagcuguagccaggucagcuuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugaaucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggccugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaaggaaacuacaucugguacagcagcugcaauuggaguuacuaccugauuuaguuuucgguaaucaacugucauucuccaugauccaucuguuuucugcacuggccagauaggagaguuaaauggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaauuaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagaggaaccuggccaccccuucauucaagggguuccggaucugcaaacugucucaagucuggaaauugauucacuggccgagauugcuguuuaccacgaucuaauguagccuuucuuucauuuguuugagaauuuuucugcuuauacagaucaaacaaauaugcaguaggcuuccuauguauuucauuccuggaaacaccaugauugauuagccaguaccaaagguccaagcgagucaugccauuauaaauuucaccucuccugugcugaccauuacuggguauguuauuauaaacauucuuuugucuacgcuguccauuauaauaacuaggaucaccuugucuccggcgauucaaugcugccaccuggcccuuguuaccucgggauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuauacuuucuaccuccccucuaggagccuguuuugcuuugagucugguuacaggucuagaagaaacuauuggugggccguaagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauauuugaaagugcugguggaucaacaagccaauuccaguauuuuaaaagauucauccuuguacuucuguuacucuagaaccacuccugguaccaacuucuguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacagauggcuacaauguccugcugaauggcgggggaguagacgagauggccucuuaagauuccuuccagccgugugauucugugauuugugacucaaggucaggcuuuaacccaguacccucuugugaacaagucuugugacuuuauucucugcucugcacucuuuuuaaaauacccuguucccaggucaccccuuuccacuuuguaaccugucauccuuucagaggcuguucccuucccaccagccuuccaauauaggcagauggaacuucaacuugcccuucccccuauccaguucuucuguucuucugucuucuuuucaucaggcuauaaaacauuaagugguuaaaaaaaaacaccauuuuggcauuuaucgcuccuacuauguauggauccauuccccagggccagauauuugaccugucuuugaaucauguuaaccauguaacucuaaaugauaauucagccauacauuugcacaacacagaucagucuguaggcauacucuuauguacauuagauaaacaaaugcauuggcucugagaggaaacaagaugggcucugguauuugcauuuacaagaagaagaaacucuaaugcuccacugagacccaaacuccaaggcuaccagcuuuacucucagcuuuccuucuacuugucuaucuaucuaaugaagagaagaagaagaaaguacuguuaggaucccuguauaaaagguggggaggaguacaaauaucugaagccccuuacuuuggggauuaacaguuuucaagggccaaauauagacauuucuauagucuacggcuuuauaaagucuucaacaaagaaagacaaaucauguuuuacagaaucacaauuggggcaaucauuagaaaacugccuaccacguuauaugaugaacaaauaaaggugcuuuguaggauaggugagucugugaacuaucauaaaaaaucccuaaauaauagaccaaaggaaaaacucaaauguacaacagagagugaaauaucccuacuucuaucacuuucuggaaauaguggcaaacuauuuuuaagaugcuugauagagucugguacaaaugaagacacuuguugucgaaauagaauguuaaauauuuaauaaguuaauuuguaaaguugaugaguaacagagaaggcacauuccuuagagugcaguuuuuccaaaucuuugaguuggcucuuaguuaugguagaaacacaucaaguaacuuuuucauagucuucucauaaaaacuaauaauaguuggaaaucacugacccgagccagugcuuucuagaaaaacuagucuuaaacaugaauuuuaagaagcuuucuaaaaaaucaaauuuaaauaaaaggucuuccucaaauguugcuauaucccaaugucuuggauacgucuuuacuuacaaauggugcuguagaacaauaguuacuuccauuucccuauagaggcagacuggguuagugggacaggagacaagguaucugcaacagccaaugaagaggcuucuccgucacaaaaggacaguguaaaguagucauuagguaucagcugcuagacucuguggagcaaaacauuacuucacaaaguaacaggaauuagcugaaacauuccaaaacacauuuaucauuuaaaaaaucauuugucuuucuguuuaauagcuugaaauauaauuacaaugucugguggcuuugggcagcauguguuuuuaauaucuuaauuacuauguacaguuuaauaacauugcaccaaagagaauucucaaauauuuuagauuaaauuucuugaaaaggaacuacuugcuauauuuagaauauacagcauuaaauuuauuuaaauugggucauguauuuuaguccuugcauauuaauuaaacuauucaaaacuggaagauaagucaggaauggugagcagcauaguauugguagcacuaucaugauaaccuugauugagcaacagagagagagacauuuuuuuucuucauuacuauauuuuacuguauuugauuuuucuauagauuuuaauucauuuuauuuauuaucauuugucaguguuguugugcguauacucuaguuugccccuaaagucuuuucuaauaugaauaugaaugcacaugugcaggcauguuuucuuauauagaauguacuucaggucauggcaggaggucauacuucagcaguucaucuuugaaacaaaaaagccccguggccugaggcaugagcuugcuaauuauuuaucuccuguggacauuauuaacuagcuuuguucauaacaaguacaccucauuacccaccaccucacucauuaaaccaguugaauaguuaauacacugaguggagguggucucuguggggagggauuacugaacccaaagcaggcagagccacgagaaccuauugugcaggcguugggccuucucccagaggcugacuccauucuacauccagaaucagucaucuuuauacuccaaugcccuggaucucaguucuaucuuccaggauacauuaacaauucaagauuugccucccccuucuaaggaugagaaaauuaacaucauauuagucaguagauuuaaaugucaaauaacucaguuauuuuagggcagugcauucagauucuguuccauggugaaugugggagguucucauucuuauuucaaccaagaaaugcuaguuguaaacuucuucuuauauagauauugaucuucugaauaaaacaauaaaaaucucaggcugcucuuaaaacucuugaacauuuaauccagugugaacacuaccucauuauacagagcaucuacaacacacaaggaaaucagugcaugugcuguugagcaaguuccuaaacuuaacuggugguaaaaauggaggucaggcaagagaauaugcauggcuugguggcaacauuauuacuuuuagaaaugauaaaugaaaucccauguuuguguguuaaugagcuaaagugucuuucuucaaagcugaugagcaacacuuccaaaauuuccuugccugugucauuagaauucugacaaaaaacaauagaaauaaagaguacuaugcuaucuuguuuagaaggaucuuuuccauagucucaaccccagagaaaaucccauguuagcugucccaacaaaauaccuggccauaguccagcccaccuacaguuauuuguuuuguuuuguuuuguuuuaagauggggccuuucccaugguuaguugagucugaucauugcauuuuaagugcauugacacaugagcagacauggauccauauucuauaugagcucacuguugguauuuaguggaaaugaagucuuaauaaugucaauccuguaucucuaauuauagcgucuccuuaggcagcaaccacagugauuuuuacauagcaacugaaaaguagaguuuuuccacuagacucccaucuaauauacaagaugaaaaucacaccauuguuuaaugcacuggauuucaguuguuuuuuuuuuaagaguuuuaacauguggucucuuuuucuccuuaauaaguugaucuauacacuuucuugugacccauauuuucaguuguuucucaaacauuaugcaguaugagcaagucugugacaagauuuuuuuuaaaaaaagcuaaaauagcuauuuuguguuaugucaugaaaaugaugcuuaaguucaggucacuuacaugccagggcacugaagagucuuagaauaauuaugcuggcuaaacuuuggacuagcacaacaaauggaggaagagucacacuuuaagaggcagaaaugggauuguggaaaucacaagcaagagagccuaacaucacaucuuagcaaaguucuagaucaaucucuuggauagugugaguucuccauaauaauuaugaacuagaagccacuguggacucucucacacaaaaucaugacauuuccucuuacagcuaugucauugaacauguguugcuggucuauaggucuggcauagacaugguuuaagaaagaaaugauaacuaugaguuccuuuucaacaagugacaagaaauguuggugaagagauaaccugcuuuagucaauguguagcuaauuaauuauuagaccuaaagaauauuuucuuagcaaauugaugucagccuggagagaggucuuugcugcuuugcuuugaacuuaacuuugacagaaaccuuuaaaaaaaaaaacaaaaaaaaaaacaaaugagcuaagacagaggagcaagccaugucauuaauauucagucacagcacgcaggaagauaauauuaacuauuauaucaauauugucauugggauccaaauauaucuuaacagacuagaugacaagagaaagcuagagaguugaaaaguuccagggauaaauauacauucuuuugggauucccaaacacaagugugcaagugauagggaaacugacuuuguagacaucauugguuuuggugauaauggaaauagcaacaaggagcagucccuagcaaguacauuagaugguguggucuguauuggcagggaagacuuguauaugagcauagguacugaaaaggucagcuuaagaacuuggggaaggucauaaaacacuugcccuccggaagggagaggcuaauuagcauuucucagaccacagggugggaacugaccugcggguggggacacauuccgcaggacugacuguugcccaccuucagacaagggaaguccuugucaccucauucucuaaagaccaaucgauuuaaaaggugcgcuguuccaccaaucauauugugccuaguugcugaugcucuauucugccccuggaaaccauauaaaaccucacagacccgguucugggagugggggggucgcugccucuccuuugggucugggaugacccuaaugcacuggaacaauaaauuccucuuucuuuuugccaacuccacaugguucacucaggggguccccaguaagcuaaggcucccuggagccuuacaguacauuggaaugggaaaaaugagagagacuaggaaaauuuucuucacucuaauuaaagguuuaaaaagauucuuugaugacugcaaggucacugcucuaccugagagacugguuuauugguucgguauauguuaaggcuuuuuauuuuuuauuaagauauuauuuuuguuaauuauuuggaacuuucacauaguacacuccagucauauucacuucccagucuucucaggcccacccccaacccuugugaccaccacaaaagaaaaggaggagaaggaagaggagaaggaggaaaggacaaaagaaaaaaagggaaaaaaacaaguuuuuauuacagcaguaccugccauuauuguaaaacuuuauugguacaguauuaaaauuacagugagaagauugaaaccacaacauuuguguauuuacuucagcauaaagcaaaaggggguuggagccaaauugaccugugcucagcugccagucauguucuuuuugaauucuuuaacuucugguuguuucaguuuccuaauaccuaggaaauggguauacuaucaucugucuugaauaaucaggauaaagauaagaugcaauguacacguaaauuggagcuacuaucuccuuucauauuauuauaguaugaaguguccgcagaagggaaagucaagcuauuugagucuuugugcagggcugcaggaacugugucuuuucuaguuuggaauguuucugugaucuuaaaauuuuaaauacaauaaucuagauucuaaagauucuuggaaacaauguaucuagccaacagauuuuuuaacuguugaaaauuuaguuuggcucaaagugcuugaagagaaaaugaagcugauaaaugaaauauagacgguaucugcaugcaugaugcguguguguguguguguguguguguguguguguguguuuaaaucaguucuuuagauuucccccaaguuugaacucugcccuaaauuagauacucuauuaauaggcaagcuaccuuccgagugcagcuuagggaucuuaguacaugauccagaagucucauuuugaucuucauccuaccagggccuuucauggaacaguaguaucaaauagacuucagagcuauaaaguucauggcaaguuaaucugcauuccuuuugcauuuuguucucuggcugaagauguugagagguuccuauauuuaaaauguggcugccaugggauccuuauuggcagaugucuaccaggagguauuuagaaugguuuggaaaagcauacaacguauuugugagugugugugcauuucacaugccagcagagcagaaagaauuuacaaggcuuggggcuacugagcuuuccuuaagacaccaucacucucagcuguuggggugaugucagagaugccgggaacacugcuuaaggcccgaauuccugagcucuauuugaauugcagagaagcucuguuuugcauugcagagcuuagagcaggccggacccauucugugggcucuaccuucaaagaccuacggaauuuguuaacuacagacagagacuagugagcacuuguuaucaggcaaaaggaaagcugcccccugcugccugagucuuugucucugccugggauaccauggaaaauggggaaggaauccagacucauuaaugagcuaauacaaaagccuaagccaagcuagaggcaguucguuauugcugcguauggauucuugaaggagguggagagcugaaagauguccagcccagaagcaggaagcggugaucuuacugcugauaucuuuuuauuuauguugguuucuggacuauuguguggcaaauugguugaucaauacuugccaucagauaacuuccugugcaaauuguugaagcuacggguuuucacucuaagagguuaagauucaacaucgaaaugaacuucuccuugggugcauggacucuguucuucccugucauucuuggaagucacuuaagcgguaaucauuucuuugagacccuuucaaaaugaagccuauaaggcagaacauauaguaaagugugguuauacauacaggcugucauauuaggaguuauuuuauguauuagguaucuguguuuuauguggugcuaaguuugauuggcuauauauguacauuaauaaggauauacagaauccacucuacauacacaucugucaucucauguagauauaucaucuuuuggauccauucauccaacacugagcaacuauaugccagcacuaugagcauauggauaccacuugagcgugaucucuuucaagguagaugaugagacauaucuucaauccuacuauccuagccuuguauuagugaagcauaaauaagguccugcuaacccugagaagggaaggauucauuucuacugagagaauuagacaggacuucaaaaauagguagccuuuaaaccaggcuuugaaagacaaggagaauuuuggcagauaaugauugcaagggaggaucuucccagcagaggaaugugguaugagcaguggcucaaagacaugaaaguacaucaguagacauguggcuagagagcugaggccacaagcuggaguagcagagagguggggagugaaagaugagacuuaaaaggugugucaaaaaugccaggggcuauagauagcauaagaaggaauccagaguuguacucuuuugacagugacagccacugaagggauaggaacaugagaaagauauggacagggaucaggguuuuguaauguccauucuugaguguaggugagaagguggggguuagagggcagaaauugguagcaagcaauccagcuaaucuugcaagaguuuccaaggaaaggaagugaagccugccaugaaaauuuauuaaaccuuccagucuacugccugguggaauagccuagggaaugagaacugcuuugucucuaaauuuggcccugucacuuuuuaccuguuagccaggacauaaggauuggaauaggcagugcugugggucucagaagaauguaguauaugucauaacccacucaaaccagaccaguagcuguuccaggucccacaguuaaaaggaaacccuaguaccuguaaacauuuaucccucauugaaccuuaagaaguuuucacaaugagguauuuagauucccugaugaauguguuaacuauuacucuuuaaucaauuuguuacacguuuuuuuuuuagucaauaucccaauuaaaaguggcuccuuggauguugaauguugagugucauccauucacugaagucucaaaaauuaccaaaacugugagaaagaucgggagagauuaucguguuuuucuucagcugccacugugggagcuuagauguguuggagagacuacuguguuucgugacagccucacaaagaggcguggggaaccagagggaagcagugacuguuugccuucuccauaccuuuuuagaacaaauuuccuuauuugaaagcaaguccuguguuuuucuaauuauagcagcuacuuguaguuugcucuguuucccuagcaugguauacagcaccuugccuguuguuuuauucaagcauaugcagacagcaagccaaccuaaccugacuuuucaccaaacacucaggcucucucuucucucugccucagcacacacuugugcccugcugaucagaucugaugcuaagaaggccaacaaaguauuugggauggguagcaggggagcuggauuacagccuuuccguaaggguggagauuuguccuccuacucagcacugggcugugugcuccuaaaacacauaguagggugacacauauuuguaugaauaagugaauuauuuuguucuaguuuugacccaccgauuucccuguuuggacaaaaugucucugucuaacaccugcccugcuaucauauucugaaaauggaucauguuaucugcuuuucgaagcacacagaucuugcccuaugaugucguguauuuaaucucauccaucuuugaguuagaugauauaauuuucaauugaugggagcuaauggcacuugagauuauuuggaguuagaguugaugcaguuaaaaaacauugagacaagguggauauauuuugcacauggaaaaauaguaaauuugggguaaggaaauguauagacauguucagagaggaagagaacacauagggaacccuuuuugccauuaaaaauuaagaacuggccgggccugguggcgcacgccuuuaaucccagcacucaggaggcagaggcaggcggauuucugaguucgaggccagccuggucuacaaagugagcuccaggacagccagggcuauacagagaaacccugucucgauaaacaaaaaaccaaaaaacaaaaaacaacaacaacaaaaacacaaaauuaagaacuguuuacauugggcauuuuaaaguugauauauagaauauucuaggucuuuccaaaggccaucuagaaagccaggugugguagcacacgcuuguaaccccagcacuuggaagguagaagcaggaggauccaaaguucaaguucauucuugguuacacagggaguucaagaccagccuuggacugcgaaaacugucucaauuagcaacaacaauaauaaagucaucuagaguacuccuuuuuucacuuucuuaagaaauauucuagaauaguaccauguccuccuugugaguucccuguucuauuuguucagaaucucuuuaacucaguaaggacuggaaaacccacagucuucucuccccucucucuguucugacucucacuuggagaaugcaugcugguucuuauuuuugacagagacaucaagccauguccuacgccuucuucucucuccuguucuaucacuuucaaauaugauaccaagcaaccuacucugucugucaaagcccgaguacuaggcacuuucauuuucuuggcuccuuugcacuucaagcuuaacuuguugaggcuugaacagcugagaugaaacagaacuucaugcacccuuuugauuucuaagacucuggucuuccuggguccugaagaccuggggugacucaugccucauguguagauagguagaaauugagaagcauucuuauuuguaaguacauaaaaccuugggcacacccucccuuauugcacagauuucucaugcuugcuacaggguauaguauccaugaaggacagcuuguccuguaauaauuccugcaaccuaggaccuacucugucccacucacauuaaaucaucauuuaugucacuagcccuauacucuauccucuguagccagucaccaaaugcuuuaaaguuauucucgguaacacugucuuuuugagauacuguuaugucccugugccauuuaugcacaugcaggcuugcuuuuuuucaccaagagucccauguugggcacaaagacuagaaaacccccuaagucagccccaccuuuggcuucuagaaaccuacauucuuucuccccuuucuuuacuuuuagcacgauaaacaccaaccugacuucuauucuuaguuugcuuuauguauuuucuuuuguguguguguguguguguguguguguguguguguguguaaaacuucuuucucugguacaaaaagucauagagguuuugcguugccuugauuccuaccuucucuagcuaaaagugcuuuuccacaucuccuccguuuuuuuauuguuuugguuguuuuguguacguguguuuuguuuuguuugucucguauccaccuacucccaucuuuuaaauaauauaggaauuucuuaugcagauuaaaaugcccuuuugagagaggguauacuggcuugccuggaacucuuuuugaagaccuggcuagccuuaaaccuagagauauaugugccuugacuuccugaaugcuaggauuaaagacauguaucaccaggccaaggcuaaguuaaaguuuuuguguggaugugugucuucugacucuacauuuaauagaaaaugguaaauaaaauaaauaaccuagagaaaggcaacugucagaaccaaauaguguguacuaugugccugcucuacaauugguuuaugccucacaaccucuaagaaagcaugccuugcuuguugaaugcuucauuuucaauaaaagaauccuuaaucuagaaaugcuuuuggcuagcaaugaugaacagcagcaguuuaaaaaaauuuuuuccaaagcaaaagcaccagaaguuuggaaaggaauugcaaguuguguuauaaugcaacugaucucuuucuuccugagaaaguuggucucucgccagaguguucacuucagacccacacacucuggguauauuuauagagggcccaaugaggaagaagaaaagaacaugaucagcuuugcuucccagcacagcagacaaugacaaauacucaccaggugauguucugcacuuaagaacuuuagggggucaaaugucaucgaaguaugugacagccagacgugcacuggguugaaagacccugcuccccgccauauacacaacccaacuugaaacagcugcagaauugaaucuaggaauccagaaguauugcuggaugcuauugggcagccuucuuggaaacagggacauauaggcgacuaaagcugcucuuuaauucuuauuguuauggaaauuguaauggagauugcugaagagcucaagcuggucuuaaacucacauuucccaucuuugccgcucaagugcuagaauucuggguaugcaccauuaugcuuacagcugcuuaugaaaucuuaacaauauauagauguuaauaaaaauaugcaccacugugguuaaauguuuauuuucaauaccacauuuacaucuaucccaugaucuagcuaucacuaacauauuauuguccuauuuuacagaugagaaaacuaauauucagguuauaaaugggccaaaaguuaaauuugaacuuguuucccugucuuuuuacacugaauuccaugggauaagagguaauaagaaucguuagagggcuggugagauggcucagcaguuaagagcacugacugcucuucugaaggucaggagcucaaaucccagcaaccacacgguggcucucaaccauccguaaugugaucugacgcccucuucuggugcaucugaagaaagcaacaguguacuuacauaaaauaauaaaauaaaucuuuaaaaaaaaagaauccuuagaauaauaaugccauugccuaagaagucaguugaaguagccugcaacuagccgcuccauuuacaaucauuucucccuaagaaagucuauuacaguccacaagauauauaaggauauggcacugucauuguuggugaauagcgaaaaaaacccaacgacaacaacaaaaaaaaccucacauaaacaaaaaaaaacuguaaaaguaauuaaacaguccaucaaauagauccuuguuaugugagcuauacugcuucuauacaauagaguaaaauacagcuaucaaaaaguauuuuuucaaaagcauuauuauccuuagaaagauauccauuacacuuauugcugcguaugaaaggggagaauaaccaaguaugguaguacccauuuauaaucuuggaauuugggaaacugagacagguagaugucaugaaaaggugugacuuguuaguucccguguccagagccuauguucuccuccucaccacuguauggacuucuguagugggaacugaagucaaggagacuuaagucaaggucuugcucaugcuaggcacacucuagacagcacuguucuauggagcuauaggcccaauucauucacaauuuuuauuuugagucaggucuucucuaaauugcuccagcuggccucagauucacuguguaacccaagcaagucuugaacugccuaccuuccuguagcuaggauuccaaguaugaagaaacaguuuuguuuuaguuugguuuucuaucaaagguaguuagcccagcaaagguuguauuucuuaagccuucccuucuccucuacacugguuggcaaaugucagauugugaaguugugcuccagccaaugaguugaggcaaagcaguaaccgaugucacaaauagagcagaauccaucuuggccaaaugcucuugguagccugguuuggauucuaauacacccuuaucucagggaaaaaaaaaaugcagcugggcgugguggcacacgccuuuauucccagcacucgggaggcagaggcaggcggauuucugcauuugaggccagccuggucuacagagugaguuccaggacagccagggcuacacagaaaaacccugucucgaaaaaaaaaugccuugcugagcuacuuuuacuuuguuucuguaguccuuugugacacaccaagacuggccuuuguuuccaauacaagcaugcaccacccuggcagcuugucguucucauucauauuuuccccuucagcagucagcuuuucagacuccauaggcuaauggucuguccuuccaugggucacccuaguuuccaucccucauucuuuuauuccucuucucuugacauugcccuauuccauugcuguccugugacuguucagacggcauuauggaagacugaauauucuggguccaagguacaguagcguaugugcacagcucucaaguuagcauagcagcuugaaagcaacaucuuugucagugggcagucauucagaaguucaguguccaacagcaaaggagccauugaagagcugugcuuguuggaugcugcuuuccuuaaugcgcucuccaccuuauauugucuaauaugcuagcauccaaacuuaggaugcaaaguaagugaggacaggggcuucaaaucaaugaaauucaugcuuucauaacauaaugugcaagcucuaaggaauaagaaagugcuaaucucucaaaggcuaaagauaaggccauccgacagcuuugcaacgucagggacuuuagucacccuuuacacagucuuuacacacgugucaaaccuucagacggucuugagaaaauaaccuuuauuuuuuuuuuuuuaaaaaaaagagagauggcuuugaaguuugaaaaucaaagcaaaugaaagcaaggcagcuguuucucaguguagaaaggaccguuccuaaacugugagaaaguuaauaaggauuucaaagggcagugauaacuuauauucuaaugggggcagcacggggaacuccagguuggagacaaguggugaagacaacuacaccugaacauggaggcuuauacggcuuccuguguauaccccacuguucaucuuucacuauuucugggucucuuucucucuauucccucuucaucauagcguucucaauuccucucugugucacaaucuuuuucuuuuaaacacauuccuaaaagugggauagcauagaccuggagucuuuuuuuuuauuauuauuauuucuuccaucuuuuaaauggaguucugcuuuccucuucuucuuuuuuucacccuaaaauacacauuuuuuuucuuccacaaaacaaacuaaagugaguccagcagcuuuuuacuuguguguggccccaauugaucacccccccccccgugggucaguggcccuugaaaaaaaaaaaaagguccccacccuuguacuaaagggucuugccaauuuaauucuucuucagaaaaggagaugaauaacaguauggacaauuaguuacugugggugggagaaggaauuuggcuggaggcaauuuucuuuggaaagagauaggccagcacaagagguugaaauagcugcacuugugaaaaauagaggguaugaaauaacuugguggaaaguucagcugagaacaggaacaucuggggcuuauucaugcuuuuuuuuuuuaaaaagaaguuuuugaagcuuuuuuauuagcugacuugaccucagauugaagaggagauuuuucaaauguuaaacaguuuuuuuuucuuuugcauuccuaaagucauauuguguucagcuuguuaauaucugcacagggggccuucagcagacugcugccagagcagcgugcuuuggggacauaguuccagauagcugguauuucccuuucuugugggggauuugcaugugucccuuucauccaugcauauagcagauucauccguaaauaauugcauuugacaucacaguuguuagagaaaacacagggagaggggagagaaaaaaaaaagauccccauuucccccacauaagacagcuggagagaagcagauuagacagggaaauacauaaacauacguggaauguagcagguaacuuugucuguguuagucaugauaauaacuuacauguuggaauaccuauggcauacauuccaagaugcguaggacucagaaaaaugcaaacacacacacaccacgaaucaacacuuuguauccuggggauggauuuaugaugucugacaggagacgcauugucucagucuuccaaggugcuuucccuuguuuuucuggacaaggauuucagguaauucuggaguuucugauggcagccacaagggcaucuggcagggaaacacccaaucugccuugugguagacuggcugggaggguaggagguugucuguuugcagugugcuagaaauuccuauugcuggaacccucagaaggacaggcgcucuaaugauguucagaaugcgggcaguuagucugucuacugaaaguguaagcagaaauaacuuucugcuuuagacauuaacugccuaaacagaagcucucauucuuaauggucugcaacauguucuguggcugaagcucuuggagguaagucagugauuuggaguuuauuuucuugcuaacugcuagaccuacaaagguuccaugcaagcaaaagaauucaaaccaaucuccaaaacuuugacauuaaaaauguuuggaguuauuccagcacagauguugugcauucuguauugcguuuguggcccaugccagguuccuugauuaacagcuagaacacauacagacaguucaguaaauuaacacauaauacuugaacucugccucaaaauguuuguuuguuuggccacugagugccaguacucuguuagguccugggaaucuugagaagcacaaagaugaaucaaacacacuucugcccuugaaaacccuugggcuucauaggggugacagauagacacaagcccccacaauauuagguuguugcaauuugaggacaaguccuucugaagaaaguguagugagaacacagaagaaacaauuagaaucaacuccaggaaucaggaaaggauguguggaggaagugauauuugagaugauucuuugagaaugaacagugugucaacagggaagaucacacaaggcuaagagaacagccuggacaaggugcacagguauggaaugguauggagagcauuggagaacauugaugagaaggagguacaugaagagucuuaugggauaguaagggcaagcauaccagaauuuaaauuaagaccuuugaauuaagagcccaaggaucaaguccagacauagaaacuuucuuuaaaaguguaaagaggaauugggccaggguagaaagaaucucuuugggaguggcacaacucaauuagaggcaaggcacucauauacuuuagaaaagagaauggccuacgcaguacagugcaguacacaugaguaccaaccgaggggugggugcgggagagcacagggccaucuauagaggugagucacuuuucaggccaaauugggaaccuugguaccccaccuauccucuucaaaugucacagccuuccuaaauaaaaccugcuauaaacuagaauccuauuucaugugucaauaccaagugacuggcugaggagacagcugauagagcagaaaggauugacagacgauucaucuuuagucuggagaauaugaaauuuaacugaucauagaaaucuagguaacuggauuguucuuguuuuguugugaacauaauaccuuuuuagguuuuuuuguuuugguuuguuuuuuuguuugucuguuuguuuguuuuugucuugaaagcaacaccuagugauguagaaugaaauaaaauaaaccacauuuuuucuuggcuuucuuguuuuuguuuuguuugguuugcuucuuuguuuugugaagaaaguuuucucaguguagcccuggcuauccuagaaccugcucuauagaccaggcuggccuggaacucagagaucugccugccucugucuucugagugcugggauuaaaggcuugugcuuuuugccuuuguagggcaugagaaaugcagauuuuucuuaccaaaaugugggguucaagggucacaagcuuucucaucguagaugaacauaugaaggucauugacacuuucugcugcuuggaaaagagauuaaauucaagugguuagcgguggcucaucuuaaauacuagaugcuuauaugccaugauuuuugucauaaguauaaaugaucauggguugaguaacucaguguuuccccaaauuggguucccuucuggauaauauuaugcaaauccuagagguggucuuggaagggaauugggugagaugacuaaaagagaacuucuaguucucccuuugaaucugguugaugaaggcaucuguugccuuuuaaaaagcauccuucuccccaguucauuuccaucaccauguaacacaaggagcagugcaccugcccuguauuggaaaggaaauaagugucaaagugaggacagaauaagaacaauuggcucauuccacgucucugugggacuggaaaauaaucacucuucccacuguguuaaggggaagggcaaggcagccucacuggaagcaaguguuaaauuguggcuuguguauauaucuacuucagcuaucauuccuuuaaaucacccuaaaauaauggcaagcucuuauaugaaauaaguuuuccagaaagccuacuuuuugaguagcagggagaucuacuagggaaaccacauguuguacccgucccccacaguaaaaguggauccauacuacagcacauugucggagcccuagaggauuacauuucuaguaagaugugaugccaagauugcuaugacuuuggggcauuaaagauccugaagcacuucuuaaaaagaguguuuucucugaccuucuuggccaaaguucacaucugguaauugcaucuguugacacuggcuucccuuguccuuucagcugcauacaauauuccugucuugcauccugucuaaacuguugucuugcuaugugcuaugaaacagcaaucauguuguacucagcaggaauacauguggaaagccuuugggaguagcaagcuauagaaagguugauuugacaacauuuuuuuuuguaagccagaaaguagaaauguaugaaucagauucaaauacuauucaggauaacuguuaaugugugcagcagaguaaacaguagucauaugcagguaugucaagguaucaacaaggccuauuagaguuagggaaauaaaaacagaauggguuuuugguuguaauucugaaagguaacuuguaauuucagaacauguaaggaauucuagagucugcugaaagggagacucuuuauguggguuuuugcagcuuccaaacauacaaaugcauuucaauuucccaacccugggagguguaggcauaacuuagcuugauguuauaauguagaaaacuaggaaugaguuuauuuccuggaucugcuuaaggucucacucuagcaagugcaagaaacaaaaggauuuggagccaggucaguugacucccuuggcuucacucuagagcacaaugaaacugcagaguggugccauggcuguuggugguuugaagaaugaaagguggguguuauauuaaacacuaagaugcuggaauucuuggggagucuggaagggccaggcgucucucucuuucuaaaccuuggaaaccuuuuuaaauacacauguucuuaccuugucauauaauugcauuguucucuacauauuuuagguugucuacauuuagcuuugucccagacaccucccgacagcaugugauaacucaaauaagugcucuauuuucacuucugucuucuuagauaaauaauaauaauaauuaauaauuaaaaauucccaaaaccaagucauuuacucaucaaaugaggacuguuucacuacagauacauuguacauuuuuuuuuuaaaaaauuacucuguguguguguguauguguguguguguguguguguguguguguguguguguguguauguuuugugccauggcauaccuauggaggucagaggauaacuugugggagccaggucucuccuucccacacauagguugcagagggaaaacucagguuaucaaauuaaugaaaagaagcuuuaccugcugagccaucucucuggcccagacacauuguuauuaaauauugucuguggaauccaugggguagaauuaggcaagagcaaaaaagcagaaacauacuauuaaaggaaaaaaauaaaacauguaagcauguuuucuugaggacaaggggaaauagcacaaacauuaggaaaugggagugagauggaaaugagauuucauaagaguaguaauagagucuuauuuaaaagugucaacuugagcuucauguagcuaaugugacuccaggcuaaugggauaauuacaggugguugaguguuggagcaggaaagaagacaucacuggcuaaaagagagcuagcuuccuacugaguuggacugcaggggcugguauuuuaauccaggcuugagcucuucacuuaucacguugacuagcauaagcucucccuuuuggcaaagauauuuuaauuacuugauugaaguauaacuuacauuuuauaaauucacccauucuaaguggacaaucuaaagaguuuaacgaaauucuacacaguuaggcaaguauuagcccaguccauuuuguucuagcacccuaacaaguucaccuucuucaaccuauuuuuccaccucagucuuggucagccacuacuuucuguuccuguacauuugcaucuucugagcauuucauauaaaugaacuuauacaagaugugugagggguguguguguguguguguguguguguguguguguguguguguuuggcuucuuucacuuagcacaauguuuugaauauugaccuguauugaaacauguaucugucccuuguuguuguuguuuuuaauuacuaaauaguacucuuugucuagcuauacuacauaucauuuuuucagucaccaauugguggacauuuggauuaguucccaguuuagacuugugugaauaaugcugcuaagaacauucacauacaaaccuuuguguagacagaugguuuugauucuuuuggguagauuccuuaggaauaaaaugacaggggcauaugauaaauaugcacuuaauuucuugagaaacugcucaaguauuuuccaaagugguuguaccaucuuguuuucccaccaccaauguaugaaguucuaguugguccauuugcuuuuugauauuuacucuuaucacucuuugauuagacuuucuagcugcuuuuauuaguaucucucugugguuuuaauucccauauccuugugagugaugauguuaagaaucucuucauagacaguuggccacuuauauguaucuucuuggauggacuguccauucaaauaauucuuauggcuaucuuauaguuugcauaggaaagagaaaugaaaguaugugaaugugccaggacauagcuugcccucccuucugugaagcacccaucagcuuuuggcucucuuuguauuuguuuaggagaaguauuuauuugcuuaugugcuuguuuguuuuuuuauuuugcuuugucuugaacuaaagcacuguaacuacccaucaucuucagggauacugauaaucauuuagguggggcaagacugacuacacugcuugggguaagauauuacaagguguguuuguauguauuaucucaucgaaucuucagagauguuccaugagguauauaugccauugccucuuuuuacacaugaaacuaugauuggauaaugcacacaaagggaaucaagugacaaaauaguacaaccaagucuuuuuguuuuaaauuuggguguuggggauguaaucuaaacauuuucccacugaacuauauaucucagcccccuguauuuagucuugauacuaggucuuuuuaucuucuauucuuuccaguguuguggcaaguggucacacuugaagguacauuuuaaaaugucaugcuuuagaauuucagcaaagcccagaccagcaccuuuaggauauaaaguaggaauguuuuuagggcaagcuuucaggaagcauuuccucccuaaccugauuaaaaugaauuggcccauuuucucuuggcccagaugucugaaucucuguauuauagacaaccugauuguaaucuggaaacaauacagacucagaacaucugcugagagaaggaaauccaauggaugagguggcauauucugaauggagauuauuuuaggaagaaaacaguuuacuuaagccaacaacacaaugugucaauugacaaugugcuaaguuguaggccaaaauauuguuaaaauuaaauguauaaauaaaaauauuaauauauuuaaaauguauuguauucaguugucccuaacguuuuaaagaaauuuuaucugaaggaguaggcaagaaaauaacaguuuugugucauugagaggcacaguuuaaaagauuuuaucauauuaacuucauaaaucauuagaaauguauguuucaauauuuaaugucugugaaacuuccagauuaccuuaaauacucaguccaacagacacacauacacacacacacacuucauuagauuagauguuuugguuaguguuggcaacuauggccuuuauuucuacaauauacaagagaaaugugaggcauuguugccuuucccuaaaacucugcaaacuuuggcgcaguacugaaucacccaaaacaaaacaaugaaauucuaagcaccaacuaaaucaaauaaagaaccaauaagaauugugagacagaagagauaucuggaaacugaucaaccgucccuucaccuggggagcaaucuugcuguccccaaaauaguaaauauuaaguguucacaagcuaaacaaaaacuccuuuauccugaaaauggauuuauaauuacccauuugccccagagccauguauuaaauaucauccauagacuuuuuauuccugugacuuuugaaauuauuccuccagaaagcauaaggaagaaauugcuaaaaauaucauuaaucggaaaaccaccaugaaauggacccucauaccccuuauguuuuacuaaaacaaaacaacaaaaagccuacauacacaaaauauaaagucuuaguguuaaugagggaagggaagaauuuaaacuuuguauacuguugguaggaaaccuucaugaaaaccagucugacaguuguuccucauaauguuaacaaugacauuaugauaugaucuagcaaucaugcuucugguuauuacaucgaaaagaaucaaaagcuagggauauuugcacaucugugcauagaagagcauuauuccccauagcuaagauaagagcaagguuucuccaucagcugauggaugcgcaugauguugagaagauaguggaguauuacucaacuuaaaaagaugguucuuucacauugcuagaacaugggagaaucuugaaggcaucauaguaaguccaucaccaaaugucaacgacuucaucacuccacuggcaucuagaaugguuacauuacaaacacaaaagagaacggugccuuucaggauuuuugagaagaaaauaauggguugucauuacaucuauagaggugagauuacaagaugaagaaguucuugagauuggcuguauaauucugugaacauaauuaacacuacugaaauagacaguuaagacagcuuuggcacuugccuucaagccugacaacggaaguucaaucccuggcacccacguaguggaaguagagaacuaacuucuaagagcuguccucugaacuuuauuacccauguaccauagcaugugccccucccaaacacaaauaaauugaaguguaacauauauuuuuaaaagauaaugaacuuuuuuaucaugugcaauguagcacaaauaacuuuuaaauguguuucguauucugaaauaacaaaacgguacucuaagccaaaugccauucauuuauagaaaacuuuaccauaauguacacuaugccuuuguaagaaggcacauaguauaugacauuuucucaacuuguauggcuguggaucuauguuuccaaugcacuaugcaacuugcccaauguauucaugagugcauuuuacaaaaugguacuguauaaacugcuagugauuuaaggucuuacuccucuaccagacauuuuauuucaaagagauaccugcacuaauuaaugcuuaugcaaaagaaaugugucucuaaagauagaauguuaauccuugcaaaugccuaagguuuagggcauccggccaccuaccaucucucggaucugugcuugccaacagccaaccucuucugccugcuugcaaggucagccuggcauuuugacaaugcugagaguaggccauuagauuuaguagucauaccuaagagagacccaucuucacuauguaugugaucccagagcugcaugacuuccuuaagccaucgaguccuucuaauacagagagccagcauuuccaaggaagaacuuuaaugcugugcagaaaccuguggauagagagaauucagaucaaaaaaaaaaaaaaaaaaaaaaaaaaggaaaacuuacuuggguugaaugucgucguguguaauucaaaaccggaagguugccuguagguuuauauaugcuguaguuguuuuaaaggacaaugacaugguuaaaagccaagaauuuccuccaugagcaggugaaaaaacagcugacauucuccauuguuuuucugagggcuucgaauggcuuuuccagaccuguaacuuguaagcauuuuaguaacauuugauuagcaguuaugccuuacugugucaaaccuaaaauuagaaucugauuuccugacauugucccucccccaaauaaagccuccaauaauucuguauuucuuccaauuggggggugggugggugguaccuuucagugguagcacaggacuucaaucccaacaguggggaggcagaggugcauagaucucugaggcugaggccagcuugaucuacagagugaguucuaggacagccagagcuacccagaaaaacucucucucaacaaacaaacaaacaaacaaacaaaaucaguccaaaauuauuuccccuuuccucuucugagaacucucaacaauacacugucagagcugaaaaaaagacuuaggguucaugugacccagcuuccuuucuggacauuaggaaaaacaaaguccagagagauuuuuuuuaaaaagaggcccaccaagaugcaaaugcugacagagcugagaaaauaugacugcuucucuggggcucauucuggcauacugcgauaccucauuacaauuugauaggcgggagcuggauggauuugugacucuaggucaaauuuguuuauaguuuauuggaccagcaaauaacagggguuuuauuugaaugccagaauaugauuucuccuagguaauacaauuuguaaacugagugugaaauuuaaaaccugaaauaaaucagucucacagcauguaagcauguacaguaaacuguagucuaacauuuuguuuuaugugcaaaccuauaacaauuaggcuacauguauccacugaaauuacuugguaguuuugauuugcaucaguauuacagcagauucugaagagaauuuuuauuaggaauuaucuggcuuuacuaugcaugauauauccuauuuguaagugauauaaauacuguggagcuaaaugaaaaccagaaaauagcuggcuugauaggaaagguugucuagaguauaauggaaauaaaaugcaugaugccugagaauaaagaagucucugcaguugugcuaucuccuggcugauuacuauauugcuaugcaugugguuaaggccacauaucauauacuagcuucaaauccauuagcaaucaacuaguuagggugagagacccgaaccaaacuagagucucauuuccuaguucucuuaggagguucuuggagcguagacuaguuacuuugcacucuacugguuuugauagucaacuuggaaggugccacuaacccaguaaacaacacuacugguuucugaaugcaaacacugacauagguagagugugauuauuuuaggauaguuaagcaguagccuuuauauggagagcuuacaaaaauuaauaacagcaggaaaaagaacaaaucugaucaucauuaaaacacuuauacucuagggcaccaggcacacacaugauacacauaugcauauaugcaggccagacacgucuacacauaaaauuaaucaaucuaaauguuuuagaagacuuuuaugccuguauugauugaucuguguuuuuuauaauguuugguuuuaguaugcuggcuccauagaaaaagaugggaauuuuucuuuuucucccauuuuuauagaaauaauguuauuguccaacaauugguguaauuuuuuuuuacuuaucacuuagggaauuugaauucauguugaaaagcagaaguagacaacugucagugugucauggacauccagagauguuucacccacaccaagacaugucuuccucuuuauuuccuuccaucucuucagggagccacucuucccauaaaguccgguguuaaggccacaguuuaucagagaagagccagaucuaaagcuucaagauuaaccgcuaucaaccaagaaaucuagcauugacuggggucuguuguguucccguguauaucaaauuauuucuuugugauaggcuauguaaggccacugguauaaucaccauucaguaaaugcagaggcgaguacuuggaaacuuuaaccaugaagaagaccuugagugaauuuaaagauaggcuuugguagaguggaggaucugguguaugaccauugcaccccaguuacacaagugcauugacaggcugaauauucaaggagcagcugggacaaacuggauccucuagagagaagacuaaccauguccaguuguaagcauuguuucuuuguuauuuuccagucagcuagccaaaguuauaaaaauguucuaugaauuacaaggauguagugaaacagggacaugagaaaucauggacauguauaacucuuucccauagaguuaggaagggaaauuucacagagccauacaguguuuaggugugguuuucugaaaguaagguaauguuucuaaauauacagguuugacccauauaaaaaugcuaaugccuaaaugcuucaagcgaaggaacaguuuucccaguugaauuaauggaaacgaaauuuuauuccuggcucauaugcuuaggaaaaagaaacagaugucagacugggguagggugaggcaggggcauguaucaggcuggugaaggacuugguuaguaacauucgccuucucuaaacucuugugaaguuucgagaaguuugacauuacuuuuacuaaauuuaguaguugccacuaaucaagggaucuguguaggcaugaauauuucugccuauggauuucuggccauucucucccugguguugggggagggugugcuugucucuguacggucacuucacaugauuaucugagaauguaguuugaacuuguggagucauuacagacaauuuuaccaaugcuuacaguauguaugucacugccucuuuucagaaaccaaaacguuaacuagcaaccaucugagauguuaaaguaaguccuuaaauagaguaaggaaagcaggaaauaaagcauaauuguauucaauuaaauacauauguaaggauucauuauaauuaagacucgcugaaguguuugaaaagacaaauaggagggagaaaaggaaaugguuaguuauuuuggcagauugacuuagccagcucauuaggacuagauaaaaaugaagacuuggaagaauauagaagcuaaugacuuaaguauaaaaaaauuacaaauccucuuuguacaccauguuggauuuguguguugccuuagaaaagacaaacacaaaaaaaguuucuuuuuuauauguauuugucuuuguucuugagaguuuuauaccugcauauaauuaaauacagucauacacauacucgauuucccuucuccaagccccagaucaccucugaauuugaacucaguggucaucaaaaaaaaucugcaucugaccuaguuuuaguccauuacauuuccacacauacuaggcaaaaccuucuggggaacuauauauuucuuaaugacaggcuguguguugccuugcauuugccuacccaugccgggucaccaugucgccagccccuuugcuggugauauugcuguguuuugcaaagaguauagaaaggagaacuuccuuccccucuuaggauauuuaaacucauuuuguagcuuuugagucccuuugccucuuuuucaccaaccuggguugaauuccccauacuaucuccaaggauacagcagacaucuagcauucuucauagaaucuaagucuaaaaagccaguugugugguuggaccaugcuauuucuguugcccauaaugauuugcuguccucaucuguaaaaucaggggguuggaucuggacuguguaaucacccaaauccuuuugaagucaacacuccuuguucauccccuuaguaagguguugcauauaauacugaccacuucuguguguucaaaacaucuaaugaauccuuuuguacacaauaagugucauccucucagaggugacuacacugguuuucacccugcuguaccuaauuaaggacacucaauuuauaucuuuuuuuaaagauuuauuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagcucccaauuuauaucuucaaagauaaaauaguacucucuucaaaugaaaucauuaagugagcacaaugcuuggaauguguuuauguuacccauuauaagguuaaauguuaugggaaaggggaaaagauguuaauugaguaugacugccaguaaucucagaggaugguggggaaacccaugucagaacuggucaagacauucuuccauauugagcucagugaagggaaacaaagaaagguggaaccauaaauacauguuggcuauaauuuguuguauaaguuuuccuuuuccccucccacacuugcauucucuuauuccugccaccaucauccccaaaucacuuugagggauagggaaagaguccagguaagauacccagcuaaguacuuuagucucagaaauaagcaaaaugugcaucccauagccaccagagagugccaacgaaacaaugaauuuaccgucaucuucaccaacauguaccuaaaaaacaguauaagaucgaacucuccccaauaccgaguauacauuggcuggucuuagccacauagugcucuucccagaguuugcaguuaaauucuaguaagccuuuugggaaaaucaaagggccugucucuggaaugaagucacaggcagcuccagcaggagaaaugguugaugugguuuagaauugaauaagaagaagaaaugacaaaagaguuacugucagaaaagggaaagaguauauuuguaauagacuccaauccuauucauacuucagagaaguaaaauuaaucccaagaccaaaauaccccauaugagcgaguucuuagcuuagggacugaaaggugaaugugaagguugguuuaggcaagugauaaauaacauauuuuuguaaagguuaguuuggguaaacauuaagucaaaaauaugucuuaggcuuaaaaucaaccaggcagaaaguauuacugcuuuaaaauccugccuaaauauauauggaauuuacuagacugaaaugguauaaugucugccaauaucaauacauaauaaaugcaaagugacuagauuuugcuaaaagacuguuuaguagaggauuccaacaagauaaugauucauucagugucuuacugguuaagcuuuauuugaaguguauugcucauaauauucuuuuaaaguguucugagcaagggcuauugguaucaucagggguggaguacaugcacagaacccuaguucagcugcuaguucugaaaaggggggggggggaggugccuaaguaguuaccaaaagcagaguucaaauuccuucucuauugaaaaaugccagaaguuccauuucacauuccuucauccccuaguugaccuugccauucaaaccuguuaaaauacagaaagaaaaaaaaaugccauaaggcaguagucaaucauuugguagaugcugaacccaacuaagcaugccagggggcacacugaagaguccagugcuuaaguguucuucugggaccaaaaucuuauaaaaucaugguggugaauucugaagaggcagccauuucagcaucuuuaaugcucuauuuaccgagcaaugcacugucauuucuauuuaaaauaauuauccaagucgcuaaguuagcuuuuacuuaaggaagguugaaagauagaagaacacucuucuugguuucuucucuuucagccuguaaauauguuugaugaaaugugaauauuguaaugcuucuuucugccccuguucucugcuucaagugagagcccacuucccaggacuaaauucccugaccuccaaggaaacuaaaaccccaguauaguuuuucaucaggucccaucucauuugcuuguaccaguugcccugagucauuucuuuuccuucaagaugcuauagugcuaccuucauuauuagaaagacuucagaauugguauuuuucacauggcaugccaaggagaaaaacuaguuuuaacuuuuaaaaaaaaaucuaucaauaaagccugauuuugacuuguucuuacaaagaaggaggaaucuuugauagggaaacuagagacaucuuguuaacucucaguggaccagaggcccuuaggaagaguagugaagcaucauccccccucagucguugagguugacucuucaaacccaaugccugaugacuuggcugcugugguucauacauagaggcuauuuuuagaggcaagaauugucauuucccaaaaguauaaccacaagaugucuauuuagaauggaucacauuuaugcccucagacaguaggaaaugcucuacucaugucuggguacccucaguucccuggggaaauauguaauaucuugguauacucucaccccaggacccuuugccuccugucaauggcccucaucucgauggggcaauuccuucggaaagcaagcaguggcaugaggguucacagaggccuuugaagcugguuuuccuuccagaaaaagauaaaaugauaugucauccuuauagcauuucacagugguuuaaagcugauacagggacaagcaugcuuguaaucuuuagugagagagaugcucugggucaguggccuccagaggaaagcuugacuugcugaccugccuuucuguuauauucccaggcuugcagugggaugagcaucuugguuuaucuuuucuuauaacugcaacucuuuggggucuuuaguuucuaaaacagaggcuuauucaaguaaagcuggagacccuugagggaguuauacagcccaucauuaacagacuggcagacuaaccuaacagaaaaguguuuggcuauggauugcaagaagcucccugguuggcuaugggaaccucaugaaaccauuuagguuaccauauccucuuguguuaguugucucauuuauuuaaggaaaucgauugucuccucuccucuuugguuugacuucacuuugccggagauaaaggauccagaaucuggagauaaauauggcaucugccucugagugucacccaauaaagugaagaguggcccuuagucacucucccuaucuaugcaucugaucuagcuguuuaggcucugcauacaaagccuuucugggaaugagcugcuaggauaccagggcaagcacagcaggaagagauagaggccaggaaacauaaaguugagugcauacaguuuuuauuccauuuguuaacccauuaguuuauccauuacuuuccauucugguccagauccuauguuuauuacaaguuaaggcuagaguaguaagugccucuuuuuggcaccauuccaaacccuaucuaaaucuuacuguaaauagcuuuucauaaaguuuucauuuuuguuuucagagauagaaucucacuaucuauaccaggcuggccucaaacuuuaauucuucugacucagccuccugaaugcugggauuauggguaagcaccaccauguccagccuuuuuacaagcauuuaggcuaaaaacagacauguugccuaauaucucuccccaguccaacauauugcuuuuuuuaaaauaaagcuaaugaugcucugcuguugccucuuaugguucuagagaggauugacugagaagacagauaaggaagugguuuuaauuauuaaaauaaugcuaguaguaaucuaagaauagguaacaguaaaggguuauucuucuguacuuagccuauaccuaaaacaagcauucauucuguucucuauaaauauguaguauuuaauauauaacuguaauguguuauugugugaacugugccacauacuaagcucagugcucuauucaauuuccauaguuacacagcgugagagacaaguagggguauuaccaugccuaucucagagauaagaaacauaaagcuuagagaagucaaaugauuuguuuacaguccuaaggcugcuagacaauauguccagauuuggagccaaguuuucugacuccagaguauaagccuuuagccccuuaugguauaucucugcucuaagaaagacuaaagggcuguacaguuuuaagauaccaacugaaaacccuuaaucuggucauuugaaacccaaaugcuccgaaauccaaaaccauuugagugccaaccugaagccaugaguacaaaacucuauagcaugauagauuguuuaaugcacaaaaguaguaaaaacucuguucgagcuguguauacaagguaaauaugagagagaaauggauuuuauauuuaaacuuggguccuauccuuaggacaccucuucauguauuugaacacaucccaaagccccuuaucccaaacauuucaguuaagguaaacucaaccuguauugguaacauuacuggaaauuuucuaagauaguaaauggcuuccucaaacuauggagagcugucaucucaaaugguuugaauuccauagauuccauccucggugcuucuuucacauuccaguuugccuuacuauccagacauggguucaguggagagccuugucuucauacacuucaguguuucuuacccauggaagcuacaaguggcgaggggagagagagaauagaugugaagucugagagauggguguggaagagaguuucaccaagaggcaccuauggaagcacagcgucuggcaagcagucccccuacugcucccucaacuaaacauccuuggcgcacagaccuuuccuugccuuacugggaacauucaaauggguuuucucacacuugaaaagaucugagccggaugauuuucugggaccucguuguguggccaaagcacuuuccuugaccuugcugaugaggccuauucaacaagcccuucaccucuguugguguggugggggcugauggcccuucucccccgcuuuuucuucuucuuugagaucauuaucauuauccugaacagcauaguucacaugucagagaacuuagccaccuugucaggaaauacauuaagcacaauguauguauuuuuucuaugugcauucauccaccuaaugaacauuuauugaauaauaccuuuacuuugugacaaaugccaugccagccacagguaaucaaggcagacugcgucacuucuuuagucuauuacaaaugcaacagggaaauguauaauugcaaauugcagaaaauucugugagaggaacauccacaggaaucuaaaauguaaauucuggaacuuuuuuuuuuauagacuuaauaguacuagcccccauuuuuacagguaagaaagcugaagcucagcaagagugacuuauacagcaucacacagguagugaacuggcuggguagagauuuaaauccaugcuggucauauuccaaagcucacacucuuaacugcuaugcagcaugaccugcucgcuguguaaaguacauauauagccauuaauucuagccuugugcauuugagguucuggcuucaucucaaaagugcagaguuuccaauuguuuccaauuacuuguggcugugguuuggugcauuuguucaaagaaagugugcaugcaaagcgggggucacaugcaaggccucguggauguacacaauguguaaaucguauuggcauuccaaaaaguccaagauucauuggaguuaccacauuuguuucucauuagauuaugcuacucaaagacaaacaguaaagcauguguuuacauuacuguggacauggagagccaugcccccaaaacauuccuugcagguuguauaaagcuaagcacccaaacaauuccaaaucaguuuuugugagcccagcuuaauagcuuuaaaauguaaccuggauuccccaccccuccccccaaaaauugccuagaagacaugugagcagccaaagagacaucagcucaauacccaaacuauguaucaaaccccguauuuccaguaucuauuuuguuaguuauucuuuauuauuuuguaaauguuaaggugauuagagucaagaaaacucuuagcuguauagcaacaggaauggcauuauugauuccauccuaacuggcuguccaaagccuaucaaaacaaacccauucaugaugagaugguuugguuauguaagacacaguagaugcaaagcaagacaggggcauccaguguuauuaagagcauagcguuguugccccuucuugguuuuguuuuguuuuguuuuguuuuacuuuugaaacaggggucucacuaugaagccucugcuacucuggaacucccuaagcagaccaugcaagccucuaacucacagagauccaguuacccaccucucucugcuagggugcuggaauuaaggcgugcaccaccacaccuacuuuuauugcccugucuuuacuuuccuacccaauaguaaaagucuuucccaucaaguuguaguuaacaccuagccuccaagagaacgucauagaguaggaaguuaccagaaaucaaggcaaccgaauuaaaaaaggguaacugaaagucucaguuauagaugucuuuaccuaacuaguacguuucuuagagcacuugggacuuaaggacuuaaugauuuuuuuuuuuuacuaagaucuuuaucaaucacccaguaaggucuuauauacucucugaggcucagaguguucccuugaugaagaaacugggaauggcagacuucccugccgcaaaaauucgagggcugcauuccaaaggacuuugugaguaugugagaggacaugugcucagucccagcucagugugaggcugauaagacucuugcccuuacaaucaggacaguaacaagaggcgcauugucuguaccauguagacagaucaagagggguuucucccaugggccucauugcagcauauuugaucccuguaagaacaagaaguauauuauucagaucuuuguucucuugucaaccaagcaugaaaagaacguugaccaaauuguguugucccauguuguagugccccuuuguggauauguauuuaagaauaugaaauugauauauucuagaaagccugguuuuuuuuuccugcacccugauucuaauuuucuuacauaauuaugucaggguuuuguuuccuuuuauugcaugaaccugaguacccguuucuaugcuuacuuuucaguguuugccuuucugaucaaaugaagucaaucaccuuuauagaagaggcuuuucauucuccuuacaaggggauuuuuauuaacuaugauggcaaaaggucaugauggccauaccucaggaaaaagaaaaaugucauugucuucuacucucuucacaaacugguuugaagaguaauaacaaggauuccagcaagcauaauaauaauaaucacauacaucuggcuagcaccauucaaguccaaagccagcuccagagaguuucuaagaagcaggguaauagugugaaaccuuuauuagagugugacauaaaccuuaaaucucaguuacuuaggaagcugaggcaggagaauaucuuugaacucuuaagugugagaccagccugagaacauucuagaaccugacccccccccaaaaaaaacacaaacaaauaacaaaaguaccucaucugggguuuagucacauuaagacucuggaagacagguguauuuagaaaugcagauguguuuugucuuugagauguuaugaauccagcuuaggaccucauaccuaccaaacucucuggaacuuaccacugagcuacauccccagccuagggagccucauuuccaacaagcaucuuagauaacuuuuauacaaguuuuauucucauuuccaugguugucuauggauucggaguacacucucuuuaaucuagcaauccuacuaaaggaaaugauaaaaaaugugaggugauaugaaaacacuugaugagaauaacuaugugugggaagucagacauaacuauaaugcaaacauuggaugcugaaaagugguuaaggaaauuuugauaaauuccuuuauugcuguauguuuuuaccacaguucaaauacuauaguuuucuuauucauuauaagacuucuaugaggcaaacacuauuucucacauuuuauuuuagagagauuaagcagcuucucugaaaauaaauguguaauugcucgggaaacuaggauuacaaccuaaguaugcaugauuagaaaauucaagauuuacuauauaaaagucaucaauuuaaagccuuauuuuaaaaaaaaacauaaacaaaauagagucuuuccuuuuacuuuuccauauauauauauauauauauauauauauauauauauguuguauuaaucagcuuucuguuguuaugacaaagucccugagauaguuaacaaauaaagacaaaggguuuuuuuuucccuacucaugguuucacagguuccagaccauggucuguugcuuuugugccguggagaagcagaacaacauggcaaugaguacauugaagaggggcugccucccccacuucauggaagccaagaaggagguuaagcgcaagcuuagaacccaaugucuucuuuaaaggcacaagcccagugacuuaacuucuuuccacuagaugccaccuccuuccuuauacuuuuguccucucccaauaaggccguuuuuucuggagacuaaaccuuuacuauaugaacauggggugggggaguauuuaagauucaaacucugccaauagugugauacaugacaguguguuaugagaucaagaacaaccugaccuauguaguaagauucuaucuuagaagacaaagugaaaaagauagaugaagaacauaacaugguacuuuacacauuacaaaaaaaaaaguucuaaaauaaaaucaagacuuagauaugguggcauauuccuauagucucagcacuccagagaucgggguaggagaauuccaaauuugaggccaaaucugggauacauagcaagaccuuaugucaaauccaauguauaaauauguauugacaauaugcuuagccaacuguaaccaugguucagacagcugagcagaggguagcagcuauagaaaaugcuggguuaugaauggucuuucccacucugcauaugugaauccaugugugacaggcagaugcuucagguuuagagcccggcuguguggacaguggaugaaacagucagauuuguguuuuaauauuugacauugcuaaucacuauucugagccacaggcuuauuuuuuaaagcugacaggauaguauccuuugcaaaugacaaacaguucaucaacaacacuaagcccuuuguguuaccugugcuuguguaccggucucuccuaaucuucuuuuuuauaaaguaaauacuaagucugagagauauuguaaauagugagagaacaaaagagcuauagugugaaauggaauuagccugauuggauuucugagggaaagucaaugcugcacuaaauccauauccauuuauuggcaauucuuccucagacccauugucuuucuuucaacccucuucuucauucucuuccaaagcaauaguuuuccugguuugaauuuguuuuguuagugugugaggacgagacuccucaggagcuguccaugugaaauuacuaggaaaccugucacaaucaccuuuccaugcuggguuucucuccaaaaugaacauaauugaagaccuaaagugcuagcuaccuccuuggcaaaauuuuacagccuguuuugcaaggcucaccuuaguuuagcagggcuauccaauaacacuggagacauuuaugaagggucagaaauggccucucgaaauaagcuacugaucuuaaccagggucauccaaaagaguuucagcagggcuggagagauggcucauuugguaagaacacuugcuacucuuucagagggucuagauccaguucucaacaccaacacaaugucucacaaccacaauagcuccaauuuuaggauaucaggagccaucuacuggccucugcaggcaccaagcaugcacgugcugcacauagacacaugcaucuacaaaaaauaaaaauaguuuuuuaaaaggggguuuugcuacucauuucuaaguucuucuacaauuaauccuggcuuugaguuuucuuuuuccuuuucucucugguuauggaaguaacuuuaaaggucuaccaugccacuucauuuuguuucuucuguuccagagcacauguauugaguaucaaguauaugccaaauaguuccuuaaaugcugugggguucaaaaacacauaagaugaaaacccuagcagcuccagucuaguaguggagaagaucauaaguauacauaaguaaugccagauuacaucuagaaagugccauuuaggggguagagauaaaagaaacacucaugggagauggaggagaauuguaaugccaagaaggcuuuauuaaggccaugacacuuggacuuggcuugaaaaccuggaagccuuucaauagacaaaaaugaacaacagcccauaguauguucuuaguuaaugcuuacugaagguauuaauaaaaagcucaaaugugagaugugcuuagaaaauagcaaguucacuaauagauaccuaaccacaaaaucuccucauguaaaaaauucuaaugcaaacaguccguguuauacacaaaggaugcauucuugaaaauuaacacgaaaugcuuaugucaaaagcaauuuucccauaugaaauaaugguuaaggauagauuugaaguuuuaguuaaacuauagugaugcuuguuauagcagggacucaccauucucagagaauggucuguggacucuagaagucccugaaauccagagagccacaagaucgaaacuacuuucacaacaauacuaaaaauuuauuuguuguuuuuacuguguugauaucuaccaaaggacugacuagggaaaguguuggcaccacuguguaaauaaaagcagugacacuaaaaugcaguugucacaaacucaucauuccauauguuggcaggaaaguggcagucaccuaagaguacuguugcugaagcuguggaaauuacugaauuuauuaaacgucaacccuuaaaugcaauuucuuauuaguuugagcuaugaacugaaaguacacaaaguaugugugccucagcuauaugucagugugcaucucaaggaaacacucuugggagauuagugaugugaccuacauuuagcccccuuuuaucauuuguguuuuugaauuccauaguaguuuggguuaggaagcgggaggaaguacacauagugugcuuccauuguacaccaauguacauuucaaggaacucuacuuauauaucauugucuugacaaggaacaaagagaggcugucagcaugaggaaaauaacuacacauacuuauugcuaaugauaaaacucuagcuuuuacgagaagacuaagggucagcaagagcuggccacacuguauccauagucccaaagcacaauaggagaucgcagcuugcucucuccuuguuauccagccugggacuccaaccauucgaugguggcaucugcaguuaggguagaucuuucuaccucuacuagccuaaucuaaaaaauccuucccaggcaugcccagggacuucccuccaugcucauucuaaaucuugucaaguugaugaucaagauaaaucaucaccaacuugcacuugaaaaacaaaggguggcaccucgaggaccaaaaaugggugacaagacagcaauuggagcaggaauugaggcuaauagcauaaagccuuagagagagauaacaaggaaaauaaaaugaaccuucauucauugccaguaugggucuguuaguggagagacauugggaugauaggagucccacaaaacaaagccacaugacuaaaaagcuaugccccaaagaucgaaagaagcaugucccuuaauaaguauauuagcuaugauaaagcagaaugauuuaaaaagcaccuuacuuacugaaaacuugcagaagaaagaucuguuuacauuuuuuucaauuggucaaaauaugggauaugacaauuguaaguaauccuuuaaauugagugcuguuccuuuaagagacuguuaugucuuuauuccauuagaaacagguguugaagguaaauuccauucuaguacacuuucauagggaauuuuuuccugaucuugguaaccuaauagacuauacauauacuucaccugucaaggaacuuagauacaauguuacagaaauguaaaaugugguguauccccugacuucagugugguuuaaguagacuggaagcauaaagaauccugucaaaugcuguaaaauuguccagaaguaugaagcucuaaaguauauaagcaacucacacauaguuaaauuugaagaugauuuuuuuaauggagucuugcuauguuacacaaacugguguugaacucuggaccuaagcaaucuuccugcuucaaccucuuucauagcuagagcuccuaguguacguuacuaugucuggccuguugaaaggaguuguuuaaaguuguacacuucaugguaacacauucuucgaacccuaccaggaaaaaaaaaacaaggagaguuucuauagaccuauucuucucuuccagcuccugagaaccaugucugugcccaaggguaaaguucuggauaaaagccuggaugaagaaggacuugaaaguggagacugcggugaugaugaagaugaaugcauuggaagcucuggugacgggauggugaaagugaagaaucaacugcgcuuccuugcagguaacuggcugaaaagguugcucaauugcuuucuagacuacugcuaaaaucucugcaguacacaaugccauaaacucucauaggaaaguugauccucuuaaaaggugaagcuuucagguagguuuucuaccccaaacccucaucucuaacccuggguagaccagaaaggcauugucccauuuuuccuugucuaaaagcaaauuggcugaucaguugguucugucuucccacugaagcuguccuugggccuucuugguuauacaaagaaaugcugccuugggaaucuugugcaaaccuacaaugaaucuuggcguuguagugggguauaucuccuguguaagguauuagguuuaaucccccacaccacaaaaaaaggaagcagaccaacaaugaaauaacuuuaaagaaagaacuaugggcugaccuuuccuucuucaaacaacaugucuauuuucuuuucucaaagcagucugguauaguuacaacauaucacuauauugcuacuuaaacacaauaacaauagaaaaaagaaauggcagggaugcuggagucaaucgggaaaugcaaaaccaaaaccaauaacaaaccuacucguauuuguugugucuccgaguuucuaaguccuuccauguugacaugcauucuuccauuauaaauccuuccuaauaaagcugggcucagagaaguaaugagauuucucuacaugcgaaauggacuuucacuaccaagccuuuuccuccucagcacauugcuucugccugugucccaggccauccauuucucucguagccucauucccuuaacuaacugcuaucuaaccugaucuggcccuaaaagaugguugccagccagaggucucauuuuuagccucuucuucccucuucuuuagagagaacacacacaucauauccacucucccucuuuaaaugcuuucuuggaaucaauucuauuucaaugaaaucuugcuucuuaagaaaauuuuaugugcacuguaggcaucauuaauuagguccaauuuggccaagagcagauguccagcauuuuccaucuugcauguccaaagcacucugcccauugaacagcaccuccucauuuuccccagacacuccccagcccuggaaaacaguauuuuccuuuguggcuucugaguuucacugcuucagaacucauauaaaguagaauuguacacugaauacccuucucugauucucuuaauauaauguccucaagcuucucucguguggaggguaugguggcaugauucccucuuccuccauuucuuggauuguauuuuguuuuuugagucaacauccuagaauaaccucaaacuuaagacguagcugagauuggccuugaacugcugauccuccugccuccaacaccccuaguacaggcaugcaccacuguacguacacacacauacacacucacacacacacacacacacucacacacacucucacacacacacguacagacaaacacacaccuuguacuuuuuaauccauuuuccuucuguacagauuuagguuaguucaucuuuuuguuguuauuguuugcuacuguagagaugacauaaaaucauuacuaucaguaucaacuguucucccaagcuaccaggccacaccuccauugggucacuaauguuuuauaucugacuuucucaccauuaucucugguuugaugugucagaaaucaaacuuaugaaaugauuaucucuaacugguucuccuuuaauaagcucucuuucugaaugccuccacacuucucuuggucauugagacuuaaccuaaagucaucuuugguucuuuuuuucuuccuugucccucauaugcaguugcucacugaauccauguugauucuuugucacuuuuucuguuucuaucacugcuuccugucauucccuccucccagccuccugcauguugcaaucaaauccaguguucuccaggauuccaggguaaggcaggaggauggugagccuuaggugaaccaauuagcaagcaaagaauuacagacccagccagaggauuccaacaaucugucaugcgcagaugacauguuaaucuuucugaagcaucuucuccucucccuagcucagcugccuucguccuguccccauugcuuugaagauaaagcucugauccuccacagaauucuaagagacuuguagucuagcccuaacuaaccuucuggccauauuuccuaccauuagccauauauacacucuuuacuucagcuuuaaaagcuguauuugugcccccaugaaccccauaaacaugcugugcugguuucuaucuucauaccauugcccauguuuaugucuauaaagauaagccucuuuucuuccuucuuaaaucauaccugaccccccacagugcauuucauauaugcuucagggacaagaaaguuaguuuuugcuauagagugagcauauauuugacuucuucuuccauguuagugugacuuaggaaaaauuucccuaaguuuuaucauuuccuuucuaauacuccaacucuucacucaccaaaugaggcucauacccuaacuccauggcucuauugcaggaacaugucaagggaacaguugacagcaugggccgcuaggugcucugugauuguuagcuuccguccuaaacucuuuugacaccgauggauauauggaaaacaauucucugaaauauugaaagaagcucugccaaugcuuucaaaauauacucuacagugaguucccaguucuacggggggcagauucaggacugauagucaggcagucugauuucagagacuaccacucuacucaaaugguuucuuugcuccucaggguaaccaugaaaauaugaaaauggguuuuguauuauacuagaaauuaaacauacuuugaaggccccaaaugcaaaacacuauaaaauucaaaccuucugagagccaccacgaugcucaagcuguuucaaauauuuagaaacgaucaaccaguaaagaucacauaaacauuguauaaucugaaaaauaaucaucaaaaccugaagcacuuuugguccuaggcccccaaccuguguuuagcaacucuugugaccauauacacuauaaagauuuuccagacaacucaccaaaauguuaacuaguuccaacauugguccucagcucacaacacugcucauuucaacucaggauuuccugccuguaagccuugucucgauccauuuuuuaaaauguucuauaguuccaaggcgaccuaccuuuuguaggcaguacuuggggaggggccuugugaaggacuuugucaaauguacuuagauugaauccuugguuucccauuuuuuauaugcacauugauccucucaaaggacucuagucaguuuguaaggcaugguuaacuuaagggcuuuguaaacuauaauacacuaugcagaagguaguuaauuuaauucacagggaaaaugaugcccugccucuuaaaguacuacaugugccuacccugaucagugauucuaccagccugugguuccuugggucuccuuuaaaacaauucuuguggagaagaaacucacugccaaucugucacgcucaaggcacaauagcuauuuggaacaacaggcuauauacacauugguuagcuguuauauaauuucaccgaaaaucuggguggaugccaugugguccuggugauucaucuucauccauuuauuuagucaacuugauuuggaacaugaugugcauuuaccauuucauuuaguacugcaaauugccuccuccagaaagcaacuugggaauaaagagcauggcuuagagucuguucaguucucuuguaucuuccuuuugucccugaacagacuuuuuacauacaucacaaccagugagugauccuauuggcugaauuuccuggcucacuucuuccuuucuuuugauauacugcauguaauacaguucuauucuugggcuuuguuucuaacuccccuguguccuaaugaaagucccuuucacuauuuaggagacaauuucuccaucuguaacauaaaggcaaugccuaaacaauucuuacagacuugucuacugccaacagucugugaucauuucuuuggcuguggcuccugccaagacacuuacaagagucuuugggggauaccuuuuuaugcauuuccaccaaacuagcagguucucuguucucgucugugauauauugccccuauucuaaccacucugacauuuccaaucaggaaacugagccuucuuacaaagaacugccugcaccuagucaucagcacauucguauaacaggauauuaccuagaagaguuuauauguguccaagcuuucugggauauauucacuuuuaaaauucauccgaaauuuuguuaaaugcuucuuuuuuuaauguuccugccuccauccuuuccuucuuucauuccauuuguuucuuuuuguguugugauuuuauuuuguucuuggaugggcgugauauugauguuucgaugauguauuugguuugggggggugguugauaacaaaguuuuacagcauaccccaggguggccuugaacaggccccaaauucuccugcugcagcugggauuguagacauggaccaccaagcccaaugugcagcacgucuuauuucugcauuaaaaauagcaauuuuggggguuucuacucuuuucugacuguugccuuaauuuuuuuuuuuuuuuuuuuuuuuuuuuuuuuuuuuuuuuuuuuuuuuuuuuuuuuuggugauggcuguaaagcaauaucucacccacaguuacacaguuaucuuuacccauggcuugccaacaguauugugcuuuccucuugaugagugucuuagcccauuuaugcugcuguuaacaaauacuuuaaacugggugauuuauaaagaacagcaauuaauuucucacaguccuggcagcuaggaagucuaacaucaaagcaucaucaucugccagaguccuugaugcauucuuagauggcggaagaugcaaaugcugauuccuuauuugguagaagagauggaaaggcaaaaaugagcaaguuuuguauucucccugcaguaagggacuaaucugcugcauggaagcagagcucacacaucguuaucaccugccaacaucccacuaccacaauacuguugcauggggaacugaguuucagggugaauuuuggggugugcaugagcuuucaaaucacaucacucauguacuucuucucuccccuccugcuuccacaucugagaauugggauagcauuaggucuuauuauagagcuuuguggauauuucaaaaaagauacauguaaagcauagagcucaguccccaguacuccaacacucaaacccagauaccugcuaugaagagugcuguccuuuuguuucucuggaugcugauaugaucucaacgagcuuauggauauaaaccagcacugucuuagaaacccacuagaguaauaaauucaucgcaucuaucacuucagagguagagacaugaucagaaauucaagguuauuuucuacuacacaggcuacacagcaaguuugagaccagccugggccacaugaaaacuugucugaaaauaaagaacugguuuuuuuguuugucuguuuauucaaaacacaugacagaccauuuaaaucaagcaacuagccugcagcuauauauacugaccucuuccuauucaacuugacuucaaagcuuuaaccaguauuaaaaccaaugcaguacuuuguauccacagauauuucuucucaaaaaugcuugaucuguagaacuuccagucucucggauaugcauguggggacugcaaaugaaaccuguucuuuguucauuagauagacaaguuugaagaugaaaccuaggcccaugcaggucccuuuuaccauucuucucuguugggguuagguugugagcuaaucuuguuagcucaccuccuccuaguagucuuguagaaaugacuaugggguuucucaacaauagaaccaguaguuccuuaucaaauauucuuucucugcgguuaguuuauauuugaaagguaaaaugacaacuucaaauaaauauugauuaggaacuauuuuaaagccacuuacuuuuauuuuuacuucuauuuuuuucuugagauaaaauuucaugugccucugguuggucuucaacuuaguauguagccuagaaucagaaucgccuuaaauuucugauuuuuuaaaaagauuuauuuauuacuauaucuaaguacacuguagcuguuuucagaugcaccagaagauggcgucagaucgcauuauggguaguugugagccaucaugugguugcuggaauuugaacucaggaucuucagaagagcaggcagugcucuuaaccuaagucaucucuccagccccaaauuucugauuuuuuuaaaaaucuacuucccaaaugauaagaggacagauauguaugugucaucacacucggccucuuuuccgugcuuuuuuuaauaaucaaguacaaccaacaagcuuguggcauaauaaagggauggacauuucaaugauguauucuucuaaacugucaagucaaauccucacaaaugugagcugguaagcacuguguauuaagaaauucauugauggguuggacuugugaaagggauaaagccagcgaaggaacuuuaugauaggccuuuuaucccaggugacaucugcagacagagagcuuuuggaggaaugaacggcccgggcuguuguuuuaaugggugacauguugaguccagugcugagcucaaaauacauuagaagcaauaccauaucuaucuaccuugaccaguuggcaacaaguucagucauaaacuacaguaguuucccaaaauggauucugcaguuugagcaaguuuuaccuucucugugcucuuugggaacauaccauacagagcuuugacacuuaaguugcagguugcaucuugcuaaauaaucuauguuucgaacucucaggcaagaucuuauauuucuuaguauaucagucccuugaauacauggcuucaaugcaaaaggagccaaucuaucuucuaggaaguggauccuaucuaaugagaaccgggacagucucaauacauagggcauugaagucucacauuaaaaacaucauguaguccagugucagggaagcuagaccugcuauaaaugcgguaacuuuuagaaaacaucccuuagcuccacaaaacuucaguuucugcauuugugaacguguugauagcaugccuaccaauguucauuaguugcugaaccacaggugaugguggauagaaacauauuuauaaaauuauagagcagaguucucauuuuaacuaaucugacuaucauuuaguacuaucugguucuaaauaauuuuuuauuugcaaaagccuucaacuaaaauggaaaagguccaaauguucuguccaguaauguucauuauacguguauucucuucgccauuccuaaaaagggggcauucgauuacucuuuaauuuguuuuuaacccagaguggucuauaguaagaaaguauuugaacaaugacaacuaugucuguugaguugugcaaauaaccacagaaucgaaacaguaguagguaccuacaucuugaaagacucacagcuagcuaugguuuguuuucuuuggugggaguauggcaguaagggcggggggggggggguggacagcuuguuggggagggucaagaaagagcccuugaugcuuuccauuauaccuuggccuuagcuacaaacagccugcuuucaugucuaggucuuugcuuuuauguaguuaauaccuuggggaagccaaaggaagcaaagcucacuauaauaacgcucuucccacauacagaucaggugcuucuugcuaauagauugacaagacagccaaucucaacucucccuaagagcuuuguucagcuucuacagcucacgaggaaagacuuagaugugagcuuuagcggugauauuaccugaaaauugagacauaugccaagaaaggagccuuccaaaugucuuaguguugacuagggaguuaccaaaaguaagcuggugauaaaugagaagaagaaaaguagaaaucuuuuuauaaagucaccacaguucagcauguuuucaggaguuuguuauuuggcuaagauuauucugacguuugauuuuuccaagucucuaccuucugaaacugcaccauaggaccuuuaggguaugaugccuuuauauccagagaaauugugaggguuuuguuuguuuguuauuugugguuucaguuugguugguugguugguugguugguuguugguugguuggaugguugguuuggcuuuuugagacaggcuuucucuguguguccgcccuggcuguccuggaacucuuuagaccaggcuggccuugaacucagagaucuacuuagcucugccuccugaaugcugggauuaaagaugugugccacccaagcccagcaucaaggauaauuacugauaauauuaugguuaauaugaacaacuuaagauuauuacguuugcaagcacgauucaacuaaaauauuaauuaagaauuuggcuaccuggguuauaauugcuuuccucuguguguguguguguguguguguguguguguguguguagagggggaacaaugcugaccaauucagugacagccucaaguaaacuuuguaagaauagauagaaaggaaugggagagcuagggacagugcucagcuuguagaugaauagaagaaggaccagucagaaaguggcaaugucagagcuuccagcugugcuggcacacagaagagaagacauuccuguggacuaauauccuugaggggucugggacaaugaguuguagugccauuaaaugggauggucucaccugcucaaaaauacaucagaaagaaaaacguggauuucuaccuaaaucaauguugcuguuggaaauuucccugaaaaaaaaaaugauagugaucuggcaagaugaucuuugaguuuuucucaauuuacguuuuuuucuaauuuuauagauuuuuuguuuaguuuguuguugucguggacauuguuguuuguuuugagacacgguuauauacuguagccuauacucacuucaaacccaugacaguccuccgugccucagccucuccaagggcugggcuuacaaaugugaaccaccauguucaguuguuuuuaaacucauagugcugauaauuuccaaauauacugaguuuuaucuuugauuuaaaaaaaaauccuaauguacguggcugauuuuaagccuuuaagguaagaacgggagugcuagcauagacucucuucauuuguaacuuguggguggacuuaagcagugauauaauuaccaaguacauaaaaacagaguggagguugcccuacaaaugcgaauaucugcaggcagccugugugugagagcagggggaaaucucauuagcaccuucaggaugguuuucugaguaaagugauuuguccaaguacccaugagcuccugggagaauuucaagcauguuuuuuucauccuauaucuacacuuuuuauccugaaggugcuaaugagauuucuuccugcucgcagacuaucccagacaccagaauuuggaggaaagccucuacuacacuuuuauuugcuuaguaauuauauugcucaugaagucuaucaaugagcuacaaauuaggaaagucuguuuaugcuggguccuuccccccauuuuuacccuaaggacucagcugucagucgccaagcucaccacccccacccaccacauacacacacauacgagcuuaguagaugucauuuaagaaacauuucaggacuggggcagaaagcucacugguagaaugcuuaccuacuaugugggaagcccuggguuuuauccccaguaucacaaaguaaacagauauuuuaauuauccaugugcagugcugguaugauuuuuuuaacaguacugaggacuucaugcuugccaaguaagcaccuugccacugagccacauuccgaacccuguguguaauauuugcuuacuuucuccccauauuuggcaggguagcaaagugcccccacucugacugacuuaugaacugacuccuccuuccaaggccccucuagggucccacagcuggaccuaugaggacuggaauaagagauuccuguccuaguccucaaaggugacucagucaagcaggcaagucaggcaggacaggcacucaaugagcaucuguaagcaaagagcaucaagaggaggggaggaaguacaaggaagaauuugagaggugacaaugguaagacagugcaauuaagugucaguguucggucuacaugagaugaggauuuggaagaugugcgcaugucuaugguuuagcggucugauacaugggagauaagaguagaaccagaagcaaagcugaugggaggaugggcuuuccuacccuuucggcaauuccucaguggaaugaaugacuugcauuaggaaauagucagcuccugacuguaggggagugugggcaguguucauuaaacaaaauauauuugaaagauucgucuaaugggcauaaagugaguguggacuaauaccucagucaucuccauuuccaagacauugaaaagcucugacguggcaugguuggacguaaguagagcaaaagaaaaugaugguagaacaaaauagcuuuucaaccuagaagaaugaaagaagaauggagaacagaaucucugguuauuuguauuugagcacauguccccaauuacaauuuucuauaacuauuuuuucuaagcaaauggcuccuuaagaguggcacagauuuuaccagagaauucuuucagcauccucugucacucacagccuguggaguugucuuucuucuaugagacaauagaucuuauuuuucuuccugauuauuuauacucuuguggccuuccugccguuguguuagaagacggacuuggaauagagcccccuccgccccagccucaagcaauuagccuaaauggcuaaauuaucaagaucuagguuaucugguucacgcucauuuccuacgcugcccucuccaaucugcuuuuuguucagagaauaaaguaguauaucuugaguaaucuaugauccagaacucccucuaccaaagcaaucauggacccauacuuuuguagaauauaauaaagauacauuacuagaaaaaggaaauaacaaagaggcccgccaaagauaaaaaccacgauuuuuaauuaagagauucaacagaccagaguaucugucgagaugcuauaaaaguuuaagugcugacuuucaguuucuguuaucuucuuacagaucagcaauaaagagcagaguagcagaguucacuuugagcaggaaaaaguagcucguccuguguguaugucugcuuggcaucccuucuuaccuuggugggaucuacucaaaagcacucugaauaggaggagggcagugguuuuacuugaguuguguggcauguaucauaaaagccaguuguuagauuuucagaauuucugugagccacuuagauguauccauuauuaauagaguaaacauuauaaaucugugauaaaauaaauucuauucaaagaaggaugauucuccaaagucauccuaugcuaauuacacugucccguugucuaacuguguccguuguaucugggaggcagaaauacuguauacuuuucccagucagcaucaagcgccagcacauuuguagcugugauggcaguaguuacuccuuuagaagucagcaaacgcaguaagucggggcuugaguuauuguuguauugauugccuagaauugagacucaaggaagugacugggagaaugugaguaguguaaccugcacuucuaauugugcucuauguguagccaccacaucuugaauagcacgcuguuugagggaauauucucugaaaauuugaaaacuauuaucuaacaguaaauaucucacucuggucacugauguagugaagucucaccggauacuguguuucuucacuucugagagcuuccuuaauguaagccaguauagcaacucauauucuuguagaaacuguauuuguuaaucaguugcaauguaguuuaguuauagaggcaaacuucuggcaaaggaaaggucaaugaaagcauucuguaaaaaccauucccaauaugaaauuuauuauaaauaguaucaucuauuuuaucuauaaaucauuugcugcacauccuuuauuccaauaaaacuuaaaauaaaaggacauacauauuucuuguucugagagccaguuguuaaauauuuacuggcauaccacuggagugaggaggugcauuggaaagauuuauuuucucugcuucauccuucuuucauccuucagggcucuuagcuuaaagcaguagcucuuuccaccauggagagaaguuccugucuuucaaaauuaugcuaacaaaugaaagagcuucucauuuuuagucacuuugacuucuaggaauccuaggcuuggagacuuucuuagcucugagacuacuaaccagauccauaaacuugcucuuucccaaagcucuuuuuuccuuauugaguuugacaggcuccuucugaagucucccuuagccaauagaaaucucaucaguuccauccucaaucuggccgagagucuugauaggucagcucacagaggcaucgaggcaaggaccacuuggaggguuucgccucucuaucagaacaaaugaauccugugugcugcuauuagcucugguuucacagagacuggaacuccuaauaucagauuacacuuuguuggcuugcugaucauuuuuuuuuaaaaaaccaucaaccauauggguagagguuggaaagaaagcuaaauuuggaacacacccccacucuucuguucagcauuucuuucuuguuugugcagggaggcaaugcauugcucauacucauguaccccaccaauacucacacucauguaccccaccagcuaauaaaacuaagaaaugggauucucccucccucaauguggucaaauaacuggcuguuuucuacauaugcaagcagcugcacguuuaaaauggccaggcucuguuccugcccauuucugaaucugccugagagacacacacugaaagacuaaauccauagugaaaagaagcccagggauuuugugacgguuaguucauaaguucaggaucauucguagucuacaucugagacacugccuucugagucagagauuuuuagacuggagagccaugacuuucucucucuaucccuuccuuucuggucugucuuuacuucucccccacaugucacuucaucuggaaugacagcuggagcaagaaagacaaacugggaagauggacaaugaugaugauuugggcaguggcuauggagucaugcagauuguauucuagcccuuucuaagucuaauuacagaaaccauaauuuagcuccagauugcuaaaagggaguuuggaaucagguuuaguuaaggaguaaaaguugguaugccuucccucaagaagaggcuaaaaccuucucaguauccagcuaagagucuaaaagauguccuccuugcuaucccuagauuccagggaggaaugaaugacagugaagcuaaacacuuuaaccuacccuuccuuaucuggcuccaaccaucucuagccccagcucccauuaaccccuaccccauccuauaguccagcuauucacaaaaaacccuaccccgcccuauaguccaguucucacaaaaggucauuuuagucauucaagccugucugggacuuuguaaaguccucuguaacacacauaaagcacuuaguccagugccuuuucuuugauagguuucaauaagaagugacuguuaauauucugaacaggccgaacucuuagaccauaauuauuuccccuucugagucuuuuaaacucacuucagaagcaccucucccuccugggaagcuucucccuaggcagagugcuuuguuaauauucuuccuggcagcuugaggucagguaacucccagggccuagcucauaauuagugcucaauuaggguccguuauauggcccugaccaugccaaaaaaaaaaaaaaaugggcacaauaccugcugguaucauaugguugggacugagggaagaaaagaaagcaacagaaaaggcguacacaccuagccaaaaaauuagacuguacuacuguuuaaguacuuaucauagcaugcacaguguguuguauaaacacagacagauacuacugugauuuccuggugaaagaguuuaagugugugugugugugugugugugugugugugugugugcacgcccgcaccuugaugaugagaagguggugagagaauacaagugauuagaaaaaaagcagugagcaaggcagugguggugcaugccuuuaaucccagcacucgggaggcagaggcaguuggauuucugaguucgaggccagccuggucuacagagugaguuccaggacagccagggcuacacagaaacccugucucggaaaaaaaaaaagaaaagaaaagaaaaggaaaggaaaggaaaggaaaggaaaggaaaggaaaggaaaggaaaggaaaagaaagaaagaaagaaagaaagaagaaagcacuggucaggauucaaaugggggggggaugaagauguaccaacaaggccuacuuauucagcuguggcaaaauagugaagaaggaauaggcaaggaaaaagucagugguccuacuuuggaagaugagcagacauccaaguuauucagcagagagaacaugaaggagguaaugcuggguuacguauaacacuaauagaccacagguuuuuagaauuuguaauacauuuauucauucagugagagagagagggagagggagagggagagggagagggagagggagagggagagggagagggagagggagagggagagagagagagagagagagagagagagagagagagagagagaauguagacauguggagaucagaagacaauuugcagaagucaguucucucuccuuccucucuguagguguaaccuggugguucucacccuuccuaaugcugggacacuuaaauacaguuccucuguuguggugaccccaaccauaacauuguuuuguuuuguugcuacuucacuacugucauuuugcuacuguuguaaguuaugauguaacuauuuuuagggauagaaauuuacccaaggguggcaacccagagguugagaacugcuuuucuaggaaaucgaacucaagucaucugguaagcaccuuuacacaaugagcuaucuugccagccuaguagcucacauuuuggaauacuuacugcaugauuuuaagcaacugauguaaaucagaccguuuuacucucucaacguggcuguagaguagaggcuauuauuauuucugucuugcagcugaaaguauacaaagaaguguagcauauugaaaaacaagcacaaucaaggacacaaaugggaacauuuuagaaaaagggaaacuaaaaaccaucucugcaucguuuaaauuaauauggauggagccaacuaggucaccagguacccaaccaugaagggguuuaucaguucaucucuaauguuuuagaaaccagaggauuuacaguucuuggaaaaggggcugcuucaaugugcaugaauccacccuaccauccacaucuguucuacuuccaaagacaaacacuaguaggacuagaauuaaaacaagucuauccaaaugaugaccuaaauggcuuccaaaugaagcuucagauauaaaauacauguccuacucugaaaagaaaaaggaauagagguugaggucuggcuagcuucccagcaucccauguuagcaaaguuauaaugaaaacaagucugcccugagaaacaaaugaaaagggcaagguuaggaaggguauugaauuaaaaaaaaauacaucacaugaagcucuguuguuuuuuccagugauuaaucuuuucuuauuucaauaauugugcuaugugcgucuguguauauaaauauuuaugcuugugccauuuguaaaacaacuucauauuuuccaaagcacuuucucuuggucauuugaauauuauaggagaccaauugcuuuaaggaccuggauguuccaguagcuaguugaaguguuguauuuucauguuaguuucccaucugguccucuuaacuagcugggcuauguugggauugcaguggcaaacacuugcaagagucagaugccacagucaggagagagcaaacauuuaugcccuauugcuugagccuggagguuguguucagggcugagcaccugggguuuuuuucccaccuuuaagccagguggaagauuaacuuacggcucugaaagcuucaugaucaauguaguugacuauaacucuaagcuucccucaaagcagcgcuuuucccugucugguaaaauuuucuauguuguaucuucauuuuaacuucucucaaaagauuuuccacuguccucucucuggauucuucuuugacucggauugugcuggguaauucucagauguuggugaauuugacaaacagucuucuguuacagauuccuaauuucuuucuucccauggugcuugguagaaucccuuguguuuguuguucuguucuuuacuuuucaguacugaggcuuaaacccagggccuugaggaugcuaggcaaacacaguaccagaaagcuacaucccugacccuuucuaagcuuucauuugagcuagaaucucgcuaaguuuucugaucuggacccuaucuuaggauccauuagccucagcuucccaaguaacuauaauuuagcuguguguugcuaugcuacaagcucuguagauaauauacuuuauuugcuauucauguuuuuacauuuauuguggcuguuuuauggcuacccagucuguuauagagaaaauucuauaugcauuuaacaaguauguaugaauuacuuuguacuagccugucuuguggcaagauuaauguaaacguguaaagugauuuuuuuccaguaucaacuucauauugaaaaucaagcuuucuuccauaucccuuuucuguggcuuuuagaaaggaacaugugaauugacaguagaccaacagaaaaaccucugcucgccauugcaacacccccagccuuugagaaccacauuggaagcacuuaacuauccacaugauacuucauuuucugucuuaacagaaauaaccuaccauucucaaaccuacugccaugugccuuaguacagaccacugauauaagcuggcacaaaagauagggauguuuaaauaucagagcauggcaguuuguuagcuugccacuaaaaucauagggacucagugugcuuuguuuuuguuguuuucuuuuguucuaaaacacuaguguugcuaggcuucuuggugacauacuagcucuauaaaauaccuauucagaacacugagcaaaguagcuaagcucaaauguacaaagcaccgugccugagcgugagugcuuugcuaaagucaacugugaugcuuaaacucucuguugauaucauucauggcauuuaaaaaaaaccagcugugccucaaaaauaaguucuggcauuaauuuccuauuuuaaauggcauucaguauugccuuuugucggagaaaccauucucacuuguagauuuauaagguaauacaaauacacaucaaagaaauaaaaauauuauggucaaccaauauguugguugguuuaaagacaaaaagaaagaaauaucuguucccuuuucaugcuucaaaauucuagugauacuuaugccauacacguguguaaauuuauaaagcuauacaauaaaaucacaguagguagguuuaagauucagacacaggagaacuauauuuucuaugauuuuuuuuuuuuuuaguucuuauauaaguacucuuaaaauucagcaaaaauauacccugccucuaaguaauacaauuggguacaguggcuauagcaauagaaaaauggccaaggaccagcaagaaauggugaaucacuuuaagcaauuggccaugggacuaaacaccgggcucucagaccuacgcuguguaucuaagucuacuuaguaaaucaagguagugaaggcacuggaucucaugcugagaaaagaggaagguccaagucaaaggccccugauucugcggcgaguuuggagaauggaugcuuuuaaggaaauuauuuuuuuuucaacucagaaugagucaucuccagaugugcccauuucaucucugauuuguuaauaccucuguuuuaaaauguucucuuccaauucaaauguguuaaggcugauguuucuagcguaaccaaaauuuguauaaucuagaaaugaauuccaucugcugauacucauuaugcaauauggaaauugcucuuaagagcuugcuguuuauaucuacagggacacuacauggauagguguuuauuaccacaugugucucacauuuaaccauaaaauagauaccaacauccauucagcacggagagauuuaaaaugcaacauuuaauugccaaauguuaguuuugcucacaaaaauagauggccuuucugguuagaggaaaacaaaaaagccacagaguggugcuuuaaggcaauuuuaagucaaguuguaccuuuacuucaguucaaauucccguggaccauaaugaggagaaaguggauucaggguuggagagauugcucacugguuagagcaauugccacagaagccugaaccagaguuaagauccccagagcccacauaaaaugauaggggagagcauggcagcccaccugcaauuccacauccacauugacuuuaaauuaaacaauguuccuauauauguuuuuuuuuuaaagauuuauuuauuauuauauguaaguacacuguagcugucuucagacacaccagaagagggagucagaucuuguuacagaugguugugagccaccaugugguugcugggauuugaacucuggaccuucggaagagcagucaggugcucuuacccacugagccaucucaccagcccccuauauauguuuuaaaaaauaaaaauccuagguguggcuggucuuuggcuccuuuguagguuucuuuuuccuaucuuucuccaccccuuuucuucuacccuuucaacccucaaacacuagcuaaaagacaaaaaaaaaugauaaagaggaaagguaagagauagcugaauaaagucaggggucacuaagggguaacauuuaucguuagauuacuuccuauugauuagggacaccaaguuucuugggggcaaguuugaucuucucuuaucaggaugucuaauuucuucuucugguuucuucuucgugcacaacuacuuaacaaacugcaaacaacaaacaacuaccaaucaaccccaccucuuggaccccuagcauuuauauaccuucugaagucuccagaauuccaaaagucacacaauugcagaaacuaucugcugcaggcaaaaucacaccccugucagagcaugaggcaaaucauaaucagauguuguagacaauccaaaccagcccuauaucucacaccugggauuaaaaugaaaacauucuuauaauauuucuguuuuuuaaggaaaccaaaauugucacuaugccuaagagaaaggagagggauggaggguaugaccgaccauucaguagugaagacauuguccaaaagaauucaaccacauuuuuaagagauaaggauaaacucacaaaucaaugaacacaaauuuaauaagaaaaguaaccagcagaggugugccuuagaccguugucuuaucugccaaagauuuuaugauuaaguaaaugguccuuugcagacaaaaaaacauuuugcuguacuagcauguuuuggaaaguguuauucauuggaauaagauugguuaucuuuggaaaguuaaccauaauuguuaauguuauuuguucauauguuuucauagccaacaauuugguauuggcuaaauaauuucugugcucuucccugagaaagacuauuucuccuacuuucagcaauccuuaguugccuguauuucucuguguaggguugaagccuugugguccuucccccaucccaucugcuuuagcauauuuauuauuguccuuguucaucuuaaguuuagacagucauguuagugagaccuuauggcuauagcuccuaacauuccuaggaaacauaacacgaaaugaaauaugaaaagccaaaauaagccccuaguccugaguccauuauagaguacuaacauaccaauugggucuaauauauccucucucugauccuuuucucuaccuccugaauucuggaauuacaaguaugagacaucaugccugguuuaugaagugcuggguaugaaacccagggcuuuauuccugcuucaucauucacuccagaacccucaaugguauuuccuggucuguguuucuaaauccuucacuaucuccccauggcuccugcaucucauaaaaauggucuauccaucaucuugcuagaaaacaaagcaucauccaaacaaauggcagucucuggagaaacacaugguccagcauugcacauugguggugggaagggugucagggcagaauuugaaaaugucaauguggaaaguuccacuauaacuaaaacaaaacuuguauagcccaccaagcucugggacaaacugcuuuuuuuuuuuuaaacaaaagaaaaaaaauagaaucaccuauacacacacaaaaaugggauauguauguacucaguuaacagaguccuugccuagcugacaugaagcucugagcuucauagcaccacuguauaaaccagauguugugaccccagaacucaggagguugaggcaagaggaucaggaguucagucauccuugcauacauagggaguuugagacuuuggucacaugacauccugucucuuaaaaaaugaauuauaauaaaaaauaaauuauagucauucucauuuccuuauuacucagaauuauuucaugguuucccaaauuccacguuacacuaguaacuggcauacacagugaaagugaccuucuuaaugacacagggauaacuguugaguugggaggccacaaggaaggaagaaauuaucaaagagaacugauucaguucagucagucauuuagguucaacuuguagauauucacagagcaucuuguuugugccuaauucuguuagguacaauauuagaaugugacuguacuugcucuguaaaaggaggguaaacucaagagggucaaagugaucaggcuucauucuguguauauaacgaugaggcaugugucgccuaugagcauacuuguggcaacuguucccaauaugccuuuauuuauuuucacaucauuacuaggggagggggucaagagagagcagggggaacaugagacagugauuacugaaaaucuuuacuauguuacacagggauauuaaugccaugacagugucugcaucucugccuagcaccuucuguaaaugugaacucccacaguuuaaugaaaagaauauaaaccaaccaucugcagcaacauauuuguuuaaaaaggaaacaccagcaugaagacuuagcaacuuugaaccaguugaaagaugagcaucugccugauauucucauagugguucuauuaauuguucaucuuccauucuucuuaugguuucuguuacuagcauauuuauauugguuccgccggaauccuuuuaaaaggaauuugugaauuguuacuuuggggagauuaaaaucuauaagggaauuaaagcuccugggaugcacaauuagagcacauaauguucuauccaucuugaaggccauccuucccaucccuauucacuuuuccuggagugcuuacauucaucucuuuccuauuauguagcaaaccacacuaaagucuuuaacguguacucacagcaaucucaauuuguaguaaagaaauuauaguccauaaaaguaauaugaauauccaagacaauacggaguguguaguacuuacagcuacauuuauuuggcuccaagucuaggauucuacaacacuaggauucuacccccacucggguguguugcauacugucugagucaccaggaaguaaccagaguuucugacuuguucauaaagaccgauugccucuuaaaccaaacacuggcccugcaaaaaugaggcucagacugcauuugacaugggagaggauugagugaaucagauacuuaguagugcuaaaccaguaagauuguccuagucagcuauaaaacaucacaaagucaacaaaucucucuuuagaagacaaagagaagacaaagagaaacuacaauagaaaugccaacaauggugaauuaaagcuaccuuguccuucuucaaaauguguuuauaaagauaggauuuaagaaaucccaggcuggucauugacuuacuauguagccaaggaugaccuuaaauucuugacucucuugccacuaccuacuccaauaguaggcuuauaggugugcaugcccaacaguguuugucuauuagacaagcucccaaucaacaaccauauccucaggccccuacuuuacaauguccacacuaggacuguaaaaagagaaggcaggaaauguggcucagagguugaaaacacacauugcucuugcagaggaccugagcugaguguccagcaaucauguaaggugccuccuaacugccuaaaauuccaguuucagggagaugugauaccuccaaccuccaugggcacauaccuacacagauacacaccauaugcauauaaucaagauaauaagauaaacauuuaaaaauaaauacaaaaagaucaucagauuucuugguggggacaaauuccugucaccccuguggaucuacuuaggaguucuaggugguaaauagaccuagcccaaacugacaguggcaauucacuccagagugggccugaaucacagauuugaguauuugaccccuuucaauuuuguaacaaauugaaguuguggcguuguaacuuggagugguccuaaccucucuagcauacucucucccuacauucaacuuugggguaggaaaugaggcccugguuaaagcccaaccacuuccaacacugaaaaugcaaaguaacauuguguccaauugaguuaaauagucauuaaugccugggacugugguccuucauauggauuaaaaguuagaacaaucuugucagaaaauaaagaaccaaguagccugaccugucucaaaagaaaagagccaguauuugaacuuucuuauuucaaaauuucaucgucuacaucaguaacaagguuauaauaauuugauuucuaccuuaaaaucuaggauuuggcauuuuaauguaguugcuguaacuuaaauaaaauaccauauucccugacaucagauuuagcuaguacccauaaccagcucuuuuauuggcuauuuugagcagaauuaugauucugauuauuuuaacauuuuuaaaugcuaacacaacuaugcugaauucuaacucaauauaaccaucuagaugcaaaccaguuggauugguuuccuuuaaaaaagggggugggucugaagagauagcucaguuguauaugcauggagaccagauguguaccuggaaacaaagauuuuugcucagccaggcaagcuagaaauagcagugcuagugaaauucagugacagugucaaaaauaagguggaaccuggguauggcaacacauaacuuuaaucccagcaccaaggaggcagaagcaggcagauguaucagaguucaaagucagccuauucuacauagcugcuuccaagcuagucagagcuagaucaugagaccuuauuucaaacaaaaaaaaaugagagaggaaaaggaaaggaaaggaaaggaaaggaaaggaaaggaaaggaaaggaaaggaaaggaaaggaaaggaaaggaaaggaaaggaaagguaaggaaaggaaaggaaaggaaaggaaaggaaaggaaaggaaaggaaaggaaaggaaaaagauagugauaaaagauacuuagcauugaccucuagucucuauacacacauacacacacacacacacacacacagagagagagagagagagagagagagagagagagagagagagagagagaaagagaaagagagagagagaaguugaauucaacagugcacucucccuucugucuuguagacauaacauuacuugcuuccuugucccaaaaguagagucaugacucaguuucaauuauuacacuaauuuuaaauauaccugaacugaacuuugcauaauucuccccuaagcccuauucugaaacagcagcauauuucaauuagccuuuaacuuucuccuuauucaugacccuuuccaucucuuugguccacgaacugggauacagauaguaucucaauucacucccucuauaauccugugaugaaauaucuuauugccauuaguguucagauuggcaaucagaagcucagauuugaaggaccguggucauguagguuguaggugacaugugagaugcagucuuucuaauugucucuguucucucagauuccuacugguagguaguucugugaaauccuauuucuaaguagccccauacaaccagauuagcauuuuaucaccauagaccugcccaugucuaauucuaccuaagucuuacugucccagaauaaaacuacaucaaagaauggagaaugagacauggacauuuacuaauucauucuucaguuuuuuuuuguuccuuuuucuuuugguccuaggaaugaaacaagggcuucauauaugcgaggauaaugcaaugcuguuuugcuuuauuuuggauacaguacagaaugaggccuaggcuguccuuaaauuccuuguguagcugaggcuggccuugaccugauauucuuaaguacauuuacuucauacugggguuagagacauacagcaccacacccagguuuccauucuuaaucuuggcaaaacuaaguaggagaacuuaguaccucuaaggagaauggggccaguccuucuccuuacuuuaauguugcuuggaaaaauacucgugacuccuucgccuuuuauaguccacauaaauauuccaagcuccucaaacauuuugaaggcacuguuuucaucuuuuuauuccucuuaaaguugaaacagaaagccucuauguguacgcauccacauguuuuagaacugugugcuucaugugcugugacuugaaauccuuccaugucauuuugauuuaauaaauauuuucauaaucacccaaaugguacaguucaugcuuuugucaucaaauauaaacuaauguccucaagggggggguggaaaaaaugcaauuguucuggcacugugccaaaaauggcccaaagaagauacuggaagcuuggcuucuaacauaucugcccugauaaguuagcaaagguucaaugaaaacuacagagcugguuuuuaauuccuauugaaaucacugcaagugcuccaaguuuuaucacucauaauuaacauaaagaaauuaaugucuuaagagccucaauauuggaagcccuaugaguccugaggauauuuaaagggagaugcaaaguaaauaggaugaaauucuuaagcaagauuccugauaugacagcacuaaagagcuuaggagugugaaaagugccucuuuucuucccuugaauaaguccauuacuugcacuugggcguauuuuaagguccuuuucaugcugaaucuagacuugagcaugcuuugcauuucaagcuuugucuaucaaucaguagaagccaaaguuauuucugcuuuaaaauaacaggagccaggaacagcuaaucucuuuucauucugaguuccuuacauuauauuaccaggacaaaguuuguguuggcuacaaaacaggccauucacaacauccaggagaaggaauuuagguaagaaugaagagagauuguaggauguauaaagacucccucuccugaggccauuaagaaauuccaaauuggcaagguuuugaauagugacauugcauuagccuugcuaauuucaguaauucaagcugauagucucucuuuaagggggaggggauggggggacucguccuugaaagcagcccaucaccucugcaccauuucucagcuaaggugaggugguauuuuaagacacgugaucaagaggggggacuauaaccagcacaaggaaaccuuagucagaaacucuuuagaaagcaaucuaagcagucuuuuucuaaccaggaaugagucuacaagacaggcaacauuugucacucugucagcuccuugcaucugaccccuuugaugauuucugucuggcuccuuaauuguguuccuuucaauaauugggaaaagcaaagaaaaccuuccaaggcuuucuuuucauuuuaacuuuaauuaacagauaaugcauauguuuacgagauacauugugauguuuucauguauguucauaauguagagugauuggaauuuuuuucauaaugggagcauauuugaucuucauuuuauaaaaugugcaaggaaacagauagacaaaaaugguaaaaaaaaaaaaacucucaacuaaccgucauugugugugcuggccaaauguacagaggguaaucuucagagccucacaagugaagaaaguaggacaguggccgaguguuugaaaggguuuaagguuucaucugaagaagagcuguacccuacugugcuuguagccggauauaccaaacaccagacaccagcaagccaaacagaccuuggaaguagucccaagugcagcgauagcagaagccuuggaugccaaggcacccuggcaacccaggccuucugcacauccagcccaagguuguugacuuagcuuuguuuuuagucaugcagugaugaagaccaaagcacgagagcuuugucggaaugcuuuauuagccaauaaaguauaaaaacagaggaaacuaggaaaaaaggggguggauguaaaagaggggagagaaacaugugaauauaugaauggccuuggggacaaaaauauuucacaagaaauauucaguuagaccauauaaguaacaucuugcuggguaugguggugaacauuuguuaaucccaacgcuggggaaguugaggcaggaggaucaguacagccuggggcauauauccagagacacucuuucaaagcacuagggccaaaaaaugaacuguaugcuuguuaagguuuaccaauauuuccauacccugugccauuguuacuugagaagugagaugaauucuuacaagcagagcgguaagggaauuggcuagucuccccaggguuucuucuuagacccucugcaugcucugcucccacucagauuccccgggcucuuugcucgugccucucuuguggcacuuaacacauucuaacucagaggacaaguuauuuuugggacucaaaucaucugccucauaagagagaauuccaggaggccaagacuugaguuuucuucugccauagcacuuggcaccaugcccagcaaaugaaaaucaugccugcucacugccgccucaucucacaccugcucaagggcagccugggcuacauaagcgguguggggggggggaaucaacuguaugcauuucugacuccugguacauagagagcucuugagaauagacucuaugaguuaucuaguguccucaaggccugucugucugguuccuaguacauuacuaaguguuccuaccucucaagaaauguuuagugaauuaauuuaauagacuuaaaauacacccuucuguucaucuauggcugcuacccuauuuauccauuugaagacaugguuaaugaucacacauguaagcacauguuuauauggacucaggcaaugguaacaggaauguaguucaucugcacucuauguauucgcaucacuguucucccugagaaacagaagugcucugaguuggaaauggguuuagggagagaaacugugcggacaaggagaaaaagcaggacgguaaagacggcagagaaagauugguaggugaagaauuccaccugucuguugugagggcucugaaccuucuugcugccugccugccugccugccugccugccugccuggggcaggaaaaagauaaccccccccccaaaaaaaaagcuaaaguagaaaagggggccucuuaaacuugguguuagucuuaauaauaagggaaaaaacuuggauuacuuaccuuguuguuagucaaaagggggcuucagauuucuccauugggugaccuaaacuguaaucugucucuauagcccucuguuaauacuucuugcauuugugaggaaauuauagugacuagaggggcuccauuuacuuccucuaaucucuugguggagaaauuaaaaagacaaccagauauugugguaugacuggaauucuccauggccuagggagagccgauugggacaaaucgauugaagagaacaaucuuuauuuaaggguccugcaucuuuaaucucggcaaucccuuuggcaaauugcuuuuucugguggcauugcauaccuaauuacagugugcucauuucaguuuucuccuugcacauugcuugcuguuugugcauuguggguuuucaggcugagcagcaaacugaguaccagcuuuaaauccucaucaccaaaaaugcccuaaaggucucgggaccacauugucaccacuuugggaagaaaaucagaagucacuagacaaauacauuuuucuuuagcacuuccucagaagacccauuuucuaucauguuaaugaauugaaugaaugcucuucucuaccagauauuuucaacaucuuaauaauugugacaauaaaaaagauauuguaugugggcccaaccaauggccauggaaguaguuuacaugcugggauuucauccaccaaccaauagauguacccuagagacauguugguaugcuuaaugaaagcacucuguugucuagccauagucaguaauaggugagcgugacucacaguuuaucuuccacaauuccguacagccagauguuuucguaucuugaaauugcaggguuuuaagugaaugguuacaggaguauuuuuguuuguuuguuuguuuguuuuauuugguucuuugagauggaauaauguuuuacuguauugcccaggcuacacucaaagugaaauuuuucauucaugucugaaccuaccaagaagcugaaauuauagauguacacuacuaugucugacuccagauauguuuaaaauaucuccuacauuauaguaaucuuguuauaaggugauuuccaucacaauuccuuaacauuauaauauucccuugauaaauacucuacuuuaucuuuuuuuagaauaaaaaaggcauuaacccuccuuucaaaauucuuuuuucuaaucagucuguacugcuuucugcucuguuguucugcaacuugaccauauuuggccaucauuccuacaugcuagaaugaaauagaccucauggacauaaaucacaugacaaaggcauauaucaaaggaaauucacugaagcaauuuuuuauaaaggagaaaucagaaacaacccaaaugccuagccgugggaaugucucguuauuauguucacuguauggaauuucuugcagugguucaaaagaaugaggucauucugcaaauauuaauaacaaagauuuauaagaugugagaaucuguguccaugcuugcauauaaaacacauucaccaguaaucaucacugagaaguugucagaggaaauagugagauggaaaguaugugugugcaugugcauuuguguguuuagauaagauauuguugguauuguuugaaucuuuaaucucaagaauauauucauagaaauaacauuuugagguguugccaaaaaaggcaaaaaaaaacaaaacaaaaaaaaaaacaaaaaaaaaaaaaaaccacacacacacaccagaaagaaugagaaaaaagagagccuaagaugagucuggguaaagcgcuugccacacaaacucaagggugggaguccccaaaacacacggguuccccugaagagaugggagauggagacaggagagucccaagaaucuggcaggccagcuagccuggcaucuacaguggcaaaaaaaauaaaaauaggaagugaaaucugcuuccaagauuguuguuucacuagcauauaugaaucauagcaaguaugagccugaauucccacauaugaacauagaugcgcacacacacacacacucauagacacaucuaucacacacauagaaaaauuaaaauaaaaauggagaguuaaaaguaagaagcacaaaugguguuugaggaguaaacaguaagacaguggaaaugcugauggaagaugaagggggaaaaaaacagaaccuggcuuagacaguggggaagaccaaaaaaaaaaaaagcauguuuauuauucagauccuagaaccagaaguguagcuuagugguagaacucuaacuagcauucuucagguccuggguucacuccucaguacucaagggagaugagggaaaacaacaaaagauaacuucugaaccaggcgguaguggcgcacgacuuuaaucccagcacuugggaggcagaggcaggcggauuucugaguucggggcuagccuggucuacagagugaguuccaggacagccagggcuacacagagaaaccuugucucaacccccccccccaaaaaaaaagauaacuucuguuucucuaaaacauaccuggguaugauagcucacaucuauagccccagcgccagaaaaugaggcgggugaaucaaagcaaguucagggauggcccuaagcuacagagugagacucugucucaaaaauuguuuaaaguaaaaauuuauccagugauuccaacuuggccuuugccgaaggaucuguuaaaagaauccgauggagacaagagaaagagagacagagagauguuugauagagaaagcuaugaucagaccagauagaaaacaauaauuggauuacagaaaguuguuuagagagaaauggaaagagaaaaagaagugaauugagaaguggaaagggggcaugaaagcauagaacuuccagguuaagguauugcacucguucuuguaccagcaugcaauuguauuucacuggcacucauucauuccauggaccucugcaauaagaaagggaugcuggcaggugguacugagaggauugaaguccuguugcuuuguuugaucacugauaagcagaggacuucauuagcaaggcuauacuuugauguuccagagacaggcauugagauuuuagucccacagcuucuacacuuaggaaucaaugguagggagaggggugaaguguggcccagggaugaguagauugggaggcagggacagaggccaaaaguuugggaacacagucauccagguugcaaaugagacaugaauggaaccuacucacuagaaaagcuguuuccugcucuguaugucacacacaaugcuggcaugugucagcugcuugcauagcauggcaucaaguuccagacaacaaaagcaaauacaaaaauaaucuuuguggauuccauugacacugagcacacaguaaacucaugcuccggcucauacacacuggcuacugcuuagcggugccugcuuagcggugccuaggaaucuaaggaccaugcuuugaauucugccauuuucuuccugagauucccuccauuggcccuacgaauguguuaucuucagcaugugucaguggugacucuuucccuugaggaaaucagaaacaucagucccugaaagauggguuccuugcaaggaaauugccccuugacuacauacucccaauaggcuugaaauggguauccauuugagcauuuguucauccaggcaacaagcguguguuuaaguucucuaauaaucaaauccugugugggggcuaugagcacaauaaaaaucauuucuuacuucaccaaagucaaccuaguugagaaggagacccuggaaaugacuaacuuuacuaugacacaaauggaaauuugugcuauaauagaaguccaauucaguucuuacuacagagagcuacucauuugggccaaagcgagaagaguagacuuccuagaagauaugguauguguauguuaaagcuuggaagauguaauuguggauagaagagguggaauggggcggggagaaaagaaaagauggagcucccaagagcuggggagaaagaggagggagaagagacagacaucagccugaucuaaggaaacagcuugaaaagacuucaaguccuuggcauuuucaacauugcuagggacuacaguauauaaugccuugaaaaaauauauaggcaguuuuccaguuacaaagcaaagaaacaugagccauagaaacugcuaaggacuuaggacucuuucccauaugcaucaaaguauugugaggcagggagaaaugugcucccacauguguuuuuaggaauagaacgcugucuuauuucuagcugucacaaaagauaacauuccuuccuggagcgaaaaggaaaaaaggggagggucauuggagaggaacagguaucuuacacuacugcgccauuaaggacugcaucaagaguguuggcuaaagcagaggaaaagcagccagcaggcagacuuacaggggagaggugccugugugagagggagugagcacugucugacaguccagauccacaggcagaaugggaaggggauggagccaagacgccagugugugcauucaaguaaagcaagagaaaagauagacuugguuccccacauccuguggaugauaagggagggauguuacaguugcugagcauuuaaugaacaacacucagauggaacaacuuagagaaggguuucagcuguccuuuaugaggacaccugccugcuguugauuuccagccugaugcucccacaccagcucugagggcuuuuagagacauucuuuugugccgccccccucccaacccccggauggagugcaaggcuguuuucuuacuauugggcauggccaggacacuggacgcauauugauccucggguacucccuccccaacccuaccccacagauccuccaguacucaaaaaggaaaaaaauggaagcugaccagaguuuucccaccaaaacaaagccucauguauuugauggacuccuaauauuguugacucugaggaaguacaugagcacuuccuuauucccaugagcccucaguagucauuggauuuggcugcaauaagugacaguuuguguuuucuacauucuucaagcccagagaugcaugccucugugacugugucaugcccacaauugauguuacaaucagagcuucguggaucuaaaccauuaauuuuuaaauuuaugaggagagacuccuuguauuuauuguuuuucucaaaauauaauuuaagcuuagcaucauuuguguaaguuucaaaagacagcaaguguaaguuucuugagauugcauaaacuugcucauuaaacauuagcuuccaauuaaaaucugucagucccuccccuugaaacauccucuuuccuuuucccuguugaggggccuuacaugcauuucauggugauagugaagagccugacauuuuuauuguugugcacaacuuggccugaguuucaagacacuggaaaggagccauuuagugugugugugcgcgcgccuuggaguugggcucauuuacagcccuccacaugguaagauacuagacuagcaacacccuugcacuggggaguagggagucuguaucccaaaugccauuaccucuugcuuucugguauacgaucacuuauuauuuaguuguagauagggccucacauagccaucuccuugaacucaaauuauaguuaaggaggcauagagagacaagcaggcaggcacacacacaaaauaaaaaaauaaagagagcuaaaagaauuguugcaaacguuuucuucugagagagucauaguaauuaaugauaacaguaauaggaacaauaacuguaaaaggccucucuucuucaccugucucuugguccugucacuuccugaggauaaauuaaguucucccugugaaggaaauguuuugaugaacugauucuuccagggcuuuaggcacucuuggggaagggacagccacugagaagaguguaguaauaccauuccugaggaaggaagguagugacagggcuucugagauuggugagggauagccagcaccugcucuuacucuccagguauccagugucgagcuagucuccuuuuggggauaugacuugauucauaacacaugcaaauaaguauaauaauggccuauguuauaauagauuauguaacaaaaccauuugcuguuuucuaaaagauuaagcgauuucuuaauugccaaacaauaauaaagcacaguugguguuucaaauuccuggcaacaauuuuauauuagaaaccuaaacagccugagccauaguugagagccacuggugugcucuccugacaagggagucaccauagaagagaauguauugagucagcuuuggaauuugagucagaauguuguuugguagcaggugacuugggucaccuaacagugccuuuaagaccuuuccaccguaugcgcuucaaagagcaccaucaaaccucugccugugaggauauggaaccuaauuugaagggcuaucucagucagcaauguuugaugaaguuuucaggacacccuuacuccaucauacaaucuuaccuguucuuuaaaagguaauuuuuuagguucauuaauguauuugugugugugugugugugugugugugugugugugugugugugugugugguguaugcaugcacgcgagagcauuccugccucaauauauagauauagauuuauaauguacauacaaaagcccaaagaagccucaagaguguaucagagucauccuagaaucagaguuagaguguguuguuagcugccauauauguacugagaaccaaacccagguccucugcaagaacaaaaaguguuccuaaugacugagccaucucuccagccccagccuugaauguuuuacuauaaagcaguguacuuuuauucugcuacaucccugggaaguauguccauagcccagugcaguguaaccugaagauauuguaccccagcuugaaaaauaggccuaugaugagagagaccaugccucccugaauggggacaaucuacuguauucucucaacaccccacuguuguagcugaggaugcuugcaggcuggaguuagcaauagaacaugaaguggagacuuaacugccuaacccuguuccagaagaggccaugagaucacugccagguuuuauagucaguuaucaaguaggcaaacuagacagcucacuuauuauagacagcucauaguguagucaauaagauacacugugaaaugugccuguucuuaacggggucccauuuaagaauuaaaagccaaaggccugaaguaugccuguuuacccacaucugaagaagaaaaugcagaccuccagagagccuggcuucauuugcagagccacuugcuucugcuuucaagucccaaguacccauuucacuccugaaaguucauaaaggagguggaguuacuguggcaggaagggggcuuuuguugugguucagaagacaaggaaaccaagaucuguuugggaaucagaaaccaauggcagagccccaggaugcccaugugaaugggcagcaaagugagcaguguugcaaugagugccguuuccuuggagauugcccccaguuuuauccucugggguaugccaggcaauguccugagguuucacauacucaugucuuaacuguacacagcaaauggaaaacacagggauggauggcaguguuguucuguugcuauauuagggccagauugaagccaucugcuggaacaggcuuggcaaggaagaaacccccaugcuuggcuuagcaguagcauccucuuuccugccauuuuuaucuuuaagacagggucuucagccaaagacgaccuugaacuucugaucuuccugcuuccaccucccaagugcugagauuccagucaucggccaccacacccaguuuacacagggcuagagacugugugcuugagaccagcauuuucacaacugagccucauucuuagccuccuccccuuccauuucuaaaaaagaauuuauuuuauuuuaugugcuuuggugugagaguauuagauccccuggaacuggaguuacagacaguugugagcugccaugugggugcugggaauugaaccgggucuuuuggaagaacaacuggugcucuuuaccacugauacaucuuuccagcccuacucccucccccuccauuuugagggcaaccagagcugcccuguaccgucaguguaagugacguucccauagcaacuucuugaugcccauuuccucagaggaugagcauuuccucauuguuauaugcucaagcccucggaggcauugaaagaaucccaagacugaccuucuuggccaccaaaucccucuccuccacugccugugcaagcuugaggggcucuccuucaaacccagcaacuuuucccccaaagcuuugugggcaguggcuuuagugggggguguuauaccaugaguuaaaaacaaaccuagaacagugcaucauggauuuguuuauugccagggucucucauccaagacuaggacacucaagaggccagagcuuccguagcugaugauugcuagagaaauauccacggugaaauaacugauugacccugcuauggggaagcucuguuggaagaggccgccuuggcucuuaagaauaaaggaaugauuccagccugcaacagacuauacuccuuuuccaggucccaagggccucgaaaccagaaaaauaaaacuggaaggaaauguacgggucaccaguucagcaccgugauuugacauauagggcaacugaagcuuuaaguaggaaaugccuugucagaggugaagugggaaggccuggaaucuagaguuccagaccccaggggauaguaaagacuccuuggggauuccaggaggagauuuucaauaaccaggaauagaggacucuccuuucagagcuuugcccagugcagaaaagcuuuccaacacaaacaacaggcagccccuaaugacugacuguuauuuuaaauggaucaucuaaucuacaacacaaaggccacugaggcaaaauaagaguccuggcugaguguguaauuaguacagauaguugggucuacccccugggcaucguuaaacugauuacaaauagaaacagauuuuuagaugaagcuggggggguggggggagucuccuugcuggcccaaaagguucucacagaagaaccacuccaagagaaaagcaauuuaugaucccuucaaaacauacacuuaacaugaugaaaaaauaggcugaaaaaaaucacugaaaaauaugagugauuucaaauaaaauaguuugugguguuucucagaauauguuugguuuaucguaaaaccuaguuguuucccuuugguguagguuugguuuuucguagacuuuuuuuuuuuuuuaaauaugugcuauucacugauccccagcuccuguucccacaggcuucuuauuucgucaggacaagauaucugagucauucuggcuuagggcugugcuucacacugauaacugggaucuuucuaagcacagagaucaaauuguacagguucugccuuagaaacugugggacggcccuuccugcugcauucacaauuguuguugcauuccuaagccacauggucuuacugaaaauccacugccuccaaucucaguucuugagcccugcugugggucaucacacaucuccuaauggagauagccaaguuggcuuaagaaaucauccuagcuacuucccuuuagguuuguuaucgauccucuugguaauuugcuacugucuuccuaugaacccucucugugaucuaaggaaugucuaucugguuuaucuauggguguggugcucuugccgaaguaugggauuccuugaaggacuagcuaaaucuuccuuccuucuuuugcuaacuccuggggacaccauacauaagauagcauuguuguuaaaugaaauuggauucuguuucuugccuccaggaauguccuuauuuaucugugaccaagauccuauuuucucugucucccauaauacuuccuuauucuucucagauaccucuuucagcucuaauccuuguggcaguggcccuagcacagagugugccuuugcugggcuuccugucaguuuacaccucaggcaccgcacugagggauugagugauagacaucucuuccugccgaaaggagagcuucgaacaaucucuagccauaauuuagauaaggauguuccuggaggccauuugguggccuaaauguacgccugggaucucauggccuuagccaucauuacucauuucuugggaaacagaacugauaauuuccaugucagcucccuaaaucaagaacucccugcaauauccuauagaguuuaacaagguuucuuaaucagacacauggugaacuuguggaaacuaugccucuugucaugcuuuggaaguucccuuuugugauauauacucaacaauugagguuuuugguuugguuugguuugguuugguuuuuagugagaaucuauuacuccuuuguccugccacauauuugguauccagaguuuuucaagaagcaguaggguggguuaaagagaugacucggcaauaagagcucuuguucuuucagaggacuuggauucaauucccaguacccacauagcacuucauaaccauccauaacuccaguuucaggggauccaaucacuucuucuaaccuccauagcaccaagcauucaugugacacacacauauauauguauguauguauguguguauauauauauauauauauauauauacacacaaaacauugauaccuaaaauauaaaacaaaaugaauacaucuaaucaaaacuuuuuaaaauaaagaaaaguagcaacauggcuuccuaagagguguacaguuagaugcuggauucagauaguacagcuauugguugccauggaaauauagaccaaaagcauuacccugaacuugagcuuccuuguuccuaaaauaggaauugcaauaccuacuucauaagguggugggaaacauuaaaauuaaugagauaaauagcacauugccugguauacaugggcauucaaugguuuacuucgaggucccuauuaucauguccaugcauaagauccaaagaaaacguuuauagggcugaggacacacuugcugcacaagccugaguuuaguccccuaguuuccacguaaaagaaaagaagcuacuccggagaguugcuuucugacuucccucuauacaucuacccucacauggugcacacacacacacacacacacacacacacacuagauagauagauagauagauagauagauagauagauagauagauagauagauagauagauagacaaauguaaaguacagcuuuagaaagucuccuggguugaacagaguguuacaccugcuguagcugcuccaguccucaaagcuguuuaguguuggcggauuauuugaagagcagagcuaacagagcaggagcgaaguggaaacauuaauagauauuguuucaucuugauguuggguaagaguauccuccagaaaagaaaugugaaagcaauguggagagcuuucucauucaggucaacccuaaaaauauccccucuuugcuuaaguggagaagcugccgugggacccaaggcuuggcuuucaacagaucagccauaugggcucucugcuuuagugaaaucugaucacgaccuaagccugcgcuauccuugccgacugacagcugaccccugccuucuugugcgccgcacauaguucaccuuucagagaaagaggucucaucuccaaguugaguguuucucuuuguucuuuucccccuuuuauuuugucugucugucugucugucugucugucuguacugagggggaucuggauuacagccugcuaaauuacuuuucccaaguaacagaguucccugcaaaacaagcuuugaauuacugucagcacuugggcaaaagaaacuugcuccaauuuuagaugaguaaaauagaaucaaauuuauacauauuaaaaucuccaucauccucucuuugggacacagagauagagaauuauaauaaauugcaagaucaaaaauacuugguuuugguuaauauaagcaaauggucuaauauaauauauauuauucaaauuaauaggaaaaauauccguacccaucacacuaaaaggcagauaauauggaacccauugagaaauauaauuaguaagccaaagcacagaaaaaaacuugaucuacacuggugaccaaguguaugcaaauuaaguaaaccuugugauaaaacaucuuguuucuucaggugaggcauauuaaaauugguucucucaucaucccugguagcauaauagaaugcaauauccuuuuuggaagguagggucacagccuaugaaaucagacccccugacuuugaucuccuugacuuugcuuccuguacuaacccaugccagccucagaucugccuggucuuggacccugcucugcgugucuucuggaccaguugaguccccacacuuguuuccugggacuuacugaguauuuucaugaccuguaauaagagcucuuccuuccucuccuugccuucauuggguagaaucccagccauuuccuccuagcccccggcaauagggcaguugguugguuguuaagucgcucacaucaccuucacaagauacugaaauagaaacuguagccauggagucauguaagggggcaggggguggaguggguggauuggaucugaaaaugcaaauuugcaagaaucugaccccuggacuggugaucuugaauuucacacagaaaccucaaucugcuuagauuugcuuucuaggggacuuuuguuucagaccaaaucacagacauuuuaggguuuuuuuggggggggggguuguggaguuuuuguuuguuuuuuuguuucagcaucauguacacaucucauacauaacaggcaaagaaugcaagacuuuuacccaugagccucucuuagccuuccuucacuuggcaucagauucuauccagguuuucagaagccucaugcaccccaagauagcuagaaauguaccccaacacaaauucagaaacuuacuuaaaacauuaggagaguuugggguagcuuuuucuggaggaagagaauaccuugcuucauuaauucucaaaugggaacuuuguaggugacagcgcuguaucacagacuggaccagcuuucuuugauagaugugacuuuuuggugugguuuuauugauuuuuuuuuuugugggggagaaaacuguauaaaagaggaaguacuuggggaaaaauaaaacagcuuucaacagcaaacuacccuguccuucaacaugaacucaacaaagucccugggauaagaauauccaguccacuguaagggguuaagggaaaguacaauuccuacucaccagucacccuccuucccuuccccaacacacaaggacagauuaguucaccaaauagcacauuuugauguaagcucuaaugaaacugaccuucaauucaaggguccauauuugcccggggagauguugcaaggggccaaaaaacauccuguuguguuggcggagcagagacggaagugcugacugacucacucccgguugcugugcucuacaaaacagcgcuucuggucaucucuuccaguccaugcguuccaaacacacccucuccuucccaccucugggaauccuggcuuuccaaacaaaaggaaagucgaacugggaguuccucaccaggccagacaggccagaagcugugaaugguauagaccugaugugagagaaagguccugcaacucaaauccucuuucucuuuugacagaacuggccuaugaucuggauguggacgaugcuccggggaacaagcagcauggaaaucagaaggacaacgagaucaccaccucucacagcguggggaacaugccguccccacugaagauccucaucaguguggccaucuauguggcgugcuuuuuuuuccuggugcacugacuugccagcguccagugccugugcugcccugcagcaccuguggucccuacagaaagggagccaccuucuuuuuuuuuucuuuuuuuuuuuuuuuuuaucuuuuaugccuccucccaccaccauuaaguaggagacuaaccgcguguuauguuuucgaaaaucaaaugguaucuuuaugaggaugguaaauuuuagugguaggauagauugucuuuuugcaaagaaaaaaaaaaccuucaaguugugccaaauuauuuucuuacauuugacuguuggaacaugguugucauguuucccucuuuucucuuucucugcauggauuucuuugacaaaaaaaaau

SEQ ID NO: 12590 - RNA, 23075 nt, Mus musculus
auucacaggacaacggaagcaaaauuuuauuccucuuggcugggaaagagaacuagaaggugguuguacauaggacuuccaccucccagaaccaaagaagacaugcucugccaccaaauggcucccucugcccaagugaaagcccagagacaggugaacacagugcagggcaagggcgaaugcagugaagagcggccagagugauccagggaagggaggguccagggcucaggaaaggaaaauggggcuucuugggaauaggacagguguggggaugcucauugccaugggagcuucuagcuggcacaggugccaacuuagguggcaggcucaggguaccauaaugcgguaugggcugccugggauaugcucaucaccccacuugaccaccaguguguacuccccuuuguccuugagcagguaagagacacuauagaggcggcugcccauguguuucaccaggaucucuucacaggguguccuugggccaugcacgcccaccagcagcauguuguuaccuaaggcaggaauaggucucaguggccuuagauccuuucuuugucuauaauugcucugagcccuucucacuauuccacauucuguuccuugccugauuauuaacauucccaagcaagcaucucauaccccagccuugccacccagaccaccagaggauaaauuacagcuccuccaggacauugguguuuugccugcauguauaucuguguaagaaaauagaggaggaaggagaagccaccaugagcuggagucaagggcccugagagcugcccaauuggaguuaagagcaacccaaaugaaacauaguaaguaauaacuugggguuauccauaggaaaauaaauucuaacaacauagagaguaguaucugccaagcucuuguauuguuuaaggcuuacuguaaauauaaagaucauguguguuuuuaaucugagaacuaaucuaaggugggguagaaacccuggguaaaacaguagggauuaaauaauuucuacaacagaucccaugaaacuggaauuacagacaguugugagcugccaugugggugcugugacuugaaccccaguccucugaaaacugcugagccaccuuuucagcagccccacuccaggacauuuucuugaaggguagaaaggaaaguacgaaggcccaaauagaagguagcucuaaaagcaauaaucauaccccuaaaggcaguuccuguacuuccuacaugcugaccauccuguuauuuauggcuuugcacuuccagaagcuaaaaauagggcuacucaccugcuuugcugcaaucuacugugaaguugcucuucuggccuacauaagccuugcuuagccccaggccuuuggcuacuaccuugcugacaucagcaggaccugggccugagguugcaugcuggggaaccguggcaacuuuagucaaagaguccacaaacacagaugaugucucauggaggcugugguugcuuacaagacgaggaccuacaaaacagaaugggugagacuaagaagcugcucaaguaucaaggcauuggguggccaccaacagcuuagccuaaggcucaccugugaccuuggcuuuaaagggacuuccaccaaugugauaggggccaccauacuugauggagaugagguagcugccaggugccauggggguauaggugacacgauagcccucggggcacuccuggcaauccaucuucaccuuggaggggccaucaaugguaaccgaaagggcaccagcuccugcauugcuuguguucacaauaaacucugcugggcucccugggaaaauagaaggucaggcagaaucuaucucacuggcuuccuugcauucagcuacccagcacagccuugauacuuccacaugcuuccuggugcuggggcuauacaucuacacucagagcuguacccauaaaccuaccugugacaccaccuuccaggccugcuccauaggcggacacuaagccuggguccccuccaugcccaggcuccccaacucggaucuugaagggacuuccaggaaugugaguaccauugaacuugacaucaaucaaguagaugccauucucucgugggaugaaacgcacagcauacuuaucugaaaugcagguaagggauuugggguacuuuuuuguaugcaacuugaaaauacuaucugaaaggaacagaauugguuaacauccccuucacuucucuugccacuagcaggaauccagcugcucaauggagaucccucugcuuccagaauuauucuagguauucauccaauaacauacauccugagacuaaggcuaucaauaccuaagaagucuacuuguaagucuuuuggaauaacaagcaaaaugccugccuuacuguuuccuuagagaguguacuguagcaguguacaaagcagcaggcuuagagauggggaggaaucugcuucaggucauggacuugggggaaagggaaacuagugaaacuagugugcuucaauagaauugccauuucucuagccccagggauugacuaucucucugucucuguuuuuaugucuuucucauguaugacacugguguaagguguucuuccuaguggccaugauggaaagccauuaucuuccugggugcuugucaaucugggaaggguuuuuuagcugaggagcccacuuuugaaucacuacauuagccuacuucuagucagcuaggucaaaugguuggaugaauaggcagggauagagccucaccuuggucaaucucugugacauagcacuccuccagagcuccugaggggcugugcaccuuggcaucaauugcccccuuggcuccauucagacugacugcaaaagaugcuggcugguugaccuuuaacccugacuccuggaagcauagcagaugugguuagacaggauguauagaaccagggcaaaugggagagcagaagaccgacagagucacuuacccaucugguguccaacaugguuuaaagagggagagccauugaucugugagggcagcaagccacaggcauacccccaaccuccuaucuccuaaacauguucuccacaaucacacacccagguagcagaaaggcaagguggcccacccuguagguagcacucagcucuaacaggcugucccucuuuaaaccucagcccuggugcucaaugggcacaggguucuguucaaagccuuuagaccugagacacgagaaaaacuccacgcggugggcaggguacuuccugccaaccucaagcgugggcuguacccggccagagcagaagccuaccauccagaauuauuucugcguaggcacucagcccagggccaagaccugcuugcuauggugacucuggucuggccgggcccaggagccccagaugggcaguuucucucagugccucaccugaagacuagaaacaguaaggcggcgggcgucaccagacggagaagccacaggcaccacgaaggggcuaucagguaugugcuccucguugaacuugacugagaccucauagucaccuggaaaggaagagaacauaaggcuauaccuggaggugccacauauccccaaaggcuagccuaggaaaggccucuugccucccucccacaguccccuugguugucccuggaaccuuacgauggagaauaagaaccaaguggagacuauguaacaccuggguucaacauacccacacucagguccuaccucccccuaccccagccauuucuguuuccaauaccuggcuccugaacuacguaggccacaccacaggagccauccuuucgguccucgaaagagaucucagccuugcuggggccuucaacagcaauggccaggccuccagcgccagcuucccuaguccaaaugccgaacuccgcugugggaaagcagugugugcucauggagcagaggacugguucccagccucagccaagucuaagcaaagccaagaucaacaugccugcuggcuacuuccuacaaacacccaccuaggcccaccuaggauagcaagaauuagacaaguacaccuaccuggcacuccaacuucagcccucucuaggccagggccuccagcacggaccuugugagcacccccuucccccagaggccccacagugaacuggaaggggcucccagguacaugcuggcccuuguacuugacacugacuguaugcauucccaucucagcaggcacaaaucggauacaguaaguaugguucucuccuucuacgaucucugccucaugggucuugccugaugggcuggucaccugggcugucauaucuuggaugcuaauuucuacaaauagaagauagcuuggugagcagggagggcccugucucucuacuuaugcuuaggguugccccagaaacccuccugaucuuuucccuaccaggaaucuucaggcugaggucacaaugacugccaauauuggccacagaaggggcacgucgccugcgugugauacucucuuucacccggcccucaccugucaccuucacagaaaagggacugccuguaggaaaaaaguacaauccauacuaugcacaaguuacaggugggcacugaggugugugacuagcaaugcugccaaaccacagguaagggguauggcugccacacucaccaggcacaugcuggucagcaaauuugauguuuauaauguaguuuccaggcucugugggacaguaggugacccugcaugugccauccuccagauccucuguguugaugucuacuuugcuagggcccucaauggacagacuaagcccaccguagccugggaaauagauagcagcuauaagccagaaugccaaggaaagcuagcuguauugccccaacuagcagaccacacugccuaccugcaucucuggugucaauaauaaacucugcaggcucaaagguaugaccuucaugaagaccuugaccagagacccucacacggcuggcaucaccuaucuccgacuggcugaucacuacugggaugggacugcuugccacaugcuggccauucuucuucacauguaccaggugcuccccugucuccuugggcacgaaggaaaucccuaggcacaggauagggcuaucaacaagaugugggcccacaaucuucuuccuugcucccuuugucugaacacaggguauuuauuacaggcuaaaaugacuuuaacucauuauguagccaaugauugguuccccugauucuucuacuuacaccucccaaguauuaggacuaugggcagucaccacaccuggcuuucccucuuucacagaaacuuuugcucccucuugaccucuuacccacguggccauuucgcaaacguuucagcagacaggguuccucucgacccgaagguggcaccacaguggcugugaguaggcuaaggucuguuucugagauauugauggggauaucagcagcagaacccaccuuuaggugggacauacgcauggaaucgucaccugguaagggugcaagccaucagccacuauagauccagcccaaagagacugugaccucaugccaccuguuccugucauuacucccgaugcuccguaccuguuacucuggcaguaaagggacugccugggauguguugaucauuguacuuaacuaggaugcuauagucaccaggcaguacaggcagguaagagacacugcauguuccauccugguugucagugcaacugauuucugcuuuagauggacccucaauggccagagacaagcccccugaaaaauaucacagauaagagugagaacugugcccagagacacauugcugaaccuuugugggugaguugacuugauggcucagcaugaagguaagguagaaaacaccauucaggaucaucucccacauacaguucucagccaauggaggacaacuugggcaggucaaaccuagagcgucuccuuacccucuccugcauccuugguguugacagugaagguggcagguuuguugaccacuccauggguaaggccaggaccauaagcagugauguggccacaguugacauaaucaacauagaacugcagagggcuuccugagaccagaauagaagccacauggaauaccagacucauucauuuguuagucauuuugguucuguuuuugaaacagggucuuuauguuucucuggcuggcuuugaacuuacuaugaagcuaaggaugaccuugaaccacugauccuccugccucgagggcuaugauuacaggcaugugccaugauaccuaguuuauucagagccugaugcaugcuaggcucuacuaacugaccuauaacccagcccuagccuguucuuccugagaugauagcaacacgggccuaggauggaguggacaagaggcaauacacccaccugggauaugcauauugucauagcgaauguccauuucaugcaggccagcuucacugggugaguaacguacaguaacagugccaucuuuguuaucaguaauggaaggcugggccaccuugccugagggcauucgaacuuccccuacagagcagugguuucaaugucaggccaggagauuggaacacccuggccaucacuaguuuccaaguuucuuccuagcccucacucaccagugaucucccccuucuugauagugaaggggaugacaagaucaaagggccucaggcuggucacauccagcccauuaacgcccaccaugggccucucuggaaucugcaauagagacagaagaaucaggugaggggcuaugagaagauaugggguuucucagggccacaugagacauccagguggccagcuucaagugucccuauggguuagacaaauugaauaauagaccaggcccaggccuuacccagguuugcuggcuacccugaggauaguuauacuguggagccagcugcugagaccuuaauggggucugcacuguugguugguccccagccaaagccuguggggcaaagugagaggguuggagacuguugucacaaagggaccuggaaggacaggcuaggacuuucccagaucucccugcccacccauccuuggccucuucucacuguaacuuggaaggggcuguugggcacaugcucgccaccgaagcgcacacagaugacauauuugcccgguuggggagcuguguagaagaugucaaaggugccauccucauucuccaccacguccacgucuaccucugagccaucaggugugcacacaguacaagucacuuugccuuugccugcugcuuuuguguccacaguaaucaccgucuccuccccaaucuggaugguggggccaaugccagcaccugguaaagcagagugaauccccagaggggagccagcaggugagccgaacauuuuggcuacccccaucagcuugcuacccauccaggccucuuacugcuacaaccaagcacagccagccccaaucucuagcccaacccauaccccaagcuacgauggugagugguuucucagaaggcaggaaggauucuccugaccaccucaagccccuuuaugagagaagaccaacaagugguacccagauaccugggaagacaaguaagggaccauccaaucccagcacaagcauuuacugcuaccuccucugccaacucagccucagcugguaucauggccuaugcuaacuuauaccggcacucuggccaggcccauggcuaccuacacccguggucuggcccugggccccagugcuauguguggaugaagugaggcagaguccugcugcagugugggggaugugaaacuuuccucccuacccaaccccgaggccugaaggugaaacuggagucuccugacaacugagaacgcuugcucaaccagaggcuugcaaugagaggcagcauagcacagccuggcacaggcaagagcaagcagcagggaaguagaaggguuagcagugcaucacagcaggcuuggcaaagcaguggcagcacccaaggaacaggagacaggagucccaagccaccacugcaggguugcaaggguagagcaucugagcagccucuagggccccauagugcccaagaaaagagaaaggacaguaauguuaugaucuggggcucagcuguggaggcuugggagcuguggauuguaaggccuggcagccagagcaccccugcagcccagccucccacaaggaaagcagcuaggaacaccaaacuuauaugaggaccaaguuuaaggggcccccuugccagccugccaccaagcccccuuuucgaccuuggucucacacuggcuacaugagacucagauagcaacuucagcuauuacccuaguugccugcugcccaugcugccaugaacuuccuuuaugccugcccuguaucaucuagcuaaugauuugggccuucugaaagcuucuugauuucucauuucuguacccaagcuccaggugaucagcaagucuugaccauagcauccucaaaguacaccugcuaauugggcuacugcuuaaugucccaauagccacugaccgggcccaagacaaccuucuggcuuacccaaagaugauuuaaguucccuggcugggcgcccugacuccauuccacacauaauggccaagaaaauugaggccacuccaaguuccuggccuaauucuguccuccccuguguacacauauaugccaucuucaaccccauaaacuauucuacaaaauaaucuagccuuugccacaaaaaccuagcuaucuuaaauccuguccuuggccaucuacccaaaugccugucugauagccuucagaagucugcaaguaguuguagucucauaucaguauuccuaggaugucuuugucuuagggcagacaaaccugccugauagggacugucuaacaucauugcugggggaaugggaagaaagaaggaaaaaagauuggucgcagaaugcacuuuggagcucugaggcugggccaggcccugccaugcuggccacccaagcaguugacacuggcacuacuguaccaccacccagccccacccacucaugcaccucccccagcccaggacacagaggccccugggaggcggggauggaagucuguggaucugacaagggcuagacucccaguggguggaggaaaccaccuuguccccugagcccaugcaggagcccauacaggagcccuugugagaaggaagcaccugcugcccauccccaggugcuucccuggggugccaagauccccagaccccaaaauccccauugaggugccuccuaggauauacuucaccccaaagcucucagcugcaacccaaguucucagauggggaaauggaggcccagagaggggagaaccagagcgcucaugcuuagcuccagaaaccucccugggcccugacccuccagcccacggccuugucuucacagccuccccaacucuguccuugccuagagcugcagcuggaacuguccugggaaugaauuagcaaugaagaggaaaggaaacugccucucugggcaguaggggcauugggaguggccccagcaagcagcuuaccuagcccgugaccuccgauugacacugaggugagagggcagagagcaaggagaaaggucaggugagucacucaagggggcggcccccacucccacacgccgccccaagcagcgagcccuugcacacaggcacacccaagccccgugccaagcaacaccauggccgacggugggcuggcucaccugugacugugcacuugcuggcauccccagugggcacagcccggacacgguacggggaaaagggaaucucaucaccaccauacuugaugaggauuguguaccggccuggcacaucuggcacauaagccaccguguaugugccaucaugauuaucuugaaugugugucuucuugggcuugccuucaggauccuguguggcaaagcaaaggugaggagguugguccaagcccagcaagaccugaacuaucucaggccauaaaaacaccaaguacugguauaacagggaaauagcuucugggacccucaaccccccauggccccaguggcugccugucugguagagaccagaccggaagcuccccaaacaucuagcauucccugacaugacaagagaucagagagcaguuuggugcccaggcucaguccuaggccuauccuaguggcacuaggagcuuacaugaaagaucucaguguugcaacauuauaccuguccugugagaauacugcauguggagaaucugaagcacuacagguuuugguaccaugcuuaauagcaaugacuguguguuuggggaagcuuguuucuuucaacuugaagaaaacugcuauacauccuaauguuacauaagcagaggcccucuccuuagaguacagcuccaagcagacuaguuagcaaaacugagcugccugccuaucuguagcccuacauuccagcugcucagagcugguuccuugccucuccucccuacagaccaggaagucaggaagcucaccguaaucuggacagccaacagacccuccccagcauccuuggcaucaauggugaacuccacaggcaggcuagcagguacaccagugguguugaguccagguccacuggccuucaccuuacuggcaucauguguaggcagcaccuugaccuugaaggggcugugagauuaggguguuauaaaccaucagacaagcuuaaguaccuagccugcccccaacaagcaagugaacucugcuucuuaccuccguggcacuucuucuucaccauacagcacagaaaugcuauaggacccuucucggcugggcacauaguugacagucugaguaccaucagcauuguccacuacauccacuggcuccaccaggccuagccccaguccgaagaacagaaccuuagguuggcucuuuguacccacucccaacucccucucccugaaggacuaaggcuagacccaaagacuagaccuuauguuuuuaacuacccaauuccaggaauuccuuaggcccucccucuugccauaucuauucagugaccaagucccauccauuauaccuucucuaggguucugccugguuuugugguuaucugaaacccuucuacuaucugugcuaguccauaugauacuaggccuaaaaaaaaccuauguuuucauaacucccuguuaccaguaugugaagucuuaccuuugggccccugcacuuugaccugcaguggggcaacuccagcuuugcuuguguccaccugaaaggacugagggagguuggcacggaccaugccugggcuuaggccagguccagaacacuugacuuuagaugcaucugucacaucauguacagggaccuugaagggacuaccugggggucgauacagaaggauaauagcuauguaagacacugugaauauagcagagaguccuaguucuauccuugucaucaucuccucaccuggcacuuggugaccaccauaagugacauuaaggcuauagguuccagcuucauaggggauguauucuacugagcagcugccaucuuuauuauccauacaagacaucuuggccucugagggacccucaacagccaagcccaggccaccugugccagcuccccugguacaaacagacagucugucauuacuugggguucccaagcuuacucacugcuugcccaugcaucuucagugucucacucaccugguuucuacugugaacuuguuggguuuguuggugguaccacuuuggaugccugguccauggacacgcacccgggaggggucacagcccucuguuacaggcaccuggaaggggcugcugggcacagggcugccaucauaagucacauccacagaguguacuccugaaggacagggcaggucaggaauaacuaggcugcuccacuuacucccugcucugccuaagguauccccaguacauucauaccuuccucauauggaguguauuccacuuuguaugugccauccccacagucuugcacauagguaucugucagauugccugagggguuggccacucgagccuugacauguggcccuccagucuguguaagagcccgggcauccacacugaacucagugguugccucucggaagacaccuggaaaaggccauagugaggaggcuguggcuacaggacucuuugcacccuguaacugcuagccaaccccccuacagcgggccuccuuaccuugaccuucaaucccaggcccauagcacuguacaccugagguaucuacagcagguuccaccuguagcuugcuggggaaguugggcacaggcuggccgccauacuugaugguaacaguguaagccccaggacagagaggaauauagguaauggugugugugccaucaccauggucuugaauguauacuucagcuggcaguccugccucagagcagaucucaaucgucaacucagcacugccagcacuugaacaguccacuuggaacugcccuaccucaccagcaguagcccgcuccagcccagggccugagcacuucaccuuggaugcaucaaaacaaggagccacaugggccuugaauggggauccaggaaugugggugucagcaaaaaggauguugauguuguaguccccaggcucaguggguacauaagacacagagcauguaccauccccguugucuaggcacucaagcugugcuucacaggggccuuccacugucaggcccaggccaccagugccagcacccuuuguaucaauggugaagcgggcaggggagccugcauugccccccuguagcccugguccaaacgccuucaccugagggaaggaagaaaucagaagcaucuaucagcccaaccuuucaucugucuccuuuugcccuagguuucuuccuuacccagagacaugaaaggaauaggcugccuaauagaucaccugcucaaucauaccaggucuauagagugaguuccaagauacccagggcuggaaggaaggaaggaaggaaggaaggaaggaaggaaggaagggagggaggaagggagggagggagggagggagggagggagggagggagggagggagggagagagggagggaggaaagagagagagagagggagggaggaaggaagggagggagggagggagggagggaggaagggagggaggaaggaaggaaggaaggaucuucaccuuacagcuucaaaagaaaggaaggggaggggaggggaggggaggggaggggaggggaggggaggggaggggaggggagggaagggaagggaagggaagggaagggaagggaaggauggucuucuccuuauagacucccaaaccuaauuaccuugcuggguuuggugggggccacagcuucuaguggaaagggacugccagguacaggcacaccaucauaggucacuuccaccucauagggccccucuucacggggcacaaaacguaccacgcuguugucagcucccaggccuggcucuaccuugcaggguaccgcugcaccugagggacucacaaucuuggaugcuacuuugccuugaccaccugcacccuuugacuuuacugugaacucuugaucuuugccaacguccacuucuguugcaaugaugaaagcagagggaaaaaacaucauucaugcagcuccaggcaagacuaagcgggaugggguugacuggucuucaauggcaauggcaauuauagcaacuacuuacugucaccaaggccagacaccuugauuuugcugagauccaggcuuggagauacucccacugaaaauggacucuuggggaugugaucuccuccauaagugacauugacaccuacugggcccuuaaauggguacagaaggacagaggucacuaauuaguaaccccgguaucuuuggccuacagauguccagcuugaacaaguaugugauauuugcuccucagaccccuucucaggugagaaauuagaaaccccuugcaggagccuaccuagcauaccauauaaggaggauagagauagcuaccugcugcacaggaauguacuugacuguguagguauuaucaugguggucaaugauguccacaucccguacugcaucucccuuagccaguccugagaauuggacauccagcuugccuuucccagcaguuuuagcauugacugugaaauggguggguuugccaaguucaacaccugaggagauaaaacaacaaaauagaggcacccuacucugaguucccuauccuugguuccacucaaccuucuauaguacacucauccuuaccagugcgauuuaggccaggacccucagccuucaccuugcuggcaucaugagaaggcuccacuuugacucugauggggcugguggguguggccuguaagugaugggagaaaaacagcuaaggagagcagcauccuagcacuuggcagucuaggaacuaggagcaguaacaccuaccuggucagcaaaaaggaccaugaugguauagcugccagccccacaggguguguauuuuacagugaaggugucauugucauugcggaugauaucaaagucaauaucagccucaguggggcccacuacuccaggggcacacuugauaccaaugcugacaucuccugucauugagaagugggguaagaggaggcugggacuuuguggagacagccugcauaccugucaucccauucaaggauaggccuuacccuggccagcuucaguacaauccacaguaaaguagguagguucaugggccuugagcccagucuuggccacuccuggaccauacaccuugacuuuguuuggauggcugccagcucccacauucaccuguaggauauaggggaaagugaaaagacaggacaagccuguagcagaggagcuaagaggcucgcuucagccacuggugguagacagcaaauauugcugcugccuuggaacaacuggcaguuccucaaacagguaaaagugagcacaugauacuguaauucugcuucuagaaaacugagcaccuagguccacacaaacacccauauguuccuaccaacuauucauauagcccaaaaguaacaccucacauauccacaaaauagacauaguguuuuccauucacacaauuugauugaaaaauuauucagccauuaaaaagguaugaagcacugacaugcuacaauguugaaaaaccuucucaugacacucagugaaaaaaaacaagucauacaacgagcaugguagugcacaccuuuaaucccagcacucaggagacaaaagcagguagaucugugaguucaaggccagccuggucuacagagaguuuuccaggacaucuuggucuacauggugagauccuuucucaaaacaaacaaacaaacaaacaaacaagaaaaaccacaaacuaaaaaggucacaccguguaacacacacacacacacacacacacacacacacacacaucuauaugaaaggccccaaaaaggcaaauccauaaaucagugguugccagaggcuagaggaagggaaaugggaaggguaggaguuuccuuggagaugaugaaaauauccuagacuauagugauggcugccaacuacucugugaauguacuaaaagucaaguccacuauaaaugggaaaacuguauugauaugcaagcuuaaucuuguuaaaacuaauauaugaacaaaggagcucugggaugacuuacccggaaaggacuguuggggaugcugacaccuccccaagaaaccauggcugugugcuucacuggcuuucugggcacauaagaacagcuguaaguaccauugccauuguccuugacugucgcuuccacagagcagcccucauuguccuguaaggcaggcaaaagcaagcauucuguuagucagcacccaguccuaggagucuaucaguccuauccccaacaugaguaggcaucccaccugaacuugaacucgaagaggagccuucccagcaugcuuggcaucaacugugaacucugcuggcuuguugacagccacaccagucuucuccaauccaggcccacgugccuucaccuaguaagaaagaagaccaagguaaggccaccaaagucagacagggguaaguaacacauaguaaaagcauugucuaggaauaccagccagggucugagcucgugaccucagccuugcuggcaagaugagauaacgcccaccacuauaagccuucccaagcaaaagcagaaggccaggcucaggucaguuuugugugcacuuuacccugucugggugaaaauccuggggugccucacggaugucagccaugaaaggacugagacggauauccucacuguuacacagcacaugaacagcauacucgccagccuccuggggccaauagcgcacaucacaggagccaucacccuugucgucacauucaaucuuugccugugauggaccuuccacagagaaaccugacaacagccaucaguucuauuggugcucuggagucuugggauaggcugcccuugccacccucuaguccagguacccacucugaagccuccaacuuacccaaggugcccacaucaucaccaauggccucuacuacgaagucugcugacuugccaacaaugccuccuuccaggccaggaccccaugcccgaacuuucugauugccacacucagugccuaccuucaccucaaacggacugcaggcaagaguaccacacagguaaacaccaagagccacugcccuaugcccaacagccacuggccccucaccagauagaugguagggcucagaacaugaugaauaguggagggagcuuaccuucgaccaauguucuggccaccccaugugauggugacaguguaugugccagggauuguaggguaauauucaaagccauacacaccauccccuaaguccuucugcuuuacacgcuccucacccucugcaaaagcaaggaagaacuuaggccugcuuguccaaccaugaccugaggucuaucacccaccaccccaccagauaaacuuacugggacccuuuacagugaccuuuagcuccccacugccagcgcccuuuguguacaccuugaagucggcuguuuccuucacucgaacacccuugggcugaaggccucuaccaauagcccggcaggcagcuggguuacaggcugugggcaaauaagccagcugaguuguggggaacuggggcuggguauccccucccuugcuacccagaaaaccaggccauuaggauuggaagguuccucagaguuuaggaccacaagcuggugaagcacaugcaagaaaaaacuuaaaugggucuagaaccuguacccaaagcaaagacaugacaggcuuuuucccaccugcuugacacuaaccccaauaccccuacccaguccuccccaccaagagaaagguagauccaaguaccguugacccugcagguagagcagagagcagcagguuucuagacagcuggagcgagcucuuccgaagguaaaagcauggagaaaagagacgaagaggggcaaagagaggaaggagagcaaaagggcuccaauaugggaaaggaaagauagugcuugcccaaacaguggaagcucagaaacuggggcucccaaacaugggcuucagugggacagucccaguugccaacucccucccuagagccccaggccauaguaccacaguagaagaacacucaugggcaggccuaccuuggccaacagugacaguguaggggcuacgagggaugggaacaccggcgaaggugacauguacuguauggacacccuccauggugggcugauagcuacagcgauaggugcugucaccccuggccuccagcugagguuccacugugccuuucuguccuguaggguccuggaugacaacuuccaccucacccaugccagcuccugucccaaggcacagacucagcucuaggaccccagcacagcucucccccauggcuggcugggccugggcugucuccccucaccugcagugaagaucucaaaguagguagucuuguuggcaauauugccacugggcuccagaccagggcccugggcagucacuuugcuggcaucacccugugacuuguccacauacaccucaaaggggcucuuggcaauauguuggccagcaaagagcacagucaccuguucccagaaggggcaggcugugagagugagguaaggggcccuucaccaacuacccauggccaccagcuuccuucucagccaaggacucaccuuaugagucccugucacuucagggacauaccagacagagaaaguacgguucuugucauuauuggcagucacuuuugccuguaaugggaagaguguuaagagcaaccccuuuaaaagggggcauaacagaauccugcccugcuaauggauaauccuaccucuuccugguguccagcuggguccuccacauauacaagcacuucucccuguccagcacuucgggucuccacagugaauucugcucucuucuucaccauauugccuguaggcucgaugccugucagaagaugagaaagccaugaaccaacuaguagggcuacccucucaccucuauacccugguucccagacccuaaaggguuauggacacagcauuagagacccuaucccucugcaggcucagugccccucccccagcuagguacaauccaaucagguagauuuguucaauguaaacccagcauugagccgggccucagauccaugcuauaugggcuauugccaccaagacaggcccaugccuguucucugaaaaaucugguuugcuguacuuuccuaaccccuugcaccugcacaauccugacugcuucaucuccaauuauagaauagcaguacacgaggucauccuucauacgugagguucuucuccuucaaucaagaagcuuccuacaagccaguaugacuuaaggaacuuacuaguauucccuugccaaggcaccauuuuuaaccagguuuugauccauucaucuuccucaagaccucuuaggacccaaaaugaaagagaauacugucccauggaccggauauaagugcucagccccuuggaaugccacugaccaggcccccucaccuggcccauaggcucgggcuuucuucggguucaguuugggccgaagaggagccccuggcuucagcuuggccuugggaaacugagacagguaggucauaacagaaugcucaucuacauugggguccacaauuucuucugggguaaucaccuguuacagacagaagacaagagccauugggucucucuucacuuuaaccaagcaccccuuagcugcaggggucaguccgggagcauaccugaggaaugccuagccagucaucagccugcugcauggcuucccgugcauuguucacaggcuuacuagcaucccaggagucccagucaggacauaggccuacaacacagaaaagaacuuguugugagucuggggcuauagagcuaccuucuagguugaccagacagucuuagcccaagaucucccuuaccuggggcacagcuaucaacaagagcacccagggcccggccacucugccagucucgacugaaguugguaaugggaagcugugguagcuuguucugaauccagccuagaagccucugcuuggguguuugcuucuuggccuccucauccucuuccucaucccacaugggcauugagauggaauagugcaggaucaggguccagaugaggccuaagaucagcuucagauuuccauccacaauagccuugcugucugugggaaaaggcguggcggcauugcaguuaggguauucccucaugaaggccagcaaggagggaccuaggucugcagcacagcaaaucaauuaggugacaagaggccccucccaacuagggguagaaaguggaucaggcacccucugcccagggcaucuaaaugguguaagaaaauauuuugugauaaaggagaguuugggggggaaagacucccauagacacauaauacaauccaauaaaagggacccugccaaaaaccgcaaagcccagaaggaggguggaagagcaagugagauggaugcuguacagcugcugagaucaagaccugcccuaauaucuugagaucuaugggaauugggagaaguggcucagcccuaacuggccaagaaacagggccccugaccucaagcuggguuggaaccaaagaagaggaaggcuaaguuggcaaagaguaguuaggaaauacaacugcugcuccagagugggggaaaagacagaggaaguguuggcaaggauccuuguguaaaagggugcgagcuccacccuuugcuacuuccuugucucucuacccccaaacuaguaaauaggagguggaacaaaagagggcuagcuuggggaagggggccacaagucaaaggaacuauguuuaguucugacucauugaggcuuauagggaacuucuggggugacagcccccauugcccagcugaaagaggaagaguagaaccgccaaggaaaccauagguccuuaguaggcuggguuagccugccuuuggugccaaagagcacuugggaaccccuguugcagaggccuugggugguguucuuaaguccugcuguuucagcauaaccugcuuagaugcuacucaccacccagccuacuugccaccuaacgggcuaggucucaggcagccaccaggcuuaccacaaaggaagugguuagggcgggcacccuaaacacccaucacuauggcaacuccccugagccccacccaaagccaccucuuuaaccuccucaaggguggauggcuuauggugaguagcauuuucuaaggcucaucuuuggaaacccuacaggacuucccuguaaucagagaauguuuaucuagugagucaauggagaauggucaugaaaacuaggauaucacugagagagcagguaacauuccagugcagugggaaagcaccuggagaacugcuaucugagccucucaaacagagugaucuuucccauucacaaacugguccuggcccuucgagaauguuuuucauuguuccaaaauacagagaggaugggaaaggaaguugaaaaaaagucaaggacacaaagauccuacccuaccaaacaaagccacaggcccaucacaaaaacccccaaggagaucauagguccuuaguagucuccaaggggaagaacaaagacagacccaucaucccaguaagguacaucuggucccuccccuggucugauuaggugagcuaugccagcuucauaucccucccaagaggagaggaucagggcccaguguugggaagcagcuugguaagauggccccgccccaucccaccccuuauccccagccccugggccagccggcccccucccuccccuaaucacugcugcuuuccaacauuuuuuugccuuauauggcaaagcucugggaacuaggccugcuccagccagcucacaagaaggaggggagaaagaaggagggaggagacccccccuaaagagcugggguguggccugccuccccacauccgguugcccccuuccaagacuuagaaaugacucagcuggcuagacugaggcugggacuaggggugaguuuucauacauccacuggcacaccucuaugagcauuuaaaaaaaaaaaaaaacucagcacuuaaaaucugcucucugaagggccuuggucccucgcuguuuuaacuagcauguaccauuccaaaguuguaaggauaauagaaaacccuuuguauuauggaguaaagguccacucuucuacucucccuguuccacauucccaagauaacaauucuggugccuguccaugagcagccccuacuuugagaaaagcaugggauccugcaagagacaauaccaaugccaaccucuccaguucaaagacuugggaacuggacuagcaguaaacccugugcacauuggagcaccuuucaaccaaucucugcauucuagauguacaaaaccaagguuuacaaugaaacaagaauuugauccaugauagacagcaaagcuaacaaccaagugcucgugccuuuagucaaccacacucauuacaccuggaguacaguuuugccagcaguauaucucuuugccccccuccaaguucagcaaaaaaagaaagaaagaaagaaagaaacuggggauuugaacuaucuccaauggggaagcauguuccagggcaagaaguugagggaguccuacauaaauaggagaacaagcuacaaccuucacuuuagaacugcagaggcagccaaaugcuagaaggguacuuuuaaaauuguuguagguggaaagcauggguaucccagggauggggugcggcucucagaggcagaagccuagucugugccugucccaccucgggugcagcguugggggcgcggccuacagaggaugugagcucagccugggagcaggccagcaaggcgcugcgggcgggggcgcguagcgguucgcaugcucgccaggccagccuuuuguucucgaggaccucaaagaacaaggcggcuaaggggccuagugguagccuugguugugugcagcagcuagggaagacaacuaggagagacucuagaggagaagaaaggaagaauuuguugcgaccacgcccgcacccacucagcgccccaguguagcccgugcccucaccuauggacacgagcuugaugcucucacgguccaggaauucaagcgccaccgacacauuuucgagcugcaucuggcggaaagugggucuuugguugugcuugcggugcauuuucuucuggcugaguaccucgagcagcgcgaugagccgcaacccaucgcucagguccgucugcagauuggcgaugcgcuugcuuacgcacuuaaggugcucauugcaccagcgggugaauguguucugcugaauuuucuuccacggugcaucuucugcuaggucuuuuucgguagccggcaucuccgcgucccgugaaucgauacugccucccggagacgcaaccgccgcacucuggccacagcgggagugagagcuacucauuuugaggcgcgaggaacggaggggcggugcugcagcuucgccgaugggacggcccuuuaauuaaagcaguaggcaccuccgagcaugaacgacgaggc

SEQ ID NO: 12591 - RNA, 23075 nt, Mus musculus
gccucgucguucaugcucggaggugccuacugcuuuaauuaaagggccgucccaucggcgaagcugcagcaccgccccuccguuccucgcgccucaaaaugaguagcucucacucccgcuguggccagagugcggcgguugcgucuccgggaggcaguaucgauucacgggacgcggagaugccggcuaccgaaaaagaccuagcagaagaugcaccguggaagaaaauucagcagaacacauucacccgcuggugcaaugagcaccuuaagugcguaagcaagcgcaucgccaaucugcagacggaccugagcgauggguugcggcucaucgcgcugcucgagguacucagccagaagaaaaugcaccgcaagcacaaccaaagacccacuuuccgccagaugcagcucgaaaaugugucgguggcgcuugaauuccuggaccgugagagcaucaagcucguguccauaggugagggcacgggcuacacuggggcgcugagugggugcgggcguggucgcaacaaauucuuccuuucuucuccucuagagucucuccuaguugucuucccuagcugcugcacacaaccaaggcuaccacuaggccccuuagccgccuuguucuuugagguccucgagaacaaaaggcuggccuggcgagcaugcgaaccgcuacgcgcccccgcccgcagcgccuugcuggccugcucccaggcugagcucacauccucuguaggccgcgcccccaacgcugcacccgaggugggacaggcacagacuaggcuucugccucugagagccgcaccccaucccugggauacccaugcuuuccaccuacaacaauuuuaaaaguacccuucuagcauuuggcugccucugcaguucuaaagugaagguuguagcuuguucuccuauuuauguaggacucccucaacuucuugcccuggaacaugcuuccccauuggagauaguucaaauccccaguuucuuucuuucuuucuuucuuuuuuugcugaacuuggaggggggcaaagagauauacugcuggcaaaacuguacuccagguguaaugagugugguugacuaaaggcacgagcacuugguuguuagcuuugcugucuaucauggaucaaauucuuguuucauuguaaaccuugguuuuguacaucuagaaugcagagauugguugaaaggugcuccaaugugcacaggguuuacugcuaguccaguucccaagucuuugaacuggagagguuggcauugguauugucucuugcaggaucccaugcuuuucucaaaguaggggcugcucauggacaggcaccagaauuguuaucuugggaauguggaacagggagaguagaagaguggaccuuuacuccauaauacaaaggguuuucuauuauccuuacaacuuuggaaugguacaugcuaguuaaaacagcgagggaccaaggcccuucagagagcagauuuuaagugcugaguuuuuuuuuuuuuuuaaaugcucauagaggugugccaguggauguaugaaaacucaccccuagucccagccucagucuagccagcugagucauuucuaagucuuggaagggggcaaccggauguggggaggcaggccacaccccagcucuuuagggggggucuccucccuccuucuuucuccccuccuucuugugagcuggcuggagcaggccuaguucccagagcuuugccauauaaggcaaaaaaauguuggaaagcagcagugauuaggggagggagggggccggcuggcccaggggcuggggauaaggggugggauggggcggggccaucuuaccaagcugcuucccaacacugggcccugauccucuccucuugggagggauaugaagcuggcauagcucaccuaaucagaccaggggagggaccagauguaccuuacugggaugaugggucugucuuuguucuuccccuuggagacuacuaaggaccuaugaucuccuuggggguuuuugugaugggccuguggcuuuguuugguaggguaggaucuuuguguccuugacuuuuuuucaacuuccuuucccauccucucuguauuuuggaacaaugaaaaacauucucgaagggccaggaccaguuugugaaugggaaagaucacucuguuugagaggcucagauagcaguucuccaggugcuuucccacugcacuggaauguuaccugcucucucagugauauccuaguuuucaugaccauucuccauugacucacuagauaaacauucucugauuacagggaaguccuguaggguuuccaaagaugagccuuagaaaaugcuacucaccauaagccauccacccuugaggagguuaaagagguggcuuuggguggggcucaggggaguugccauagugauggguguuuagggugcccgcccuaaccacuuccuuugugguaagccugguggcugccugagaccuagcccguuagguggcaaguaggcuggguggugaguagcaucuaagcagguuaugcugaaacagcaggacuuaagaacaccacccaaggccucugcaacagggguucccaagugcucuuuggcaccaaaggcaggcuaacccagccuacuaaggaccuaugguuuccuuggcgguucuacucuuccucuuucagcugggcaaugggggcugucaccccagaaguucccuauaagccucaaugagucagaacuaaacauaguuccuuugacuuguggcccccuuccccaagcuagcccucuuuuguuccaccuccuauuuacuaguuuggggguagagagacaaggaaguagcaaaggguggagcucgcacccuuuuacacaaggauccuugccaacacuuccucugucuuuucccccacucuggagcagcaguuguauuuccuaacuacucuuugccaacuuagccuuccucuucuuugguuccaacccagcuugaggucaggggcccuguuucuuggccaguuagggcugagccacuucucccaauucccauagaucucaagauauuagggcaggucuugaucucagcagcuguacagcauccaucucacuugcucuuccacccuccuucugggcuuugcgguuuuuggcagggucccuuuuauuggauuguauuaugugucuaugggagucuuucccccccaaacucuccuuuaucacaaaauauuuucuuacaccauuuagaugcccugggcagagggugccugauccacuuucuaccccuaguugggaggggccucuugucaccuaauugauuugcugugcugcagaccuaggucccuccuugcuggccuucaugagggaauacccuaacugcaaugccgccacgccuuuucccacagacagcaaggcuauuguggauggaaaucugaagcugaucuuaggccucaucuggacccugauccugcacuauuccaucucaaugcccaugugggaugaggaagaggaugaggaggccaagaagcaaacacccaagcagaggcuucuaggcuggauucagaacaagcuaccacagcuucccauuaccaacuucagucgagacuggcagaguggccgggcccugggugcucuuguugauagcugugccccagguaagggagaucuugggcuaagacugucuggucaaccuagaagguagcucuauagccccagacucacaacaaguucuuuucuguguuguaggccuauguccugacugggacuccugggaugcuaguaagccugugaacaaugcacgggaagccaugcagcaggcugaugacuggcuaggcauuccucagguaugcucccggacugaccccugcagcuaaggggugcuugguuaaagugaagagagacccaauggcucuugucuucugucuguaacaggugauuaccccagaagaaauuguggaccccaauguagaugagcauucuguuaugaccuaccugucucaguuucccaaggccaagcugaagccaggggcuccucuucggcccaaacugaacccgaagaaagcccgagccuaugggccaggugagggggccuggucaguggcauuccaaggggcugagcacuuauauccgguccaugggacaguauucucuuucauuuuggguccuaagaggucuugaggaagaugaauggaucaaaaccugguuaaaaauggugccuuggcaagggaauacuaguaaguuccuuaagucauacuggcuuguaggaagcuucuugauugaaggagaagaaccucacguaugaaggaugaccucguguacugcuauucuauaauuggagaugaagcagucaggauugugcaggugcaagggguuaggaaaguacagcaaaccagauuuuucagagaacaggcaugggccugucuugguggcaauagcccauauagcauggaucugaggcccggcucaaugcuggguuuacauugaacaaaucuaccugauuggauuguaccuagcugggggaggggcacugagccugcagagggauagggucucuaaugcuguguccauaacccuuuagggucugggaaccaggguauagaggugagaggguagcccuacuaguugguucauggcuuucucaucuucugacaggcaucgagccuacaggcaauauggugaagaagagagcagaauucacuguggagacccgaagugcuggacagggagaagugcuuguauauguggaggacccagcuggacaccaggaagagguaggauuauccauuagcagggcaggauucuguuaugcccccuuuuaaagggguugcucuuaacacucuucccauuacaggcaaaagugacugccaauaaugacaagaaccguacuuucucugucugguaugucccugaagugacagggacucauaaggugaguccuuggcugagaaggaagcugguggccauggguaguuggugaagggccccuuaccucacucucacagccugccccuucugggaacaggugacugugcucuuugcuggccaacauauugccaagagccccuuugagguguauguggacaagucacagggugaugccagcaaagugacugcccagggcccuggucuggagcccaguggcaauauugccaacaagacuaccuacuuugagaucuucacugcaggugaggggagacagcccaggcccagccagccaugggggagagcugugcugggguccuagagcugagucugugccuugggacaggagcuggcaugggugagguggaaguugucauccaggacccuacaggacagaaaggcacaguggaaccucagcuggaggccaggggugacagcaccuaucgcuguagcuaucagcccaccauggaggguguccauacaguacaugucaccuucgccgguguucccaucccucguagccccuacacugucacuguuggccaagguaggccugcccaugaguguucuucuacugugguacuauggccuggggcucuagggagggaguuggcaacugggacugucccacugaagcccauguuugggagccccaguuucugagcuuccacuguuugggcaagcacuaucuuuccuuucccauauuggagcccuuuugcucuccuuccucucuuugccccucuucgucucuuuucuccaugcuuuuaccuucggaagagcucgcuccagcugucuagaaaccugcugcucucugcucuaccugcagggucaacgguacuuggaucuaccuuucucuugguggggaggacuggguagggguauugggguuagugucaagcaggugggaaaaagccugucaugucuuugcuuuggguacagguucuagacccauuuaaguuuuuucuugcaugugcuucaccagcuugugguccuaaacucugaggaaccuuccaauccuaauggccugguuuucuggguagcaagggaggggauacccagccccaguuccccacaacucagcuggcuuauuugcccacagccuguaacccagcugccugccgggcuauugguagaggccuucagcccaaggguguucgagugaaggaaacagccgacuucaagguguacacaaagggcgcuggcaguggggagcuaaaggucacuguaaagggucccaguaaguuuaucuggugggguggugggugauagaccucaggucaugguuggacaagcaggccuaaguucuuccuugcuuuugcagagggugaggagcguguaaagcagaaggacuuaggggaugguguguauggcuuugaauauuacccuacaaucccuggcacauacacugucaccaucacaugggguggccagaacauuggucgaagguaagcucccuccacuauucaucauguucugagcccuaccaucuaucuggugaggggccaguggcuguugggcauagggcaguggcucuugguguuuaccugugugguacucuugccugcaguccguuugaggugaagguaggcacugaguguggcaaucagaaaguucgggcaugggguccuggccuggaaggaggcauuguuggcaagucagcagacuucguaguagaggccauuggugaugaugugggcaccuuggguaaguuggaggcuucagaguggguaccuggacuagaggguggcaagggcagccuaucccaagacuccagagcaccaauagaacugauggcuguugucagguuucucuguggaagguccaucacaggcaaagauugaaugugacgacaagggugauggcuccugugaugugcgcuauuggccccaggaggcuggcgaguaugcuguucaugugcuguguaacagugaggauauccgucucaguccuuucauggcugacauccgugaggcaccccaggauuuucacccagacaggguaaagugcacacaaaacugaccugagccuggccuucugcuuuugcuugggaaggcuuauaguggugggcguuaucucaucuugccagcaaggcugaggucacgagcucagacccuggcugguauuccuagacaaugcuuuuacuauguguuacuuaccccugucugacuuugguggccuuaccuuggucuucuuucuuacuaggugaaggcacgugggccuggauuggagaagacugguguggcugucaacaagccagcagaguucacaguugaugccaagcaugcugggaaggcuccucuucgaguucaaguucaggugggaugccuacucauguuggggauaggacugauagacuccuaggacugggugcugacuaacagaaugcuugcuuuugccugccuuacaggacaaugagggcugcucuguggaagcgacagucaaggacaauggcaaugguacuuacagcuguucuuaugugcccagaaagccagugaagcacacagccaugguuucuuggggaggugucagcauccccaacaguccuuuccggguaagucaucccagagcuccuuuguucauauauuaguuuuaacaagauuaagcuugcauaucaauacaguuuucccauuuauaguggacuugacuuuuaguacauucacagaguaguuggcagccaucacuauagucuaggauauuuucaucaucuccaaggaaacuccuacccuucccauuucccuuccucuagccucuggcaaccacugauuuauggauuugccuuuuuggggccuuucauauagauguguguguguguguguguguguguguguguguguguuacacggugugaccuuuuuaguuugugguuuuucuuguuuguuuguuuguuuguuuguuuugagaaaggaucucaccauguagaccaagauguccuggaaaacucucuguagaccaggcuggccuugaacucacagaucuaccugcuuuugucuccugagugcugggauuaaaggugugcacuaccaugcucguuguaugacuuguuuuuuuucacugagugucaugagaagguuuuucaacauuguagcaugucagugcuucauaccuuuuuaauggcugaauaauuuuucaaucaaauugugugaauggaaaacacuaugucuauuuuguggauaugugagguguuacuuuugggcuauaugaauaguugguaggaacauauggguguuuguguggaccuaggugcucaguuuucuagaagcagaauuacaguaucaugugcucacuuuuaccuguuugaggaacugccaguuguuccaaggcagcagcaauauuugcugucuaccaccaguggcugaagcgagccucuuagcuccucugcuacaggcuuguccugucuuuucacuuuccccuauauccuacaggugaaugugggagcuggcagccauccaaacaaagucaagguguaugguccaggaguggccaagacugggcucaaggcccaugaaccuaccuacuuuacuguggauuguacugaagcuggccaggguaaggccuauccuugaaugggaugacagguaugcaggcugucuccacaaagucccagccuccucuuaccccacuucucaaugacaggagaugucagcauugguaucaagugugccccuggaguagugggccccacugaggcugauauugacuuugauaucauccgcaaugacaaugacaccuucacuguaaaauacacacccuguggggcuggcagcuauaccaucaugguccuuuuugcugaccagguagguguuacugcuccuaguuccuagacugccaagugcuaggaugcugcucuccuuagcuguuuuucucccaucacuuacaggccacacccaccagccccaucagagucaaaguggagccuucucaugaugccagcaaggugaaggcugaggguccuggccuaaaucgcacugguaaggaugaguguacuauagaagguugaguggaaccaaggauagggaacucagaguagggugccucuauuuuguuguuuuaucuccucagguguugaacuuggcaaacccacccauuucacagucaaugcuaaaacugcugggaaaggcaagcuggauguccaauucucaggacuggcuaagggagaugcaguacgggauguggacaucauugaccaccaugauaauaccuacacagucaaguacauuccugugcagcagguagcuaucucuauccuccuuauaugguaugcuagguaggcuccugcaagggguuucuaauuucucaccugagaaggggucugaggagcaaauaucacauacuuguucaagcuggacaucuguaggccaaagauaccgggguuacuaauuagugaccucuguccuucuguacccauuuaagggcccaguaggugucaaugucacuuauggaggagaucacauccccaagaguccauuuucagugggaguaucuccaagccuggaucucagcaaaaucaaggugucuggccuuggugacaguaaguaguugcuauaauugccauugccauugaagaccagucaaccccaucccgcuuagucuugccuggagcugcaugaaugauguuuuuucccucugcuuucaucauugcaacagaaguggacguuggcaaagaucaagaguucacaguaaagucaaagggugcagguggucaaggcaaaguagcauccaagauugugagucccucaggugcagcgguacccugcaagguagagccaggccugggagcugacaacagcgugguacguuuugugccccgugaagaggggcccuaugagguggaagugaccuaugauggugugccuguaccuggcagucccuuuccacuagaagcuguggcccccaccaaacccagcaagguaauuagguuugggagucuauaaggagaagaccauccuucccuucccuucccuucccuucccuucccuucccuccccuccccuccccuccccuccccuccccuccccuccccuccccuccccuccccuuccuuucuuuugaagcuguaaggugaagauccuuccuuccuuccuuccucccucccuuccucccucccucccucccucccucccuuccuuccucccucccucucucucucucuuuccucccucccucucucccucccucccucccucccucccucccucccucccucccucccucccuuccucccucccuuccuuccuuccuuccuuccuuccuuccuuccuuccuuccagcccuggguaucuuggaacucacucuauagaccugguaugauugagcaggugaucuauuaggcagccuauuccuuucaugucucuggguaaggaagaaaccuagggcaaaaggagacagaugaaagguugggcugauagaugcuucugauuucuuccuucccucaggugaaggcguuuggaccagggcuacaggggggcaaugcaggcuccccugcccgcuucaccauugauacaaagggugcuggcacugguggccugggccugacaguggaaggccccugugaagcacagcuugagugccuagacaacggggaugguacaugcucugugucuuauguacccacugagccuggggacuacaacaucaacauccuuuuugcugacacccacauuccuggauccccauucaaggcccauguggcuccuuguuuugaugcauccaaggugaagugcucaggcccugggcuggagcgggcuacugcuggugagguagggcaguuccaaguggacuguucaagugcuggcagugcugaguugacgauugagaucugcucugaggcaggacugccagcugaaguauacauucaagaccauggugauggcacacacaccauuaccuauauuccucucuguccuggggcuuacacuguuaccaucaaguauggcggccagccugugcccaacuuccccagcaagcuacagguggaaccugcuguagauaccucagguguacagugcuaugggccugggauugaaggucaagguaaggaggcccgcuguagggggguuggcuagcaguuacagggugcaaagaguccuguagccacagccuccucacuauggccuuuuccaggugucuuccgagaggcaaccacugaguucaguguggaugcccgggcucuuacacagacuggagggccacaugucaaggcucgaguggccaaccccucaggcaaucugacagauaccuaugugcaagacuguggggauggcacauacaaaguggaauacacuccauaugaggaagguaugaauguacuggggauaccuuaggcagagcagggaguaaguggagcagccuaguuauuccugaccugcccuguccuucaggaguacacucuguggaugugacuuaugauggcagcccugugcccagcagccccuuccaggugccuguaacagagggcugugaccccucccgggugcguguccauggaccaggcauccaaagugguaccaccaacaaacccaacaaguucacaguagaaaccaggugagugagacacugaagaugcaugggcaagcagugaguaagcuugggaaccccaaguaaugacagacugucuguuuguaccaggggagcuggcacagguggccugggcuuggcuguugagggucccucagaggccaagaugucuuguauggauaauaaagauggcagcugcucaguagaauacauccccuaugaagcuggaaccuauagccuuaaugucacuuaugguggucaccaagugccaggugaggagaugaugacaaggauagaacuaggacucucugcuauauucacagugucuuacauagcuauuauccuucuguaucgacccccagguagucccuucaaggucccuguacaugaugugacagaugcaucuaaagucaaguguucuggaccuggccuaagcccaggcaugguccgugccaaccucccucaguccuuucagguggacacaagcaaagcuggaguugccccacugcaggucaaagugcaggggcccaaagguaagacuucacauacugguaacagggaguuaugaaaacauagguuuuuuuuaggccuaguaucauauggacuagcacagauaguagaaggguuucagauaaccacaaaaccaggcagaacccuagagaagguauaauggaugggacuuggucacugaauagauauggcaagagggagggccuaaggaauuccuggaauuggguaguuaaaaacauaaggucuagucuuugggucuagccuuaguccuucagggagagggaguugggaguggguacaaagagccaaccuaagguucuguucuucggacuggggcuaggccugguggagccaguggauguaguggacaaugcugaugguacucagacugucaacuaugugcccagccgagaaggguccuauagcauuucugugcuguauggugaagaagaagugccacggagguaagaagcagaguucacuugcuuguugggggcaggcuagguacuuaagcuugucugaugguuuauaacacccuaaucucacagccccuucaaggucaaggugcugccuacacaugaugccaguaaggugaaggccaguggaccuggacucaacaccacugguguaccugcuagccugccuguggaguucaccauugaugccaaggaugcuggggagggucuguuggcuguccagauuacggugagcuuccugacuuccuggucuguagggaggagaggcaaggaaccagcucugagcagcuggaauguagggcuacagauaggcaggcagcucaguuuugcuaacuagucugcuuggagcuguacucuaaggagagggccucugcuuauguaacauuaggauguauagcaguuuucuucaaguugaaagaaacaagcuuccccaaacacacagucauugcuauuaagcaugguaccaaaaccuguagugcuucagauucuccacaugcaguauucucacaggacagguauaauguugcaacacugagaucuuucauguaagcuccuagugccacuaggauaggccuaggacugagccugggcaccaaacugcucucugaucucuugucaugucagggaaugcuagauguuuggggagcuuccggucuggucucuaccagacaggcagccacuggggccaugggggguugagggucccagaagcuauuucccuguuauaccaguacuugguguuuuuauggccugagauaguucaggucuugcugggcuuggaccaaccuccucaccuuugcuuugccacacaggauccugaaggcaagcccaagaagacacacauucaagauaaucaugauggcacauacacgguggcuuaugugccagaugugccaggccgguacacaauccucaucaaguaugguggugaugagauucccuuuuccccguaccguguccgggcugugcccacuggggaugccagcaagugcacagucacaggugagccagcccaccgucggccaugguguugcuuggcacggggcuugggugugccugugugcaagggcucgcugcuuggggcggcgugugggagugggggccgcccccuugagugacucaccugaccuuucuccuugcucucugcccucucaccucagugucaaucggaggucacgggcuagguaagcugcuugcuggggccacucccaaugccccuacugcccagagaggcaguuuccuuuccucuucauugcuaauucauucccaggacaguuccagcugcagcucuaggcaaggacagaguuggggaggcugugaagacaaggccgugggcuggagggucagggcccagggagguuucuggagcuaagcaugagcgcucugguucuccccucucugggccuccauuuccccaucugagaacuuggguugcagcugagagcuuuggggugaaguauauccuaggaggcaccucaauggggauuuuggggucuggggaucuuggcaccccagggaagcaccuggggaugggcagcaggugcuuccuucucacaagggcuccuguaugggcuccugcaugggcucaggggacaaggugguuuccuccacccacugggagucuagcccuugucagauccacagacuuccauccccgccucccaggggccucuguguccugggcugggggaggugcaugaguggguggggcuggguggugguacaguagugccagugucaacugcuuggguggccagcauggcagggccuggcccagccucagagcuccaaagugcauucugcgaccaaucuuuuuuccuucuuucuucccauucccccagcaaugauguuagacagucccuaucaggcagguuugucugcccuaagacaaagacauccuaggaauacugauaugagacuacaacuacuugcagacuucugaaggcuaucagacaggcauuuggguagauggccaaggacaggauuuaagauagcuagguuuuuguggcaaaggcuagauuauuuuguagaauaguuuaugggguugaagauggcauauauguguacacaggggaggacagaauuaggccaggaacuuggaguggccucaauuuucuuggccauuauguguggaauggagucagggcgcccagccagggaacuuaaaucaucuuuggguaagccagaagguugucuugggcccggucaguggcuauugggacauuaagcaguagcccaauuagcagguguacuuugaggaugcuauggucaagacuugcugaucaccuggagcuuggguacagaaaugagaaaucaagaagcuuucagaaggcccaaaucauuagcuagaugauacagggcaggcauaaaggaaguucauggcagcaugggcagcaggcaacuaggguaauagcugaaguugcuaucugagucucauguagccagugugagaccaaggucgaaaagggggcuugguggcaggcuggcaagggggccccuuaaacuugguccucauauaaguuugguguuccuagcugcuuuccuugugggaggcugggcugcaggggugcucuggcugccaggccuuacaauccacagcucccaagccuccacagcugagccccagaucauaacauuacuguccuuucucuuuucuugggcacuauggggcccuagaggcugcucagaugcucuacccuugcaacccugcagugguggcuugggacuccugucuccuguuccuugggugcugccacugcuuugccaagccugcugugaugcacugcuaacccuucuacuucccugcugcuugcucuugccugugccaggcugugcuaugcugccucucauugcaagccucugguugagcaagcguucucaguugucaggagacuccaguuucaccuucaggccucgggguuggguagggaggaaaguuucacaucccccacacugcagcaggacucugccucacuucauccacacauagcacuggggcccagggccagaccacggguguagguagccaugggccuggccagagugccgguauaaguuagcauaggccaugauaccagcugaggcugaguuggcagaggagguagcaguaaaugcuugugcugggauuggauggucccuuacuugucuucccagguaucuggguaccacuuguuggucuucucucauaaaggggcuugagguggucaggagaauccuuccugccuucugagaaaccacucaccaucguagcuugggguauggguugggcuagagauuggggcuggcugugcuugguuguagcaguaagaggccuggauggguagcaagcugauggggguagccaaaauguucggcucaccugcuggcuccccucuggggauucacucugcuuuaccaggugcuggcauuggccccaccauccagauuggggaggagacggugauuacuguggacacaaaagcagcaggcaaaggcaaagugacuuguacugugugcacaccugauggcucagagguagacguggacgugguggagaaugaggauggcaccuuugacaucuucuacacagcuccccaaccgggcaaauaugucaucugugugcgcuucgguggcgagcaugugcccaacagccccuuccaaguuacagugagaagaggccaaggaugggugggcagggagaucugggaaaguccuagccuguccuuccaggucccuuugugacaacagucuccaacccucucacuuugccccacaggcuuuggcuggggaccaaccaacagugcagaccccauuaaggucucagcagcuggcuccacaguauaacuauccucaggguagccagcaaaccuggguaaggccugggccuggucuauuauucaauuugucuaacccauagggacacuugaagcuggccaccuggaugucucauguggcccugagaaaccccauaucuucucauagccccucaccugauucuucugucucuauugcagauuccagagaggcccauggugggcguuaaugggcuggaugugaccagccugaggcccuuugaucuugucauccccuucacuaucaagaagggggagaucacuggugagugagggcuaggaagaaacuuggaaacuagugauggccaggguguuccaaucuccuggccugacauugaaaccacugcucuguaggggaaguucgaaugcccucaggcaagguggcccagccuuccauuacugauaacaaagauggcacuguuacuguacguuacucacccagugaagcuggccugcaugaaauggacauucgcuaugacaauaugcauaucccagguggguguauugccucuuguccacuccauccuaggcccguguugcuaucaucucaggaagaacaggcuagggcuggguuauaggucaguuaguagagccuagcaugcaucaggcucugaauaaacuagguaucauggcacaugccuguaaucauagcccucgaggcaggaggaucagugguucaaggucauccuuagcuucauaguaaguucaaagccagccagagaaacauaaagacccuguuucaaaaacagaaccaaaaugacuaacaaaugaaugagucugguauuccauguggcuucuauucuggucucaggaagcccucugcaguucuauguugauuaugucaacuguggccacaucacugcuuaugguccuggccuuacccauggaguggucaacaaaccugccaccuucacugucaacaccaaggaugcaggagaggguaaggagacgcucuagguuugaccugcccaaguuguccuccauuggcugagaacuguaugugggagaugauccugaaugguguuuucuaccuuaccuucaugcugagccaucaagucaacucacccacaaagguucagcaaugugucucugggcacaguucucacucuuaucugugauauuuuucagggggcuugucucuggccauugaggguccaucuaaagcagaaaucaguugcacugacaaccaggauggaacaugcagugucucuuaccugccuguacugccuggugacuauagcauccuaguuaaguacaaugaucaacacaucccaggcagucccuuuacugccagaguaacagguacggagcaucgggaguaaugacaggaacagguggcaugaggucacagucucuuugggcuggaucuauaguggcugauggcuugcacccuuaccaggugacgauuccaugcguaugucccaccuaaagguggguucugcugcugauauccccaucaauaucucagaaacagaccuuagccuacucacagccacuguggugccaccuucgggucgagaggaacccugucugcugaaacguuugcgaaauggccacguggguaagaggucaagagggagcaaaaguuucugugaaagagggaaagccagguguggugacugcccauaguccuaauacuugggagguguaaguagaagaaucaggggaaccaaucauuggcuacauaaugaguuaaagucauuuuagccuguaauaaauacccuguguucagacaaagggagcaaggaagaagauugugggcccacaucuuguugauagcccuauccugugccuagggauuuccuucgugcccaaggagacaggggagcaccugguacaugugaagaagaauggccagcauguggcaagcagucccaucccaguagugaucagccagucggagauaggugaugccagccgugugagggucucuggucaaggucuucaugaaggucauaccuuugagccugcagaguuuauuauugacaccagagaugcagguaggcaguguggucugcuaguuggggcaauacagcuagcuuuccuuggcauucuggcuuauagcugcuaucuauuucccaggcuacggugggcuuagucuguccauugagggcccuagcaaaguagacaucaacacagaggaucuggaggauggcacaugcagggucaccuacugucccacagagccuggaaacuacauuauaaacaucaaauuugcugaccagcaugugccuggugaguguggcagccauaccccuuaccugugguuuggcagcauugcuagucacacaccucagugcccaccuguaacuugugcauaguauggauuguacuuuuuuccuacaggcagucccuuuucugugaaggugacaggugagggccgggugaaagagaguaucacacgcaggcgacgugccccuucuguggccaauauuggcagucauugugaccucagccugaagauuccugguagggaaaagaucaggaggguuucuggggcaacccuaagcauaaguagagagacagggcccucccugcucaccaagcuaucuucuauuuguagaaauuagcauccaagauaugacagcccaggugaccagcccaucaggcaagacccaugaggcagagaucguagaaggagagaaccauacuuacuguauccgauuugugccugcugagaugggaaugcauacagucagugucaaguacaagggccagcauguaccugggagccccuuccaguucacuguggggccucugggggaagggggugcucacaagguccgugcuggaggcccuggccuagagagggcugaaguuggagugccagguagguguacuugucuaauucuugcuauccuaggugggccuagguggguguuuguaggaaguagccagcaggcauguugaucuuggcuuugcuuagacuuggcugaggcugggaaccaguccucugcuccaugagcacacacugcuuucccacagcggaguucggcauuuggacuagggaagcuggcgcuggaggccuggccauugcuguugaaggccccagcaaggcugagaucucuuucgaggaccgaaaggauggcuccugugguguggccuacguaguucaggagccagguauuggaaacagaaauggcugggguagggggagguaggaccugaguguggguauguugaacccagguguuacauagucuccacuugguucuuauucuccaucguaagguuccagggacaaccaaggggacugugggagggaggcaagaggccuuuccuaggcuagccuuuggggauauguggcaccuccagguauagccuuauguucucuuccuuuccaggugacuaugaggucucagucaaguucaacgaggagcacauaccugauagccccuucguggugccuguggcuucuccgucuggugacgcccgccgccuuacuguuucuagucuucaggugaggcacugagagaaacugcccaucuggggcuccugggcccggccagaccagagucaccauagcaagcaggucuuggcccugggcugagugccuacgcagaaauaauucuggaugguaggcuucugcucuggccggguacagcccacgcuugagguuggcaggaaguacccugcccaccgcguggaguuuuucucgugucucaggucuaaaggcuuugaacagaacccugugcccauugagcaccagggcugagguuuaaagagggacagccuguuagagcugagugcuaccuacagggugggccaccuugccuuucugcuaccugggugugugauuguggagaacauguuuaggagauaggagguuggggguaugccuguggcuugcugcccucacagaucaauggcucucccucuuuaaaccauguuggacaccagauggguaagugacucugucggucuucugcucucccauuugcccugguucuauacauccugucuaaccacaucugcuaugcuuccaggagucaggguuaaaggucaaccagccagcaucuuuugcagucagucugaauggagccaagggggcaauugaugccaaggugcacagccccucaggagcucuggaggagugcuaugucacagagauugaccaaggugaggcucuaucccugccuauucauccaaccauuugaccuagcugacuagaaguaggcuaauguagugauucaaaagugggcuccucagcuaaaaaacccuucccagauugacaagcacccaggaagauaauggcuuuccaucauggccacuaggaagaacaccuuacaccagugucauacaugagaaagacauaaaaacagagacagagagauagucaaucccuggggcuagagaaauggcaauucuauugaagcacacuaguuucacuaguuucccuuucccccaaguccaugaccugaagcagauuccuccccaucucuaagccugcugcuuuguacacugcuacaguacacucucuaaggaaacaguaaggcaggcauuuugcuuguuauuccaaaagacuuacaaguagacuucuuagguauugauagccuuagucucaggauguauguuauuggaugaauaccuagaauaauucuggaagcagagggaucuccauugagcagcuggauuccugcuaguggcaagagaagugaaggggauguuaaccaauucuguuccuuucagauaguauuuucaaguugcauacaaaaaaguaccccaaaucccuuaccugcauuucagauaaguaugcugugcguuucaucccacgagagaauggcaucuacuugauugaugucaaguucaaugguacucacauuccuggaagucccuucaagauccgaguuggggagccugggcauggaggggacccaggcuuaguguccgccuauggagcaggccuggaagguggugucacagguagguuuauggguacagcucugaguguagauguauagccccagcaccaggaagcauguggaaguaucaaggcugugcuggguagcugaaugcaaggaagccagugagauagauucugccugaccuucuauuuucccagggagcccagcagaguuuauugugaacacaagcaaugcaggagcuggugcccuuucgguuaccauugauggccccuccaaggugaagauggauugccaggagugccccgagggcuaucgugucaccuauacccccauggcaccuggcagcuaccucaucuccaucaaguaugguggccccuaucacauugguggaagucccuuuaaagccaaggucacaggugagccuuaggcuaagcuguugguggccacccaaugccuugauacuugagcagcuucuuagucucacccauucuguuuuguagguccucgucuuguaagcaaccacagccuccaugagacaucaucuguguuuguggacucuuugacuaaaguugccacgguuccccagcaugcaaccucaggcccagguccugcugaugucagcaagguaguagccaaaggccuggggcuaagcaaggcuuauguaggccagaagagcaacuucacaguagauugcagcaaagcaggugaguagcccuauuuuuagcuucuggaagugcaaagccauaaauaacaggauggucagcauguaggaaguacaggaacugccuuuagggguaugauuauugcuuuuagagcuaccuucuauuugggccuucguacuuuccuuucuacccuucaagaaaauguccuggaguggggcugcugaaaagguggcucagcaguuuucagaggacugggguucaagucacagcacccacauggcagcucacaacugucuguaauuccaguuucaugggaucuguuguagaaauuauuuaaucccuacuguuuuacccaggguuucuaccccaccuuagauuaguucucagauuaaaaacacacaugaucuuuauauuuacaguaagccuuaaacaauacaagagcuuggcagauacuacucucuauguuguuagaauuuauuuuccuauggauaaccccaaguuauuacuuacuauguuucauuuggguugcucuuaacuccaauugggcagcucucagggcccuugacuccagcucaugguggcuucuccuuccuccucuauuuucuuacacagauauacaugcaggcaaaacaccaauguccuggaggagcuguaauuuauccucugguggucuggguggcaaggcugggguaugagaugcuugcuugggaauguuaauaaucaggcaaggaacagaauguggaauagugagaagggcucagagcaauuauagacaaagaaaggaucuaaggccacugagaccuauuccugccuuagguaacaacaugcugcuggugggcgugcauggcccaaggacacccugugaagagauccuggugaaacacaugggcagccgccucuauagugucucuuaccugcucaaggacaaaggggaguacacacugguggucaaguggggugaugagcauaucccaggcagcccauaccgcauuaugguacccugagccugccaccuaaguuggcaccugugccagcuagaagcucccauggcaaugagcauccccacaccuguccuauucccaagaagccccauuuuccuuuccugagcccuggacccucccuucccuggaucacucuggccgcucuucacugcauucgcccuugcccugcacuguguucaccugucucugggcuuucacuugggcagagggagccauuugguggcagagcaugucuucuuugguucugggagguggaaguccuauguacaaccaccuucuaguucucuuucccagccaagaggaauaaaauuuugcuuccguuguccugugaau

SEQ ID NO: 12592 - RNA, 2271 nt, Mus musculus
ucucuuuuccucuggcgcggugagugaguucggucacgguuuuuuacgauggucucguaauuuuucuuugggauuuuuuuuacacuuauucugugucuguauucuuugacuguuucauuacagccaccgacgauccuauugucaucaugggccgccgccccgcccgguggugagugcugaacccaugcaaucuuccuacugugaaaacugagggaaaaaugcauuucuuucgaaagacuuuuuuuuuauggguggacucucugccacuuagagacccugaaguaaagacugacuucggguuuucuuuaauacuuuacugggaccuuuauuuugaggcuguggguggcguuacccaauacuaaagcgcuuggguagaacuagcauguccgugugcauccaauccucugcgucgcaaaugagccuuuuuacaacgccuaccaggccuucuuggucacuuuugcguccgucuuuuauuuccggccuugagcuuugugguuuuuaacaggacaccaagggcugaccaguccguaggcgccgccuaaacgcguguccugaagaggacgccauauucucuuaacguggcuaaggcgggucuucugucacaugcuaggaaaauugugauaucucacccaacucugguuagagggugaugcuagugcaugauucuuuuucuguuuuauaauuuguguaauuguuuaacaacaaguugccuuagaaucaguuacccugaauggaaacuggauucagagcugguuuaguccuguugucaccauuaaucacaccugaguuuccuuccuucuauaguuaccgguauuguaagaacaagccauacccaaagucucguuucugccguggugucccugguaaguagugacaaacuucgaacuggaucgguguuugucuauuccccacuucucgagaacuuuaaaccacguguuuuucagaugcuaagauccgaaucuuugauuugggacggaagaaagcaaaaguugaugaauucccacuuuguggccauauggugucagaugaauaugagcaacucucuucugaaggugagacagcucccauuuguuaauuggcucuuuuuuuuuuuuuuuuugguuuuucgagacgguuucucuguagccuuggcuguccuggaacucacuuuguagaccaggcuggccucaaacucagaaauccaccucccaagugcugggauuaaaggcauggaccaccaugcccgguguguuaauuggcauuucuuguguacuuguggauuauauauuauaauuuauucaauguccugacacccuguuucacugcuguuauuuccccauucagcacuggaggcugcccguauuugugccaacaaauacaugguaaagaguuguggcaaggauggcuuucauauccgagugaggcuccacccuuuccaugucauccguaucaacaagauguuguccugugcuggggcugacagguaagcugguguuuuauuugguuuugagacaggguuucucuguaucccuggcuguccgggaacuuaauguacaccaggcauaucugagaucugccugccucugccucccaagugauuaaaaaccaccacuguccagcaguauuuuuagggauuucuuugauuuuuugugcagcuaauuaagccgaccaaguccccuuuucccauggggacuuuggugugcaaugguugcaaacagcagccuccuugguaguguauguagccuauuaucuauaugggcugccucaagggaccuuggagacaauuuucuggcaguugguaaucaggccucugaucacaauguugucccugaucuaggcuccagacagggaugcguggugccuuugggaagccccagggcacaguggccaggguucacauuggccaggucaucauguccauccgaaccaaguugcagaacaaggaacaugugauugaggcucugcgaagagccaaguucaaguucccuggccgccagaagguagguagugguauuuaaguucuucuguuuucuugcucugguccuccuugcugaguuuguuauuuucuauuuccuucuagauccacaucucaaagaaguggggcuucaccaaguuuaaugcagaugaauuugaagacaugguugcugagaagcggcucauuccugauggcuguggugucaaauauauccccaaucgugguccucuggacaaguggagagcccugcauuccugaaggcuucaauaguucuccuauacccuaccaaaucguucaauaauaaaaucucgcaucaa

SEQ ID NO: 12593 - RNA, 20651 nt, Mus musculus
cgaugccucagaagguaguuauuugcucuggugcuuucugaagauggcggcggcuaaggacggaugcggccuagaaacugcugcuggaaacgggcggcggcuccacuuagggauuccugaagcaguguuugugguaagaaacucuuucucagcgucuuaaucugauauuggagauugcuuuccagucacuucccaggucugggucguugggaggaacagagcuaaagggucccggaagggaaugucuggccuuuugccucuuccugcaucuuggcuuuuuaggccuggcgggcgauagcuuugaagaaagguaguccaaccccggcccagaagagggagcagggaggagaacuggguagcuggagacggaugcgaggcggauuggggcguggcgucccuugaaacugaccaguugcugccuguugucgccuaaagaaaaacaaaaaacagcagcaacgguuauugagcucaagaccgcagugaugccggagauguagauggguggacauuuagcacagagagcaggcagagcagcuguuuguaggguguggguacugaguggcacccagucagcuugagcacggccgugguccguuuccuugggaauggaagcagacugcugagaaaaguaaacguuagcacaaacguuaaguccauguguucuugcuuuuaagaauugaggcuuauguaaugggcaaccggcuguuauuagguuuuugaaaccauuuuauauuugcuuuuaguaauacuauuuaagcaguuuguagacaacaaauuuuaugcaguugugaagauugugggaaaugcaauuggaagguuucauguaacaggaccgacccaaguuaaauauuuguacugaagcauauaaaaucuuagucaaaauuuccuugauucuuuuuugguauguaccaaaaauuauauauauucugucuuauugcuaacauucuucaaaagacccuuuuuuucuuuuacuuaaaucacauuuuauauuguauauuuuaaugugcugguggaauaaauuuuuauguguauucucaauguucugugcuuuuaaaaauauuuuucaagugaucuuuacaugaaguaauauuuucugagguucagaaauuuucuuagaaaauuugcaaaacuuuaugagggaguuacuguuguucaaauuuuguagauguaguugaugaaacccagaaauagagguauccagaaguagcauuugagcagucaggagagcuuuagaaccucuuuggucaugcucugcuacuuagaggugaggaaauuuuguguuauuucuccugauccuauuauaaugccugauauauaaggauguaaauauauaaauuuccauucugucuuaaauauaacccgauagcaguaacuucagaaauggaauuaaugaauacaaacuuuaucugagggauuuaccguaaaauaaacuuuuauuuauuuauuuuauuuauuuauuuuuuugagacagcccagguuggcuuagaacucacuguuuggauuaggauggccucaaauucauagugccuguccugcuucugcuuuccaaguuuguagguuaaagacagacacugugacaacuggcuguaaaauuuuaugguuaaauuuuauaccaacacgauguaauaagcaguccaaacuuuauauaauuaucuugauguuccaaaacuaauggaaguggcaugauauuuuaacaacauaaaauucuaugucugagaguauuugaauccuacccaacuuccaucuugcugcuuagucuugaguuucuaugggugacaauauuuauggacuuauuuugaaaaauaaaauauguauucaauugaauuaaaucaguaagaaaaaugauaacuuuggcacacaauuugcucaauucuuuagugacuagggcacaugaguaggcagugugcuucauugcuagcaauuuucauauuuauuacuagagccacaugagaaauguauaaagcaggcaaguucaugugucuuacauuaaaaacagaaaaauaaagaauaaauuaccuacauaauguauguaaacuguccgaaauggucuuucuugaacuuuuuuuuucuuuuuuugagacaaaguauguuguccaggcugacaacuuuggauccuuucgcuucuacuuccuaaguucugggauaacagaccuguagcaucaugucuaacuucucuuuaacuuuucuucugccagugcuggggauaaccuagggccaccugucuuguaggcaagugguauaccacugagcuccagggcagccaucuuuaacucuuuauaguuagguuuuuaauuaaaaacaagcuuucagaaaagaaaaauuaguucucuccaguggagucucacuagguauauuagccauacuaacggguggauuccaugcagggcaguaaauagacggccaccacaaaauuaauucaaucguauuguuguagacuuuuuguguaguauuguuugaguauuuuucucccuccuggccuuuugccuggaugcuuucauuucagauuuuguguuuuuauggauuuuuuuuguuuuuaaaauuauggcuuuuuguuuguuugccuauuuucuaaagaaagagaaauuggggaguuggagaggugggaggaucuuggaggaguugggagaggggaaguugaucagauuauuuuaugaaauuuuuucuucaaaaaaaauuaaaugaaacaaaccuuugaggaaaacaaaacuuguucuuuuacauuuuauaaacaaaguaguaaaaaucagguuuguaauaugaauuuaaaacuucguaugauuuuucauauuaaaggaagauguagauucuuucaugaagcagccugggaaugagacugcagauacaguguuaaagaagcuggaugaacaauaccagaaguauaaguuuauggaacucaaccuugcucagaaaaaaaggagguaaucaaaauuucuacauuuaaaaaucuuuacuauaauuauuaaugaauauaaguuguauacacuaaugaauuuuacucugauauauuuauacaugcaaauauugugcuuagaucauauucauuuucccugaugccaaccauccuuuccuuuuacuuuagucugguauauuuuauuuaacaugauaaccuaaaguucugcuaaugguguuguaagugacauauuuucauucuuacuaaauuauugcauaauguucuauuucuacauauaugcauagaccuugcauauauaccuguuuauccaaucaucugauguucuugauuauugugaauaaugccacaauauuaguaugcacagaacuucauuacuuuauuuucuuuggauaugcacucaggaauaauaaagcugaaucaaauaguguuuccauuuuuaguuuuucaauuaugugugugugugugcucauauguaugcagguucaugcaugccaugccacaagcauaugcucaaaugugcuauagugcgcacauguggaggucagagaacaacuuucuagaaucauuuuccuucugcuaccuuguggaggcagggucucucuugcuauuauuuuugccacuuuguguacucacacuagcugaccugugagccucugggcaguucuccugucucucgggcaguucucauuuugccaugcugagauuacagaugcuagccauugaauccuguuuuuuuguuuuguuuuguuuuguuuuguuuuguuuugugagauucagagguugaacuaagguugcucaucaguaaggauuuugauccauuucucuggccucauuuuuauguuucugaggagcauucauacuguuuuuuuuauaaaagguauuauaaguuauauuauguaagguaacauugcauuuauauuauauaacaguauauaaaguacccuuuuccuguauauccuugccaauacugcuaauuaguuauuuuugagauagggucucauguaguguagucuggucuugaauuugcuauguagcaaaggaugaccuugagguccugacccuucugccucuaccucccaaauguuggaguuacagguguguaccguacugguucauugaaccuagggccucauguguacaaggcaaguguucuacuuuugaguuauacugcuaguccuuuuuuuuuuuuauuuugaaauagguucuuaaauuguccagguaguucuugaacuuucaaucuuucugucucugccucccaaguauuugggaugauacuguuuugacucuagugagauggaaucuuuguaguuuuaauuugcauuuuuugaggccuaaagguguugaacauuuucuuuauacauuuauuagccauuugguacgucaaaucauuaucuacuuaguuauuggauuauuuuuucuuuugguuaaguuuuuuuuaauucuuuacauauucuagauaucaaugcacuauuagguaaauaguuggcaauauuuucuauccgcucuaaacuuguuagucuacugauugguucauuugcugugcagagcuuuuuaauuugguauaauuucauuuuacaauucuguauuuugagcuacuggaauccuauugaaaaaauuguagccuaugucaauaucuugaaauauuucccucauguuuccuguaguaguuuugaaugucagguguugacuucaagguuuuugauguauuuugaauuuugauuuguuccuuuuuuguacagugugaugggggauaugguuuuaguuuuuuaauauguggauauucaguuuucuuagcaccauuuauugaagagacucuccuuucuccaucagauguucuuggcaucuuuguugagaugguuuuagcuauauguguuuauuucuagguccuuuguuuuauaucaguggucucugucugucuguucuuuuuugucauuaugauuuuuuuauucuuauucauccagcauugcuuuuuguucaagguuaccuuggucauuuggaguuucauaugaauuuuaggauugugauuucuaguucugugaagaaugucauuggaauuuugcugggcuuaggauugaguucagagaauacuuuugguaauaugaccauuuuuacaauauuaauuuugcccauccaugaacauagaaugaacauccuucuaccuuucuaguaucuuuauuuccuuuguuuaguauuuuauaaauuucaauguagaaguauuuuaccuuauugaucagguuucuguuguuugucucuguuuuauucauuuguggcuauuaugaaugggauuguuuuuauuucuuucuuagugaauucauuauugcugcauagaaaaucuauuaauuuuugcuuaaauugcuuaccaauucauccaucuacuaaucaaacccaauucaauuuaucacugagaucggaugagauucucuuuguuuucagggucagauggcugaagacuuagcaguuguaagcaucuuuugauggagacuuugggguucucuugguauagaaucauauggcuaauuugauuucuuccuuuucuauuugauuuccaucuauucuuuugcuagcuaaaaugugaaguacuguauugaggaagaguggcaagaguagauagagaucuuugccuuucuuuuuauagcccaugacugucuuuauuaucuuugcaugaacuggggggucaauauuuaugucucagcuucacagcuuggcccuuucucugccucugaagaucauauauauguccauauccuuuccuaccuuguaucugaauaugugcugaguaugcauaccuaaaacagccccauguaguacuacauagaugcuugauguuuucagacuugagauuuaauauauuuggauacaucuuguuuuaauaauuagcuaaaugaaaguuuauaaucaaaugcagagccugugaaucacuucugcagaaugugaccuguucuagaaauguuaauaacagggaguuggacauaugaaguaaggcuuuuuauaccauguauuuuauauaugcuuaguauuacaucuuuuuuaaaaaaaaaagauuuauuuauuauauauaaguacacuguagcugacuucagacacaccagaagaggcuaccagaccucuacagaugguugugagcuaucaugugguugcugggauuugaacucaggaccucuggaagagcagucagugcucuuaacugcugcucccuacauuuuauuuuuuaauuuuaaaauauuuuaugugugacuggagagauggcucugcaguuaaaagcaccaacugcuuuucuagaggacccagguucaauucccagcauccacguagcaguucacaauaaucuguaacuccaagauccaacagccucaaacagacuuacauggagacaaaacuucaguguauauuaaaaaaaauaaaauaaauaucuaauguauaugaauguuuugccuacuuguaugucugugcaccgugugcaugucuggugcuuguagagaucagaauugauaucagaucuacaacugggcuauggaugguuguaagccaccacgaaggugcaaggaauugaaucuggguccucugaaagaacaacaaaugcucuaaacuucuuuagucccuuaaauauuuuaauuaaauguuuguauccuuauaguauuuucuguaugguuuauuaaguauacuuuguuuugcaauguuuaucaaaucuuuucuuauaucaaaaauauuauuuuaaauaaaauuuauaaaauauaaccuauauuuauaaauaguuuuuaagggcauauuaguugaaaauugcaaugcuaguaagaugauugugauuuuuuuuauuuuauuuauuuauuugucuuuuugagacaggguuucucuguauagcucuggcuguccuggaauucacuuuguagaccaggcuggccucgaacucagaaauccgccugccucugccucccgaauuauuuauuuauuuaauuuuuguuuuuugagacaggguuucucuguauagcccuggcuguccuggaacucacucuguagaccaggcuggccucgaauucagagauccgccugcaucugccccccaagugcuggaauuaaaaggcgugcgccaccacugcucagcguaauguuuauuuuugcugguaaaauacuuuguuaaccuuuuuuucccuccucacaggcugaaaggucagauuccugaaauuaaacagacuuuggaaauucugaaauacaugcagaagaaaaaaguaaguguaccuuuguuugcagguauaagcaaaucagcauuguuuuggcagaggccugauuuccuugacucuuugguuauaggcauuucauuuguuuuguaggguucacccuaucuuuuugagcauauguaguaauguuaaaaguaguauacuuucaccaaaaaagauggcuuuguggucuuccccuaaaaugacgccuaauucuaaggucuucacuuagauuauuuuguaaauuuuuaauuagaaaugauuuuagguauucuuaaaauguuuuauucugagguaguaacauuuaagaguguauuuauuuauuuguuuuuauuuuuaugugugugcuggcauacuggcuuuguagaaggaguuugugagugacccuuuuguuucuguuuuuacuuuuuggggaggggguuucuuguuuuuauuuuuuauuguuuuguuuugaauaguuugagaagauuagguguagauugucuuuaaaugucugauauaauuguucugugaaauuuucugguccuggacucuuuuuuagcuggaaggcuuuuuauuauuauauccucuccucauuucuuaggagccuguuuaggucauugacuucuugguuuaauuuuggugguuuggcugaauccuacucauccauuucuuuuagguuuuccaucuuaguggaguacagguuuuuaaaauagucccucauaauauucuacauuucuuugaugucuguuguaauguuucccuguucauuucugauacuguuaauuuggaucccucuuuucuuucuuuugguuaguugggccaaggguauuaaguuuugucugucuuucaaagaaucagaucuucgguuuuuugauucuuuauauuguuuucuugguuucuguuuaguugauuucugcucugauuuuuauuauuuuuugauguugauuugguuuggauuugguucguucuuuugaguugcaucauuaaaccauuuauuuguguucuuucugauuuuuuuaaauguaagcacuuagagcuguacauuuuccucauagggcugcuuucagugugucuuagagagguguucucuuuuagaagacgcuuccaugugaugcugaguagaauguauucuuuggucuuuggguaugauauucuguagauaucuguuagguccauuugauguacgaugucaauuaauucugauauuucucugucuuuugucuagaugaccugucuauuggagaaagugggguauugaaaucaccuacuaauggacugauguuuaucugugucuaaauucaguaguacaguuuuuuuuuuuuuuaaugaaauugggugccccagaguuagcauauuuguuuaggauaguaauagcuuccugguugacuguucccuugauuagaaugaugugucccucuuuaucuguucugauaguuuaaagucaauuuugucagauauuaggauagugacaucugcuugauuccuagucucauuugauuuagguacuuuuguuuauccuuuuacucuaaggcauuauguaucuuuaaaacuaagauguguuuuggaaacuuacaaucuuuacaguuguaggaacuauuauuauuuuuauuuuuugguuggggaacuugaggcauagauaaacagugacaugcuaaauuuacacagcuaguaaguagcugaaucagaguccauuuccagucauuuggugguaauagucauuuauuucuuuuccaacuaaauaaaucuucaugaugguacuguuuuaaaugucuugggauuagguggauuaggugugggauuccuccuguauaaccuugauaucaacuuggccuguuugugguacugucauuucuuuuaaaggagucuaccaauucaauggagacgagauucuuacuggccgauaaccuguacugcaaagcuucagucccuccuacugauaaaguaugccuaugguuggggguaaguacauguuauagccacagccaauauaguuguaaaccaagguuuucugacuagcaaaacaguauuucuucuuuuuuuuuuuauguuuucacugacuuaucuuuuuuuauuauuagauauuuucuucauuuacaauucaaaugcuaucccaaaagucccuuauacccuuccccuacccuguuuucuaacccacucacuccugcuuccuggcccugguauuccccuguauuggggcauauaaucuuugcaagaccaaggggccucucuucccagugauggccgacuaggccaucuucugcuacauaugcagcuagagacaagagcucugggggguacugguuaguucauauuguuguuccaccuauaggguugcagaucccuuuagcuccuuggguauuuucucuagcaccuccauuggggaccauguauuccauucaguagaugacucugagcuuccacuucuguauuugccaggcacuggcauagccucacaagagucaucuauaucagggucuuggcggagaugagauggaaggaacggccgugcagagacugccccaucuggggauccaugccauaaucaaccaccaaacgcagacacaauugcauaugccaguauuucuucuuacuaugcaauguuuuuaucucccuuugauuuuagaaagaauaaagcuguagaguucaaguaguccuuauuagaaacuuacuggaauuaagaguguuuuuaaagauguuuaaagauuuuucccaaucaagacaaaaaauugaccaaaucuagucuuguaguuguguguguguguguguguguguaaacacaggaguuugaguaugcugggaaagcagucuaccauggaucuagucaucaccccccccuuuuuuuugauguuugguuuuugguuuuuuucgagacaggguuuguauagcccuggcugucuugggacucacuuuguagaccaggcuggccucgaacucagaaaucugccugccucugccucccaagugccaccaccgccuggcccccuuuguuuuuuuaagacucauguaguccauacugucuucgcaucauucuugccuuuguuuaccaaauacugagauggcagacauaccaccaugcccaacuauuucuccaguuaauguuuugucuuuuuuaaaugcauaagaaggaagagaguggggagaagauguggcucauuugguaaaguacuugcuuuacaagcauuacaacuugaguccaauacccagaacucacauaaaaaaugcuagacauuguauguuugagauccuaucccuugggagucagagauaggaggauuacuacgagucauuggccaguuagucuagccuaauugaugggcucuggccaaugagaaacccuauuuuaaaugaugacaccuaagguugugcuuguguuuacauacaugcacacauauauacaaacauauauaaaaagcauguaacagaaggaagaguaaaagucaaacaguacuguuuuacucugauaaauguuugucuauaagacuguaauaguuuuacaaagagcccuauaaauuuaaggagaaaaagauuauaaaaacucugagguuagaauaauuuaguuuuuuauuuuaugugcaugaguauuauguacuuggaucuauguucacugcaugcaugccuggugcucauggaggccagaagagggugucacauucccugaaaguguaguuaagagauuguugugagcugugaugugggugcugggaauugaagccuagcucgcuagugcucucuagucacuagaggagacuguucuuaaaaauauucugcuuuagauacuuucauagauuuuugucuaugcuuuuucuucauucuuucccuuuuuuugcuguuuuauuuauuuauuuauuuauuuauuuuauuauuuugagacagguucuuucuaugugucccuugcugucuuggagcucacuauguaaacuaggcuggccucaaacucaaagagaucugccugccucuaccuccugagugcugggauuaaagacugacacugugccuggcccagcacuuucugugcuuuuucacccuugcuuuucuuagaccccagaccuagcuaaauacaggauuuuuuuuuucuuuuacucaaagcaagcuccuaugcaaaguagcaaguacacaaugcacacuguuuccugcuauccagauugccucauuggaaggauuuuccuuugcugcuguuguaagacaugcucuagugcuaugaacaauggaucauuuaacacagugaaacucaauuuuaugauauaguuaguuuauguacucaguguuuguuaguugaguucauuucaguuuccuguuuagucuuaguucuguuuuuaaaaggaaagauucaguguuuaucacuuaggcuuuuauuuucucauuuuuaacauucucugaaaauuucacacguauauacaauguauuuuuaucauacccauccucacuauguuccuucaguucucccaggcacuucaaccuguuuccuucuagacuuuaugugaguuuuuugucaucauuaguagcucccugauuucaauuaguacugaccauauauagauggcuauaggggccaucugcugaggcaugggcaaccuaccaaugccagcaucucuggggagggacuuucguucagcagcuaagggguugggcaucugaagcuccuccuuuuauccaugcuggaauguuagcuggauuaauuucauauaggcaaucauggcuauugugaguugauuugcucaucaaccaugccauguccagaagacagcauuucacacuucuucucuggcuuuuauauuccuucugcccacaucugugaugcucccugagccuuggauugggggaaguugauguagaaaacuuuuuuuuuaagguugagcauucacagucacuuagucugaacagaccaguuaugacucucuguaguaaccacuccccacugcaaaaagaaucuucucugaaccaagauugagagcagcaaaauauucugguauaaacaaaaaagaaggcaguuugacaugaccauuuaguggaacagcagcaguuaagcccaacuuagggcuggucuauuaucucucagucauggccuacuaaaguauagaaaauauacccgaauguaucacuguggaaagacugucuauauucagcuuauuuugacgugguuacauuuguaaagaaauuauaugcucaaauaauuuuuaaauuauuuuuuuugcagucugaaguacugaggguuaagacuggauuuuuuuuggaaaaagacacugcuuaauccauaauauauuuuauuucugcauaagguuuuagguaccgggagguuagagcuucaguauaucuuuugauguacacaguugaauucaaauuaacaucuuaaguucauuuucuugcuuuugccccuauauuccaaaauccuuuucagacauaguggguagaacuauccauuaagaucuguugggucaugccauuauucuguccaaauuuuguggucguuucucaucuuauuucaaggacaaucuuuugaguagcuggcaagucccaaugcagucuaguacucuuuuauacuucucuuaccuaauuuuccaguuuuuuguuuggucacacuuggacuucuuccuggaccuagauaaucgugauagauaaauaaauaaauaaauaaauaaauaaagggucugccucagagccuuuauuguggaauucuuuuuagcuuuucuagcuguaacugcccaaguuauauuuuuagaacacaugauagcaugucauuuuucugaugaagguuccaucauuuccucugucaaaagcuaggaccacuucugguacaaugugacuuuuacuuagucucacagauaucguuucuuguaaacgugggguuuuccuccuugcuuuuuuuuuuuuaaagaauuguguaugagugagugaguguaugugguguauguaugugagagagagaaagggugaagggagagaggggagagagaggauagaaaggagagagagaggagagagggagagacagagagagagagagagagagagagagagagagagagagagagagagagagagagagauaugaguauagguguucagaggccagaagaaggcaucaauucugugaaguuggagucacaggcaguugcccaacaugagggcugugacccaagcucugguccucuggaagaacagcaugugcucuuaaccauucugccaccuuucuagccucuuguuguccuuuuaaucuugcgauagaguuuuaauauucccauguuaggagauauuuaaguugucuuuggguuuccugucuagagaacagcacuauggccaauacuuaugcauguauaaaccaguaaagaaaggcuucccuuuuuguacaccucuuugggauagaauuguuuaagucuaagaguaaaucuauguacuccauaaaacauuuuuuugaggcaaggucucauuuagugcagucuuaaaaugaucauuuaagugggucuaacuggguuuucugcucaggaccaaguguuaagugaccaaaauuaaaguaccaguauguuuugcagccucauuccugugcuauguguagaacugaaguccuguuuccuugcugguguuuacacuguaugugcauuuauugccgcgugaacccuucuguuuucaaagccaacagugacaagaauaauccuagauuucagaucuuugcaauauuuucuugugccaucaaccuuggacaauucucugucccugaaguuugauauagauuauuauuaggcuuacccagguuguagcuauaugcuaggauccacucugacaaaucucuccagagccacagagaguagagugggacuuguggccucagagagccauauuuuccccuaauagagaacucuaucacaaaaggacauacacuuacgugauuucauuuaucaaaaguucaauuauagacaaaacuacacguuagagaagucaggaaaaugauuacuuuuggggugagaguguuggggauuacuagaaguguacacagaaagcauuuacaguguuggugcuuaucuguucucugccugguuaguuuccauagauccucugggaagauucaacccucucguaggcuuuuaaaauugaauaauuauuacuuugugguacuaggguugaacugagggacuuaugccuauuaggaaguugcuguauuucugauuuacaucaaccccuuaauuauuuuuugacuauacauauuuauaggggacaguaugguaauuuaguauguauauacaaaguguacugaucuacuaagugcaauuaauauuuccaucccuauacuacuuugcauuuaagcucccguuuucuaguauuucaucaacuauauaauaggagucaggcaucaugacaguacauguaaucucaacauuugguaggcuaauugccucaaguucaagguuaaccugggcuacuggguaagacugucaaaacaucccucuuccauauauauagauaguagaguguugugaauuguaguucauauaacuguucuuuagaacacuagaacugcacuuuaccuauuaccaaauuccuucuauccucuaucccaaaauuccucccagucucuaauaguuacuauacauacauuuuuaaaagaguaucuacuuguaaagagauauagccugcuauauuuguucuuugugucugaauuaaaacuucugucuuccaguuagcguacugaucuuuauauuauuuagagucccguaucuaccaugaguaaaagucucaaaucaucucuuugaagaaauuuucucucuuguuaacaauuaagauaaaauuugcuauuuaaaaguauauaguuucauaguuuuuaguguguucauaguugugcaaccaucaucucuuucuaucuccagaacauuuuauuuaucccauaaaguaaccccauuucuucauucuacuaucuccuuuccuauggcauccaccacacuugaccuuuaccagauggcuaagaaguuguagcaacuaccaauuuacuuucuuucucuguguaucagcuucauuccuucauuacacccuguuguguguauaaaccauaccuucuuuauucauugucauauuugguuuauuucuucuuuuuggcuauugugaauacauuuuugugccaacauauauuuucaguguuuuugaguuauguauguuuccuggucuauaauguuuguuuguuuacuugcuugcuuacuuccuuuuuuuuuuuuuuaauacagggucuuucuauguaguucuggcuuuccuagaacuugcuauauagagucuauagcaagacucugcuuuuuccuccaaagugcugguaaugaagacaugaacuauauguccagccuauuaauguuagcuuugugggaguuuuuguuuguuuugguuauugcuuuuuaguugagauugaauaacuaccauuacagccacccaucuuacacaacacagagccuuguguaagcuaggcaggcauuuuaccaaugaacuauguccucaguucuuguuuguuuguuugcuuguuuguuugcuuguguaaagucuuccuauguugcccaggcuggccuugaccuccuacucuucuugccucagaaucuuaaaugcuggguuaaugcuuuuugcuuuaugcuucuuuguuuuuugagagauuguuauguauccuaggcuugcaauaaacuauauagcugaggaugaccaugaauuccugacccauuuugucuuucccucccgaguacuggcauuuacagguuugaguuuuucuguuuugcuuucuugagauaaacucuuaauagauagcacaggcuggccuugaacuugaaauucuccuuccuuacuuuucugcauuccaggguuauagccaugagucucuaugcuaagcuuuaauacuugcugggcaaccaacacauuuauauguaauuuaagaggcacagacacauuaucuuagucauuuucucuugcuauaacugaauuaucaaagacugagaaauuuauaaagaauugagauuuauuugaugcaucuggaaacugggaaguucaagaggauaguguuagcaucaggugagagcaacaggugagagcuguaucauauggcagaggaggucauguagugaaauaguaaacauacuaguuuggcucucuuuuuacagaguuacuaaugccaucuuggagguucuuuccucaugauguaaucugauuacuucccaaagaccccaucuccaaauaccacuaguauaugaauuugguacuuuucauucuggaggacaaauauuaaauuuauuuuuuuauagcaaggauaucuaugaaagccugcuucucauuagcucagugugccugccuuuuaaguaaucaagagucuauuucuugauauucuucaagaaaaaauuuauacauacauagguaagaccacauccaucugucuuuuuacagaaauaguaacacuauucuaccuuuugcacacuucauuucaaaauguguguugugauuuuguguauugauaccucauuuucuacauaccuguaacucagggguuagcaaauuuucuguaaacugucaaauaguaauauuuucugcuuuucaggauacauggccuuuguuuucugcccuacuguagcaaaguccaagacaaguggacuguguuuaacccaagggcugcauuuucagauacuuacccuaaccucgagauuauaaaguaauugucaugacuauuuuucuucaggcuaauguaaugcuugaauaugauauugaugaagcucaggccuuguuggaaaagaauuuaucaacugccacaaagaaucuugauucucuugaagaagaccuugacuuucuucgagaucaguuuacuaccacagaagucaguauccuuuuaacaaauaaagggaagaaagagaaagauuuuuuaaaaaauuucuaaauauuguuuucaugggaagaaugacuuuauucuuaaauaaaugugaaguuagagauugcauaagauaaugacugucauuugaauaaaaaaguuuaaagguagaauaauaaauuagaaauguaaagauguggagagcagacucacugugaugaaauaaguuucuuuucaaauaguuuuacuaagauaccuuuauaauagguuaauuucacaaacauguaagucuucuauaaguuaggugcagugauccaagcuugugauccuagcacuucaaaagcugaggcaagaguauuaucaaccugaggccacccuggggcuacauaaugagacccagucuuuaaaaagucuuugcaauuucugcaaggaugcuaagccauaugagucaugaaaauuaguagagggaaaaggguaucaaagucuuugucuguuuaaaguacauauauaaaauagguccuugaugaccacauagcaguuguaaagaaguccauguauuuaggaucaggauaauuuaaaguuugagaaugauagauguguccuggaguuaggucaggaaaugcuuuuuaggagguaaaacuuaaacuguuuugaaaugcaauacaaaauuuguagggaaaggaaugcuugcaagcaagcucuuuucuccucuguuuuccuuuccuuuucuuuuuuuuuuuuuuuuuuuuugcugugguaaaagucugaccagaagcaaccuaggggaggaaaggauuuauuuggcauguacuuccagguuacagcucaucacugagggaaguuagagcaagaauuugaaacagaaaccacauaggaucacugcuugauagcucucacauacucauccucagcuagcuuuuuuauacugcccauggaguggugcuacccacagugaacuagauccucuuacaucaacuaacaacaagacuaucccauacagacaugucacaggccagucagagugaugacucuaaucugugucaaguuaaagcuaacugggauacucugcuuuaucucuuuuuguuccugacacacucaagaaaaauacccagcacuugggaggcagaggcaggcggauuuugaguccaagccuggucuacagagugaguuccaggacagccagggcuacacagagaaaccugucucgaaaaaccaaaaacaaaaaaaccccaaacaaccaagaaaaagaacaaagaaaaguaccuaagugccauucuuuauacuucucuuuuccuaauaaccaagagucauccagucaugucagcuuuuccccaugagguuuucuguacuauaauguuacuuaguuuuggugcuauagaaccuacacauaguagaccuguucuuuacaacaucuccagcaugaauuuaccgagucauacaucuuuguuuuauuuccuugguuauauacuuuaauuauuagcugguuuauauaauauaugcauauagucagucuugagugcuuuccacuagucuuauaccucagccagugucaugacaugcauugaauuucauaaacagguccuucucuagaauauuacaaauuucauauaacuaguuguuuuauucaucccuaaaaugucccaggcuguuuguauuuucuucuuuuguucuuuuauuuguuccuccuaccuggaaugauuucucuuuauuuacuuggagauacuccuuuauuguucauauaucaguuuaagcaucagagcauucuucaacauuuugcaauccugucagaguggguuuuuuuuuucugcuuugcauguaaugcuuuguuuuccuggcuggccacaagcucuucaagugcaggaacugaagucucccaaacauguaucauguaguaggaaaauucuugggugaggcaagauagguuuuuuugaggguuugugccaggauuaucaucuaacuaaugugaauacuugguucagcuaugaaaucccuaguuccuaggaaggcuaauuagaccuuccuuggugggugggggcuguuaacugugagggaaaaaaugaaauguaauggaaaaaucauacaaaucgaguucuaggaaacuuagagaaaagugccauuuaucaucaauauaauacuguauaaacuggaaaaguuagaauaguagacaggcauuagaguauguucuaaugaaucuaaacuccaugaaggaaggggcuucaccuagcuuguucaaggcuuagucaaaacacaguagguauuuaguaaacuaaaggaucuguuuagcccagauaaaauuuuggguaaucguauucauuuuaacauuuuauguuaggauauagaaugaacagaauuuucuuagcaauuuuuuuguuuuuuguuguuuauuguuuguuuguuuguuuucgagacaggguuucucuguguagcccuggcuguccuggaacucacucuguagaccaggcuggccuugaacucagaaauccaccugccccuaccucccgagugcuggaaucaaaggcgugcgccaccacgcccugcucuuaacaauugguaguauagcaacauagcuaucaacaguauuugccacuaguaucuuugugauuuccguguuuucuuuuguuuuagcuuuaugaguaaauuauaauuucauuguuaccuuugguauuauauuuucauuuuccuugacaguuauugcagauauggccaggguuuauaauugggauguaaaacgaagaaacaaagaugauucuaccaagaauaaagcauaacacuggcaauugaaaaugugauucagguuuucaaacauguuaaauaagccaagguuuaaagauugaucuaauuuucacugauuuuuuuuuucacagcaagauuaaaauuuaaaaacaccauuuuauuuauuuaugaaaacaaaauuacuuucaaauauuuuaugaaauuaccaguauuuuuuucauauuucccuaaaauguaaugcugcuuuuguuuuauuuuaucuguuauaagacaacuccuaacugaaauggccgagaacugugaggaaugcuauggaagcugcugaauacugggcaccagagcaguuuucuuuuucuuuauugguugauauuacucucacuggauaugguaaaccuuuuagaggcaggaaagacauacaguuccaauauuuguaagcuuguucuccuuuaguacuugaagggcauuaucaucuuuuguugcuguuuuguucuguaaaugggguuucauguauuucugccuaacaaguagcuuuuauaauacucugaacuuuucagaaaauuguuauuugcuuuccuacacaguaugagggcuauugacauccauaacacuuugaucccaaguaaguauagugugucuacaaugacaauauaagggagacuugaucaaugcuagagaguacuacccauucaaaacuguaagcuaagguaauuuuuauauuauguaacaguuuuccaaagcaccucgaacaggaagaguaacauaaauauaaaucugcauuauuugaaaagaguuguaagcuuuuuuauucaugauaaaauuuacauaggacagauauaaucucuggaaagccauugguacugacugugguaaaaguacuuggugauacagauucugguaaaaacacaugcauguuauuccaucucuguguaguaaaaaguauacuuguacaauguuuuguacuuguauuucauguuauuaaaauagugauguucaaccuguugcc

SEQ ID NO: 12594 - RNA, 20651 nt, Mus musculus
ggcaacagguugaacaucacuauuuuaauaacaugaaauacaaguacaaaacauuguacaaguauacuuuuuacuacacagagauggaauaacaugcauguguuuuuaccagaaucuguaucaccaaguacuuuuaccacagucaguaccaauggcuuuccagagauuauaucuguccuauguaaauuuuaucaugaauaaaaaagcuuacaacucuuuucaaauaaugcagauuuauauuuauguuacucuuccuguucgaggugcuuuggaaaacuguuacauaauauaaaaauuaccuuagcuuacaguuuugaauggguaguacucucuagcauugaucaagucucccuuauauugucauuguagacacacuauacuuacuugggaucaaaguguuauggaugucaauagcccucauacuguguaggaaagcaaauaacaauuuucugaaaaguucagaguauuauaaaagcuacuuguuaggcagaaauacaugaaaccccauuuacagaacaaaacagcaacaaaagaugauaaugcccuucaaguacuaaaggagaacaagcuuacaaauauuggaacuguaugucuuuccugccucuaaaagguuuaccauauccagugagaguaauaucaaccaauaaagaaaaagaaaacugcucuggugcccaguauucagcagcuuccauagcauuccucacaguucucggccauuucaguuaggaguugucuuauaacagauaaaauaaaacaaaagcagcauuacauuuuagggaaauaugaaaaaaauacugguaauuucauaaaauauuugaaaguaauuuuguuuucauaaauaaauaaaaugguguuuuuaaauuuuaaucuugcugugaaaaaaaaaaucagugaaaauuagaucaaucuuuaaaccuuggcuuauuuaacauguuugaaaaccugaaucacauuuucaauugccaguguuaugcuuuauucuugguagaaucaucuuuguuucuucguuuuacaucccaauuauaaacccuggccauaucugcaauaacugucaaggaaaaugaaaauauaauaccaaagguaacaaugaaauuauaauuuacucauaaagcuaaaacaaaagaaaacacggaaaucacaaagauacuaguggcaaauacuguugauagcuauguugcuauacuaccaauuguuaagagcagggcgugguggcgcacgccuuugauuccagcacucgggagguaggggcagguggauuucugaguucaaggccagccuggucuacagagugaguuccaggacagccagggcuacacagagaaacccugucucgaaaacaaacaaacaaacaauaaacaacaaaaaacaaaaaaauugcuaagaaaauucuguucauucuauauccuaacauaaaauguuaaaaugaauacgauuacccaaaauuuuaucugggcuaaacagauccuuuaguuuacuaaauaccuacuguguuuugacuaagccuugaacaagcuaggugaagccccuuccuucauggaguuuagauucauuagaacauacucuaaugccugucuacuauucuaacuuuuccaguuuauacaguauuauauugaugauaaauggcacuuuucucuaaguuuccuagaacucgauuuguaugauuuuuccauuacauuucauuuuuucccucacaguuaacagcccccacccaccaaggaaggucuaauuagccuuccuaggaacuagggauuucauagcugaaccaaguauucacauuaguuagaugauaauccuggcacaaacccucaaaaaaaccuaucuugccucacccaagaauuuuccuacuacaugauacauguuugggagacuucaguuccugcacuugaagagcuuguggccagccaggaaaacaaagcauuacaugcaaagcagaaaaaaaaaacccacucugacaggauugcaaaauguugaagaaugcucugaugcuuaaacugauauaugaacaauaaaggaguaucuccaaguaaauaaagagaaaucauuccagguaggaggaacaaauaaaagaacaaaagaagaaaauacaaacagccugggacauuuuagggaugaauaaaacaacuaguuauaugaaauuuguaauauucuagagaaggaccuguuuaugaaauucaaugcaugucaugacacuggcugagguauaagacuaguggaaagcacucaagacugacuauaugcauauauuauauaaaccagcuaauaauuaaaguauauaaccaaggaaauaaaacaaagauguaugacucgguaaauucaugcuggagauguuguaaagaacaggucuacuauguguagguucuauagcaccaaaacuaaguaacauuauaguacagaaaaccucauggggaaaagcugacaugacuggaugacucuugguuauuaggaaaagagaaguauaaagaauggcacuuagguacuuuucuuuguucuuuuucuugguuguuugggguuuuuuuguuuuugguuuuucgagacagguuucucuguguagcccuggcuguccuggaacucacucuguagaccaggcuuggacucaaaauccgccugccucugccucccaagugcuggguauuuuucuugagugugucaggaacaaaaagagauaaagcagaguaucccaguuagcuuuaacuugacacagauuagagucaucacucugacuggccugugacaugucuguaugggauagucuuguuguuaguugauguaagaggaucuaguucacuguggguagcaccacuccaugggcaguauaaaaaagcuagcugaggaugaguaugugagagcuaucaagcagugauccuaugugguuucuguuucaaauucuugcucuaacuucccucagugaugagcuguaaccuggaaguacaugccaaauaaauccuuuccuccccuagguugcuucuggucagacuuuuaccacagcaaaaaaaaaaaaaaaaaaaaagaaaaggaaaggaaaacagaggagaaaagagcuugcuugcaagcauuccuuucccuacaaauuuuguauugcauuucaaaacaguuuaaguuuuaccuccuaaaaagcauuuccugaccuaacuccaggacacaucuaucauucucaaacuuuaaauuauccugauccuaaauacauggacuucuuuacaacugcuauguggucaucaaggaccuauuuuauauauguacuuuaaacagacaaagacuuugauacccuuuucccucuacuaauuuucaugacucauauggcuuagcauccuugcagaaauugcaaagacuuuuuaaagacugggucucauuauguagccccaggguggccucagguugauaauacucuugccucagcuuuugaagugcuaggaucacaagcuuggaucacugcaccuaacuuauagaagacuuacauguuugugaaauuaaccuauuauaaagguaucuuaguaaaacuauuugaaaagaaacuuauuucaucacagugagucugcucuccacaucuuuacauuucuaauuuauuauucuaccuuuaaacuuuuuuauucaaaugacagucauuaucuuaugcaaucucuaacuucacauuuauuuaagaauaaagucauucuucccaugaaaacaauauuuagaaauuuuuuaaaaaaucuuucucuuucuucccuuuauuuguuaaaaggauacugacuucugugguaguaaacugaucucgaagaaagucaaggucuucuucaagagaaucaagauucuuuguggcaguugauaaauucuuuuccaacaaggccugagcuucaucaauaucauauucaagcauuacauuagccugaagaaaaauagucaugacaauuacuuuauaaucucgagguuaggguaaguaucugaaaaugcagcccuuggguuaaacacaguccacuugucuuggacuuugcuacaguagggcagaaaacaaaggccauguauccugaaaagcagaaaauauuacuauuugacaguuuacagaaaauuugcuaaccccugaguuacagguauguagaaaaugagguaucaauacacaaaaucacaacacacauuuugaaaugaagugugcaaaagguagaauaguguuacuauuucuguaaaaagacagauggauguggucuuaccuauguauguauaaauuuuuucuugaagaauaucaagaaauagacucuugauuacuuaaaaggcaggcacacugagcuaaugagaagcaggcuuucauagauauccuugcuauaaaaaaauaaauuuaauauuuguccuccagaaugaaaaguaccaaauucauauacuagugguauuuggagauggggucuuugggaaguaaucagauuacaucaugaggaaagaaccuccaagauggcauuaguaacucuguaaaaagagagccaaacuaguauguuuacuauuucacuacaugaccuccucugccauaugauacagcucucaccuguugcucucaccugaugcuaacacuauccucuugaacuucccaguuuccagaugcaucaaauaaaucucaauucuuuauaaauuucucagucuuugauaauucaguuauagcaagagaaaaugacuaagauaaugugucugugccucuuaaauuacauauaaauguguugguugcccagcaaguauuaaagcuuagcauagagacucauggcuauaacccuggaaugcagaaaaguaaggaaggagaauuucaaguucaaggccagccugugcuaucuauuaagaguuuaucucaagaaagcaaaacagaaaaacucaaaccuguaaaugccaguacucgggagggaaagacaaaaugggucaggaauucauggucauccucagcuauauaguuuauugcaagccuaggauacauaacaaucucucaaaaaacaaagaagcauaaagcaaaaagcauuaacccagcauuuaagauucugaggcaagaagaguaggaggucaaggccagccugggcaacauaggaagacuuuacacaagcaaacaaacaagcaaacaaacaaacaagaacugaggacauaguucauugguaaaaugccugccuagcuuacacaaggcucuguguuguguaagauggguggcuguaaugguaguuauucaaucucaacuaaaaagcaauaaccaaaacaaacaaaaacucccacaaagcuaacauuaauaggcuggacauauaguucaugucuucauuaccagcacuuuggaggaaaaagcagagucuugcuauagacucuauauagcaaguucuaggaaagccagaacuacauagaaagacccuguauuaaaaaaaaaaaaaaggaaguaagcaagcaaguaaacaaacaaacauuauagaccaggaaacauacauaacucaaaaacacugaaaauauauguuggcacaaaaauguauucacaauagccaaaaagaagaaauaaaccaaauaugacaaugaauaaagaagguaugguuuauacacacaacaggguguaaugaaggaaugaagcugauacacagagaaagaaaguaaauugguaguugcuacaacuucuuagccaucugguaaaggucaagugugguggaugccauaggaaaggagauaguagaaugaagaaaugggguuacuuuaugggauaaauaaaauguucuggagauagaaagagaugaugguugcacaacuaugaacacacuaaaaacuaugaaacuauauacuuuuaaauagcaaauuuuaucuuaauuguuaacaagagagaaaauuucuucaaagagaugauuugagacuuuuacucaugguagauacgggacucuaaauaauauaaagaucaguacgcuaacuggaagacagaaguuuuaauucagacacaaagaacaaauauagcaggcuauaucucuuuacaaguagauacucuuuuaaaaauguauguauaguaacuauuagagacugggaggaauuuugggauagaggauagaaggaauuugguaauagguaaagugcaguucuaguguucuaaagaacaguuauaugaacuacaauucacaacacucuacuaucuauauauauggaagagggauguuuugacagucuuacccaguagcccagguuaaccuugaacuugaggcaauuagccuaccaaauguugagauuacauguacugucaugaugccugacuccuauuauauaguugaugaaauacuagaaaacgggagcuuaaaugcaaaguaguauagggauggaaauauuaauugcacuuaguagaucaguacacuuuguauauacauacuaaauuaccauacuguccccuauaaauauguauagucaaaaaauaauuaagggguugauguaaaucagaaauacagcaacuuccuaauaggcauaagucccucaguucaacccuaguaccacaaaguaauaauuauucaauuuuaaaagccuacgagaggguugaaucuucccagaggaucuauggaaacuaaccaggcagagaacagauaagcaccaacacuguaaaugcuuucuguguacacuucuaguaauccccaacacucucaccccaaaaguaaucauuuuccugacuucucuaacguguaguuuugucuauaauugaacuuuugauaaaugaaaucacguaaguguauguccuuuugugauagaguucucuauuaggggaaaauauggcucucugaggccacaagucccacucuacucucuguggcucuggagagauuugucagaguggauccuagcauauagcuacaaccuggguaagccuaauaauaaucuauaucaaacuucagggacagagaauuguccaagguugauggcacaagaaaauauugcaaagaucugaaaucuaggauuauucuugucacuguuggcuuugaaaacagaaggguucacgcggcaauaaaugcacauacaguguaaacaccagcaaggaaacaggacuucaguucuacacauagcacaggaaugaggcugcaaaacauacugguacuuuaauuuuggucacuuaacacuugguccugagcagaaaacccaguuagacccacuuaaaugaucauuuuaagacugcacuaaaugagaccuugccucaaaaaaauguuuuauggaguacauagauuuacucuuagacuuaaacaauucuaucccaaagagguguacaaaaagggaagccuuucuuuacugguuuauacaugcauaaguauuggccauagugcuguucucuagacaggaaacccaaagacaacuuaaauaucuccuaacaugggaauauuaaaacucuaucgcaagauuaaaaggacaacaagaggcuagaaagguggcagaaugguuaagagcacaugcuguucuuccagaggaccagagcuugggucacagcccucauguugggcaacugccugugacuccaacuucacagaauugaugccuucuucuggccucugaacaccuauacucauaucucucucucucucucucucucucucucucucucucucucucucucucucucucucugucucucccucucuccucucucucuccuuucuauccucucucuccccucucucccuucacccuuucucucucucacauacauacaccacauacacucacucacucauacacaauucuuuaaaaaaaaaaaagcaaggaggaaaaccccacguuuacaagaaacgauaucugugagacuaaguaaaagucacauuguaccagaagugguccuagcuuuugacagaggaaaugauggaaccuucaucagaaaaaugacaugcuaucauguguucuaaaaauauaacuugggcaguuacagcuagaaaagcuaaaaagaauuccacaauaaaggcucugaggcagacccuuuauuuauuuauuuauuuauuuauuuaucuaucacgauuaucuagguccaggaagaaguccaagugugaccaaacaaaaaacuggaaaauuagguaagagaaguauaaaagaguacuagacugcauugggacuugccagcuacucaaaagauuguccuugaaauaagaugagaaacgaccacaaaauuuggacagaauaauggcaugacccaacagaucuuaauggauaguucuacccacuaugucugaaaaggauuuuggaauauaggggcaaaagcaagaaaaugaacuuaagauguuaauuugaauucaacuguguacaucaaaagauauacugaagcucuaaccucccgguaccuaaaaccuuaugcagaaauaaaauauauuauggauuaagcagugucuuuuuccaaaaaaaauccagucuuaacccucaguacuucagacugcaaaaaaaauaauuuaaaaauuauuugagcauauaauuucuuuacaaauguaaccacgucaaaauaagcugaauauagacagucuuuccacagugauacauucggguauauuuucuauacuuuaguaggccaugacugagagauaauagaccagcccuaaguugggcuuaacugcugcuguuccacuaaauggucaugucaaacugccuucuuuuuuguuuauaccagaauauuuugcugcucucaaucuugguucagagaagauucuuuuugcaguggggagugguuacuacagagagucauaacuggucuguucagacuaagugacugugaaugcucaaccuuaaaaaaaaaguuuucuacaucaacuucccccaauccaaggcucagggagcaucacagaugugggcagaaggaauauaaaagccagagaagaagugugaaaugcugucuucuggacauggcaugguugaugagcaaaucaacucacaauagccaugauugccuauaugaaauuaauccagcuaacauuccagcauggauaaaaggaggagcuucagaugcccaaccccuuagcugcugaacgaaagucccuccccagagaugcuggcauugguagguugcccaugccucagcagauggccccuauagccaucuauauauggucaguacuaauugaaaucagggagcuacuaaugaugacaaaaaacucacauaaagucuagaaggaaacagguugaagugccugggagaacugaaggaacauagugaggauggguaugauaaaaauacauuguauauacgugugaaauuuucagagaauguuaaaaaugagaaaauaaaagccuaagugauaaacacugaaucuuuccuuuuaaaaacagaacuaagacuaaacaggaaacugaaaugaacucaacuaacaaacacugaguacauaaacuaacuauaucauaaaauugaguuucacuguguuaaaugauccauuguucauagcacuagagcaugucuuacaacagcagcaaaggaaaauccuuccaaugaggcaaucuggauagcaggaaacagugugcauuguguacuugcuacuuugcauaggagcuugcuuugaguaaaagaaaaaaaaaauccuguauuuagcuaggucuggggucuaagaaaagcaagggugaaaaagcacagaaagugcugggccaggcacagugucagucuuuaaucccagcacucaggagguagaggcaggcagaucucuuugaguuugaggccagccuaguuuacauagugagcuccaagacagcaagggacacauagaaagaaccugucucaaaauaauaaaauaaauaaauaaauaaauaaauaaaacagcaaaaaaagggaaagaaugaagaaaaagcauagacaaaaaucuaugaaaguaucuaaagcagaauauuuuuaagaacagucuccucuagugacuagagagcacuagcgagcuaggcuucaauucccagcacccacaucacagcucacaacaaucucuuaacuacacuuucagggaaugugacacccucuucuggccuccaugagcaccaggcaugcaugcagugaacauagauccaaguacauaauacucaugcacauaaaauaaaaaacuaaauuauucuaaccucagaguuuuuauaaucuuuuucuccuuaaauuuauagggcucuuuguaaaacuauuacagucuuauagacaaacauuuaucagaguaaaacaguacuguuugacuuuuacucuuccuucuguuacaugcuuuuuauauauguuuguauauaugugugcauguauguaaacacaagcacaaccuuaggugucaucauuuaaaauaggguuucucauuggccagagcccaucaauuaggcuagacuaacuggccaaugacucguaguaauccuccuaucucugacucccaagggauaggaucucaaacauacaaugucuagcauuuuuuaugugaguucuggguauuggacucaaguuguaaugcuuguaaagcaaguacuuuaccaaaugagccacaucuucuccccacucucuuccuucuuaugcauuuaaaaaagacaaaacauuaacuggagaaauaguugggcauggugguaugucugccaucucaguauuugguaaacaaaggcaagaaugaugcgaagacaguauggacuacaugagucuuaaaaaaacaaagggggccaggcggugguggcacuugggaggcagaggcaggcagauuucugaguucgaggccagccuggucuacaaagugagucccaagacagccagggcuauacaaacccugucucgaaaaaaaccaaaaaccaaacaucaaaaaaaaggggggggugaugacuagauccaugguagacugcuuucccagcauacucaaacuccuguguuuacacacacacacacacacacacaacuacaagacuagauuuggucaauuuuuugucuugauugggaaaaaucuuuaaacaucuuuaaaaacacucuuaauuccaguaaguuucuaauaaggacuacuugaacucuacagcuuuauucuuucuaaaaucaaagggagauaaaaacauugcauaguaagaagaaauacuggcauaugcaauugugucugcguuuggugguugauuauggcauggauccccagauggggcagucucugcacggccguuccuuccaucucaucuccgccaagacccugauauagaugacucuugugaggcuaugccagugccuggcaaauacagaaguggaagcucagagucaucuacugaauggaauacaugguccccaauggaggugcuagagaaaauacccaaggagcuaaagggaucugcaacccuauagguggaacaacaauaugaacuaaccaguaccccccagagcucuugucucuagcugcauauguagcagaagauggccuagucggccaucacugggaagagaggccccuuggucuugcaaagauuauaugccccaauacaggggaauaccagggccaggaagcaggagugaguggguuagaaaacaggguaggggaaggguauaagggacuuuugggauagcauuugaauuguaaaugaagaaaauaucuaauaauaaaaaaagauaagucagugaaaacauaaaaaaaaaaagaagaaauacuguuuugcuagucagaaaaccuugguuuacaacuauauuggcuguggcuauaacauguacuuacccccaaccauaggcauacuuuaucaguaggagggacugaagcuuugcaguacagguuaucggccaguaagaaucucgucuccauugaauugguagacuccuuuaaaagaaaugacaguaccacaaacaggccaaguugauaucaagguuauacaggaggaaucccacaccuaauccaccuaaucccaagacauuuaaaacaguaccaucaugaagauuuauuuaguuggaaaagaaauaaaugacuauuaccaccaaaugacuggaaauggacucugauucagcuacuuacuagcuguguaaauuuagcaugucacuguuuaucuaugccucaaguuccccaaccaaaaaauaaaaauaauaauaguuccuacaacuguaaagauuguaaguuuccaaaacacaucuuaguuuuaaagauacauaaugccuuagaguaaaaggauaaacaaaaguaccuaaaucaaaugagacuaggaaucaagcagaugucacuauccuaauaucugacaaaauugacuuuaaacuaucagaacagauaaagagggacacaucauucuaaucaagggaacagucaaccaggaagcuauuacuauccuaaacaaauaugcuaacucuggggcacccaauuucauuaaaaaaaaaaaaaacuguacuacugaauuuagacacagauaaacaucaguccauuaguaggugauuucaauaccccacuuucuccaauagacaggucaucuagacaaaagacagagaaauaucagaauuaauugacaucguacaucaaauggaccuaacagauaucuacagaauaucauacccaaagaccaaagaauacauucuacucagcaucacauggaagcgucuucuaaaagagaacaccucucuaagacacacugaaagcagcccuaugaggaaaauguacagcucuaagugcuuacauuuaaaaaaaucagaaagaacacaaauaaaugguuuaaugaugcaacucaaaagaacgaaccaaauccaaaccaaaucaacaucaaaaaauaauaaaaaucagagcagaaaucaacuaaacagaaaccaagaaaacaauauaaagaaucaaaaaaccgaagaucugauucuuugaaagacagacaaaacuuaauacccuuggcccaacuaaccaaaagaaagaaaagagggauccaaauuaacaguaucagaaaugaacagggaaacauuacaacagacaucaaagaaauguagaauauuaugagggacuauuuuaaaaaccuguacuccacuaagauggaaaaccuaaaagaaauggaugaguaggauucagccaaaccaccaaaauuaaaccaagaagucaaugaccuaaacaggcuccuaagaaaugaggagaggauauaauaauaaaaagccuuccagcuaaaaaagaguccaggaccagaaaauuucacagaacaauuauaucagacauuuaaagacaaucuacaccuaaucuucucaaacuauucaaaacaaaacaauaaaaaauaaaaacaagaaacccccuccccaaaaaguaaaaacagaaacaaaagggucacucacaaacuccuucuacaaagccaguaugccagcacacacauaaaaauaaaaacaaauaaauaaauacacucuuaaauguuacuaccucagaauaaaacauuuuaagaauaccuaaaaucauuucuaauuaaaaauuuacaaaauaaucuaagugaagaccuuagaauuaggcgucauuuuaggggaagaccacaaagccaucuuuuuuggugaaaguauacuacuuuuaacauuacuacauaugcucaaaaagauagggugaacccuacaaaacaaaugaaaugccuauaaccaaagagucaaggaaaucaggccucugccaaaacaaugcugauuugcuuauaccugcaaacaaagguacacuuacuuuuuucuucugcauguauuucagaauuuccaaagucuguuuaauuucaggaaucugaccuuucagccugugaggagggaaaaaaagguuaacaaaguauuuuaccagcaaaaauaaacauuacgcugagcagugguggcgcacgccuuuuaauuccagcacuuggggggcagaugcaggcggaucucugaauucgaggccagccuggucuacagagugaguuccaggacagccagggcuauacagagaaacccugucucaaaaaacaaaaauuaaauaaauaaauaauucgggaggcagaggcaggcggauuucugaguucgaggccagccuggucuacaaagugaauuccaggacagccagagcuauacagagaaacccugucucaaaaagacaaauaaauaaauaaaauaaaaaaaaucacaaucaucuuacuagcauugcaauuuucaacuaauaugcccuuaaaaacuauuuauaaauauagguuauauuuuauaaauuuuauuuaaaauaauauuuuugauauaagaaaagauuugauaaacauugcaaaacaaaguauacuuaauaaaccauacagaaaauacuauaaggauacaaacauuuaauuaaaauauuuaagggacuaaagaaguuuagagcauuuguuguucuuucagaggacccagauucaauuccuugcaccuucgugguggcuuacaaccauccauagcccaguuguagaucugauaucaauucugaucucuacaagcaccagacaugcacacggugcacagacauacaaguaggcaaaacauucauauacauuagauauuuauuuuauuuuuuuuaauauacacugaaguuuugucuccauguaagucuguuugaggcuguuggaucuuggaguuacagauuauugugaacugcuacguggaugcugggaauugaaccuggguccucuagaaaagcaguuggugcuuuuaacugcagagccaucucuccagucacacauaaaauauuuuaaaauuaaaaaauaaaauguagggagcagcaguuaagagcacugacugcucuuccagagguccugaguucaaaucccagcaaccacaugauagcucacaaccaucuguagaggucugguagccucuucuggugugucugaagucagcuacaguguacuuauauauaauaaauaaaucuuuuuuuuuuaaaaaagauguaauacuaagcauauauaaaauacaugguauaaaaagccuuacuucauauguccaacucccuguuauuaacauuucuagaacaggucacauucugcagaagugauucacaggcucugcauuugauuauaaacuuucauuuagcuaauuauuaaaacaagauguauccaaauauauuaaaucucaagucugaaaacaucaagcaucuauguaguacuacauggggcuguuuuagguaugcauacucagcacauauucagauacaagguaggaaaggauauggacauauauaugaucuucagaggcagagaaagggccaagcugugaagcugagacauaaauauugaccccccaguucaugcaaagauaauaaagacagucaugggcuauaaaaagaaaggcaaagaucucuaucuacucuugccacucuuccucaauacaguacuucacauuuuagcuagcaaaagaauagauggaaaucaaauagaaaaggaagaaaucaaauuagccauaugauucuauaccaagagaaccccaaagucuccaucaaaagaugcuuacaacugcuaagucuucagccaucugacccugaaaacaaagagaaucucauccgaucucagugauaaauugaauuggguuugauuaguagauggaugaauugguaagcaauuuaagcaaaaauuaauagauuuucuaugcagcaauaaugaauucacuaagaaagaaauaaaaacaaucccauucauaauagccacaaaugaauaaaacagagacaaacaacagaaaccugaucaauaagguaaaauacuucuacauugaaauuuauaaaauacuaaacaaaggaaauaaagauacuagaaagguagaaggauguucauucuauguucauggaugggcaaaauuaauauuguaaaaauggucauauuaccaaaaguauucucugaacucaauccuaagcccagcaaaauuccaaugacauucuucacagaacuagaaaucacaauccuaaaauucauaugaaacuccaaaugaccaagguaaccuugaacaaaaagcaaugcuggaugaauaagaauaaaaaaaucauaaugacaaaaaagaacagacagacagagaccacugauauaaaacaaaggaccuagaaauaaacacauauagcuaaaaccaucucaacaaagaugccaagaacaucugauggagaaaggagagucucuucaauaaauggugcuaagaaaacugaauauccacauauuaaaaaacuaaaaccauaucccccaucacacuguacaaaaaaggaacaaaucaaaauucaaaauacaucaaaaaccuugaagucaacaccugacauucaaaacuacuacaggaaacaugagggaaauauuucaagauauugacauaggcuacaauuuuuucaauaggauuccaguagcucaaaauacagaauuguaaaaugaaauuauaccaaauuaaaaagcucugcacagcaaaugaaccaaucaguagacuaacaaguuuagagcggauagaaaauauugccaacuauuuaccuaauagugcauugauaucuagaauauguaaagaauuaaaaaaaacuuaaccaaaagaaaaaauaauccaauaacuaaguagauaaugauuugacguaccaaauggcuaauaaauguauaaagaaaauguucaacaccuuuaggccucaaaaaaugcaaauuaaaacuacaaagauuccaucucacuagagucaaaacaguaucaucccaaauacuugggaggcagagacagaaagauugaaaguucaagaacuaccuggacaauuuaagaaccuauuucaaaauaaaaaaaaaaaaggacuagcaguauaacucaaaaguagaacacuugccuuguacacaugaggcccuagguucaaugaaccaguacgguacacaccuguaacuccaacauuugggagguagaggcagaagggucaggaccucaaggucauccuuugcuacauagcaaauucaagaccagacuacacuacaugagacccuaucucaaaaauaacuaauuagcaguauuggcaaggauauacaggaaaaggguacuuuauauacuguuauauaauauaaaugcaauguuaccuuacauaauauaacuuauaauaccuuuuauaaaaaaaacaguaugaaugcuccucagaaacauaaaaaugaggccagagaaauggaucaaaauccuuacugaugagcaaccuuaguucaaccucugaaucucacaaaacaaaacaaaacaaaacaaaacaaaacaaaaaaacaggauucaauggcuagcaucuguaaucucagcauggcaaaaugagaacugcccgagagacaggagaacugcccagaggcucacaggucagcuagugugaguacacaaaguggcaaaaauaauagcaagagagacccugccuccacaagguagcagaaggaaaaugauucuagaaaguuguucucugaccuccacaugugcgcacuauagcacauuugagcauaugcuuguggcauggcaugcaugaaccugcauacauaugagcacacacacacacauaauugaaaaacuaaaaauggaaacacuauuugauucagcuuuauuauuccugagugcauauccaaagaaaauaaaguaaugaaguucugugcauacuaauauuguggcauuauucacaauaaucaagaacaucagaugauuggauaaacagguauauaugcaaggucuaugcauauauguagaaauagaacauuaugcaauaauuuaguaagaaugaaaauaugucacuuacaacaccauuagcagaacuuuagguuaucauguuaaauaaaauauaccagacuaaaguaaaaggaaaggaugguuggcaucagggaaaaugaauaugaucuaagcacaauauuugcauguauaaauauaucagaguaaaauucauuaguguauacaacuuauauucauuaauaauuauaguaaagauuuuuaaauguagaaauuuugauuaccuccuuuuuuucugagcaagguugaguuccauaaacuuauacuucugguauuguucauccagcuucuuuaacacuguaucugcagucucauucccaggcugcuucaugaaagaaucuacaucuuccuuuaauaugaaaaaucauacgaaguuuuaaauucauauuacaaaccugauuuuuacuacuuuguuuauaaaauguaaaagaacaaguuuuguuuuccucaaagguuuguuucauuuaauuuuuuuugaagaaaaaauuucauaaaauaaucugaucaacuuccccucucccaacuccuccaagauccucccaccucuccaacuccccaauuucucuuucuuuagaaaauaggcaaacaaacaaaaagccauaauuuuaaaaacaaaaaaaauccauaaaaacacaaaaucugaaaugaaagcauccaggcaaaaggccaggagggagaaaaauacucaaacaauacuacacaaaaagucuacaacaauacgauugaauuaauuuugugguggccgucuauuuacugcccugcauggaauccacccguuaguauggcuaauauaccuagugagacuccacuggagagaacuaauuuuucuuuucugaaagcuuguuuuuaauuaaaaaccuaacuauaaagaguuaaagauggcugcccuggagcucagugguauaccacuugccuacaagacagguggcccuagguuauccccagcacuggcagaagaaaaguuaaagagaaguuagacaugaugcuacaggucuguuaucccagaacuuaggaaguagaagcgaaaggauccaaaguugucagccuggacaacauacuuugucucaaaaaaagaaaaaaaaaguucaagaaagaccauuucggacaguuuacauacauuauguagguaauuuauucuuuauuuuucuguuuuuaauguaagacacaugaacuugccugcuuuauacauuucucauguggcucuaguaauaaauaugaaaauugcuagcaaugaagcacacugccuacucaugugcccuagucacuaaagaauugagcaaauugugugccaaaguuaucauuuuucuuacugauuuaauucaauugaauacauauuuuauuuuucaaaauaaguccauaaauauugucacccauagaaacucaagacuaagcagcaagauggaaguuggguaggauucaaauacucucagacauagaauuuuauguuguuaaaauaucaugccacuuccauuaguuuuggaacaucaagauaauuauauaaaguuuggacugcuuauuacaucguguugguauaaaauuuaaccauaaaauuuuacagccaguugucacagugucugucuuuaaccuacaaacuuggaaagcagaagcaggacaggcacuaugaauuugaggccauccuaauccaaacagugaguucuaagccaaccugggcugucucaaaaaaauaaauaaauaaaauaaauaaauaaaaguuuauuuuacgguaaaucccucagauaaaguuuguauucauuaauuccauuucugaaguuacugcuaucggguuauauuuaagacagaauggaaauuuauauauuuacauccuuauauaucaggcauuauaauaggaucaggagaaauaacacaaaauuuccucaccucuaaguagcagagcaugaccaaagagguucuaaagcucuccugacugcucaaaugcuacuucuggauaccucuauuucuggguuucaucaacuacaucuacaaaauuugaacaacaguaacucccucauaaaguuuugcaaauuuucuaagaaaauuucugaaccucagaaaauauuacuucauguaaagaucacuugaaaaauauuuuuaaaagcacagaacauugagaauacacauaaaaauuuauuccaccagcacauuaaaauauacaauauaaaaugugauuuaaguaaaagaaaaaaagggucuuuugaagaauguuagcaauaagacagaauauauauaauuuuugguacauaccaaaaaagaaucaaggaaauuuugacuaagauuuuauaugcuucaguacaaauauuuaacuugggucgguccuguuacaugaaaccuuccaauugcauuucccacaaucuucacaacugcauaaaauuuguugucuacaaacugcuuaaauaguauuacuaaaagcaaauauaaaaugguuucaaaaaccuaauaacagccgguugcccauuacauaagccucaauucuuaaaagcaagaacacauggacuuaacguuugugcuaacguuuacuuuucucagcagucugcuuccauucccaaggaaacggaccacggccgugcucaagcugacugggugccacucaguacccacacccuacaaacagcugcucugccugcucucugugcuaaauguccacccaucuacaucuccggcaucacugcggucuugagcucaauaaccguugcugcuguuuuuuguuuuucuuuaggcgacaacaggcagcaacuggucaguuucaagggacgccacgccccaauccgccucgcauccgucuccagcuacccaguucuccucccugcucccucuucugggccgggguuggacuaccuuucuucaaagcuaucgcccgccaggccuaaaaagccaagaugcaggaagaggcaaaaggccagacauucccuuccgggacccuuuagcucuguuccucccaacgacccagaccugggaagugacuggaaagcaaucuccaauaucagauuaagacgcugagaaagaguuucuuaccacaaacacugcuucaggaaucccuaaguggagccgccgcccguuuccagcagcaguuucuaggccgcauccguccuuagccgccgccaucuucagaaagcaccagagcaaauaacuaccuucugaggcaucg

SEQ ID NO: 12595 - RNA, 24528 nt, Mus musculus
uuuagugacuggaggucccucaugagcacagaaguuuauuagcauucagcaaaugaaauauauguuguaacauacaggcaguguaucaggauauccagaugccagugagugcuagggauggagagguaacaaaugcagaugauuccaugaugucucaggaaugcggaagggaagcucaggugcagcaacaagcuacaauccccuuucuguccuggaagagagaacucuuacaccuagacucauaucuuucuucuucccccagccauuuuauuuaacgugaccuaaauauacauuucugguuuaccccagcccuuccccacccccauauacagcggggaaaauaagcaccaauaguaacaggaauaauuaaagcccccucuuaauagacccaacccucacaaauguacaugccauguggauuuucuucuuuggaaugacuacaggauggagaaaccguggaucaggccacccagccaugacuguaacagucaccauuccuaaaagugccauccugguuaaagagacaacucagccauuaagggcuaagacuuacaauaaaaaaacaaaacaacaagaguucaguuuccaaaaguaccauccacuugugagcuggaacagggaagggaaggaggaggcaggauguggagagauucucccaaaguagcaagagggaccaaggaaucaccuaaugccuuuucuggacaauguugccaucuucuaaauugcuggcaagucucauucaagggugucucccaaggagaugaccaauuccuggagguugaaauagcauugucaucugucaucccgagucuccugguguugaaugagccccuaaugcuccauuggagaaacuuaauacaacaaaccacacaauaugggcaugauacuuugcaaaaaacaagcacaaaauauaaagaaaggaaaagaauaaaagucaagaggcaggaguacuuucaaaacgucuacacaagagaaggaagggcucaaaagguaaauaaaaugaaagcuagaaaacaugcugucugccaggguccacaugcuugcguuaccugguauuggucuucgguacaugggcaucuucuguccuuaccguguggaaagagaaugaauagugugacacagccaggugggagagggaaaagagggaggguccuagacacuuugagaugacaucccucugcacgagcagcagcauuuuuugugucaucuuuuuuuuuuguuuaaaacuguaaacagcaccgcuuaaaaauaaaauauaucagaaaagaacaauugauaaacauuguuuccaugaauauaaaaugcaaacaauauaaaaauagauaauuagcuuuugauauauauauuuauauauauauauuaaaaacaacuuggaugcaacauacacauggguaaacuugaaguaucccugguaaacccccaugccucccucuagcaagugagccuaagggcugaaggcagugguggcacuggugcaggugaaaaagccacugguggcaggaugaaaucaugcacccaacauucugaguguggaaagcuacuucccuccuugaaauagcacuaagaggagggacacuggcauuuacugaaaccauuauccacgaggcuuguggucugguaucuaagcuaaagccagaugauccccaaggcagagcuuccuuggagaaucuaaagcaccaagaaauuggcauccuggcuuuggaagaggccugcuagguggcuuuccauacccacagucacugguccucuauggacuggguuacuaagaaauucucaggaucagagcugacacuauauaguaguacuggguaacaacauaaagcuagccuccuucugucagcacaucuucccuuaaagucacauccaaaugcauuguccaaggaccugcaauggagucaggagguucaucuggccacagccuuagggugaacacaauagcagcacuucugguaguuuguagcauauuuggugccagcaaaggaaguacuuguccauguuuggacagauaccuagagauugguuacauaucccauugguaaucauguugccauuaccauauauccgcagccaaaucuucuuuccccuucuaggcugcaguuaguauuugcuuuagauacucaaaaggagucugcuucuguagacaucuuggcuaucccauuuuagguuguaaauauuuugucccuaggcuagcagccagaucagugaaaggacuuggaaggcaaugauguuacccaauccacaaacuucuacuuugccucagguccuacucuaagguaugaaguuucaaagcauagcaaaauauauccaaguuauagcaggucccuucagagauauugcacugugcuguccuccugaacugugaggguagauuccuucuuccucuuccaaacaggcugguagcccuucuccagugggcuauggaggcuguggacagcucuagugccugcuguagauggcagcgacauguaaacagcaacucaagcuaccuugacuaggcaagagguguggcuuuuccuguuguaaaggcauugagugcuuacuuccugccacccaaccaggcuaaguucagccucaccuucccagaacagcuuugguaggaggccaagugguuaaaaucugggcaugugucucuuaugacgaugugguugggguaaggaaggccuuuuucacuuucauuauccagauccacaagagaugcacuucuucgugauguagccaaagucauccaagagagcugaucugagguccuugaggggugguucuagugcuggugccaugcaaaguuaugaaguuacuuacaagggguuagauuuuaccaaucaaaucugcucuuuugggggaaaggcacagggccaaucccaagcuuagaaacugugaaaaauauuaugaauauaugcccuggcaaagaaaguaugucuacaaagcaaucuugacucagaaggccaccagcaucuguucucaagguaaauugccuuauuuugagcaagagcccuauugauaucuucacuuaguagaugugaagauggcuuugaggugagaagagggacaugggcagaagauuuaaaaaguucuaacuuugaucaacauaucgauccccaaaauauuucauauuccaauacagaaaaaaauuuaaaacaaggucuaucuugcuauguagcccuaguggccuagaacucacuauguagaacaggcuggucucacacucauauaacuccaauugccucuuccuucugaguguugagauaaaaggcacauaccuccacaccgggccugauggagaauuuuaaagaaacuguuucauauagaugauuaaggaaauguugaaccuggucaagaugagccuguugcaauguuuuccugacaccaagcucuucccuaguguuuccaacauuuaggcugggcuugcuuggaggcagaggcagguggaucucuguuaguuagaagccaucguggucuacaugguaaguuccaggcuagagagaacuacagugugggaccuuguccagaaaaaaaauauagaaaaaagaaaaagaaaccugcauggaugcaagagaagagagggugcuguucauuucagaaaggacugcaacugccaugcaaaucagcccuguaguuuggcagagcaaggguacauuacaaucuuuccucucaagaagccugguccuuugaaaaugcuaagaacuuggcuaacuggaagauaaaagcuuuuuagugugccuacaacaggugagaugccuuuggcauccugucuuagacaagcuuggaaccacuuuacaaaggggcggccaaggguuuauuuauuuauuuacuuuugguuugggagaaaggaugggaaaaguuuucccuccuaaucugaguugcuucaaguuccaaagucugagaucccuucuugguguuuagauaaauggaucacccugucuguuuuccucuuuugcaucucacaacacccaaugcucuauauagucaagcccaauuuagguggcuucucuuccuuuaacucaguuaagauacuacauucauugugaugagaugaaauuuuucagggacaggaaaagggggaaguucuaaaaugccugcaacagccacaggcuuaggaaacaaacaagauagauauauuauuauuccacagcucaagaccucacagcauuuuccauaagcuaucuaucuuuguauucugcuugaauauggacagauuuaaucacccccuuaugaggauuaguguuuuugucuucaaucuagacuauggcaggccagguuaaaaggacaucaucuaguugugauaccaaaguccacagcaacagggagcgagacacaugcuacuugacccacucuaaacauaacuaacugggauaaauagguuauagucauuugaugugcuagaaaggaaugggguuaggaaggcuauguaccauaacuuuauauugcuaauagcuagcaagccucccaucucugggugagagucagugcaaaaaauuggcugcucaucagugguucauuagucagcaagggaccagagaagagggguucagccugcaauaaggaugcaucccaagcccuguauaggucacaagaaacuccaaagcaaaaauuggagcacagaagcagcagccucccuaggcagauauaauugagcugaaccuggccaaagauggcagaggaaggugggcaaagugaaaacucagaggaguuuaucuuagccaauaagauuuucaaguggaacagcacuacucaccccuaccccucugcccaacccuugacccccaauucacaugcucaggucuccauucuggaauugauaacuacuuggcuagguuuccauucauggcaguagaggaguagcugguagagagagaggcaccuugcucaccccucuccuuugacaggucaagguuggaagcucgauagugauuggguugaagcuggaaggguucaggccgcacccugggcagcugagggauaccaugggugauaccuacaggcuuggcuugagacugagaguuggcuccagaaauggaagagcaacugggcucaucuacaggcagcaguacaucccgaggcuuggcccucccacucugggaggccugugauugaagguuauagcaagggcccaugggcagggguaggugcgaaggucgagcuagcugagacacagagucuccagguguucuuccuggcacugacacuggcauugccacaggagguacacaacagguugccugcacauaggaagacugauugaaaggcucauacaacugauuagggcucauccaagcaagaccuggccccacuggaagaggacagugagcccagggaggccagucauagaccccuggagguucaguguagagagacaagggacuaucccgaccccauucuccuuccucuucuucaccuucuucaucugaaucuuccuggugggccuggagcucaucagacuccauguaacccugggcuaggugagaacuggagagcuccagcuccagagacucugcauugucaagggaacggcuucuccuauugagugccauugcagcaggaggaggucgaggguggacuccggggaguccuaaguaucgagggaggcugcuaacuccccagggcaggccuugguagaaccgacugugauagcuguugaaggcauguuugugguaauaacccagcucaaaagcuuccaaggaggcuguaagaucuucgucauuguugaacucaggauucucuucacacuugccuucuccaucucguuccacgucagcaauaucaaaggugaccauggggggcagcucagggagguuuugagugaaggaugagucagaaucagagcuguaggacaugcugguaaaaagguuuccauugcuggugaacucuacuagggccugugagaaacucacaguggcauucccuuccuucuccucuucuucuuccucuggcuccucagggggugaguaacuaggguacgccuuccugggugagccuccaaaauuugcuucuugcaugucuggcucaaacauggcaucacucuggaagagcugcauuaaacaaguacuuugaucuuuuuuggaacaaguccccucaaaacgcuucuccagaggacggaaaucccuccagucuggcucacugcuagaaguagcagggaaagcugaagugguuccccggugagaagucugagaaccuccugaugucccugccaccagacccaucacugagggaccuaagggccucaucugauacuccaaggcaggcuucuccugccguaccuuggucucuuggacucgacccucuugagaaugagccucuaaggccugaguuucucgggcucggacauuucugccauaagauucccgaguaugggugucucgggcauaagcuucucuggcaugagccucucuggcacaugccucuugagccucacgcugcucccggcgaaguucccaguauagcaacugcuucuggauggucacuagccguucuuccucgguuuccauugccccagguggccgagaagaaaagggcuccaaguucaagaaaggauccaacaucucugaguugcguccacggaggucauauaggcagucauccccagguggggagugcucaagacugucaucuggcucauagaacucauauagcgcaucaccacuauagcugucccuggguagacaaucccugugggcaagucccagagccucaccugaaucauccucaaauccuggugugguagagucauaauaaccuucaucacuauugggagcagacucuugcuggucgcucugaggugucaaaaguucuccaaggccuagauuaggauaagacugaacugggucaagaagcauguagcccugguggcugggagauauagcaguaugguagcccagauucauauuaaaucuuggguauaucugggcacuugcccacagauacucuaagucaucauuuuccucuccauccuuaaccuccucuucauccucuaauaauucuucuucuucuucuucuucuucuucuucuucuucuucuucuucuucuucuucuucuucuucuucuucuucuucuucuucuucaucaucauugucaucaucaucuggcaaggccaucuccuccccaccuccuugguagguuaccaagcaggaacuucgcuuggucccaucucgguuggcccucuggccaccagaggccaugcuaucugucaugcuguccauguccuguucugcuauaaugucaccacaaccugucagugagucaaagcuuuuuagcgauguaacauccccaaacaagaggcuuagcugauccccaacagggccauuggguggguuuacuucuccugccaccacuuuuccuucuguuucugaaguguggggcuccucuagacuaccaccuucaagaacaggcuugggcugcaugaacucugaggcacagguccuugugaguuuuucuggauuuuuacaagcugccuucucaguaguuggugaaaaauguacuugugcuggagacauuuuugguccaggggcauccugggguuuggcauuuuccuuucuagugucucggaauaucuccucagagcugggcagagagauugaacucacaugcucaugagaccugguucuugcccccucaaguuccuuggccccuggcacacuuuggucagccccagaagucuugcccuuccggugacggcggauacugcuaaagaagcuuuuuaggcuuuucuucggcuugugcacagaggguaccuucucaacuccagcuuuuucuauggcuucagucccagaugucuuauguuuagagccuaucuccaacgcuccauuggcacucugggagcuaggaaauugagcagaugacuuggacaaagguguagagaggucuguuucuucaaugacaacaucuucaggucccugagacgcuucacuuagaccaucgugagucuuacucuuguuuagacuuuucuuagagcugacuuucccagaaccuuugcuucguccacccccaaagaaacuaggcagaguacagauucccuucuugccaccaaagaguuucauggcaguuuucuucagccuaccugggccugauaagggaggcucugauguugguccuucuguugccucaguugucuuauucuuggcucccuuuucagcucccuggucuugggcaucgcuagaaguugaugcuccuuugguuugaacagcuucauccuguugacucuccaugaugaagacaauucuuccacuggauaugcugccuuuggauuccgggcacacuuauaacaugaucagucaggaagcaucacaguggggucugaaggagauaagagagacaaagacagagauagauacuagugagcaaguacacaggcuagguugguuuuuaugggugcuuacugucucaggauucaauuagaaaagagagaaaauaacaaaauagaaguagaagguacucuacccaacucauucuaugaagccacaauuacucugauaccuaaaccacagaaagauccaacaaagauagagaacuucagaccaauuucccuuaugaauaucgaugcaaaaauacucaauaaaauucucgcuaaccgaauccaagaacacaucaaaacaaucauccauccugaccaaguagguuuuauuccagggaugcagggaugguuuaauauaugaaaauccaucaacauaauccaguauauaaacaaacucaaagacaaaaaccacaugaucaucucauuagauguggagaaagcauuugacaaaauccaacacccauucaugauaaaagucuuggaaagaucaggaauucaaggcccauaccuaaacuugauaaaagcaaccuauagcaaaccaguagccaacaucaaaguaaauggugagaagcuggaagcaaucccacuaaaaucagggacuagacaaggcugcccacucuugcccuaccuauucaacauuguacuugaaguccuagccagagcaauuagacaacaaaggagaucaaggggauacaaauuggaaaagaggaagucaaaauaucacuuuuugcagaugauaugauaguauauauaagugacccuaaaaauuccaccagagaacuccuaaaccugauaaacagcuucggugaaguagcuggauauaaaauuaacucaagucaauggccuuucucuacacaaagaauaaacaggcugagaaagaaauuagggaaacaacacccuucucaauagucacauauaguauaaaauaccuuggcaugacucuaacuaaggaagugaaagaucuguaugauaagaacuucaagucucugaagaaagaaauuaaagaagaucucagaagauggaaagaucucccaugcucauggauuggcaggaucaauauaguaaaaauggcuaucuugccaaaagcaaucuauagauucaaugcaauccucaucaaaauuccaacucaauucuucaacgaauuagaaagagaaaucugcaaauucaucuggaauaacaaaaaaccuaggauagcaaaaacucuucucaaggauaaaagagccucuggugguaucaccaugccugaccuaaagcuuuacuacagagcaauugugauaaaaacggcaugguacugguauagcgacagacaaguagaccaauggaauagaauugaagacccagagaugaacccacacaccuauggucacuugaucuuugacaagggagcuaaaaccauccaguggaaaaaagacagcauuuucaacaaauggugcuggcauaacuggcgauuaacauguagaagaaugugaauugauccauuccuaucuccuuguacuaaggucaaaucuaaguggaucaaggaccuccauauaaaaccagagacagugaaacuuauagaggagaaaguggggaaaauccucgaagauaugggcacaggggaaaaauuccugaauagaacagcaauggcuuguacuguaagaucgagaaucgacaaaugggacaucauaaaauugcaaaguuucuguaaggcaaaagacacugucaauaagacaaaaagaccaccaauagauugggaaaggaucuuuaccuauccuaaaucagauagaggacuaauauccaauauauauaaagaacucaagaagguagacuccagaaaaucaaauaaccccauuaaaaaaugaggcucagaacugaacaaagaauucucaccugaggaauaccgaauggcugagaaacaccugaaaaaauguucagcauccuuaaucaucagggaaaugcaaaucaaaacaacccugagauuccaucucacaccagucagaauggcuaagaucaaaaaauucaggugacagcagaugcuggcgaggaugugaagaaagaggaacacuccuccacuguuggugggauugcaaguuguacaaccacucuggaaaucagucuggugguuccucagaaaauuggacaagguacuaccggaggaucccgcaauaccucuccugggcauauauccagaagauauuccaacuaguaagaaagaaacaugcuccauuauguucauagcagccuuauuuauaauagccagaagcuggaaagaacccagaugccccucaacagaggaauggauacaaaaaaugugguacauuuacacaauggaguacuacucagcuauuaaaaagaaugaauuuacaaaauuccuaggcaaaugguuggaccuggagggcauuauccugagugagguaacccaaucacaaaagaacucaaaugauauguacucacugaugaguggauauuagcccagaaacccagaauacccaagauauaaguuacaauuugcaaaacacaugaaacucaagaaggaagacccaaguguggacucuuugucccuucuuagaauugggaacaaaacacccacggaaggaguuacagagacaaaguuuggagcugagacaaaaggauggaccaucuagagacugccauauccaggaauccaucccauaaucagcuuccaaacgcugacaccauugcauacacuagcaagauuuugcugauaggacccugauauagcugucucuaacgagacuaggcuggggccuagcaaacacagaaguggaugcucacagucagcuauuggauggaucacagggcccccaauggaggagcuagagaaaguaacuaaggagcuaaagggaucugcaauccuauagguggaacaacauuaugaacuaaccaguaccccggagcucaggucucuagcugcauauguaucaaaagaugaccuagucggccaucacuggaaagcgaggcccauuagacuugcaaacuuuauaugccccaguacaggggaaugccagggccaaaaagugggaauggguagguaggggaguggggggggggaggguaugggggacuuuugggauagcaugggaaauguaaaugaggaaaauaccuaauaaaaaagaaaaaaggggaaaaaagagaauuaaaaaauaauuuagaucauagggcaaguaacagguugagcacagcuaaaucaaauauccaaaauuuugaaacacauguguuaccaacgucucacuuuggggagcacucuauacuugauuagugaugaccaaccugaaagaucuaugcaacccuucccaaacuuaaaauuuuccuacucccagccucaaaucuggaauacauuugguccaaaagaaaccucagauaaaggaaagcaaccuggauuaucucagaauauucaauaaaguaagccaggcauagcagcacacgucuuuaaucccagcacauggaaacagaugcagguggcuaucugugaauugggaauccagccugguuuacagagggaguuccaggauaaucagagcuacauaguaagacccugucucagaauauaaaauaaguuaaaauaggaaaacaaauaaaguaaaacaaaggucaugauucaaacaugaacaccaaaccaaaccaaaaccagcaauguaauuccuuggaggccagggaggagaagccucacacugagggucaggagcauguauuuccucaucguccucuggggaugcguuaccugagccucucugugccaacagggaacaacugcuguacagagcaaacaggaaaaaauauuuaaaauuauuugcaucaagauguucacaaaaaccagcuuuaaagucaaugguuuuguaagcagcuguaacuuuaaugccuugguucuccacagugcacaggguuacuaaaguuaggcaagaugcguuucaauaacucugggucccuguuacacauaaaugaaacaacaugguuuuuuuguuguuugcuuccuguuucuuuaugccacgcauuuccuuaguaauuuaucuugauuuucuccucagauuuuugcucuccacuuuuccuaggcugaagugaaggacuauuugacuugggauuuaccuuaaaccucaguuaagaacaauuuuaccugugacccucaagagcuuuaaucagaacaucagguuucaagggcuuuuccgccuucauuuaaaaucacccuuguacaaaugaaauaaauguuaaaaagucuaaaaaacaaaacaaaacaaaacaaaaaaaaaacaaaaaaagagagagagaaaauaaguaaacacugguaaaaccaucuauuccauauguuuuguuugcuggucuagauucuucugagcuccagggcauuuuaaacccuacaaugagcaacaggcaguucauugcagcucaucagcuacccccucacuaauccacucccuuuagacuguuuuaaguagagagcaggauuugacagaggcaauuguaggugugcaaaagcccaguugcgcaauugucucugaggaagcuuaucaguuaucagguuggggucaggaaaggaguagagagguugcuucuagcaucacugaaguuuugaaaauuguguguggggaguugcucauugagccuucauuggguucuacuggauccaggccuuaguuaaacauuaacccguacuaucaccaacauucuucugagggcugggaagacaaguguaucuacagcuuuaucuucugccuagagguucucuuaauugccccuaggacaauggccaaaccuuuggaacaccagagaagaaacaacauugaguugcagaucagagcuguaauguaggaccugcaaaaugauacgguagccuccgaaaaaauaucauccuggcuucuguauccucuguccaagaagcuuaccagcaucuaccucuuuaaguaaccccuuauggagacuauaugagggguagaucuagaccagaaucucuauugacucuuccuggcaaguggaaacaccagauucuacuguagaacuguaaggcaaaaauuucuucuacuuuguuccucguaauaucuugauucccaucuagguugcuaucuagaaagggaacuugagaacacacaacucuguaugauucaugcuccuagccuaggagauauuuaaguacauaaacuugguguaagcugcacaauucugcucaaggcuaccuagucccaaugccaauagaacuggaauuaaaaagaagggcuaaauguaaaugagcuaaauaccuaauaaaaaauggaaaaaaaaaaagaagggcuaaccaccuucuacaccaacacaccccaucauucccuugguuccugacaagucugguauuuuccagugacaguaaacaucuagcauuuaaaccagugauuagccuucagaaaucuagcgauccuuucuuagaaagcccuucccuucucugaacccucuuuguagaucuaaggguaacaaagggagacagaagagcuguugggauugagagagcaagaugcuaaaacagcaggggaagggagagagugagacugaagcagucccaggaaucacuggccagaaaacugguccagugacugaaugcuacauuaaggagauucacacaguuaaaauaauguaguccagcacuggagcugaagagaaacuagcaacuauacucuagccugugauuucauuagacaaaccucuccuacuacaauuucgugccuggugccucacuuaguuugacacauuuaaaucaucagaguuacccgaguuccagugcuuugcuaaacaaccagagucauacacuucugacagaguuacagagauaagagaaaaacucaucugaucuucucagugcagagauuuaaguugcuauuuucucaaguuaugcauuucucugugccauauaucuugacauuacacucucaacacucagcucucuaaugaauagacaguacccucaccacuaagcacaugacuaccuagaauucugugccucauguuauaaugaaaauaugggcccagcauguagcugaauuccuuaguauuaaucuucucacuucagccuugaaauuacuaacaggauugccauuauggcacuggggauggggguggcagcagugaaguuauaugugaaacuguauuuccugguguguaauuuguaaauuaaaucucucugaacauucaguaagugacagacacuaaagucgguguaucaggcaacacuaagaaguggaacucucaguccuagcuuuagagagcuuauaggcuaguagggagaaaaucuuaucuacagaaguuugaagauacagcaaaauauaggccuucaaagaauagccuauuauuucuuuuuguuuguuugguuggauuuuuuuguuuuaguuuuuuuauuuguuuguuuuuugagacagggucucucuacauaguccuggcucuccuggaguuugucauauagaccaggcuggccucaaacucacagagauuuucaugccucugucuccgagagcugggaucaaagaagcccugucauuucuuuauacucugcuaaugagccuuuagauaaaaauaaaagguaaaacauacucccugggcucagaaaaguugccuugucccaaaaccuguggcuggggagaucccagaccuuaggagagaaccuacuacuauuauuuugcuaaauggauucacuaccaaauugcuuucuaagcacuuuauacucauacaucgguacagcucucaacccccaucagggcuucuuuuugaaguagacagugauuaaugagaugcuguagaguacucaucucucaagauaaaucuguaucaugccuccuaccccaaaauucagggaucaucaaggaagagggggcagaaauacuguaagaacaagagguaauggaaggauauugcaaaaucuuuucuggauaugcuaaagcuacugcacauaugaacuuucagcaaccgugacugcauguccaagaccugcaguagaucaagucagccaaaauuucagcauggauugguaaaggacucaagagcccccuucccuucaugaagagcuaauggcaggcaaugauggcugcuguggggagggagucagcuuucuucagaaguguggccccuaguguguugcuuguguuccaguggauaguccuauauccacacauauauggcaucacuaauuggacucauugcaauagaaaacaaagaagagggcauuaaguuguaagggagauggaagauggguccugggggaggagaggggaaugauagguggguauagucaaaaucacuuuacacauguaugaaauucuuaaacaacagauacguagguagaagacaaguagacagacagauagauauauugauauauagauagaugauaaaaaagagaaaagaaaguaaagaugcuuugaggaggaagaagcuucagucuggacucugucaagcaguagggaauggaaauggcagugaucuagaugagguauguguucuuauccaucaaaggggacucauucuaguggauucaaucaggcccagggagcaguacugguuagaaugagaguaucccccauagacucagaugucuaaacaccaccagaugguggcgcuguuugaggaggauuaagagguauaagauucuuguaguaaguuuugucacuggaggcaggcucugagaguuuauaaagacuaugccaucuguaguugguucucucugcuuuaugugugaagcucaagauaugaacucucagcuuccuguuguugcuaugccugcuaacuacugcccaugcuaccccaaucauuaugaauucuaaacuucuggaaccauaaauuaaauaaacucuuugguuucuguuuguuuugguuuguuucaguuguuuuuuguuuguuuguuuguuuguuuuuugguuuuguuugguuuuuguuuuugaauguggaagauuucuuuggacuagaaaagcaguugaaugguauaagcagagcuuaaugggcugagcuuggagacagugcucagaucaaaacagacucaagaugccuggcucaggauguuucagagggaagcaaaaacuucagcagcaacuaugcuagagaaaacuuuuguguuucuuuggcaaagaaucugguuucauucugccuuugucacaagaacuuuccugaggcuaaauuuaagacuaauguacuaauuucuuugguggaggaaauuucaagguagcaauaauacugaaucucuguugugguuauucauagugacuuuuacgcagguguacaacaacaaaaaaaauagcaaguaggguagaaggaauuauaaaauguaaaguuugaagaaaaaagaaucaccaggaaacuuaaugcuacgccaaagauucaaaagcccgaggcuauaaaguauauguccuuuacccugggacagagauucuauuacuucaauguagaccucccucuuacccagaccccagguuauguuuugcuaagcaaggaucaaucuuaaaacuauguuauaucucucucuuaguuuuuuuucccuuccagaaccaugcccuugccuguguuccacagaacaccuugaaggaguacaguagaaauauuauauagaucaaagcucccuaaaucuggucuuauuuagcuaucucuacccuaaggcuucuucacacuccuuauuaaucuaucaugguccucaaacuguccuucuaaaacaugcgauucugcuuugaccuaggguaagaagaaguccuucaggagagagaacuggagcccaaaacauaaggaacagcaaaggacaaacucuaaagcucccuuaggcugggacuggcuuuccuuaggcucuugccaagaaagugguccugccaaaugcagagcuccucaacacucagauuucucagucaguguggcuggcuguuuuucagaugggcuguugggaacccuaccaagauacuugauauucccagauagagacuacuagcugcagucacugugacuguagcagaguacaggcuguggaagaaaaugauggaaccacuuaaaauccaagaaguaaccucaggccauuuugggacaagcaaaugcuggcucccaaagaagagcguccuucuuuucaccucgacuuaaaccccaaguagaagaauagccacagacucaccugaaacacuucucuugaggaagaaacaguuuuaguucaaccuugacauuuucuguucuuggccuagcccuugaccaguuuaauagacaggaaagaaccuggguacagguucagaggcguggccuuuacccaugauaguuuccagacucauuccaagcagucuuaauuuauccagucccucaguauguuaguggagagaggguaaagaagcuguaaaaaugcugaguauccucccuuuagagagcuagacaguucuucacuggaaucaacucugccacgcugggagaauucagcaaguuauccaaccugucugacccucauauuccugaacugugaaauggggcuauugagaauuucuacuuauugagauuauugucgaaacaaacccaaugcauguaaaguaccaaauaaaauucauugcacagcaaaagcucaaauguuauggcaaauuguauuaauguguaucccaacgauguauggcuggacaauuucuagcaguaaaucaaccccaaucaggcauucuccaaagcucuauagguaucucugaaaccuuuucaguuuccccuaaauauaaauuauggugauuauguaguuauaccacaggaagccuuacuugcucauuagaccaacuuuuaaugucaagggagcuaacaauguuagaucaucugcgagauuccagauaggauccaagccagaaagaucaacauuuuaaacugagcuaaaagugccacaaucaacagaaaugcaauuaacacacccucuccacccaccguguguaccuaccaguauacaaggcgcucccuauucacuauucccacuauuucuucccgguaccacauuaaucccugguccuggcacaugguaaagccuugucacugaaaagaaaaaugugcccggacuuggggaaagauuugucuaaggucucuaaugggaucaugacagaacuugaguaguuucuaggccucuugaguuccacuucccuggcacucugcuucacuugugcugggcccccaauuaaagaauuaggacgggugugaauaugaucaaaacacacuuaugaaauuuucaaagaaccaguagaacauguuuuuaaaguacugggccaggagaaaagcaaagguucccuuuauaccugugaauagcugucguuuccuuucauuauucugcccugucucagcucacuuuaacuuuuccugaaggguuucuugucuauagcuguuuuuggucuuacccagugcauucaaaaaacaaaaccaaccaaccaaccaaccaaccaaaagacaaaagccccugaugaccucaguacucaggugcuaucuauucagcuggugaccucuucccucaucaauaaaugcugucaccacuccuuucaaacuacgggacauaucuucuguuuuguuuccuugggagagaaguuugagguacaaaaauuuuuuuaaaauuaaaaaaaaaaacccaaaaagcugaacuagaaagcuaacacaguggacaauuuugaaaaguuugaccuacuuaaacauaauguccucugcuacucaaguagcacauuacuggugcccauaaccaccugaggucaaaauguucaugguaugaaagaagggcuccugguuuggaacaguggaaaugaucgaaagagucccccuuacccacuccugcaccacucuucuuuccgaauuugcagcauucuuuucagaaaacaacucaucaguucccgaugauccacaaaucccaaagcuggccuuguaucccugccuugauucccucugucuucagcugcccuguucacacaugcauccuugcuuacuuccuucuggcaggcuucaguguguccacugagguucucucacaaggccucucucagucacugcaucuaccuuggagcacgugcuugggaugcugguucaguuggacucuaacucagcuggaguuugccagccugaaacuggaaugccagucucaccccuuucaggcagaaccauuugagaaaguaucucucugagacagaaguguccugcaugugugaaaugaagagaaaaauacaccauaucuugcaaaacugguuauggaugcaaaggcaaacuguuuacuaugcauggagcagauaacuacauaaugggcucuuuggaugaggcugcuugcagccaaggcaccuugucucuauuugucaauugguccccaccggaguccucugaaguugauacaagcuuucuaaucaaaccccuuugucugaccuucaauaucugcuuuucccaaacgcccacugaaaguuuuucagcuuuauuucucuacccuaaggucucagaauauacagggaucuuauucaguucagaagacaggguaccaaaacacagcccugaaaugagccuucuugaagguuucuuuuuuucuguuuuauuuccggguuguuuguguuuuggugcugggggaauacacacagcaucucauaugugcugggacaguauucuaauccucagccccacuccaccccaccccaccccugaggagcauccuaaugccucagcuuugaucauuucucagcucacaaucagaaucuuuaagauccacuuacuugccccugccuuugagucucaucagagagauuauuuuaccaaguagaagcuaugucugcacaacgcacccccaccccccugcagugugucaguacuagccaagcaaaggcaaaaucagagacaggcuguaccugcuccaucuauucagaaaggguaggaaauauuuccucuuggggcuaaaacuuuaucaucuaguucaucugccuaaacuggcuuugcacagagaagcucaggagaugacauccagagucucccuuuuccauuuuagguagccuaacugcgaaggagugagagagcuagaacucccuucucugucuuugguucugaggaguuacaaauauucccugauaaagcagaaagacaaggaguccauggcuagguaauaaagauggcaaacuuccucacccugcaggccugagacaaaagccuggcagcuuaaaacaaaagccuugcaggcuuuuucuccagguagaaggccucuugcugauggacuggcucaacaaguuuaaggccagaucaggacauguuuacacaacaguuuugggucaaucagccaucuggccuuucuucaaacugaccaauccuaaauuagugaaggaagacccuucagaaacuuaccaagaaaaaaaaaaaaacaaaaaaaaaaaccaaaacacaacaacaacaacaacaacaacaaaaagaaaagccaaauaaauaaaacgaagccccuaaggagccucugagcucuggcucccugaguaccccucuaucuugugaugggucuuccccugugcaugcuugcuguguguaucucuguguauguuucauacaugucauacaagcauuucuuuacaagcacuguguugcuguuugcuccucugugcuguguuccagaauuuucccacugcuagcugcauguucaagauuuuuccugccuuuaaauuauuuaacaggcagagaaaacaaagcugaucaggaccccuagacagcaaagguucuacaaguaaacucaugagaagauaagccugcugcuguuuuccuuauuucuuuggacuagugaagcagggguauuucuuccauacacugagugcaaauauuacaguucuugaggugccaacuuuucccaaauacuucccuucuccagauacuuccagcccccagcaggcugcaagccuuaaucucuugacugagaggaaaaaaaaaaguguucccagaaugcaacugccacauaaacccaggcagcuuucacuuuuaaggacuaggcuagugggaggagggaguaguaguucaucaaaugugcacugacugaguggugcuuccuggagaccuugggcacaacauaaaggacuaccacaaaagagcaauaggcuguaucuccucaaauugcugugucuugcuugcuuucuaggccacaucuaugaccauagggggcuuaacugcuaguccacacaaaaaccuguguagcugagagaugugggggguaaaaagaggccugaaggauauuucucuagcuuuuagcaaauaaguauuuaggcccaggugcuccuccccaaccuaugaaaugccaaaaggaaucuuacagugugaaauuucccucuugugauagcaugccccuccccacaccucuacuuagaacuuuagagguaaccuguuaccuaccuaacuuguaggaugcuuucaaucucuaagaccccauuuaaaaacccuuucaaaaacucuauuauugggcugguggugguacaccccuuuaauccuagcauucaacacaggcaaauaucgaugaauucaaaggcacuggcuuacaaagcaaauuccagaacagcugggacuaccuagugaaauccuguuucaaaauaauaacaaaaccccaaauuaccccaauacaaauacccccaaacaaucaaacacccuuccauucuuaucgcugguucgaaggugcauccaccacccccaaccccugacccugaccagccuuuguucaaugaucuaaagaucuucgccuaaaaagauuagaucaccauuucaaggcuugauguuuggcaguucccaccacuggguccuaaacucuuuugcaccucugaguuaugccaccuccaccacucacccugccugccaggcacucccuuucauuucucauucugucuauucuuucucuaccaaacuccuguacuucccagcugcuuucuaaaugcagagagagagaucucuccauggcacuuugccuguaggcucaugaaucagcaaccaaaaguaugcagagcuccaggguuugagcaguccagacccugauaauagagggaacuaauuaugacuuucuuuuugaauguaguagcaacccaaucccucuuuccacccacacuagguauauuauauccauaucugagccuuaggcacguuuacuuuauguuucauggauuaaggcaaacacaaguugggaggauaaaggucuuuucuaaaguucuacaaagacagaaaguccuucuggaacauucacucauuaauugcuuuauaaaucuaggauccuagaggguuguagcugaggccuaggcuuuauuuaccccuaugaggguucugagagaaccuaaauaccuauauaagggaaacaaagcagagucagugaaacuuaacuguacaggaguuccaagaggucugcucaucuagaagcagccugaaaugccccaaagagaaaguugguugagaacugaggccugaaagggagggacuuggacaaguguaggaugagaguguuugagugugggaaaggugcuggacugaagucaaagcagggcagagucagaugcuggaaauaaaagaccagcugcaaagauguguugaggucuggucaauuagguaggggugaaaauaaugugguauccccaauccuagcuuggguguaugugugugugucuauauagcuauaucuauagauagauagauagauagauagauagauagauagauagauagauaucccauguuaacguuacaaaguaagagauuuauuuacugggucucaaugccccacuauaaagcuguccagccugcacagucccuuagucaaauccccucucuuauucuucaggaaugccuuaauaguccagaguggugcacagaguagggcacucgaaggaaugggcuuuguuggaaucuccaaugguaggacagaaaguccaacaaugcagugcccggagaccaguccauaccaguguugcugaggcaggccagccagagacgcagaagacauaugcgaacagggcugucuacacuucucucaaggcgaguccagcgacagggaggaugguccugcuguauuagucccgcugccgccuuugccucccauggcucaucuggcaagcuuagccccucaaaggggagcucaggagaaaucacgccuuugggcggucaccagugucagaggugucugcagcagacaaugacagcagucuggcaggcuggguauuuuaaguaacugagaaguuguaggauuugucugccuuauauauacuguguguucuuuacuacaacgacggcccccuccgccucuagcagggaaauccccccacaauauugugccuauugcuauuuuaaaccaaaggcuggagagaaaaagaaaaaaaaacgcgcccuaugcccuacaagggaaaagaggcgcguagggggugggggcggcaacaaagcggccuugcagcucuaacccaagggccaguaagagcuccugguccagcccgccugcaaugggggugggagccaaacgacagacuggaggcccaggagggggugcggcugguugggaccauaggaccaagguuccaggauaagugggaaguucagaaacccaacugugcucccuugaggaggaacagacuguggauaucuuaauccacccuaaagccagucucagucuggccauaagcgagcgcgccagcuuccucugcagaggagagacauaggagaugcaccgcagaggggaggggccacagcaaggccucgcgggugagcagcaccggccuaacagcuguuccagaaaauauacuacaaacaaagauaaggaguucccggccugcaaaugcguucuccgggugcuggcuagcggcgcccuucccggaaccacgcaacagcacgugugggcccaucccagccucccauuacaaccuagaggcguagcccaggauaguccgcccgccuuccggcccucccaccccaccccccagccacggucgcccggacccuaaagacuaacggccgcugggcccuucgcuggacaguacgcaaagcgaguucaaagaaagaccagcaagaggcugggacuccgaucagccaggcucuggaaacccuaguccaggagaccagagcggagcacgcggggaugcacuagaccuucagcaggauggcucuuagcugugugcaaugcuuacccugccagguccagcucccagcgcuguuuauugucugcugcgcugcuccgauuugagcuggagccucugcugagaacgccaccacugcuccugccgcagccuucaccgggacuacagcagucuucugcgccgacuacccuucuccaggcucugggcagcucccccauacccccuucaccccgg

SEQ ID NO: 12596 - RNA, 24528 nt, Mus musculus
ccggggugaaggggguaugggggagcugcccagagccuggagaaggguagucggcgcagaagacugcuguagucccggugaaggcugcggcaggagcagugguggcguucucagcagaggcuccagcucaaaucggagcagcgcagcagacaauaaacagcgcugggagcuggaccuggcaggguaagcauugcacacagcuaagagccauccugcugaaggucuagugcauccccgcgugcuccgcucuggucuccuggacuaggguuuccagagccuggcugaucggagucccagccucuugcuggucuuucuuugaacucgcuuugcguacuguccagcgaagggcccagcggccguuagucuuuaggguccgggcgaccguggcugggggguggggugggagggccggaaggcgggcggacuauccugggcuacgccucuagguuguaaugggaggcugggaugggcccacacgugcuguugcgugguuccgggaagggcgccgcuagccagcacccggagaacgcauuugcaggccgggaacuccuuaucuuuguuuguaguauauuuucuggaacagcuguuaggccggugcugcucacccgcgaggccuugcuguggccccuccccucugcggugcaucuccuaugucucuccucugcagaggaagcuggcgcgcucgcuuauggccagacugagacuggcuuuaggguggauuaagauauccacagucuguuccuccucaagggagcacaguuggguuucugaacuucccacuuauccuggaaccuugguccuauggucccaaccagccgcacccccuccugggccuccagucugucguuuggcucccacccccauugcaggcgggcuggaccaggagcucuuacuggcccuuggguuagagcugcaaggccgcuuuguugccgcccccacccccuacgcgccucuuuucccuuguagggcauagggcgcguuuuuuuuucuuuuucucuccagccuuugguuuaaaauagcaauaggcacaauauuguggggggauuucccugcuagaggcggagggggccgucguuguaguaaagaacacacaguauauauaaggcagacaaauccuacaacuucucaguuacuuaaaauacccagccugccagacugcugucauugucugcugcagacaccucugacacuggugaccgcccaaaggcgugauuucuccugagcuccccuuugaggggcuaagcuugccagaugagccaugggaggcaaaggcggcagcgggacuaauacagcaggaccauccucccugucgcuggacucgccuugagagaaguguagacagcccuguucgcauaugucuucugcgucucuggcuggccugccucagcaacacugguauggacuggucuccgggcacugcauuguuggacuuucuguccuaccauuggagauuccaacaaagcccauuccuucgagugcccuacucugugcaccacucuggacuauuaaggcauuccugaagaauaagagaggggauuugacuaagggacugugcaggcuggacagcuuuauaguggggcauugagacccaguaaauaaaucucuuacuuuguaacguuaacaugggauaucuaucuaucuaucuaucuaucuaucuaucuaucuaucuaucuauagauauagcuauauagacacacacacauacacccaagcuaggauuggggauaccacauuauuuucaccccuaccuaauugaccagaccucaacacaucuuugcagcuggucuuuuauuuccagcaucugacucugcccugcuuugacuucaguccagcaccuuucccacacucaaacacucucauccuacacuuguccaagucccucccuuucaggccucaguucucaaccaacuuucucuuuggggcauuucaggcugcuucuagaugagcagaccucuuggaacuccuguacaguuaaguuucacugacucugcuuuguuucccuuauauagguauuuagguucucucagaacccucauagggguaaauaaagccuaggccucagcuacaacccucuaggauccuagauuuauaaagcaauuaaugagugaauguuccagaaggacuuucugucuuuguagaacuuuagaaaagaccuuuauccucccaacuuguguuugccuuaauccaugaaacauaaaguaaacgugccuaaggcucagauauggauauaauauaccuaguguggguggaaagagggauuggguugcuacuacauucaaaaagaaagucauaauuaguucccucuauuaucagggucuggacugcucaaacccuggagcucugcauacuuuugguugcugauucaugagccuacaggcaaagugccauggagagaucucucucucugcauuuagaaagcagcugggaaguacaggaguuugguagagaaagaauagacagaaugagaaaugaaagggagugccuggcaggcagggugagugguggagguggcauaacucagaggugcaaaagaguuuaggacccaguggugggaacugccaaacaucaagccuugaaauggugaucuaaucuuuuuaggcgaagaucuuuagaucauugaacaaaggcuggucagggucagggguugggggugguggaugcaccuucgaaccagcgauaagaauggaaggguguuugauuguuuggggguauuuguauugggguaauuugggguuuuguuauuauuuugaaacaggauuucacuagguagucccagcuguucuggaauuugcuuuguaagccagugccuuugaauucaucgauauuugccuguguugaaugcuaggauuaaagggguguaccaccaccagcccaauaauagaguuuuugaaaggguuuuuaaauggggucuuagagauugaaagcauccuacaaguuagguagguaacagguuaccucuaaaguucuaaguagagguguggggaggggcaugcuaucacaagagggaaauuucacacuguaagauuccuuuuggcauuucauagguuggggaggagcaccugggccuaaauacuuauuugcuaaaagcuagagaaauauccuucaggccucuuuuuaccccccacaucucucagcuacacagguuuuuguguggacuagcaguuaagcccccuauggucauagauguggccuagaaagcaagcaagacacagcaauuugaggagauacagccuauugcucuuuugugguaguccuuuauguugugcccaaggucuccaggaagcaccacucagucagugcacauuugaugaacuacuacucccuccucccacuagccuaguccuuaaaagugaaagcugccuggguuuauguggcaguugcauucugggaacacuuuuuuuuuuccucucagucaagagauuaaggcuugcagccugcugggggcuggaaguaucuggagaagggaaguauuugggaaaaguuggcaccucaagaacuguaauauuugcacucaguguauggaagaaauaccccugcuucacuaguccaaagaaauaaggaaaacagcagcaggcuuaucuucucaugaguuuacuuguagaaccuuugcugucuagggguccugaucagcuuuguuuucucugccuguuaaauaauuuaaaggcaggaaaaaucuugaacaugcagcuagcagugggaaaauucuggaacacagcacagaggagcaaacagcaacacagugcuuguaaagaaaugcuuguaugacauguaugaaacauacacagagauacacacagcaagcaugcacaggggaagacccaucacaagauagagggguacucagggagccagagcucagaggcuccuuaggggcuucguuuuauuuauuuggcuuuucuuuuuguuguuguuguuguuguuguuguguuuugguuuuuuuuuuuguuuuuuuuuuuuucuugguaaguuucugaagggucuuccuucacuaauuuaggauuggucaguuugaagaaaggccagauggcugauugacccaaaacuguuguguaaacauguccugaucuggccuuaaacuuguugagccaguccaucagcaagaggccuucuaccuggagaaaaagccugcaaggcuuuuguuuuaagcugccaggcuuuugucucaggccugcagggugaggaaguuugccaucuuuauuaccuagccauggacuccuugucuuucugcuuuaucagggaauauuuguaacuccucagaaccaaagacagagaagggaguucuagcucucucacuccuucgcaguuaggcuaccuaaaauggaaaagggagacucuggaugucaucuccugagcuucucugugcaaagccaguuuaggcagaugaacuagaugauaaaguuuuagccccaagaggaaauauuuccuacccuuucugaauagauggagcagguacagccugucucugauuuugccuuugcuuggcuaguacugacacacugcaggggggugggggugcguugugcagacauagcuucuacuugguaaaauaaucucucugaugagacucaaaggcaggggcaaguaaguggaucuuaaagauucugauugugagcugagaaaugaucaaagcugaggcauuaggaugcuccucagggguggggugggguggaguggggcugaggauuagaauacugucccagcacauaugagaugcuguguguauucccccagcaccaaaacacaaacaacccggaaauaaaacagaaaaaaagaaaccuucaagaaggcucauuucagggcuguguuuugguacccugucuucugaacugaauaagaucccuguauauucugagaccuuaggguagagaaauaaagcugaaaaacuuucagugggcguuugggaaaagcagauauugaaggucagacaaagggguuugauuagaaagcuuguaucaacuucagaggacuccgguggggaccaauugacaaauagagacaaggugccuuggcugcaagcagccucauccaaagagcccauuauguaguuaucugcuccaugcauaguaaacaguuugccuuugcauccauaaccaguuuugcaagauaugguguauuuuucucuucauuucacacaugcaggacacuucugucucagagagauacuuucucaaaugguucugccugaaaggggugagacuggcauuccaguuucaggcuggcaaacuccagcugaguuagaguccaacugaaccagcaucccaagcacgugcuccaagguagaugcagugacugagagaggccuugugagagaaccucaguggacacacugaagccugccagaaggaaguaagcaaggaugcaugugugaacagggcagcugaagacagagggaaucaaggcagggauacaaggccagcuuugggauuuguggaucaucgggaacugaugaguuguuuucugaaaagaaugcugcaaauucggaaagaagaguggugcaggaguggguaagggggacucuuucgaucauuuccacuguuccaaaccaggagcccuucuuucauaccaugaacauuuugaccucaggugguuaugggcaccaguaaugugcuacuugaguagcagaggacauuauguuuaaguaggucaaacuuuucaaaauuguccacuguguuagcuuucuaguucagcuuuuuggguuuuuuuuuuuaauuuuaaaaaaauuuuuguaccucaaacuucucucccaaggaaacaaaacagaagauaugucccguaguuugaaaggaguggugacagcauuuauugaugagggaagaggucaccagcugaauagauagcaccugaguacugaggucaucaggggcuuuugucuuuugguugguugguugguugguugguuuuguuuuuugaaugcacuggguaagaccaaaaacagcuauagacaagaaacccuucaggaaaaguuaaagugagcugagacagggcagaauaaugaaaggaaacgacagcuauucacagguauaaagggaaccuuugcuuuucuccuggcccaguacuuuaaaaacauguucuacugguucuuugaaaauuucauaaguguguuuugaucauauucacacccguccuaauucuuuaauugggggcccagcacaagugaagcagagugccagggaaguggaacucaagaggccuagaaacuacucaaguucugucaugaucccauuagagaccuuagacaaaucuuuccccaaguccgggcacauuuuucuuuucagugacaaggcuuuaccaugugccaggaccagggauuaaugugguaccgggaagaaauagugggaauagugaauagggagcgccuuguauacugguagguacacacgguggguggagaggguguguuaauugcauuucuguugauuguggcacuuuuagcucaguuuaaaauguugaucuuucuggcuuggauccuaucuggaaucucgcagaugaucuaacauuguuagcucccuugacauuaaaaguuggucuaaugagcaaguaaggcuuccugugguauaacuacauaaucaccauaauuuauauuuaggggaaacugaaaagguuucagagauaccuauagagcuuuggagaaugccugauugggguugauuuacugcuagaaauuguccagccauacaucguugggauacacauuaauacaauuugccauaacauuugagcuuuugcugugcaaugaauuuuauuugguacuuuacaugcauuggguuuguuucgacaauaaucucaauaaguagaaauucucaauagccccauuucacaguucaggaauaugagggucagacagguuggauaacuugcugaauucucccagcguggcagaguugauuccagugaagaacugucuagcucucuaaagggaggauacucagcauuuuuacagcuucuuuacccucucuccacuaacauacugagggacuggauaaauuaagacugcuuggaaugagucuggaaacuaucauggguaaaggccacgccucugaaccuguacccagguucuuuccugucuauuaaacuggucaagggcuaggccaagaacagaaaaugucaagguugaacuaaaacuguuucuuccucaagagaaguguuucaggugagucuguggcuauucuucuacuugggguuuaagucgaggugaaaagaaggacgcucuucuuugggagccagcauuugcuugucccaaaauggccugagguuacuucuuggauuuuaagugguuccaucauuuucuuccacagccuguacucugcuacagucacagugacugcagcuaguagucucuaucugggaauaucaaguaucuugguaggguucccaacagcccaucugaaaaacagccagccacacugacugagaaaucugaguguugaggagcucugcauuuggcaggaccacuuucuuggcaagagccuaaggaaagccagucccagccuaagggagcuuuagaguuuguccuuugcuguuccuuauguuuugggcuccaguucucucuccugaaggacuucuucuuacccuaggucaaagcagaaucgcauguuuuagaaggacaguuugaggaccaugauagauuaauaaggagugugaagaagccuuaggguagagauagcuaaauaagaccagauuuagggagcuuugaucuauauaauauuucuacuguacuccuucaagguguucuguggaacacaggcaagggcaugguucuggaagggaaaaaaaacuaagagagagauauaacauaguuuuaagauugauccuugcuuagcaaaacauaaccuggggucuggguaagagggaggucuacauugaaguaauagaaucucugucccaggguaaaggacauauacuuuauagccucgggcuuuugaaucuuuggcguagcauuaaguuuccuggugauucuuuuuucuucaaacuuuacauuuuauaauuccuucuacccuacuugcuauuuuuuuuguuguuguacaccugcguaaaagucacuaugaauaaccacaacagagauucaguauuauugcuaccuugaaauuuccuccaccaaagaaauuaguacauuagucuuaaauuuagccucaggaaaguucuugugacaaaggcagaaugaaaccagauucuuugccaaagaaacacaaaaguuuucucuagcauaguugcugcugaaguuuuugcuucccucugaaacauccugagccaggcaucuugagucuguuuugaucugagcacugucuccaagcucagcccauuaagcucugcuuauaccauucaacugcuuuucuaguccaaagaaaucuuccacauucaaaaacaaaaaccaaacaaaaccaaaaaacaaacaaacaaacaaacaaaaaacaacugaaacaaaccaaaacaaacagaaaccaaagaguuuauuuaauuuaugguuccagaaguuuagaauucauaaugauugggguagcaugggcaguaguuagcaggcauagcaacaacaggaagcugagaguucauaucuugagcuucacacauaaagcagagagaaccaacuacagauggcauagucuuuauaaacucucagagccugccuccagugacaaaacuuacuacaagaaucuuauaccucuuaauccuccucaaacagcgccaccaucuggugguguuuagacaucugagucuaugggggauacucucauucuaaccaguacugcucccugggccugauugaauccacuagaaugaguccccuuugauggauaagaacacauaccucaucuagaucacugccauuuccauucccuacugcuugacagaguccagacugaagcuucuuccuccucaaagcaucuuuacuuucuuuucucuuuuuuaucaucuaucuauauaucaauauaucuaucugucugucuacuugucuucuaccuacguaucuguuguuuaagaauuucauacauguguaaagugauuuugacuauacccaccuaucauuccccucuccucccccaggacccaucuuccaucucccuuacaacuuaaugcccucuucuuuguuuucuauugcaaugaguccaauuagugaugccauauauguguggauauaggacuauccacuggaacacaagcaacacacuaggggccacacuucugaagaaagcugacucccuccccacagcagccaucauugccugccauuagcucuucaugaagggaagggggcucuugaguccuuuaccaauccaugcugaaauuuuggcugacuugaucuacugcaggucuuggacaugcagucacgguugcugaaaguucauaugugcaguagcuuuagcauauccagaaaagauuuugcaauauccuuccauuaccucuuguucuuacaguauuucugcccccucuuccuugaugaucccugaauuuugggguaggaggcaugauacagauuuaucuugagagaugaguacucuacagcaucucauuaaucacugucuacuucaaaaagaagcccugauggggguugagagcuguaccgauguaugaguauaaagugcuuagaaagcaauuugguagugaauccauuuagcaaaauaauaguaguagguucucuccuaaggucugggaucuccccagccacagguuuugggacaaggcaacuuuucugagcccagggaguauguuuuaccuuuuauuuuuaucuaaaggcucauuagcagaguauaaagaaaugacagggcuucuuugaucccagcucucggagacagaggcaugaaaaucucugugaguuugaggccagccuggucuauaugacaaacuccaggagagccaggacuauguagagagacccugucucaaaaaacaaacaaauaaaaaaacuaaaacaaaaaaauccaaccaaacaaacaaaaagaaauaauaggcuauucuuugaaggccuauauuuugcuguaucuucaaacuucuguagauaagauuuucucccuacuagccuauaagcucucuaaagcuaggacugagaguuccacuucuuaguguugccugauacaccgacuuuagugucugucacuuacugaauguucagagagauuuaauuuacaaauuacacaccaggaaauacaguuucacauauaacuucacugcugccacccccauccccagugccauaauggcaauccuguuaguaauuucaaggcugaagugagaagauuaauacuaaggaauucagcuacaugcugggcccauauuuucauuauaacaugaggcacagaauucuagguagucaugugcuuaguggugaggguacugucuauucauuagagagcugaguguugagaguguaaugucaagauauauggcacagagaaaugcauaacuugagaaaauagcaacuuaaaucucugcacugagaagaucagaugaguuuuucucuuaucucuguaacucugucagaaguguaugacucugguuguuuagcaaagcacuggaacucggguaacucugaugauuuaaaugugucaaacuaagugaggcaccaggcacgaaauuguaguaggagagguuugucuaaugaaaucacaggcuagaguauaguugcuaguuucucuucagcuccagugcuggacuacauuauuuuaacugugugaaucuccuuaauguagcauucagucacuggaccaguuuucuggccagugauuccugggacugcuucagucucacucucucccuuccccugcuguuuuagcaucuugcucucucaaucccaacagcucuucugucucccuuuguuacccuuagaucuacaaagaggguucagagaagggaagggcuuucuaagaaaggaucgcuagauuucugaaggcuaaucacugguuuaaaugcuagauguuuacugucacuggaaaauaccagacuugucaggaaccaagggaaugaugggguguguugguguagaaggugguuagcccuucuuuuuuuuuuuccauuuuuuauuagguauuuagcucauuuacauuuagcccuucuuuuuaauuccaguucuauuggcauugggacuagguagccuugagcagaauugugcagcuuacaccaaguuuauguacuuaaauaucuccuaggcuaggagcaugaaucauacagaguuguguguucucaaguucccuuucuagauagcaaccuagaugggaaucaagauauuacgaggaacaaaguagaagaaauuuuugccuuacaguucuacaguagaaucugguguuuccacuugccaggaagagucaauagagauucuggucuagaucuaccccucauauagucuccauaagggguuacuuaaagagguagaugcugguaagcuucuuggacagaggauacagaagccaggaugauauuuuuucggaggcuaccguaucauuuugcagguccuacauuacagcucugaucugcaacucaauguuguuucuucucugguguuccaaagguuuggccauuguccuaggggcaauuaagagaaccucuaggcagaagauaaagcuguagauacacuugucuucccagcccucagaagaauguuggugauaguacggguuaauguuuaacuaaggccuggauccaguagaacccaaugaaggcucaaugagcaacuccccacacacaauuuucaaaacuucagugaugcuagaagcaaccucucuacuccuuuccugaccccaaccugauaacugauaagcuuccucagagacaauugcgcaacugggcuuuugcacaccuacaauugccucugucaaauccugcucucuacuuaaaacagucuaaagggaguggauuagugaggggguagcugaugagcugcaaugaacugccuguugcucauuguaggguuuaaaaugcccuggagcucagaagaaucuagaccagcaaacaaaacauauggaauagaugguuuuaccaguguuuacuuauuuucucucucucuuuuuuuguuuuuuuuuuguuuuguuuuguuuuguuuuuuagacuuuuuaacauuuauuucauuuguacaagggugauuuuaaaugaaggcggaaaagcccuugaaaccugauguucugauuaaagcucuugagggucacagguaaaauuguucuuaacugagguuuaagguaaaucccaagucaaauaguccuucacuucagccuaggaaaaguggagagcaaaaaucugaggagaaaaucaagauaaauuacuaaggaaaugcguggcauaaagaaacaggaagcaaacaacaaaaaaaccauguuguuucauuuauguguaacagggacccagaguuauugaaacgcaucuugccuaacuuuaguaacccugugcacuguggagaaccaaggcauuaaaguuacagcugcuuacaaaaccauugacuuuaaagcugguuuuugugaacaucuugaugcaaauaauuuuaaauauuuuuuccuguuugcucuguacagcaguuguucccuguuggcacagagaggcucagguaacgcauccccagaggacgaugaggaaauacaugcuccugacccucagugugaggcuucuccucccuggccuccaaggaauuacauugcugguuuugguuugguuugguguucauguuugaaucaugaccuuuguuuuacuuuauuuguuuuccuauuuuaacuuauuuuauauucugagacagggucuuacuauguagcucugauuauccuggaacucccucuguaaaccaggcuggauucccaauucacagauagccaccugcaucuguuuccaugugcugggauuaaagacgugugcugcuaugccuggcuuacuuuauugaauauucugagauaauccagguugcuuuccuuuaucugagguuucuuuuggaccaaauguauuccagauuugaggcugggaguaggaaaauuuuaaguuugggaaggguugcauagaucuuucagguuggucaucacuaaucaaguauagagugcuccccaaagugagacguugguaacacauguguuucaaaauuuuggauauuugauuuagcugugcucaaccuguuacuugcccuaugaucuaaauuauuuuuuaauucucuuuuuuccccuuuuuucuuuuuuauuagguauuuuccucauuuacauuucccaugcuaucccaaaagucccccauacccuccccccccccacuccccuaccuacccauucccacuuuuuggcccuggcauuccccuguacuggggcauauaaaguuugcaagucuaaugggccucgcuuuccagugauggccgacuaggucaucuuuugauacauaugcagcuagagaccugagcuccgggguacugguuaguucauaauguuguuccaccuauaggauugcagaucccuuuagcuccuuaguuacuuucucuagcuccuccauugggggcccugugauccauccaauagcugacugugagcauccacuucuguguuugcuaggccccagccuagucucguuagagacagcuauaucaggguccuaucagcaaaaucuugcuaguguaugcaauggugucagcguuuggaagcugauuaugggauggauuccuggauauggcagucucuagaugguccauccuuuugucucagcuccaaacuuugucucuguaacuccuuccguggguguuuuguucccaauucuaagaagggacaaagaguccacacuugggucuuccuucuugaguuucauguguuuugcaaauuguaacuuauaucuuggguauucuggguuucugggcuaauauccacucaucagugaguacauaucauuugaguucuuuugugauuggguuaccucacucaggauaaugcccuccagguccaaccauuugccuaggaauuuuguaaauucauucuuuuuaauagcugaguaguacuccauuguguaaauguaccacauuuuuuguauccauuccucuguugaggggcaucuggguucuuuccagcuucuggcuauuauaaauaaggcugcuaugaacauaauggagcauguuucuuucuuacuaguuggaauaucuucuggauauaugcccaggagagguauugcgggauccuccgguaguaccuuguccaauuuucugaggaaccaccagacugauuuccagagugguuguacaacuugcaaucccaccaacaguggaggaguguuccucuuucuucacauccucgccagcaucugcugucaccugaauuuuuugaucuuagccauucugacuggugugagauggaaucucaggguuguuuugauuugcauuucccugaugauuaaggaugcugaacauuuuuucagguguuucucagccauucgguauuccucaggugagaauucuuuguucaguucugagccucauuuuuuaaugggguuauuugauuuucuggagucuaccuucuugaguucuuuauauauauuggauauuaguccucuaucugauuuaggauagguaaagauccuuucccaaucuauugguggucuuuuugucuuauugacagugucuuuugccuuacagaaacuuugcaauuuuaugaugucccauuugucgauucucgaucuuacaguacaagccauugcuguucuauucaggaauuuuuccccugugcccauaucuucgaggauuuuccccacuuucuccucuauaaguuucacugucucugguuuuauauggagguccuugauccacuuagauuugaccuuaguacaaggagauaggaauggaucaauucacauucuucuacauguuaaucgccaguuaugccagcaccauuuguugaaaaugcugucuuuuuuccacuggaugguuuuagcucccuugucaaagaucaagugaccauagguguguggguucaucucugggucuucaauucuauuccauuggucuacuugucugucgcuauaccaguaccaugccguuuuuaucacaauugcucuguaguaaagcuuuaggucaggcauggugauaccaccagaggcucuuuuauccuugagaagaguuuuugcuauccuagguuuuuuguuauuccagaugaauuugcagauuucucuuucuaauucguugaagaauugaguuggaauuuugaugaggauugcauugaaucuauagauugcuuuuggcaagauagccauuuuuacuauauugauccugccaauccaugagcaugggagaucuuuccaucuucugagaucuucuuuaauuucuuucuucagagacuugaaguucuuaucauacagaucuuucacuuccuuaguuagagucaugccaagguauuuuauacuauaugugacuauugagaaggguguuguuucccuaauuucuuucucagccuguuuauucuuuguguagagaaaggccauugacuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugaucuccuuuguugucuaauugcucuggcuaggacuucaaguacaauguugaauagguagggcaagagugggcagccuugucuagucccugauuuuagugggauugcuuccagcuucucaccauuuacuuugauguuggcuacugguuugcuauagguugcuuuuaucaaguuuagguaugggccuugaauuccugaucuuuccaagacuuuuaucaugaauggguguuggauuuugucaaaugcuuucuccacaucuaaugagaugaucaugugguuuuugucuuugaguuuguuuauauacuggauuauguugauggauuuucauauauuaaaccaucccugcaucccuggaauaaaaccuacuuggucaggauggaugauuguuuugauguguucuuggauucgguuagcgagaauuuuauugaguauuuuugcaucgauauucauaagggaaauuggucugaaguucucuaucuuuguuggaucuuucugugguuuagguaucagaguaauuguggcuucauagaaugaguuggguagaguaccuucuacuucuauuuuguuauuuucucucuuuucuaauugaauccugagacaguaagcacccauaaaaaccaaccuagccuguguacuugcucacuaguaucuaucucugucuuugucucucuuaucuccuucagaccccacugugaugcuuccugacugaucauguuauaagugugcccggaauccaaaggcagcauauccaguggaagaauugucuucaucauggagagucaacaggaugaagcuguucaaaccaaaggagcaucaacuucuagcgaugcccaagaccagggagcugaaaagggagccaagaauaagacaacugaggcaacagaaggaccaacaucagagccucccuuaucaggcccagguaggcugaagaaaacugccaugaaacucuuugguggcaagaagggaaucuguacucugccuaguuucuuuggggguggacgaagcaaagguucugggaaagucagcucuaagaaaagucuaaacaagaguaagacucacgauggucuaagugaagcgucucagggaccugaagauguugucauugaagaaacagaccucucuacaccuuuguccaagucaucugcucaauuuccuagcucccagagugccaauggagcguuggagauaggcucuaaacauaagacaucugggacugaagccauagaaaaagcuggaguugagaagguacccucugugcacaagccgaagaaaagccuaaaaagcuucuuuagcaguauccgccgucaccggaagggcaagacuucuggggcugaccaaagugugccaggggccaaggaacuugagggggcaagaaccaggucucaugagcaugugaguucaaucucucugcccagcucugaggagauauuccgagacacuagaaaggaaaaugccaaaccccaggaugccccuggaccaaaaaugucuccagcacaaguacauuuuucaccaacuacugagaaggcagcuuguaaaaauccagaaaaacucacaaggaccugugccucagaguucaugcagcccaagccuguucuugaaggugguagucuagaggagccccacacuucagaaacagaaggaaaagugguggcaggagaaguaaacccacccaauggcccuguuggggaucagcuaagccucuuguuuggggauguuacaucgcuaaaaagcuuugacucacugacagguuguggugacauuauagcagaacaggacauggacagcaugacagauagcauggccucugguggccagagggccaaccgagaugggaccaagcgaaguuccugcuugguaaccuaccaaggagguggggaggagauggccuugccagaugaugaugacaaugaugaugaagaagaagaagaagaagaagaagaagaagaagaagaagaagaagaagaagaagaagaagaagaagaagaagaagaagaagaauuauuagaggaugaagaggagguuaaggauggagaggaaaaugaugacuuagaguaucugugggcaagugcccagauauacccaagauuuaauaugaaucugggcuaccauacugcuauaucucccagccaccagggcuacaugcuucuugacccaguucagucuuauccuaaucuaggccuuggagaacuuuugacaccucagagcgaccagcaagagucugcucccaauagugaugaagguuauuaugacucuaccacaccaggauuugaggaugauucaggugaggcucugggacuugcccacagggauugucuacccagggacagcuauaguggugaugcgcuauaugaguucuaugagccagaugacagucuugagcacuccccaccuggggaugacugccuauaugaccuccguggacgcaacucagagauguuggauccuuucuugaacuuggagcccuuuucuucucggccaccuggggcaauggaaaccgaggaagaacggcuagugaccauccagaagcaguugcuauacugggaacuucgccgggagcagcgugaggcucaagaggcaugugccagagaggcucaugccagagaagcuuaugcccgagacacccauacucgggaaucuuauggcagaaauguccgagcccgagaaacucaggccuuagaggcucauucucaagagggucgaguccaagagaccaagguacggcaggagaagccugccuuggaguaucagaugaggcccuuaggucccucagugaugggucugguggcagggacaucaggagguucucagacuucucaccggggaaccacuucagcuuucccugcuacuucuagcagugagccagacuggagggauuuccguccucuggagaagcguuuugaggggacuuguuccaaaaaagaucaaaguacuuguuuaaugcagcucuuccagagugaugccauguuugagccagacaugcaagaagcaaauuuuggaggcucacccaggaaggcguacccuaguuacucacccccugaggagccagaggaagaagaagaggagaaggaagggaaugccacugugaguuucucacaggcccuaguagaguucaccagcaauggaaaccuuuuuaccagcauguccuacagcucugauucugacucauccuucacucaaaaccucccugagcugccccccauggucaccuuugauauugcugacguggaacgagauggagaaggcaagugugaagagaauccugaguucaacaaugacgaagaucuuacagccuccuuggaagcuuuugagcuggguuauuaccacaaacaugccuucaacagcuaucacagucgguucuaccaaggccugcccuggggaguuagcagccucccucgauacuuaggacuccccggaguccacccucgaccuccuccugcugcaauggcacucaauaggagaagccguucccuugacaaugcagagucucuggagcuggagcucuccaguucucaccuagcccaggguuacauggagucugaugagcuccaggcccaccaggaagauucagaugaagaaggugaagaagaggaaggagaauggggucgggauagucccuugucucucuacacugaaccuccaggggucuaugacuggccucccugggcucacuguccucuuccaguggggccaggucuugcuuggaugagcccuaaucaguuguaugagccuuucaaucagucuuccuaugugcaggcaaccuguuguguaccuccuguggcaaugccagugucagugccaggaagaacaccuggagacucugugucucagcuagcucgaccuucgcaccuaccccugcccaugggcccuugcuauaaccuucaaucacaggccucccagagugggagggccaagccucgggauguacugcugccuguagaugagcccaguugcucuuccauuucuggagccaacucucagucucaagccaagccuguagguaucacccaugguaucccucagcugcccagggugcggccugaacccuuccagcuucaacccaaucacuaucgagcuuccaaccuugaccugucaaaggagaggggugagcaaggugccucucucucuaccagcuacuccucuacugccaugaauggaaaccuagccaaguaguuaucaauuccagaauggagaccugagcaugugaauugggggucaaggguugggcagagggguaggggugaguagugcuguuccacuugaaaaucuuauuggcuaagauaaacuccucugaguuuucacuuugcccaccuuccucugccaucuuuggccagguucagcucaauuauaucugccuagggaggcugcugcuucugugcuccaauuuuugcuuuggaguuucuugugaccuauacagggcuugggaugcauccuuauugcaggcugaaccccucuucucuggucccuugcugacuaaugaaccacugaugagcagccaauuuuuugcacugacucucacccagagaugggaggcuugcuagcuauuagcaauauaaaguuaugguacauagccuuccuaaccccauuccuuucuagcacaucaaaugacuauaaccuauuuaucccaguuaguuauguuuagagugggucaaguagcaugugucucgcucccuguugcuguggacuuugguaucacaacuagaugauguccuuuuaaccuggccugccauagucuagauugaagacaaaaacacuaauccucauaagggggugauuaaaucuguccauauucaagcagaauacaaagauagauagcuuauggaaaaugcugugaggucuugagcuguggaauaauaauauaucuaucuuguuuguuuccuaagccuguggcuguugcaggcauuuuagaacuucccccuuuuccugucccugaaaaauuucaucucaucacaaugaauguaguaucuuaacugaguuaaaggaagagaagccaccuaaauugggcuugacuauauagagcauuggguguugugagaugcaaaagaggaaaacagacagggugauccauuuaucuaaacaccaagaagggaucucagacuuuggaacuugaagcaacucagauuaggagggaaaacuuuucccauccuuucucccaaaccaaaaguaaauaaauaaauaaacccuuggccgccccuuuguaaagugguuccaagcuugucuaagacaggaugccaaaggcaucucaccuguuguaggcacacuaaaaagcuuuuaucuuccaguuagccaaguucuuagcauuuucaaaggaccaggcuucuugagaggaaagauuguaauguacccuugcucugccaaacuacagggcugauuugcauggcaguugcaguccuuucugaaaugaacagcacccucucuucucuugcauccaugcagguuucuuuuucuuuuuucuauauuuuuuuucuggacaaggucccacacuguaguucucucuagccuggaacuuaccauguagaccacgauggcuucuaacuaacagagauccaccugccucugccuccaagcaagcccagccuaaauguuggaaacacuagggaagagcuuggugucaggaaaacauugcaacaggcucaucuugaccagguucaacauuuccuuaaucaucuauaugaaacaguuucuuuaaaauucuccaucaggcccgguguggagguaugugccuuuuaucucaacacucagaaggaagaggcaauuggaguuauaugagugugagaccagccuguucuacauagugaguucuaggccacuagggcuacauagcaagauagaccuuguuuuaaauuuuuuucuguauuggaauaugaaauauuuuggggaucgauauguugaucaaaguuagaacuuuuuaaaucuucugcccaugucccucuucucaccucaaagccaucuucacaucuacuaagugaagauaucaauagggcucuugcucaaaauaaggcaauuuaccuugagaacagaugcugguggccuucugagucaagauugcuuuguagacauacuuucuuugccagggcauauauucauaauauuuuucacaguuucuaagcuugggauuggcccugugccuuucccccaaaagagcagauuugauugguaaaaucuaaccccuuguaaguaacuucauaacuuugcauggcaccagcacuagaaccaccccucaaggaccucagaucagcucucuuggaugacuuuggcuacaucacgaagaagugcaucucuuguggaucuggauaaugaaagugaaaaaggccuuccuuaccccaaccacaucgucauaagagacacaugcccagauuuuaaccacuuggccuccuaccaaagcuguucugggaaggugaggcugaacuuagccugguuggguggcaggaaguaagcacucaaugccuuuacaacaggaaaagccacaccucuugccuagucaagguagcuugaguugcuguuuacaugucgcugccaucuacagcaggcacuagagcuguccacagccuccauagcccacuggagaagggcuaccagccuguuuggaagaggaagaaggaaucuacccucacaguucaggaggacagcacagugcaauaucucugaagggaccugcuauaacuuggauauauuuugcuaugcuuugaaacuucauaccuuagaguaggaccugaggcaaaguagaaguuuguggauuggguaacaucauugccuuccaaguccuuucacugaucuggcugcuagccuagggacaaaauauuuacaaccuaaaaugggauagccaagaugucuacagaagcagacuccuuuugaguaucuaaagcaaauacuaacugcagccuagaaggggaaagaagauuuggcugcggauauaugguaauggcaacaugauuaccaaugggauauguaaccaaucucuagguaucuguccaaacauggacaaguacuuccuuugcuggcaccaaauaugcuacaaacuaccagaagugcugcuauuguguucacccuaaggcuguggccagaugaaccuccugacuccauugcagguccuuggacaaugcauuuggaugugacuuuaagggaagaugugcugacagaaggaggcuagcuuuauguuguuacccaguacuacuauauagugucagcucugauccugagaauuucuuaguaacccaguccauagaggaccagugacuguggguauggaaagccaccuagcaggccucuuccaaagccaggaugccaauuucuuggugcuuuagauucuccaaggaagcucugccuuggggaucaucuggcuuuagcuuagauaccagaccacaagccucguggauaaugguuucaguaaaugccagugucccuccucuuagugcuauuucaaggagggaaguagcuuuccacacucagaauguugggugcaugauuucauccugccaccaguggcuuuuucaccugcaccagugccaccacugccuucagcccuuaggcucacuugcuagagggaggcauggggguuuaccagggauacuucaaguuuacccauguguauguugcauccaaguuguuuuuaauauauauauauaaauauauauaucaaaagcuaauuaucuauuuuuauauuguuugcauuuuauauucauggaaacaauguuuaucaauuguucuuuucugauauauuuuauuuuuaagcggugcuguuuacaguuuuaaacaaaaaaaaaagaugacacaaaaaaugcugcugcucgugcagagggaugucaucucaaagugucuaggacccucccucuuuucccucucccaccuggcugugucacacuauucauucucuuuccacacgguaaggacagaagaugcccauguaccgaagaccaauaccagguaacgcaagcauguggacccuggcagacagcauguuuucuagcuuucauuuuauuuaccuuuugagcccuuccuucucuuguguagacguuuugaaaguacuccugccucuugacuuuuauucuuuuccuuucuuuauauuuugugcuuguuuuuugcaaaguaucaugcccauauugugugguuuguuguauuaaguuucuccaauggagcauuaggggcucauucaacaccaggagacucgggaugacagaugacaaugcuauuucaaccuccaggaauuggucaucuccuugggagacacccuugaaugagacuugccagcaauuuagaagauggcaacauuguccagaaaaggcauuaggugauuccuuggucccucuugcuacuuugggagaaucucuccacauccugccuccuccuucccuucccuguuccagcucacaaguggaugguacuuuuggaaacugaacucuuguuguuuuguuuuuuuauuguaagucuuagcccuuaauggcugaguugucucuuuaaccaggauggcacuuuuaggaauggugacuguuacagucauggcuggguggccugauccacgguuucuccauccuguagucauuccaaagaagaaaauccacauggcauguacauuugugaggguugggucuauuaagagggggcuuuaauuauuccuguuacuauuggugcuuauuuuccccgcuguauauggggguggggaagggcugggguaaaccagaaauguauauuuaggucacguuaaauaaaauggcugggggaagaagaaagauaugagucuagguguaagaguucucucuuccaggacagaaaggggauuguagcuuguugcugcaccugagcuucccuuccgcauuccugagacaucauggaaucaucugcauuuguuaccucuccaucccuagcacucacuggcaucuggauauccugauacacugccuguauguuacaacauauauuucauuugcugaaugcuaauaaacuucugugcucaugagggaccuccagucacuaaa

SEQ ID NO: 12597 - RNA, 41253 nt, Mus musculus
guugcuacacguggaagugaaaugacuccagcagaaccuugguugcaacggauuccaccuauugugagagcgguaugccaucugggggcugaggggcggcuguugggcugggugucugcucuguacucgaaugcuuuuguucaaagaaucccauuguaagauccauccauuugaucuugacagaguaagugugggaacauccuucgugugguaaaucacuuggaaccuguggcaccuagggacggaaauagaggaccagagaacuauaucagaugucccucuaagagugcuacaaagucagcaugacuuguggggggagaagggauucuguggcucucagucauucuauccguuugugcccugacagcauucuccuagaugucagaaacgcuguuaucccuacagcuuugaguagucaguuccugccugugcagguucgaacuggggccagauggccgcugggaauaugcccggacuuguccaacaacccugugcaucugggauccagagauaaggaagagaaggagccugggaguuagcucuuggagaggaggagggaacagauuggacaagcagagcauccuguggaaagcugaacuagcccacccacguggugccugggcaaguccgggccuguguaaaaagcaauuuggcacuguguaugggggcuuucaguccagccucgucaccagugcgacugaguuucauuugaucacuugcugcuggaagccgagcccgggacagugauauuuugauccggccucaccccaaacacuggccaaggcccagacagcugcaagaacuggcagggugaaaggagaagggaccugccagagacuaggcugggaaaacaggcuguaagaucucauuuugacagguuuuggcagcgcuggccaauuucaucuagggcaguaagagguaguaaauuguggaacucgcuguccagguaaaguuucugucccccuugacucaccauaccuuucauccaaccuaugaugcauacugaauauuugcccucuaucaccaaguuugaaguacuaagccauauagaggcuguucucccuggagccuuaagagacucauccugaguguaggacgacaaccaauacugcacaagaugagcuuuaaacauacaagcaaaacucucugaaguugucauuguaaggaccauaucaacuagagcuagagaaagacagauauggguuugcuuguuuuugucuguuugcuugcuuguuuguauguuuuuggacaccuuuugaguguuugauuuuucaccagagguacugagggaagauuugucucagguuucuuugggaccugauacaaucccauguagauaaggcuggauugaaugauacuuauuagcugaggaggauuuuaauuuccgaccucccugccucuaacuccuaaugcuuuacauauaggucuguguucauuaugcccagcugacugugguucaauccuaacaccuuugccugcuagagagcaaaaguauuucuauucagaucucauuccaccauauagugacugugugaccuuggagaaaaggaauauuucucccucucugagcuucauuuuacuacaagcagcaguugaguuaauaauaguaccaacaucaucgaguuauugugagaaugaacugaaauaauccauguaaaauacuugaacacgcuuagcacagugcaaaauaagcacucaauaaauguuagccgugauuauuuaagauagauuauguagcacagauaggauuucaacagguggaauaaggagagaagacauuuuaaauagagaaaacauagguaauggccugacagcaaggaacucagagcacagagccugagaaaggagcaauaguuauauuggauguuuuaguauaauuagggaaaaguacaaguuagauugaugagaaaaaaacacaagacuggaugcuugagguucuguuuauuagacagaaucauagagcugcugugaguuucuuuuuccccauucauucauucauucacuuuacaucccaauugcugcugaauugaagaaaaagucagaucuauacuucagguaaaugugaauaaacugggcuugaguaggaaaaaugcaaaguggacaaaucaaaaguacacaaagcccuggaccugacgugguggcuaugagaagagaaaggagacaacguaauguguagaucaagucauauaaacuuuguucagaaauuggaaguugaugauuugcauggaguuuaagaauggaaagauggagggucucucuaaggguuagguuauacuuugaaagagcuccuaauuuuaucccuucucucuggguagaguuaaagacagauguuuuuaaaucuuggguagacuuaccugcuguuuggaauccuaaaugcauugugugcucagcauuuucuugcugcauuaguauucacugguuguauacaacaaagagauguuucuucuguccaccuauggaaucaugaguaagccuggaaauuaaaauuuccucaugcuucuguuuuccugaaaaaugggaaauaacucccacuuauugaaaggauuaaaaaugguaaucccuguaaaagaccuagcccaaugcuugaugaauaccaggcuuuugugagucauauguuucuuuuuacaacaacugacuucaccuuuaaacauccaucucaucucugacuguacauuucuagaggaaaagucuucauuguucucugaaagaacccaucaucuggggugggcaggugggggaauccuggccuguuggaaguucuuuccuuugucuggcugcauucauuaugucucugacuuguauucagauguucuaauagaguuugcugggguuacuuacagcaacuggccucuccuuucuaaaaguucagagaucuggaaauaagagaccaaauuuccuucacauuuuguucucugguaaaagagcugguuucuuccauuucuuggcuggcuugauauuaaauaaaugugagucugagguuuugaauuauacaaaaguuaagugguaauaccuucagagagauggcagucacugcaaaaaaaaaaaaaaaaaaaaaaaaacaaaacaccaaaacaaaacaaaaaacaaaaacaaaacccaugaugggauaaugugacaagauucuuuauaauguauuauuuccuucaauuguuuaauugcaccauuucuucguagagaguguauaaagaaaaugaaaccuacucaagauuguuuggucuguaugugucugagucauaacuuuaagccacauuuuucaucuaauucacuuuuuuucuucauuuucuacagcuguuuguauauaaaaugauggccagguaggcuaauucugacacuagagaggaagauaaucauuuaauuguccuguaccaguuauuaugucuuugaaaucuuucaguaagagaaaccagggagaaaaauaacuagacccaagagaaaaacaaagaguaacuccguguaaaaaccuccgcaaggccauauagccuuucuuuacauagauggcugccugaucuauucccugcagugaaguccuuauucagagcugaagccugugaaccagaggcuaguuuuucaccguuuccuuuagaaaacgggcuccaccuguauauucuccccuaagguucuuaaugggaagaguacuggccaguuuuaucaucauucuuuacacuagacagacucuuaacaaauaaauaugagagaugcaaggaucgcucuagucugccuuagauuagaauuaacuauauauauauauauauauauauauauauauauauauuugguguuuuucuagaccuguucucuuauagaugaugauaauuuuuuuguuuuuuguuuuuuguuuuuuuucauuccaguguggcuuucucucuuuugacuaaguucuaacagaauuuggagcuucacaaacaauuaucaacugagugguuagugacuagccauucacccuggagaagcuaaagcuacucuauauaagugucccugagagacaacaacccacacugaaaaagugaagugguuuccauguagugaaugauggaaucaaacaguaaaaugucauuauuuccaggagguuguuagucacuauugugacuaagccagaaagagugggcaguacuauuucccuuucacgaacuaccuuucccugaaccagucuacccuuuggaauuuuuccgcuugagagauuacugagccaacauucugcugugggaguaagaggggaagagaagcuggauccuugguaacagagucaguggacacucagcauaaagguggccugcuucuuuguuuaugggaaguagacaaugaacuaaguaacuuugaggaauucuuuugguucuuuuaguuccaaauuucugacuuggaucccaaggguuggggugaucuugauacacccuuguagaauuucaugccuauauaguccaaucaguucuaauguauauuuuauccacuuguggaaaaggagaaaaaaacauaaugaaaacauauugugaguacugaguugccuguuauuaaggaggucaaauagagauagaagguaguuuccucuaaacaauaaaaagaugaggcuauuaugaccuuuugugugggauuuuucaaaaucugaaauuauuucugaaaaauguuucacagaggauaauuauauaugaaauaauaaguuuauuuuuauuggauauuuuuauaaugccaacucuuucaacuccugcacuuugucuucuucaugggcauuuuucacauuuucuuuuauguaugguuuuuaguuagcauacaaaacauugaguuuccuugugacauuuuauaaguguauaucaaucuuucuuauuuauguucaccuccaauuacccuucccuguuucuugggcauggcuuuaaacuggaggugaaacuacuuuagccauggaacaucauuuucuacaaacaggccucaaucucugggcugauuuuucccagucuuauuguaugauuuuugccuuggguuguguuacaugugccuucuggcuugccccacuauuucuguaguauauuuuauucccugguuuugugagggagagauggcauauuugauuguuguuggguaaaaaggacugacagauucaaggugacagauucaauucuucuagauagcuugcuagucugaacagaguagaaauaauaugaugcaaggccaaacaaugggaagggaaaucagaaauuagaacacacuuucugagucaugcacauaaagaaaucauauuauaauuucaauuguuuucugggacacuccgccaaauuuccuugguuaacuaaugaaacucuacuuugagcacuguauggguagauuguugcucguggcacaauuccaugcugucuuaugguagucaauacacaaagcagugacucauuuaggguucaguaacaauagagcaaaucagaggcuuugaauaauggcucaauauugacuugaucuguggcuuuucuccacuacucuuugcuccucugcuugggaugggacacuaacagucagagcagcuguucacaugugaagcacagucuggaguuuccagagcacuuucacacacauugucucauuuuuuucccuugaacauaauccaaaguaguuucugugccuuuucuuuuacuugggaugacaguuucagcagaaauaaaaagaguauuuuccccuuaaaaucaaacugggauugacuguucguaauuucauuaaugcuuucauuaaucauaccuuuauaugguuuuauagguuuuggccuuuucuucuggucaauuuacaguuuucuacguuguauuuguccuuuugaaaaauuggugucuguuugugugguagcugugugugcaggcacacauucugaaauuuagcucauauuauuacuguuugucuuuagauaaguagauguggccccauucaaguauuaauucuaccucuacagugacaacugccuugaaaaagaacuauauauuucuaccuaccucagaugggacaucaccucuugcugugugcacuggaauaaaagacaaaggaaacaggugagucuuuaauuauauacaacucccuuuuauuuuccugaaguugauaucauuaauagaugaaauucuacaccuacuaaauaggaaaagaaaccaaugaagaacuacaauaggcaaccauguucucucuauuauuuuuaucccaggcauauauuuuaacacuuuuaggcauaaaaagacaauuaaauuucuaaauauguguuccaagagucaaaucucuucauuaggcuuucaugauaaauccauugcucuagucacugagcuauuuugcugaaugaaauuuuacuucuaugcaaacccaaaacaaaucaacauauuauaacccuuuugcccaugccuguaucaaaacaucauuacuauaacaauauuagaaggagcuagagaaaauacccaaggagcuaaaggggucgacaacccuauaggaagaucaacaauauaaacuacccagaacugugucucuaguugcauauguagcagaggauggccuaguaggccaucaaugggaggagagguccuuggucuugugaagaucauauacccuaguacaggggaaugccagggccaggaagcaggaguugguggguuggggagcagggcgcggggggaggguauaggggauuuucaggauagcauuugaaauguaaaugaagaacauaucuaauaaaaaugaaaaaaagaaguucuuuuuaucauuuacucaaacaauaaauacguauuuagugccuacuguguaacagacacuguuuuaaauauuuuggacggaguaguaaacauaauagguauaaugacuucauagugauugaaguauaguuugagaaaaaauaggagaaauguuaauaagaaaaccauuauguauuaagaaggucauaaguacuauggagaauaaugaaaugaaaagggauggaaugauuagggaaauuccaguuuaaaauagcggccagagaacccuaauuaagaagaugguauaauaauaaagagcugaagaaguagagaaguaaucuaauguuugggagaaagauuccuggcuugagacagugugguggccuucuaccaaaaauaucccugcuuaauuugaagaauagcaaugagaccacuaugggugcaaugaauggaguaggggaagaacagaaaagcauauggcuagagauaacaggaaaauuagguagccagauuauguaaaguaccaccagccauuaaaaggacuucagauuucuuauuaguaaaagagaaaaccaaugaaagaguugaaaacgaugucauuuaauguuuuaaaggauccauucuccuauauucugcuucuucaucucucauauuauaaaaaaaauguuccucugacuaaggaacaauaagaauucccuuuuauuggcugugacuuauauucgagaaacacagaaagcuuaagaaacuugugcauccacacugcuauuuagaauagcuggacgugagaaucaguggauaaacuguauaaguuccagaaguucaggucagacuuugacgaauuauaucugagacucauuagugguacccagauaccaauauauauuggagcuuccaaaauauaacaagaaauaaagaccacuggucugaaguguuuaaccuaagcaaacuucucaugaugacuguguagcuugagucagcaaugaguaugaauguugcuuuuggcagagcuguaccugggaccauucacucuaaguaaaagaagauauaaaacuucacaaagagugaucuagaaaggugauaugaugcuugauaauauggaaauaggaaaaugauaagugaaagcugugguagaaauggaucugggccagaccagaaaagagaaaacugaaagacaguauuuaacuguuugcagcaacaucugaacugcaggccaaacaucuggaauugaugagugcacuauacauauuagaaagcgggguuuuuaaaggaaagauuuauucucaaggccaagcugagcaacugcuuugauuugugacaaaccugugcacauggguggugauugagcuugcaggagaggaauggguagggcaugggccagcugcuaucuuuauugcccuuuuuuaaucucaggacuucuguacugcccaggcaaagcaaauagccuaaagucuugaguucuuaauuuagacuugucauccuacaaguucuacccauccgagauagagagaccaugcuucaugccacaggcauuucugcaaguugagaagaccaacagccacaaaggguggccagaagcagcugcacacccagcagcaugagugccuuacauccagaagaaauuuagccagcaucauuuauucagggcacagugagcuaauguugagauuauuauuaaugccuacgucauuccuuuucucuuuccugccugccugcauucacucucuucuaaguuaauuucuggggaacaaagacaaugggaacagguucagagauggugcaaaugacagggauaggacaaguaaagaagcacugucaccuuuguaguuguugcuccagccuuacuggauauguguauguauguacacauacuugauaaaguauuaaugcagcaauauaacauuaaguauaugcauguguucauacacaucaguugccaaguuuggcuaaaaaguagaaugaaauaaaucaguuggaucauaguagccuuaaauuuuauuuuaauuuuggagcuaacuuuggcaauauucacuagaaaaauaugggauauuuccaauauuaaaaaaaaugacagucaucuuaauccaaaaaucugaaacauaauucauauaacauaaacuuuaccauuucaaguauacaacuuuaugcuuuuuaauauauucacaaacuccugccauguaauuccaggucauuuucauugugcauugaucagucauugucuccuccucccaggcuaugacaaauaauaaaucugccuuugugucuguggauugucaauuuugggcauuucauguaaauaaaaucacauuauugcccuuuccugucuagcuaugucucuuaaucauaauaaagauugauuauacauuauagcauacauuauguauuucauuccuuuuucuagauaaauccuacuuuauuuuacagacacacuaaguucuauuuaucaacuuuauuuaugaguugauuauuucuguuaucaugaguaugcuccuaggagcauuuauguacaaaguuugugugaacauguguuuucaccucuuggcauauauauuuaggaaucuauauuuaggaauaauugcuauaucauauaauaacucaauucuucacuuuuugaagaacugauuaaucauuuucuaaaaauuugcacuauuuuagacucucagcaccacuguaugaaauccucguugucuacaucuuccaugacaguugucuauccauauuuaagaaaaauauauugcuacaauguauaacgaaacauuuaauuguggucuucauuugcauuccuacugagcauacguucauguguuuauuggucacuuguacuccuucuuucagaaauguuuguuuaaaaucugagagaaguuaggccaaauuucccuucuugguucucuccuucacccuuuaaccaucagucaaauuuuacccauggauauuuucuauaccacaguuugggaauaugugacuauacagaauuucagaucccagaucacauuaccuguggcaagaauuccauuuaagucuagugggaagauacagaaacucugucuagcuccuccauugggggcccuguguuccauccaauagaugacugugagcacccacuucuguauuugccaggcacuggcauagccucacaaaagacagcuauaucaggguccugucagcaaaaucuugcuggcauaugcgauugugucuguguuugguggcugacuaugguacgaguccccaggagggguagucucugaauggcccauccuuuugucucagcuccaaacuuugucucuguaacuccuuccauggguauuuuauucccuauucuaggggggaaugaaguauccauguguuggucuuccuucuugauuuucuuguguuuugcaaauuguaucuuaagaaaguacccaaggggcugaaggaaucugcaacccuguagguagaacaacaauaugaacuaaccaguacccccagagcucgugucucuagcugcauauguagcagaagauggccuagucagccaucacugggaagagaggccccuugguauugcaaacuuauaugccccaguacaggguaaugccagggccaagaagugggaguggguggguaagggaacagaguggguggggaggguauaggggaccuuugggauagcauuugaaauguaaaugaagaaaauaucuaauaaaagaaaaaagaaaaaaaauacagaaacucugagcaugugauuugccaugaaagagggaaucuauugugcuacauaugacaugguaauuuuagucaaauacacuuacuguuacuuuucagaagaugaugaaauaaaacaugguauucaaagcccuuucucaaguccauuuuccaguaaguuauagcuuuauuuuugaacauaaaccuggugcuagaaacugugggagaucuagggagagauccuggacuuuauggaacaggcaaacaagagucaguaaaggguuuugagguaaagagcuacaggcaauaagagcuuuuuaaagccccuuaucucuguuccaucuauucaucuggcuaaaggguagaguaggugguucugagugaugagaacaucagagauuauauuugaggguuuugagguauuccugauggggucaguacuuuccuuugggcuugaauaucacauccugacacuccuuccuccuuuuaaaucuuuacauaucaaagagaugagcuagucugagacagugaagucauggguuagagagucaaaggaagaaaauuaccuaaagcuccuggcuaggaguaaaaagaccuucggccucucuacauuuggccugagguucuaggcaaacuaaaauucacugaugacuccuuugguguuagcuagaugguuauaucuaaugaacugucagcuauguucaucuaaucuaugaggucaguaucuagauucuauucacguuaaaacaugcacacauaucaagucagaaaaggaccauguacauuguuuuacauuugcaguguuucuuacucaggucuguauuuggugacuaauaaggucagaauguuugguauauacuuuccuacaguuaucagacuggcagaaauaaggccuucaaacugaggauuuccucuuagaugcccccuaugugcucuguggacaauggagggccuuccugacaaucugguugguucacaagugaguccugagauucucaagucagcaacuacuggagcccaaccacaauaauccaaaagucauagagauuucugaaaaauggcuucugacccauagaagggaaaguagccugaucuucaguagaaggcacgccuggcauugguaccauuucauguguuaaagagccugugguggaagguacugucagggacacugguggugggcaugauugagaugccacuggaagcugaggcacgaaggguacucacugcaacacaucauauuuucacuaaaagucauggguguuccuggaauaccaggcuuuccuaauggcguugugugggacccucuuacaaaucaucuucucuggcuacaagaaagaugcucccugaggaggaggggucuguagggagcaguaucacccacuauaaucacguaguagcaaaaugcauuaugauucuccuuuacucauauuuacugcaugacucaacagaccaaaauaauaaauaauaauaauaggccuucaauuuuuuucagauucugagaauagugaugaaugcuugcuguucugugauuguaagcggugugcacccuuuuuccagaaaacaaucauaucgaaagcuaacagcaacuucucauauuuuagagguguuuggucaacagacuaccagggucucaguuucuuagcuuccuacuccauguugaccauaguccaauuguacuuugggacuccagagguucagaaucacuucagaucugagaggaggcacuuucuuagucucauaaugaugcuuugagaaaacaaaaguuuugaauuuuugaauacuaaauuucaacacaccuuaucuucccaccauaaucuaagaucacaaaaacuuagaucuauaguguuugaucaaagcaauuuuaaaugacaugcuuuaacaucucuuaugaaaaaaaucauauaaacuaggagcaaaaaugugauguccuauauugggagguguaugacauuagaugacagugaaaacauauaaugacagaaacuagaauggcaacuaccugugggaaggggucauauuugcugugaaaggaauacaggggagccugaguaggucauguaaaggcucuauaucuuaccuggacaguauuuccugucccaaaccauagauuuugucuacugcauuuaggcuuugcucaauguugaucuuuauauuuuuauucuuuauacuuuuauucuuuauacuuuuauuuuuauauauucuuuauacuuuuauuccuuuguuacuauucaaggcauaggugauagauauguauucucaacacuuaauuauucuuucuuuacuuuuaccauaaauuagcaccugcuguagggcacugcuauucauaggguauaaggucucauauuauccaugaguuuauuuauugcuuauuaggcaguuuuuucuguauauccaggauucucuagaacaguccauuguacauguuuucuuuaauaaaaguuucuuaaauuuaaauugaacaucaauuuaguuuauguuuuggauaccauuuuaauaaaaaggagggacaaagaaacucuguguuauuuauuauguccugguauguguauuugguaggaagccuaccugggaaauaguuuuguaccaagguuaaugagagacauuaagguucaugcaauuuaaugccuauuggguaaacuagcguuuggaaaccaaacugaaaauagggucucacauaugccuccuggacagcagcuuccacaaaauucuaggugcuuauguuaagaauuuaucucuaaaggaggucugcuuugggaacucuaucaauguuuuccuguuuucugggaaagaaaacuauacagcaaaaauuuucuuaguuauucuaugcuggauuuguugccauaauacugaauucccuuauuagugaagguuaugagaugaauaguuuuuccuuuaauaacaaggagagagagagagagagcaaaagccuugucuucugagugugacaauuugacaacagaggagaaaguguguccauuuuguuuaaauuguagacauuauagaccaccuucuauugauugaagaaauggggaaaaguuaagagaaaaguuauacuucagcaaaacuggcagccagaacaucuuacccuauuucuauugguagccuuggaggagaugauugggguaacaucauccucccuuauaauuagaaauauacauuaaggacuuuccguagguggagaacccacaugaaauagucuuguauaagauuaggaaggagugacaaaaaugucgcuggcaacacauccauucauggugaucuuaaaaacacccaccugcaccaucacacuggacuguaccacuagggcauccagaacaagccccacccuaacaguggggggaggcacagccagauucacagcacugagagucucaaccagcuaagcugaacuucaaauuagaugccuccugccccugcccucagcugcccaggccccagcauggagaugaaugaccugcacaacaggcucagcaccucugaggugugcauuagccacuuauagcagcagucuauacucuuucaaguaugcaaguuuugacuucacuacuugccauagccuguccccacugucugaucuagugcuuaacuucaacccuagaggcugccuugaccugaggaggcaucucacugguucugugcuugugugugcccuaccccucacugcugggucccaggacccagacucagguaggagggaggacaggugccuuggucgcucuggggcacuuuauauguugugaaauuaaaccuguuguaaguauauuuguuugaauuaacuuaaguauuguaauauuauuuguugaauguaguaauuagauauuuaugaauuucugacauccaaaaacuaaaaaguucauaaguaaaaaaaaaaaaaaaaaaaaaaaaaaaaaaaaaagggcucccaauggaggagcuagagaaagaacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaauggaaaaaaauuguguuuauauaagacuaucuaucuucauaccuaucuuuuuaguuuguauaguucuucaaagucuucaugaggacuugaagaaacauaacacauucaguccucucaagcuaccugguguagggaggaucacaauguaaaauuuccucgguuuaaguaacugaagucauuaggaauccaugcaagacuguaaguugaaauggaaugacccagucaaaguaaucagauccuuuggcaaagaaaaaaucauguuucaacuuuuucauccacaaauaaggauuauauuuuccacauugcuuacgucagaaaacuauugaaaauauugacaaauaaaguaaguguaaaggugguuuuuaagagcuuuucacauauuuuauuguagucaguagaaggaagccaauggguuuucuaauuuauuuauuaauuuuucccaguaaagcuccugauaucaaaccacaagcugaaaaacuuguuugucccauugccuuaguucucuuaucuguaaaaugaaauuaauaauaauuugugacaucuuuuuggagaauggaaugcauugccacauagaaagcauuuagaagaguuauuaacaguacucaaaaacuuuugccugcuuuagguuggcuuuuguggccauuuucacuagaacacacaguaaagaaaacagaaaugccacaucucaggcaagccacuacuuuaaaaucauucuuuaagauaacuaguaauuauuuuuguacccacaguuuuuuucaucauggauugucaagagaaugaguaccgggaccaaugggggcgcugugucaccugccaacaauguggcccuggacaggagcucucgaagguaaaacuuuuuaaucaguacuuuaaaaaaaaguaugcauuuguguguguguguguguguguguguguguauuaugaaaggaguaaagaagguuuaaagagaaaaagaucugagaaaagccaauauuaguaauacagucaaucacagcuaugacaguucagcagauauaaugaaaugcaaauaauaugcaauaauauucauuguucacaagaagugaggcaaucagacucauauguuagggaaccucaugaagaaauauuucaguacagaucucuaaacuuguugcguuaaagaaaucuguuaaacaaagcaagguauacuuaauuugauuaaaaaucaugguauacuaugguaagaaugaagcccuguuguaaaauugcauggaaguuccucaaguaauuaagaauaggcauuuuuagagaaguuggcagguuagagaucuuaugaugcaacucagugaaagaaaacaggauaguacaggauaaucucuauccuugcaauagacaguagcuguaaauggacuuauuaagccaagugagaucucuguggggaagcagacaagaguggcugugaacuggugccuagcugcacaaauuggcucuggugagguaauuggaaaccgcagggaggcacuuuacagcacacacacucagcagcacugcaguaacaguuagcucauaaccaaggacuggauagcaauugcagaugaagccuuggaacuaaagcuuaguucucacagcagggcucugguugagguuaagcccaacuugcaggacaaagccuacaccuccuuucccuuccccauauaccagcaugguggcgcagccugaggaaaaacuugccacaaaaccuggguggcuccaggggcugaaaugugauaguacaguugacagccucuuuuaucccaaguuuguagcuguacucaaugggaacccacagcaagggaucccacccuggcuucuccagcacagugaugucaaaccacacagaguaucaagaagggaauugagaacuacacugcucaucucacugcagcucugccaaauacucaauccaaaguguuuauuaucuaaucucuaugggacaauacauacacaaaaucaggcuuuacagcuuucuacuggaauaagaaacaaaucgcaucuuccccauuagugcaauuugcuagaggaaaguuuugaauggaaaagaaagaauucaaaacccauuccaagaggaaagaaauagugacugauaugauuuuucuaaaauccaaagugcuuuuauuauacuuugucuuuuuugcugcugucaauguguucuuucuuuuuuuuuuaauuagauauuuucuuucuuuauguuucaaauguuauccucuuuccuaguuuccccuucaaaaauucccuaucccuuccacaccacugcuccccaacccacccacucccacuuccuggcccaggcauucccuuauacaggggcauagaaucuucacaggaccuagggccagcucccauugaugaccaacuaggccauccucugcugcauaugcagcuagagccaugagucccaccauguguuuucuuugauuggugguuuagucccagggagcucuagggaguacugguuaguucauauugcuguucuucucgucaauguuuuugauaauuuuuauguuuucuuuucauuuuuaagcauuaauucuugaauaaauacucugaaaguaucucaaauuaggucauacagugcuuaguuugcacaacuguuuugcaugcuuuuuaacccauuacacuauuauauacucuauaguaucuuuuuccuacauacaacccauguacuuuguuuuacuaauuuccacuuccuuuucaauuuuacuuccuugccccucuucuuucacuuaacucuaucccuccaaaacuuuaaaaaugguuaaacuauuagacacuaacaguaucccaauucuuuccucccaauaucuuuccucaacucaauauucuuccaguugaucuaacauuaauuccuauguuuaucacauucugucugcuuguaaucuugguaaugcuucacuauacauaauauuauucuuauauauuaaucuuccaauaguuuuuagaauaaaaagaucacuguuaauuggcuagaaggacauuuuuguaggcauuuuauccagcaauuguaguugauucuacaccugauauuugguuguacuagggaccuuuaguacaugacuagggguauaaacucuaaacuauacauauaaauucuaucacuugaauaaugaaaguauuuugacuacaagaaaaacuaauaaaauaacccagaugcaaaaaucuaaacagaauagaacaagaaagaugacaaaucaaggaagaaugauguuauccccaugaaaaauauaguacugguacacagugagagucaauuagacaaaaucucagaaaaauacaguuguuuaauaaaagaagaaagaaauaaaacccugaauaaacucaagaagacuaaaacuaaacaguugaauguaauaaguaaguuacucuagcauacaaaaacuagaauucaaugaagaaacagcaauauaaaaaauggaaaauuuuaguuauauaaaagucagcaugcucccuauucuaaggaagaugaaguauccacacuucugucuuccuucuucuugaguucguguguuuuccaaauuguaucugggcuauucuaaguuucugggcuaauauucacuuaucagugagugcauaucaugugaauacuuugauuggauuaccucacucaggaugauacccuccagauccauccauuugccuagggcccccaauggaggagcuagagaaaguacccaaggagcugaaggggucugcaacccuauagauggaacaacaauaugaacuagccaguaccccggagcucuugacucuagcugcauauguagcagaagauggccuaguuggccaucauugggaagagaggccucuuggucuuacaaauuuuauaugccccaguacaaggaagcaccaggaccaaaaagugggacugggucaguaggagagcaggguggggggaggguauggggacuuucaggauagcauuugaaauguaaaugaagaaaauaucuaauaaaacuuugggaaaaaaagcagcaugcaaaauaaacccaauugaaagccuaaauaauacaauagaucauguggaagaaagaauucuagagacagaugaacagaaacacuaaagauaucaacaaagauaaaauaaugagaaaauauaacuaaaacauagaguucuaugggacaccaugcaaagacugauuuugucccauggcacaacucuuguaccuaagacucagggaacaccauagaaggugucagaaaauuuguaagugccagaggaccaggaagccugcuguaagauugugucuuuuagaaaugacagugaagcuacagccacagcaccucaguaauauggcugccuagacacaucuugaagagugacaaugaaaauagcacgcaaaggcaggaaggagagaucucauagggcuccaccucaaaacuaagaacuacaagcaacuuaggacuucugagagaaagagaauuugacuuacugaaggaugaaccccuuaauuguuuguucaagaccaaguggucaacacugaaaugguaaacauaaaaacuaugcuaaguggacucagaaagcugucuuuauuuaaaaaaucaaacuuucaaaaucuagacuaacaggguggcuauccaggcucaggaaacaugucagucaaaauaucuguuuacagaucuuucguaaguacaaaacaugauagauagauagauagauagauagauagauagauagauagauagauagcacuaaaguaaaaagggcaaaucuaucagaauucuaauggauuuuugaagagacaccuuaaaagucuggagagcaugcaaugauguauuucaagagcugaaagacaaugauugggaauucaguuacuauugaauaaacugaugaaaugacccuuaccaaguaugguuaaaugcaagguuucaucauagauaugagaguacagcuugagguaucuggaaucauccaaagaagggaaagaaaauaauggacugaacauagcaagcagacugaacuuggugaucagagaagaggcugggaagcaaaagaggaagacaaagagagcaugaauaaaggaggacaggacaaaggaaaggagagagagagagagagagagagagagagagagagagagagagauaggaugccaguauggauucagaaauguuaacagguauuugggauagugaaggagccucuaggcccucaugcuauuuagcauguuaauagcaccacagauagcauuuuguccaugcagacagugaucaggaaaugguugccuucauagaagggaaccagcuucauaaguuaccacagaauacuggcuuuuguauaaucaccaguauuuuuaccugacaacuaaauccaaaauaguuauauugaggaaauagcucuguugauaaaguguuugcuucacaugcaugagaagcaaaguguagaccccuagcacccaugcaaaaaaagcaauauccacacaugacagcauguuccuguaaucuuauacuaaagagauacagcugaaagagucacugaaagagugguuuaguugccagcuuaucugguugaauuuuugaacuccagauucaaugagaguuuuugccucaaaacauuaguucaagaagcuauugugaauggugcauacuuuacauguguuucugcauucacgugcauacaaucagagauuacaaacaaauaacuuauuaauauacuuuaauugaaagagcaagaaaagggcaaaccccaaaucaguagauaggaagaacuaaucuuuuucaaggaagaaauuaagaaaauggaaaaaaaaugauaacaauaaaacaaagcaaguaauuaaugaaacaaagaguugguucuuuaaaaagauaaaaucaaaagucauuuuaaaaaaccauucuagagaaacagagagaaaacucaaauaucaaaauugcaaaugaaaggacauauuuuacagaagaucccaaugacauucaaaacagccuucaaaacauucaugaagacaucuaaaaaagugaaugaaucaauaaacacaugaaagaccaaaauuaaaccaugguagauuaaacaacuuuaacaguccuaaacugugcaaugugauuagagguuuuuaauaauaguaauaauaauaauaaugauaauaauaaccucacaacuaaaaaguucuaggaugaggauucaagucuaacaacccuucaagguagaaacaacaccaguauuucuccaaguauuucauaaagcagaaagauaaaguaaacauagauagagaauuuuucauuagcacauguguauuagcuacuuuucuauugcuaugauaaaaggcaacaaccaaggcaacuuauagaagaaagcauuuaauugggcuuauuauugcagaggcuuggaguccauguuuaugggacaaaggcaugguuacuggagcagcuaaaagcucacaucuuaaaaaucccaauagagaggaaaagagcucuggagauacugagcaaaaggguuuuggagcucccaagaucaucccaguggcauaccuccuauaacaaaagcacagccaccuuuuaauucucaaacaauuccaccaauggggagggaucaaauauucaaauguaguacccaaugggggucauucuuauuuaauuugccauagcaugcaaacagaacuuaucuaucuaucuaucuaucuaucuaucuaucuaucuaucuaucuaucuaucuaucuauuuauugggguuuuucuagacaguguuucucuguauagcccuggcuguccuggaacucacucuguagaccaggcuggccucaaacucagaaauccaccugcauuugccucccaagugcugagauuaaaggcgugcgccaccacugcccagcaacagaaccuuauaaaauuaauuuaauucacaacaaaaaguacacucauggacaaauuguuuuuuuuuuuuuaauucagagauguggaaaugguccaacauauucaaaucaacaaacauaauuuaguccauauauagaauuaaagauauaaauuauauaauuguuucaauugaguuguuaaugcuuugacaacucuaacaucccuuccuaauaaaagucauaauagaaagcuagggauugaaagaaaauagcucaauguguuaaaagcuacauacaacaaaccuaaaaccaacaucauccuaaauggaaaacaaucccaggcauuuccacuaagauuagaaacaagauaagccucccuuucuccacucauacucaauagagaaagaagacgacucugggagaugcugguaugcugguugauuuuaugucaacuugauaugaguuaaagucauuuuggaaaugagaaaaugucccccaaaauuagccuuugggcaagagaguaguacauuuccuucuuuucuuuuuucaagaauccucaaaaaacaauuuuaacugcaccaaauuucuguaccuuuuacauuuucuauuauuaaaauuuuuauuaguuauuuuauuuauuuacauuauaaauuuuaucccccuucccguuuuccccuccgaaaaaccucuauccucccccuccucccugcuucuaugacugugcucccccacccacccacuccagccucaucacccuagcuagcauucaccuacacuagggcaucaagcauucacaggacuaauguccaugccucccacugaugccagauaaggccauccucugauuacauauacggcuggugguuuagucccugggagcucugggcggugggguauggcugguugauauauauauauauauauauauaucgauauaucgauauaucaauauaaguauauauaucaauauaucgauauaucaauauaucaauauauauauauauaguuguucuuccuaugggguugcaaaccccuucagcuccuucagucuuuccacuaacucguccauugggaucgccaugcucaguccaaugguugaugaaugauugauaucagaauacucagauuauuugaaugauauagguuaauggucucagguuacacacacacacacacacacacacacacacacacacacacacacacacacacacacauuaggaugaaaaggccccaauaagaaaaccaguaugcagcaauccuacauggcuucugcuuuaguuucugucucuagauuccuggcacgacuuccuuggaugauggacugugauguaaacacuguaagcuugaaauaaacccuuucuuuccuaaguugcuuuuggucauaauauuuuaccacaucaauagaaauguuuuuaagacagauggaaagacugcugauacucacaaaugagaaaacaauauuuugaaaauggcuauaguaccaaaaaagccuacauggucaauauaauuccuuucaaaauaucaaugccacucuucacaaaagcacagaagauaaauaaauucaugugguaacacagacgacccugaauagugccaucaauucugggaaaaagaagaaugaaagauaccuauuacaacaauguggaaacacaucauuuucaauuguacuccggaaccauaguaauaaaaagcacuggacuggcaaaaagaacacauguauggaucugugcaucagaauauaggacccagauauaaguccacacugcuacaaccaaauaugauuuuucauaauacuacuuuagaaucacucuuuaaaaaagguaaccucaccaagaaauguuucuggccaagcuagauauccacuuaugaaauaaucuagguccacauaaaaccaaaccagcacauaugcauaccacaaaagucaugaagcagagacaaggcaaaagagcuagcuuuacauuaggaaaaaaucauuuucucgaaguuuccaaaaagacuuuucuuugcaucuuaugauaaaacuggguaaugcauuucuguauagaagggugacuaugaauguauguuuggcacacaagaauaauuccaucaagguuugcuaaacaaauaaagcaagcauuuuugagccuggucaucauacuaccuagaaugaaaugaacaauugauuauuaagggaggccaaugauguuuggauaagaagcuaacaacauccaagacaacauuucuguucaguuaccuuuauucaauuuuauauuucacucaugaauuauaaauaacccuguaaacaaauuauugcagaagauuaacaguaauuccuugggauauuuucuacaaguauaauuugugaacuaaauacaauuuuaauauucuugaaauauauaaauagauaucacauuuguacauuuuuuaguaauuuccauuacaauugcauguauuuuaaauaauguauaaaauucccaugacacaaaagucaaacccaaaaaugaauaaugcauauuucuaucaucuguuaccuuuaugcuuucuucuauaauauuaauuacuaauuuaugaagcuuuaagauuuuuuuuuacuuuucaaauauuugacagggauguauacuaaccugugaacucuuucuuaguacaauguuuauuguucaacuucuacucaaguaaaguacuugaguagacaaauguuauaaaauaaaguauuuuuaauacuuuauauaauaaauauauuaaaaucagaaauguuuuuaaauuuuauucaacgucacuauuuuguauguacuuuuuaauacauuuucucuuauuauguuuauuugauaauaugguaaugaauucuuaaaguuaaaauaguauauguuuuuagcauaaaccauucuugauuauguuuuucaguuaauuguucuugcauguuauacaaacaacuuuuaaaaagaaauaacuauacuuacuccauggucagcauugaaauuuugugucagcaucaugaaagcaugauaaaauuaagauaaauguuuccugauuauaaaacugauuagcagcaaaagcauuuggaaaccugaaucauuuaaaaaacgaaacucuuuugccuccuaacuaugaaagaugauucucaacaagacuuguaaaugauaauuugcauguuuuuaauucuuaggaaaugauucauucaucagugaaagaaauggcugggggguggcaaugugauaguaucugauuuuuuucuacaaugcucauuucugccuuuuaauugcuuugcuuagaugauuuaaauuuaagauugcuauugauugacacuuuaagccugaaggcuguuguuuuacuguugggcucuccauuccuauucuuuucuuugucuuuucuugccuuucuguugguuauacaaaguuguauuuuaaaacuucauauugauauauuugugccaauuuuacuguauuuauuuguauuguuugcuuagcuguucuaaauacuaaaauacacacauguaacuuuuuaguaucugcugguuucaacuuuuuucccauuaugaguauagaaacauccauuuaagugccuuuacuuucccaauaucuuagucaguguucuacugcuauuaagaguuaccaugaccccaaaacucuuguaaaaauuuuuaauuggggcuuacauacaguuucagagguuuagucuauuaucagcaugagaagaagauggcaugguacuagagaaguagcuuuaaacuucuauauccagauccauagucaccaugaagagagaguaacucuuggacuggcuugggcuuuugaaacaucaauguccacuuccucagugacacacuuccuccaacaagaccacaccuacuccaacaaugcaauaucuccuauuccuuuucauauagugccacuuucugauaacuaaacauugaaauaaaugagcguaugguagccauucuuacuugugccauuucacccaauguauguauauaauuggcauagauaucagaugugguauuauguuauaaucaccacauaggauuuauacaauuugugaaaagaaaguuuaucauuucaaagauuuuuuaauuuuacaaauuaaaauaugauuacaugauuuucuucuccuuuccuccguacaaucauuaccauguauucucccauuguacugguguguucuucucuaggcaagacuauuucucccauucugagcauuuuuuuaguugaccaaagcucuuuguguaugguuaaagucuccuggguuuccccauuaacuuuaacauguccaugcugcuguucuugaucagcucauguuuaagagguauucacguugguaagauuauggguguauuuccgacauuacuaggauacacaaucucacagaaaacuugcucauucuuaggcccuaauauucuuuucucaauauucacugaguuuuagguacgggagugguuuuguagauguauccacuggggauggacaucacaacacugcaguuaauuaaucgugguuuucuguaaugguuuccuguagcaaagauaauuuuauuaaauaagguguaaugacagaauuauuacucuauuguggguauaaagacauuauacagaaggugguuagagacauuggugguuuaguaaagugguaguuguaaguuauuagauccaaguucugugacugcacuagcucuagguaguugaaaagguucccuguaccugacaugguuucccuuuuguugagcaggucuuaauugaaauuagaaaguuguuggcuagcacauaugugugugugcgccacugcuguaccuauuaggcuuauugugccaagguggucauuguugugguucauagacaucauagcuggguagaccaccaaucaaagaaaacacauggugggacucuuggcucuagcugcauauguagcagaggauggccuaguuggucauuaaugggaggagaggcccuugguccagugaagguucuaugucccaguguaggggaaugccagggccaggaaugggaguggguggguuggugagcagggggaagggggagggaauaggggauuuuuaauaaaaaaagaaguuauuagaacaaaaacaaaaaggaauuccuuugcuuccuuuggaaguuuguuuuuuuuuuuuuuuuuuuuuaguauuguaaaaacuauuccuugugggcaagguauucaaguuaauucuagcaccagcuccuauaaacccuauccuugaagugcauaguguguauagaaauauagacuuacuuucuacuuuugaggacaaucacuguugacagcaauaggcuauuuguuuuggggagucucuuggacaacccugagcaaaaguucaaaagaguuucucaugccuguucuuuacauuuuuguuagauugucuuuggcucuuagaggaagcauuuucaauccagauaggaaauauacaugaauauaauaaauaguuaauuguaugauuccuuaugaccuuuucagacaugcuuguuguuauuuuauccuccccauucuaauuucauuucccuuucccuucaauaauuugaaccucucugucccauuucccugaucacaucauuuggacccugcugguucccucuguucugaucuugagccaauuuucuuaauacuauuugugggccgcuuuuccucuuuauuucuugagcuuuucacauaucuuggauauuaauauuuuucauauguauagcuggcaaagauucuuauucuuugggaauaaucuucaugggauuguuucuuuaguugugaagaugccuuuuaguuuuaugauuucuacuuuuuaauucuaugagaccaauuauuacccacaauaccuuagcaagugagacacuauuuagaaaguccauuccuacauucauuuuauguagaguacuuuguauauuuuccucuaaccauugacauuucaaauuuaggucuuggcuucauuuguauuuagauuuugucaaagguaauagauacaguucugauacauuucucuuauauguagacauccucuuuuacuggcaccauuuguugaauauguuguauuuucaccagugugugguuuuggcaucuuugcagaguauuagauggauguagcuauauauacuugugucucaaucaucaguuuuguuucauuggucaauauguuuauuuuugugccauuaucauuguauucauuacuugucccgguaauacauuuugaaacuggaauggguuuugcccccuagagucuuaagguuccaugugaauuuuacaauaguucauuucuuuucuauuucuguaaagaaugagauggggauuuugauugugauugcauuaaaacucuaaauggcuuuuuaagagaacacucauuuucacaauauuaauucuaccaaucaauaagcaugauuuauguuuuuacuuucuagugucuuuaucccuuucuuuagagguuuaaaggucuuucaucucuuugguuugguuuacuccugggcauuuaacuuucuuugagacuauugcgaaugagaggcuguccaggagcucuuucucuauacguguuuuggcugguggugguagugcuggaucccauuuuuacuuguuucuacaagccuucuggggaauaucugcaauuucuaacauauaaucucaugucaguugccaauagagauaguuuaauuuauugcucccaauuaguaucucuuuaauuugcuuuuuaaugccuuaaguuuccuggcuggugcuuacaguauugaaaaggagugggaguaaaagcucaguuuuuauaaauuaguuuuauaauuccaacauuuuucaccuuuuacaagcuaccaguuuugaucauuucuuucugauugaaaauuuuuaguagcuaccauuuuauagugugucuaccaggcaacaugggcguuuuauguuaccugaagaauaucuuuuuuuuuccccuucuuucuuaaguugaaguuucacagaauauuacaauuugcauauggcgguuauguacucucaacaucuuaaaaauauggcuuaagaaauuuuucaaaguuucagacaaauacucacugucauuucagugauuguuguuuuagaguuaaugucauacugaauauuuucaaaucugaccuucgccaagaaguuucauuauauacacauacacauaaacauaaucuccaguacacauaaacacacguacacauauguguauauagauagauagauauagauagauagaugugugugugugugugugugugugucugaguauaucgggauuccaugugugggguauauaaauacaugucuguuguggggguguuuuucaacccaugccccuguugguaaaaauaacaacucugagacucaaauauauuuacaaauuucuagacuauauagcuaugcauguucccuagcuccugaguuaauaucuuauuuauucaaauuuaaguucugccacuuggcuuguuucuucuguccgguuccaugagucuccucuuucauauuacagggugcauucuucucuuucucuagcccagaauucaauaagucuacuggauguucuacuuucuauuuccugucuaagcuuauagacaaaucaccauuuuauugauaacuccugcaucuauacaguacauaagagauucuuucuauacacauguguguauuugaugauauuuggugauuauuuuuccaaaucuaugaaaauuuagcuuuuguuucuuugacuauuuucugacacacauuuuauuuguuuugauuucaugugguuuugguaguuuuauuucuuugucugcuuaauuauccccaaaauucuccagucauuuucuuguuuuugucuauuuuagucuaauuguccuguuauuugaacuguauuccuucuauuguuuuaucuucagguucagugauuuuccuaauuuucuaguaaucagcacagccagugaauuuuguucauuuauuuaguuauuuuuauaacuucuguuuggcucuuaaaaacaauuucuuugagcugaauuuaguuacuuucagcucuaaugccagcauucugaaggcagaagcaaaaugacuucaaccuugaagccagauuggggcuacaugaugagcuccaggucaaauaauacuauagagaugcugucuuaaaaauccaaauuugcccccaaaaaauuccauucauguucugugauauuuuaauuuaccucauauuuaaauguauuuuauaauuguuugucaaugaauuuuuggagugcuuuaaaauccuuguuaaauaaucccaauaauugauucaucuagcuugugguaucugcugauugucuuuguacuggcuaguuuugugucaacuuaaaacagcuggauuuaucauagagcaagagcuucaguugaggaaaugccuccaugagauccaacuguaaggcauuuucucaauuagugaucaagggggaaaggccccuuaugggugggaccaucucugagcugguagucuuggguucuauaagagagcaggcugagcaagccaggggaagcaagccaguaaagaacauuccuccauggcuucuacaucagcuccugcuuccugaccugcuuggguuccaguucugacuuucuuugaugaugaacagcaguauggaaguauaagcugaauaaacccuuuccuccacaacuuguuucuuggucaugauaauuugugcaggaauagaaacccugacuaagacagucuuuuuuucguuaaucugauuuucuuguuaucauggguguuuuauuaugucugauguuguguuucauuaugucugacauuuuuuucaggagacucagagucccacuacaaccuuccauuuagaaagcuguguuaacauacagauucuagccuucuuugugcauaucauuuugaaagacuaauuuucuguaucccuggggcauuauuuggucaauauugcuuuuuaguacuauuugauauuuggaaagauguuuccugagauauuuuucuauuuaucucaugugaauuaaagaagucucucaguuuuagagauuaagaaaauuucuacaacuauagucauuguaggaugcugccugcuuguauacacucaacuauacagccuuaaguaguaguauucuuaguuccacaagauuaagagacuaagccuggguaaauguaucaauaucucuguugcucaugucuccuaaaacauaguaucucugugcauauugaagucuuaugagcuagcauacucuuuugacacaaacauuucucacuuuuaagauagggaugauaaugcaaucuuagaaguuuuauggugaauaaacauguauaaaaguuccugaaugcagggacguuuuuuacucugauacuuuuaaucauucagucauaauauccauggcagaaucauaauuauauauuaguugcucaauaaauauuauauaaauuaaucaguaaaaucaaggaaaauucugaacaaccaguaaaauuguuauuuaauuaucagugaauauuggcuaacuuccaucauugucuuucuagugagugaguuaauagggaaucaugucauguucuucugauaccaguggucuacuuauuauuucagaauacauaacaauauguaguguuacuuguuugaauuacuauguacuaggcaugaugauaacaacagcacuugguuuuaccuaacauccuuggauaucuagucuuacucucuuggugcuccaagcaguacuggguaugguuuccauucccuggaguggaucugaaaucaaaccagauauuuguugguuacuccuacaagcuuugggccaccauugccuuagcauaucucacagguaggauaccauuuuagauuaaaaaguuuguaccuggguugcuguucuuauuucuccuuugguaguauacagagcacauucugauaccaagaacacuaguccuuauggguaaaggcuuuccauaggcaaaugguagaguucuccauguuuagugauuuguguagauauugucuucaggaauuaggccuugucaucaguuuguggauaaaacuuauagucuuugccacagccuggguuguuugaggguucccaugugacccauuuuaacucaauuaaauauaacccaguuuugcuacugcagacuuaauuuggcaacaagauauguucaguugggggaucuaucucccccauuauuuggcuaauuuauuuagauuuccucuuucauguauggauauaaaccucuacuguaucaaguuuccaaacuagacucaaauaacccuuaauuuuaguuguuucucccaaccuuucccucagcuuuuucucuucuucccuacccugcuugaacuucuccaauaccccaucgguccauucauaacuauauauucuaauguuccuuucuauccaucuccuuuuuggauuauagcucaauuauaauuggcuuagcagccaauauccacauauuagcaaauguauaccauauugguccuucuggguuuagguuaccuuacucaggauguuuuuuguuuuuuguuuuuuuucugguuccaucugcuuaucuacccauacauuuuuaacaggugaguaauauuucauugugaaaauguuccacauuuucuuuccauucaucuguugaaggacaucuuaguuguuuccaaucucuaguuauuacuaacagagcaucaaugaacauuuuugaaucuguuaggauaaaucaucuuuuggguauauguccaagagugguauagcaggaucuugauguauauugauucccaucuuucaaaggaagcaccacauugauuucuauaguaagagagcuaaaauuaucuucacagaacauuuacuccaaucucuucagauguuccguucucuuguguacagaaagaauggguuggagguaauagcuguaguauuauugcacugauacaagaucugaagcaaaagucagauagaucuauuuuccaguggauauuaaaacauuuuuaucaugaccuagacuaaaaagucaauuuucaucaauaccuaacguauacuaacauguguguuaccugggaaaguuuuaguuagaacaguagguccuaacuauucuuuaauaccagauacuugcuagcauauacuauuugauauacuguaaacuugggcuuucuuauaugcuuuaugccuaauaaugaucaguuaucauguaugacuugugccauaugaugaaaccgaaguguauuauuucuuggggagaaauguucucuuuuacaugauuuuccuaucauguaagcacaguaugaagccuuucuugaaugagaugccccauuguggguaauaauguaggccccaauccucauuaagucucuaauaggcagagugugaguaagaaauaaacuaaaauuugguguuuuuuuuuccauaguguaaucuuguuuauuuugauugaugcacuuagcuuuacaucauuuuauaccacuauucuauuuaguuacauuucaguuuucagugcugguuacagcugauaaauuuauguaaugacaaguuuaaugaaaccuguaguuugaaaaauagugucuugcugggcgugguggaacacgccuuuaaucccagcacuugggaggcagaggcaggcaaauuucugaguucgaggccagccuggucuacagagugaguuacaggacagccaggacuacacagagaacccugucucaaaaaaaaaaaaaaaaaaaaaaaaaaaaaaaaaaaaaaaaaaaaaagaaaagaaaaaaaaagaaagaaagaaagaaagaaagagaaaaauaguaucuuacaguauauucacuuaagucauaacagaucgucuccccaagcucuuaugaaccccuucuauauuucaggauugugguuauggagaagguggagaugcacacugcauagucugcccuccccgaaaguauaaaagcacuuggggacaucacagaugucagacaugcaucacuugugcugucaucaaucggguccagaaggccaacugcacaaauaccucuaaugcuaucuguggagacugucugcccagguaagccuacuaaacugcauaagucguucugggaauuuuuaacauucuuagaugcccuuuauuauccuaccucuuaaacccuaguaaaaguauucuaaggaucaguuucaugcucuaguuaagcuccaugaauggagaaucuguaucuuucuaacuggaucuaucuauacaaagaauccaggaauuuucgaacaccuaugagcaccuagaagcuuuuuaaucacacugauauucugccuaaaauuuaaaauaaaugucauguuauauuacacaggaaucaugaagaaguuggcaucauauaacuguuugccugucucaugaccuuagcuccucuuugggccauaggauauggauaauuaagagaaaagauggacugaaucacacuuggcagagaucucaugaggguuggcacuccugcuaagaaaggacucauagacacuccuuaucaucucaggaagggcuguuacaagucaacugcuuguucaucacucugccauuccuuucugcucugaucacagguucuaccgaaagacacgcauugggggccugcaggaccaagaaugcaucccauguacaaagcagacuccuucuuccgagguucaguguguguaucuuuuuuucucucccuucuuccccaaaccuguauuagucaacaaaaucaguaaacuucuuuauccuuguaggaggaaaacauuccuuggcacucauuccuuuggcauauuaaacagaggcagccacguaugauuaaaugccaacuuuucagcauucagauucauuggaccuguuucccuuuucuuaaaaaaaaauguuucuaaugagaaaacauuuguauucauacuuugugagcugccugacuagguuugauggauuaaugaaugauacaauguauuuuaaaaauaacauuucuacacuuaauugcuauuagagucaauauugcuauuagagucaacauacauagcauauggaaauccuuaacucuuggacuacuauagaagcugaaaaaacagcuagaauuaauuucuaccugugucacuagacauuuacuuaguuucuaguguucuaaauuuuugucuaucuucucacauacucuugaaauuacagguguuuuccuuaaaaaauaugacauacaaaauagacauugaaaauaaauauaaauauaaaagauaaaauccuauauuaucugagauucuuggauaauuaaucucaaaauuuuguauauauccuucagguuuuuuuuaaacaacaggcauaauaaacuucccuguagauucuuucugaauuuccuguacuauccuucacagaaauaaacacuuuucuuaaauuuuaagaagcuuucuacaaucccaugcuucuuuucauaagauaaagggcuuuuucuaucgcaggacuaugauugcuaggccagguagugucuuguuccuuaucacagaaagaagugguuaagauguaucagcucuuaacugacucagucugaaaguaacaaacauuguuucuauuaaaaguacauugguauuuuguguacauugaugguuuuacuguaaggguguauacagaaugcagugaauucauuggcauauuucucugccuuauucuccacugcuauuuaaaugcuuguauuacuucauauguacucauauucuuagacaauauuugcuauugcuuugugguuuacaucauuuucuauaaaggucauaagcuauccuuucuucacuuuguuuuucucuacuggguuauuuauauuaaucaaugaaaggucuuuuaugacgucuuagaaaaucacgauuuacugauccaguguucacugaugagcauuuuaauuuuauaauauuuguuuuuaggcuauauuacuaaacauagcaugagugaagcacaauauggcaucuuuugguuagugaugcuaauuuauaccaugcauguaacauaugaucucugcuucauuuuauuauaauuuuaccuauuuuuaaauacaaagauaggaaaccugaugcagauggccuaaaggagaagauuuggccuacagaacauuagggcccuugucauaaugacaguuaacuguccacuuugaccaaccuuacccauugcuuuguuguuguuguucuacagguaccuuccaguugagcuuagugaagguagaugcacacacuguucccccuagggaagccacacuuguugcacuggugggaagucugcuagugguauuugcucuggccuuccuuggacucuucuuccuuuauugcaagcagaucuucaacagacauugucaaugcaguaaguauaucuauuuaauauuucacaugaaucaggaguaagacggggcuuuuuauuuuauuguuaaaagaggaauuuuucuaaaaaaaaaaaaaaaggaauuuuucugagacugcaugauaaugggccuuccuugccacauuggaaaaucccagcaaugaugcucuguuguucuaugggaacuauuuagcaugcuauaaaaaauauagaaagucaaaggggcuggagucuaccuagaaauucaauggacauguuuauuagguuuuaaggguucauggaacacuuuucuuuaugggaaaucacuugguaaaggaaacucaagaccgagcacucaagucuauuauuaaaucauagccuaacucaaauuucaguuuacuuauuuuuaaucuucaaaaugaaauaugggauugaauauguuguuucuuuuauauauauuuacauauauuacuuauacauuaauauagcauuaguauguacauauauacaaauagauucugaaacauacgaggugaagaagauuuagcuauaccuaaaacaugaauaauagaaguugaugagguuuucaguaaauguugucaacauaguaaccucccaaaucuggauaacugaaagcauaguguuuaaucaaaauucuuauacacauucuugaaauguguaauuuuagcucacuuauaggugcucugguucucuaggaggggaagaggagcucuggccccaaguuccucucacucacucccuauuuugugcgcaauaagaggugaaacuuauagaggagaaaguggggaaaagccuugaagauauggggaagauaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuucauuguuggugggacugcaggcuuguacaaccacucuggaaaucagucuggcgguuccucagaaaauuggacauaguacuaccggaggauccagcaauaccucuccugggcauauauccagaagaugccccaacugguaagaaggacacaugcuccacuauguucauagcagccuuauuuauaauagccagaagcugaaaagaacccagaugccccucaacagaggaauggauacacaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauauccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggauggaccauguagagacugccauauccagggauccaccccauaaucagcauccaaacgcugacaccauugcauauacuagcaagauuuuaucgaaaggacccagauguagcugucucuuaugagacuaugccggggccuagcaaacacagaaguagaugcucacagucaccuaauggauggaucacagggcucccaauggaggagcuagagaaaguagccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaaauuuauaugccccaguacaggggaacgccagggccaaaaagggggaguggguggguaggggaguggggguggguggguaugggggacuuuugguauagcauuggaaauguaaaugagcuaaauaccuaauaaaaaauuaaaaacaaaacaaaacaaaacaacaacaaaaaaaaagagguaaacuguugaaaagagacccugacucaguggcuuucugcuucauguugcaggagauucguugcaauaugaggcugaaaagacaguggaggaggauucucuuuuccccguaccaccuggccaggagaccaguccugaauuuccagcuaaugagggcaucuuggagaucaaaccacuuaacuccauccuggaugaugacugcagcuccacucgcggcuuccccacccaggaguccuuuaccauggccuccugugccucagagagccauucucaauggguccauaccccaauugaauguacagagcuggaccugcaaaaguuuuccagcucuauccccucuacuggaccugaaaccuugagagagaacacagcugaacacucaggagacaggcuggagcucuauguaccuuuugaaguucccagccuuuaauucuaccaaggugaacuagaaagguaggacuaaaggacuggaaggcauggacuagccucacaaaauuuccaaccuggguucuguuguuccauaggguuuggacuaaagaauagcaggaaacuagguccgauagagguuggagaagcacuaaauuuugagcuaaguuuacacugaacuucuaggacaagaauugucuagagaucaggcagguugacaugaggcuaauauauuuaucuugacucuacuagcaacuagucauauucaauuuucuccuuucaaguguauaagcagcacaacacuguagagauauguggcuccauauucagagaaauaccaguucaugauuagcuuuauacacuugugcaaaucauuuuauucuuucagagacauagucuucagcucauaaguuuucuugaggaaugaaugaaagcauauacacauguccuuuauagugccuacaugguaggccuuuuuuuuuuccuuuuccugugcucacucagucacaaauuagaaauuccuuuuauaucaucuacauaucauucugaauuuuguaacuucaccccucugugguaggcaaauaagaaauauauuuuuaaacaagcagcaauugagcaacagagaugaaaagugauuugcuuaaaaucacagaacaacccaaucucagaauuagacuagaacccaggauuagcagucccauuauagaacucauucaacuccaucacugaauuugaaauauauauguauguaucucaauauaugugucauacacauaugugguauauguauguguguauauauacauacacauauauaauggaauaguuuugaggaaaaaaaaacacacauaaaaccugaaaguuuuucauguuauauucuuaauauaaacugucaugugugaucaaguguaaaaaauuuucacuuaugauuuuaugccaaauaguuaaaauguuuuuuagcauuuuuggauuuugaaacuuuuaauuuuggauaaaggaugcccaaucuauuucuucauuaaaaauuauguaguucuugaguucacaaguguaaaaagcauaauuguaucucauucuuacuuauggguucugguucuguucugacuccucugccuugcgcgagaacugaagauaacauuugucuggaaaacacuacuuuuuuuuuugguacauggugcuuauaacaacucacuauuugaaaaacaauaucuuacuaguuugaaauaggagagauuugucauuucuauagccaggugauauauuucugcuauuguguccuaaaucuuugcuggucuaaucauuaaccuuuagagaaaaggaaaaggaggguggugaugagcuugcaucccuggauucuaauuguucugcucuuuuucuaggucucuuucacucuuagcaaccuugccauugcuuguugcuggacuuuccugcucuucuuuuacucaacaaaaguagcaagagccugggaugugggucccacaauaaccagcguucaaaaauggggucuucagagccccauucuaagagagaacuaagucuccagugacugaccuugaacacuuuuuguuuuauuauucuagucuggggauccagauuccauagccaugggacugcugggccuguucuuucucuuuaauuaauuauagaaguggggggaguaacaaugaaugagguggaguuugccugccuguauauguuucaugccuauauuuuugagaaguagaccuaaaaaauggaguauacaguauaaauauuggcaucugccuaccauauugaagagaaugaaauacuuucccuuuuagcuauuuucuuugaccccccccuacgucuacacacacauaaacauguacauggagugaagggauauugaggaagguaucauggggaggccugaagccuggauuuuauaacucauauccuagacuucuguaaaaaugauaguugucaagccaguauauuucuuagacucuucauucuuagagacaggcuaucaguacucucugguggggauucaaaucagugucuucuagauuuuucuaaauuguuguuucuugaaugucuuugcauuuuucuuacuccaauauucuuaccuuuucccccuuccagucaaguccugacugugauguuucugaggugcagaaguaguacccuguggagcuacagggaccauuuggugcuuucuuggcuuagagaauagucagucuauuucucuuaagccugaaucuucaguuuuacaugcgucuaagcaugaauugaaacauuuuucuucuucuuuuuuuuuuuccagaauaugucagacaugacccucaggacuuagauguggcuaucauguguuggcuuuaaguauccugguauguucaaaaugagccacuaggauugaugcccauuucguuauagugguucaaguuuugacagggcgaaguggucaacugaguaaagcaacugaaccuuuuuugcuuagguguaauauauaauauccuggaggcuagugugacuuagguuauuaaaaacaaauucaagaugcacacaauuauucugggucaaagagguaaagauggacuaaagcugugggugcuguacuuuauauuauucacauuauaguuguucucucugugacucacuauauaaacuuugauauaggcagugcagggguugcucagugaaauaggggggcauacaaaaguuagaaugcuuucuucagucauuucccuucauuugacacuuaacuaaggacauggcugcauacaaguauuccuccaauaucaagguggcagaagcaggaguaaugaaauuuggaagcaagcuuaccuuacauuguaagacucuuucucaaaaacacaagguacaggaauuuagauaguguuggaauacuugcauuuggcaugaacaaggucuuauuuuugauccuag

SEQ ID NO: 12598 - RNA, 1546 nt, Mus musculus
agccuuuuaaaucugcuuuauuagguucacaauauauacugagcaucuucccaugcaauagauaaauucugcuaacaaaaaaagaaauguaagacugagucgaaaacacaaguuucaauuagaagcuggcagaaguuggagccccauggggaaacaagugacaccagaaauauuacaacaguacaucacaaacauguaaguuuugaaagcagggguccccaugucaucuucagagaaaagcucaggacucagggcauaaggcaaaacucaucaugguggucaugaugaggcgggucagugcuaaccgcccgcaggcuguggcucagcugccuuucccucagcuucuccaugagcugucucacaucauccccaaaccucuguacguucuccucucucauccuucccuggggcuccccaacccuaugcaucaggucccaucuguagugcacgaugggcugccgaacccggaaccgccugcgaccuccucuaggcacguaguagucuccagcuucgaaaggcagggccacaaucggaucccuuuugcuagcauccuguggcuuuucuuccuuuuccuccuuuuccugauggucauucuccauguugagauuuuucacgccuuguuccacuuuggacuccauuucuccuagaagacaagagaaauguucaaagauucagcaccgaggacagaggcccauuugccaccauucacaaucuuggauguccauauguuuguuuuucaaauuuuauuuuuucuaccugaaaggcucaacacgcccucuagggggcccccagucccagacccucccuccccacaacccaccauuuucccugcagaucuguuuccaaagcuuuugcaggcaucaaaauggaggauggaacugugggaauggugggugguggaaggggagcugggagguagaaugaggggugugggauaguaggugggaagggauggaugagggggauaugaggggacuaacgcccauccauccccguucagucuccccaccccacccccaccgccacugaaccaaccugggccuaucccuugcggcguaguccuccugucaauucccgcugccgccuggacucucgguuuccagucaaucugcagacagggugggaugggaaggacugggcgccgagcucagcaccgcacccgccuuccucggacccaccgcccaucccccuacagggccgcccacgaucucuagcagccccguccccauccccguccccauccccguccccguccccauccccguccccguccccguccccgcucuccggggcucgcucuagcgcucuccgcugcgggcccgcccagccgccccucucccgggacccccgcgccguccccgccccugagcccgggcgucccuucccgggcgcagccgggguuccccgcgcggugcacaaagccgcggugcgcgcccgcccgucgcgaggcugucgcccgcagggccgcggcgugcaggccccuuaccugucccgcucgccucgggcccgcugccagcccgccgcgcgcagaggagcuccgagcugc

SEQ ID NO: 12599 - RNA, 10558 nt, Mus musculus
acucaaucaacauccguuuauugaucaccuugugugugcccagcacuguuacagucuuggguauacauauggacaggucuaagauauagcaauugcccuccaaguacuuacagugaacuuuugagaucacacagacagacagacggauagagucacacacaaaugcacauacaagaacuauaaacuaucaaucaaaauuaugaaugaugaggauuaggcaauuuauauauugggaguuggaggagggaaaggaaagaacaggaaggaguggucagagaaggcucaaugagcaaguucuccaagcauggggaugacuuaguuaaaaggaaauggcuuccaggucagcauaucagcuugaacacaaguaauaugguggaaauaggaaaggcauguuaagggaaaccucacauaugggccucucuugccggugcugaaguuuugaugaggugcgcuggggaucuucugaagcuggugauauuaagcugguggugguggggaaaugucucugguuuaugacccccaucuaccacagaagaaauggagcauuuuaagaccguggaaauaaaacuguuggacagggaaccagucuccguucucccaccucaagcacaaucccaggcagaaguucaccaauugcucaggucaugaacacaacaccuuggucacagauguuccacacuggagacuuugcauaccugugagaguaucuucugaugggcgaugacucaagugugaaaagugacaaaggaccucucuggugcuguggucuuucagaggcucuguagugcugagacauagacccugauggguuggucuuccaucaagucuaaaguaucugguagggcugccucucugaaacaguaggagcacacauaacagcuaccacacaucucuguccgguucuuugauacccaagcccuuauucuuucucggucagggcuaaaggguaguauuuuuuuuaagccuucugcaacucgcaugucaaagggcaguucuagaaaaacugguuuauuguccuuaaggaaacccuugucuagggcuccaagucuugugguuuagcaggaagcugggucagacaccccagugggaggcagagcuuucagugguccguguucaccuuggcuucugggcaauuccucuguggagucagagggcagcagccaugugcuuucccuuggcuucuugugcuuuccuuagcagugcuuccaucccugacccacaaauguacgggaauuauaggagauggccugagaagggauucugucggguuuugcuguuuguuuuguuucuuuagaucccagguugccucccauccugcacccagcuguauucugcuggaugccaugagauagcuuuccuucaguucauucacaaugcagucuggacauacugcauucauagcaaaacuggaagagaagcuucagggcccauuacugacuaauccauuucuuuggcuggagauuugagaagggagcuagaaauguccucacagaagccaccacucuuucuucucucugucccuuaguaauugaguuaagagccaaccucagccagagggagagggucuuuugaucacaggugauuagucaacaggauaugauugguuuggggacagaucuccaaguaaaccaaagggcagaagagagccucugggcauagccuaaaguggcagagaugggauuugggcuuuuggguugagcauucaaagcacaggagguacuuuagugaggucaggugagggaaauagaaaagcuagcuuggcaagcguccuuggcaaugccaucuacaugcugacaccccucuucucaucucugccuucacuccauccaauggccaaagucauucuacccucagcagcaccuuacacaugauucaguggcaauguccuuugcuugugacccugggggcauuguccacugcuuuuuuuuauauauauagucccagccacuaccccacccuacccccagcucuggccccugguucuucacacauacccagucaggcuguaugaguugaacucacucuuggcuuugggcuguugagcagaucuuggagagcuccuaguggcaagaggcugggccugguagccaucauaguaguugguacgauugcccuggggcgagcaggaaaagcaaaggaugacuccggcuaccaaagaaaacagggcugagaugaugcccaaguacagagccucuccaaucucaaauuucaugcugucaggaaccagcggcgaguagaagucccgaaggaugccaugaagauuccaagcaacugggauaaagcccaggaugccaccaaggaugaaaaagacuccacccacuacagccacucuguccuuagcucgagaauccuggcagaacacggugcaucucaugcccaccacagagauaauacaagccagcgaggacauugcacuggacgucaccaucauggccugggcagccuggaugucagcaggaaguccuaaaaggguacuguagauaucgcacugggugaugccugugcugugugucgcacacuccauccagaggcccuuggaaaagccaaccgccgucacaaugcuggcaccaacauaggaacucguucgccaguugggaagcagcauggcaauggaugugccuaacagccccaaaaggccuaggauguagcccaccaguuggacgccaagggaggccauggcagaccucucaguagaaguaucuucggagccuguuugcuugucguuuggcugcugcucuugcuucuuggauccgagccucuaaucccuuauuucacagugucucuggcaagcugacuucuuuccuccuuacaaguaucuguggguggccacaagcaggcucaagaaggcaucuagaaaaccuuaaaaaaaaauccauaaaccagauuaaauauugaccagaagcuuaugagaaaccagaaaacgcuggaugccuuuugaccuuuguuaucuuuaaaaauaacacaugagaaagaaaaaaaaauacuuuggaaguagagccaaaaugucaucaccuccugcguaggcacauguuuuaggcuggcagucagacaaaggcaggggccagacagguggcugcuuuccgagaaggcagucauggcaauaagaguuguggugugcuaaccccacugcuagucuccaaggccugcuauuuaacauauugccaagcaaccacaccacgggggccccucaguugcagacugaggccaaacuccaggagacuggaucauguggaacaaggcuuagaguguggccuuggacuccaguuuguuagaggcugccugaaucuccaaaggggacuaaagaguaguggcuuagcccucaaucaauucaugcuucuggcaauaauguacuucccaggcagauuggaguggggagcaaagcuuucugcccauacucggaaagagaaggucuuucuagccuuggccagaucccuuccugcaagguagcauaaggacccuuaaaaguauaacauaccagauaucuccugucuccucuccuaacagaaucccaugacacaugaagacuuuagggaaaaguuguccagaguccuacaaguccucaaggcuugucagagaugguagaaagggugugugugugugugugggagcugcugcagaauuagagggcuuuguaagagguaggcaggcaucuggugagagaugggauuuugcacuguucagggauuuuucacccuuuucuaaggcucaagacacaaaggucaaaguuagacaccucccccaccuucugcaaguccauucaacccacuaauuuuuaacccaauucaacauugcuacuccauuuucacuucccucaaaauaucuuuuggcagcuagagagagagagagagagagagagagagagagcugcucagugguucagaacacuugucucucuuccagagggccgagguucauuuccuagcaucuacauggggacucacagcugucaguaauuucaguucaagagggaauccgauucccucuucuggccucugaggacaccuggcacauacaggcaaaacgcucauacucauaaaauaaauguuuuaaaauuucccauuccuauugcucaagaguccauucuucucugaacaggcauguguacccuguuaccuaauguuuucuauccaaaucugaauuuucaguaggaagccucuuaaaagccaacacagucaaagggaccauuaaaaaaaagagcucugugaggaggggguuaggauuuagcauggguuagacaugggaaaugucauaguaaccuaaaguuugacauauucaagagaauacagcaccucuaccucugugucuuuugaucaguucuugccuaggucucauguugucagcaaaugagaacccuuaccauccagaccaacaucccugggguaauccuugacacccugugccuauuucuccagggcaucuucuaacuaagaaguccuacuaguacuaucucuugaacuuacuugaaaugucuuauuuguguuucucauuuccaccacuacuuucuaauucaggguuucaucaucccucuuuccuugucuggagacauaauaguuuauuaacugcucuuacuugcagucuugccucuuccaauucagucuccauaguguugccaugacaaucuuucaacacauuaaucugauuaaguuguuauuugaacgugugucuacaugugggcguguggacacacacacacaaauguucaacaguguguggggggagugcuuggugcaugagccuguggagaccagacuuuggguaucuuccuugacuuuucuccauuuuacauuuugaaguuuuugauguguuuuauuuuaucaugcaucugugccucucucugugugugugugugugugugcuuguguguguguguggugugugcgugugcauauagaggucagagagcaauguguaggugaguugguccucuccuuccaccaugugaguucuggugaucaaguguagguggguagacuuggcagcaagggacuuuauucacugagcuacguuguuucccucugccuuuguauuuugaaauggucucucccugaaccuggaacuuguuguuuuggcuagcaagugaagcccugugaucugccaccuucucucccacccugagugcacauaccuccacacccacauuucucuucuuuuacauucuucuugcagcucugaacuccgaucaucaugcuuucacagcaaguugcuccucuaggacauuccaauggcgaaggauaaaguccaagccuguuugcacucugggaccucucaagguucaccuauugccauucaccugcucacacuccacacucugccuucacuaaauuacucucagcucuuuaaucaugucaugugguguuuaacuugugguacagucugagcacaggccguaccguaagaaaugucuugacuuccuuggagaucucucauucuagacaugguccagugccccuauuaguuuuuucuaaagauuuauuuauuuuuauuucuaugucuggaaaugccuggccuguggagaugucuguaugcccauaugugcagggccccuggguaccaaaaagaggguaucggauucucucugugcuuguguucccuaugugguucccucccauagugguugugagccacuauguugauguggagauuugaaccugggcccuugggaagagcacccagugcuguuaaaaacacagagcaauugcuucaggauacucuucuauauucuuauaguaccuuauauucauuuacuucuguuauuaucauaaggacaacgauaauacacacuaauguuuucuucucuuuuguuguuuucucuuucauuuuguuuagagacagauuucacucaguagaccagaccuggcuggaacccgcuguguagcccaaacuagccucaaacaugaucaucuugccucggcuaccauagugcuaagaaugcaggcaugcaccacuauaccagacuauagagaguuucuuauguaauucuuacaagcacuuuauauguguuaaugcauguaauuagcaauuauuucaugacagacuaauagucuguaccauauauuaaugagaaaaauaaggucgugacauacuuuguuauauuguaauuuccuauuuaaacucauaguugcucugcugguauaugggcuacaucaaggcaacauugguaucuuauuuauguuuauaucucauguaccuuacacaguacucuacccucaaaaaacuguucaaacaaucuuuuguuuaaaaaaaaacuggagacagggucuuucuuucuaugcaauucugggcugaucugguacuugcaauguaaucuagguugcccuugaauuccugcuucguucucccaaaugcugagauuacaagcauacaucaacucacccagcgucaaauacaucuucuuaaugagauaauaaaagcaguuaacaggguuugaagggccccaugagacuauaaggagucaguaaacuuugcagaguaaggguuaccaaaaugcuacccaugcacugaaagaaggcuaucagaagagggacuaaguagaggaggacaagauggagaacuacacaguugcucccuccauccuuccuuccuucccucacuaccccccucuccauuuguugaauaucuugccuauucaguugaaggugaaaaacacgcuaaauuuguguuaggcuuccacagcauaagacccgguugauagcacugcucaucggcacugcuaugacaugguaugcaaagcaauguagcacaguugccagggcauauuuagcaaacucugcaaucaucagcugugacaaggggcaaguccuuuucuggcaccguuuuccuucugcuagucuagucacaucugugcauagccaggucucaaauguacaucucagcaagaccuucaggguuucuccucuguggucagcauccuucugucaaauccuucucguguugcccacaccuuuuuuaagcuccccuccccaauguguccuuguuaggcagcuauuauuguccagccugacccuucuguuuuucagucaaccuccuuaacccauuuaguaucaguaucacuacuugaccucuguacacgcugcucugguugcugcaggccugcaucugcuggccacugagaacgcucuccccaagguuaaucauuuucuuauucuaacauccaagauucauauagcugccacuugaccuugccucucccuucagaaaacugacuucgcugcuauuuucucuagcgccucugccaauguugccauuccucuuucuuuuuagagaccgccuuuuaaaauguagaagggcuagagauggcuggcuuacuccucacuauguagcccaagauggcuucaaacucccagcaaucuucuugcuuuagcuugacaauggcugugaaagccauaccucucucaugucagauccacaccaaaagaggucucucuuuuacucaacguuuggauagucgacugcauucucaaugaccacccaugaauguauuaaggcauuaacggcaccucaaacucaacacuuacaaagcggaagucuuuuguccucuuuuuuuuccccauccucaaacuauucuucauacaguauaugcuaucucaguaguagaaccaggcauucuguaacccaagccaguaugccuugauucuucagccuuucuguuuucuauauauuuucuucuuuuugagauagggucuugcuauauagcccaggcugaccuugaaccugugccaacccuuccacuucagccucugaaugcugggaguauaaggaugagccacugcagcuggcuuccucacauguucuugauuuauaaucauagugcuguuuugccagauauauuuucaaaauaaaacacaaauuuaucuuucucucuaucuccaccguccaacccuuuuuagacaauacagucaacaucacuuguccauuggaacucagauuggccucuguaacuucacuucaguccugucccugagaccaaucaucaagauagucaugagggaucuuucgaaaguacaaauccagucauagcagucaugcuacacuuugccaugcuuaaaagacuuuaggaauguuugauggcuuuacuaugaggcucagucuccuaggaaaccagggaaagcucucuauuaucugaccucauacuucugaguuucaucucuagcccuuaacuucccguuucaugacccccaacacaugugcauaccaacuuagcuguaucagaguaggugcaguuuccuucaucugccuugccagccaccauuuuaccuggagacuuguuggucauucuuuaguguuauaaucaucuauuuuugagaacuguucuuggacccugcuccacaccuugccuggggugaguuaaauacacucagaaaaguacucccuugaagagcgcucccuugaagguuuuguuagcaaagagccccuggcucgcagagaagcagcucgggccucugcuuucuugggaugguaacagacagaagcuugagcugggcaugcuggcacacaaaccuggaaucccaguacucaggagguagacacagaagugugcugaguuagacaccagcuuggggcuacacugcgaaguuccagggaguauuggauagcaaaacucuguuucaaaaaaaaagcaaacagaaacaaaacaguaauccucaguuucccccaagggaaucaaagguucuccaggaggaaauccuaugcagagaggcaggccuuacuugguagucaugagagaaaaguaucuguaguugagugaagaaacuacccuuacugaaggcuggaaucuucagaaaguggguugccauagcucagcaggaggaagggacacuauccggguuuauucaaauggaagaaguggcucccugccacuuaauuuucccuuagggucaggaagauaagguugacaugcuggccagugacuggcuggugaggugagccagccaggagugauucaucuuuggugagcaguagcagacacugaagcuuaaggguccuggcggggcgucaaacgcucuaguuucuugucucaguugugccuagaaccuggggaagaaauccccucggucccucaucccuggcuuagcucaucgacaagguucucucaccuggaagcagguaguggcaacaggugaccauuuuaaccaacacaagacuauggagcugcuauuugaaguagagagggcuuuaaaagaaaccuuucuuucagggcuucuccuaaaagccacaugcagagacuuugggggauacagagacucuaggccuugcuugcugaaauuugucuccugggagugaagccauggcuaaaagcuggccaagaaaguuucccucaggaccccuaccuaaucuuccuuagaggcgggauuggaacugcgggagaagauuaagaggaaaggcugacagcagcucccuacuuaacuccuucucaccagggaaguuggucugauagucuccccaucuauguugccuggugucaucucuuacaaucauggaugccaccggaccauuaagagucuccggcucaaggaaggacaugauauagcuuucuguuaugaauggaagccauuaaagccuguuugcuggcggccauccucauuucucagucccuugcuuuuagaguccucccccccccccccaccaccaccgcagaggaauccgagauaguggcucccuaucccgguaagcuacucccacaagccagggucucgaguagguggcaaagccaucucuuugcaaucuaccuuucuguaccaguugauugaggacagcuaagggacuugcaccuagagugauagauuucauaauugucuuuaaaaggaagcuuauuuuugucauggccaccaaaguaaaaucaagcauuacuuuaaagcacugaaaaacacagaaaggaaagguuugggggacgaggaggaagaacgacugucucccuaucucuaagugccacgaauguuucgguuccgacucaauauuuaagaacgcuugaaaagaagagugucuaaggcaggacauuuacggagagcgauugagggguucaaaaggagagucacagaggaacccaccuucgacugcccccuuaacucucaugcccaggagaguaugggagcuuccugaccugcuuagcccccugugguccagcaaaaagggaaaagcucuagcuccugguuccuucguuucagaucuucuggcccguaagacugcaaaucgugucacaacuugaagaaaacacguagcgccaugugcccacuuccaaaaccuucccucaacgguccaagguagcccacccugacuccaucaugggcuccagaaacagcagcuagguuuaaaaaccacccgccuaagugagccugaaggguagcaacugcaucaggauacucacgaccagauacucacggagccguccuuucgaagagcucuggaagagacgcuucuggggacaaggacuagguccagagaaaggcgaacgggguccaaggggucacaagcuguggugauaagggauuucuaauuauuagccacagcuuuguaaacuccaccuguaacucugagccuucuuacagaugggaaugaaacccuu

SEQ ID NO: 12600 - RNA, 132138 nt, Mus musculus
cgauaguuccuacggcgcaugcgggagccggcggcggcaugcuggcuccgccccguagugcuccgugagguugugcgucauuugcuuuucgcuucgcguggggugagagcggagcgguggcgauuugggguuugguggcaagcgaggguugggacgggcugggcucaguuuuuccugguccgguggagguucuccugggaucacgcgaaggcggcggccgagguuggcuacugagugcaggagcugcggaggcgcgagcagcgucuucuggugcugccguucuuagccggugaguucucgcgggagcaggguuacguccucguggggauucgccggcgguggcggagauaccuugggggugggggggcagugacuagggucgggccgccuguuaagauggcggcggcggcggcugccugucuugcucuuacacgguaccaagggguuagcuauccgcguuugugacgcuucucagguaccagacguuaaggagaugacgaauggcgaaacgucguggugccgguaaauccuuccugagcugaagaccauccuguuucuuaccgguuaaagcgacaccauuucccccggccucugccucgugugggccugccuuugccccaccaaucgcucuucgccucuguuuucgucgucgcagugggcggguugggaagugcgggagggaguccauaguucauuggguagugggcuggggauuagauuaaaaagugggagagagggacgcaccuaagauuguucucauaauuauugcgcgcuugcugcuucucagcccuugcagcgacccauaugaaaccccuaguuuuucuugauccgaggugggcucugcuucccugcucccgcggcuuucgggcuaagguuugagaggucaaucuguagagucauuagaguaccuucccuuucccaaauucugucucccugucaaaucgcucagcuacgugaauaucgggaugcauuauuaaggggagaaguuaaaaaaaauccuaucacuccuccucuguaguccuaauuuagagccuagccugaaucaucuacccugucccauguccuuccguggugcuuuuggcgcagauguuaaaagagcuuaucuuauucccugcauuuacuccaucuuuguggauggaucagcaguaaccuuccauuuuccuagguccucuugcuuguuuaucccugacgcggggacagcguacugauuucuucaacuuugaauguuuugagaccauacuugggcagaacaauaaacgggucaguggucggauaauugcagucuuaguggucuccuucgugcccccacuaggugaaacuuugccuuuccaaccccuuccacgcuacaagcucugggacccgcccccuuucccgccuauguuucuguagucugcuggucuguauaucuuuuuguuuuguuacagcuaaccaacauuuaagaacuaagucucacuucuuaauccuuauauuucucucuuaacugcucuuccucccacccccaggagcugaauccccuagcaaggugucgacccccaguaccuuuuccuuccuccaggaguuuuaccccuaaaacagucacgcuccuuuuaaauuuaaauuuacuuccuuucuccucaaaucacuucuauuauagacaauuaauucccuaucacguguuuccuuuguagauaacaugauuugaauuacuuuuuauuuagcaccaguguugcauagauugaggagaugcugccaacauuuccaauucauaggaagcagccugauuuagaaaguuaguguuugcuuccaguucacauugaacucaugaccuugggcaaauuacuuuucagauuuuguuuguuuauauaaugaggguaguaaugcuuaccuuguagaaaauuugccucagaaaguuugggugccuuuuuaaugugaaacuguauugguagauaaauguuuuugugccauauucuaccuuuauagccugguaagguuuuuaaaaauuguuauuucuucagcuguauuuuucuauguuuaggaauaauaccuauucgcuccugucugcuuuuaauuuuuuccucauaagccacuuuguaugaucagugguucauguuugaauauguucucacuauuugaagcuucuacugguguaagacuuuugaaugcaaaaucauucucuuggaaugaccaccagcuauguuucggucaugaaccacacccaaguguucuaccuuuuggaagggagugccucaucccuugccuacucauuuuugccacuccuucaaauacagucuguccuguccuucaccucacaaaagucuugaaauuucaugccauugccaguuugcaguguuaaagagaacuuaagcuucaaguguuuuuauuucuuucucuuuaccucauuuauuucucuuuaccucuaucauuuuuagacaaacuuugucuaaguugggucaguauggggggcauauuuggcagucuuuuuauuuaaguaggauaauaccuauaugcaagacauuaggaagguugaucuaauuaaauaccaucauuucccccucaaaggcaaccacagaugacucuuugauaacuaccuccuguugugcuuuugccauuuuauauuuucuaacauuuuacucggaaguaguuuuucuuacuacuauauuuuuauuagaucaacacuagagugguuuuuuuccuuaauuauguugguugggugaugggguucaaguaggaauauaguugcaagaaguauacuaucauugacauuuuaguggguaacaucugauaauuaacuauuuguggauuuccguuuugagcuucaggguuugaguuggaagugcuuuaggaaaaugaauuuccucuuucauugaaagacaggucacuuuauuuugagacucuugucuugauuccuuuuacaguggguuaagcaauaaucacuaacucuuguccuuuagaauuauacuaaaucugggaaugaugaucaaggcaugaccuaaaagguuuaauuuauucuagguagaucucugagaagagaggaaggaguggcaguaccaaauaaaaacuuugucuaagguucagugacaaaguucaaccugaauuuccaggauguuuaucguuugucucccaguauggccaaaaagcacuuaugaaggugaaaaauaauuuuaauguguacagcuuuuucuuuucauaaaauauguuuuccuuagugucaguuuguuaaacaugcuaucauuuuguuugaguugaaaacaguuuucagggguauugucuaagugucacuagaaacacuauacaguucuuuuucagaguguuuaguuacugcucaaagcagguucuaaaaaugcaaguuggcauuuaagggcuauugcuucaaaaauaacugauugugucuauugauacagugguuaacuacccaauucuaaugaauaauauacuucuuuuccacaaucuuuuuuuguagguccuucaguagccugaccugaguguuagugcuucagaggaacaaaccaguagaccagaacuuggucaggaaguuucaggaagcuauuggagcaguguugggauuucccaccaggaugacuaugauuggcugugauuuuagguuaguuuuuuuuuuguuuuuguuuuuuuuaagaucuuugcgguugguauuuguauuuuacaucuugaaauggagauggggcuggaauuuacauuuuuugcuugugcugcuuugguuccauuauaugggucagguuuguuuuauuuuuuuuuuuaaauaauuuuauuggauggagcucauuagacaauuaaaaggaauuguuuuaaauguauauugucagugcaugauuuucacaaaauuugaaacauaacugaguaguauguugucuacucccccagguauuuuuaacauuuaucaacuuuagccuuuuuaguuuuacccuauggcaccccccuuucccauagaauuauuuugaaauaaaccucucuugauguguuauuuuuauccauaccaaaaauuguauagauauugagagaguucuugacaguauaacccagaauucauuuucaguugaagaaauugaaaauuuaaagguagaaaaugggcucauuuuaaaauuuccgugauauuuuaaguuugacucaugauccagagaaaaguccauuuaugaaauaguuuauguagacuuuaagucuguuuuauucuucagguuauauuucucuuguuuuuuuuucuccaauuuauuuguuaaguccuuuuugcauuuccucacauuugaaaauuacagucuauagugaugucuagcucauucuuguuaaagaccauagguaaucuauuauaaugaaacaauaaugguaguaaucucuuaugugaucucuuaggugauacugcuggcuuaguugguauacuaaaauagcuagucauggguuccuuuuucuguggcccucugauuugauaccugauuuuaguuuuccauaugaaauauaggccuucuggaagaaaaaguuuuuuuuaauguguauuuguaauauccuuagguuguuuuguuguuuuuaugcucuguuauccuagauucucugauucagagcuuagauauuaagaacugguugaugaauuauuuugcuugugcaguguuagccauucugggucuguacuauggucaaaaccagaaaaugagaguugaacacauauccuucagccuccagccagccuuuagcucauacacaaauguggacagagcaacgguuuuuguuccuaucuuuaaaauaguaagaacugcaaguuaaaggaacagaaaguagaaaagucaugaaugaaaaauuuugaauuauuuagauaaauacgauuaugaaucacuggucagguguucagguauuucagcuguguucaucauuggagaaaauacgauuaugaaucacuggucagguguucagguauuucagcuguguucaucauuggagaaauaagucccuguuugaaaauugauuaaauauuaaaggaauuuuggggagauuccagcaagcucaugcuuucaacagggaaaaaaaaaacgagcauguuagauauagugauuaaauauuaacacuuaaguucuuauaguuuaagcaaaaccacuuagacccaaauccuauuuuaugaaacuaggaugacugguacagaauugugcacaguagacauuccaauauuugaaucacccccuucuuaacacuggaaguucacaauggaaacaguguuggcuuuuuaauucuccuuuuguuguguguuuuuagccaccaguucaaaguaucauugaaaugccaacuugguugcuuugaaaauauuugcccuucacauuccacauugccucucauggaauaagauuaaguuucuaagucuguuguguagcugugaccauguuggacugcuuugcaguggaucacacggccagacaggucacaggugcuuguacucuuaggauuuucuuguauuuuuuuuuugaccccuucaaugacugguuaccaaauguuuauauauguuaaugucagggauaauucagcucuuaagauucucuggaagcuucuuaguugaugugucauagagguugagucgguaaaacuugauguacuuguugaccaucuugguuuucugguuauagaaaugcuuuuaaugaaggaguggcacucugaggaaaacaaguuugagguguuaaccuaauaguuuccaacuuugaguuucuuaaaaaaguaguucaacgguugucuuuuaaaaaucauaauggugacauggaaagugauuuuacagaauguuggaauuugugcuuuuaugaaguacuauaaaaugcaaguuguauuauaaaucugauucagcugauugaacuagguauauauucaucuuagagacuuuguucacauaaucuuaagaguugaaagaaagcaguuuuacuuuuuuaauagugauaaguagggcuggacagauggcucaguggcuaggaaaugcccuuccagagauccugaguucaauucccagcaaucacaugguugcucacaaccaucuguaauggguguaucuucugaugugucugaagaaagcaacagaguacucaaaauaaauaaaucuuuuuuuuaaaaagggggcgggguggugguguuggagaugucucagugguuaagaaaacugauugcucuuccagaggucuugaguucaauuccuaucaaccacaugguugcuaucaaccaucuguagugggaucuaugcccucuucuggagugucugaagacaguggcaguuuacucacauacauggaauaaauaaaaucuuuuuuuaaaaaauagugguaaauaaaaggaacuaaaaguaaaaacuagagggagaacuuaaauuuuuuuuguaauuuaaaauuaaaaagauuagggccuagagagauagcuuaccaguuaagacacagguuugguuucuagcacucacauggcagcucacaaccauaugaaauugcagcuccaggggaucucauaccuucuacugaccucuuagugcaccagauacacacauagugcacauauacaugcaugaagucaaauaaaauauucaugcaaauaaauaauuuuuaaaaaccuagaagguugcuaagugcagauggacuacaaugaaucaccuuaagcaacucagguuuuaaguucuuaaaauuaagcauauuguauuugguaggugcuuacauuuuggaacaguuuuuagagaaaguuuuucuaugguuguuauuugcuaaauuuauuuauuugccuauuuuuuaauugaaguauauacuagucuuugcuaguguuuuuccauacacuucucuuuuccucaccccaaguugguuuuauauguuugugcacagauauuggugauuuagcuuuagcuuugaguagcugaaacuacagguauuugccacugcaggaagcucuccuuucacuguuacagcauucuaggaauugaguuuuuauugguggaaagacuucuuucuauacaaugauaaagaguauucccucaguucaaguucugauccaauuucuuuguuuguuuuuguuuuucgagacaggguuucucuguacagcccuggcuguccugggacgcacuuuguagaccaggcuggccucagaaaucuaccugccucugccucccaagugcugggauuaaaggcgugcaccaccgcugcccugcucugauccaauuucuuaucugcugugucaucucguacaaauugaccucuuuaugcuauagugaaguuguuccuuuauaaaguaaugauugaggcccuuugggauugcaaacuuuauaugccccaguacaagggaaugccagggccaagaagcgggaggugggggggacagggggagaggggguggguauagggaacuuucaggauagcauuugaaauguauauaaagaaaauaucuaauuaaaaaaauuaaaaucuggaguguaaaauaaugauuguuaccuaucaucacauaggauuuuggauaaguugaacuaaguacaugaaucauuaauaguaaauaguggcuuuaaaacuuuagggaacaucagaucaccuagaagguuuauuaaaccagauugcuguaucacuaauuuuugauuccauaauuugauggggaauagauuuugcauuuguggguuuccaggugauaguggugcuaucauauaauuguaguuggugcagaauuuuaucuacuucuguuucuggacugauuucucagagagugaaacacuuuacucuuuagucuuauuuacugucaccuucagcuaaaguaaauacauucuuugagaauuuuacauguguauacaaugcauuuuggucauuaacuaaccacccaguuccugucccaguuucauguuuaaaaagugauuauuguucuuaaugugcauaauguggaucauguguaacuuaccaauguccacuuuucccaaagaaaaaugacuuucccucuacaauggccguuggcugccaguggcuccucaaacuaggguguaggucuugcguguccuuccccuauccaugcuagaauuuugauuagcuugaucuuauacagacagguaaucacagcuacugugaguuuacaagugcaauggaaauaucguauccagaagacauuauuuuaaggcauuuuccccuguccucuggcauuaauguucuuucugccucuuccuauuuccugagccuugcagguuuuuuuuuccaauuuccuuuaauaggguucaaaccucuucuagcccaccacccaccagagguaguagaagagaaaaguuauuacaacaugggggaauuggaucucuuuagaaguaguuguuugggggugaguccaaucuuuguugucuggauaccagccguucaguccaguagggaagaccaaauauaaaucagcagcugcggucuagucuacuuggcagucuccauacaggaaccagcaaggggaguucaauccagaagaaagcacaaagcuuggcaacaggaaggucucugcaaaagcaccaagaagcugcaggaaaccuccucgugggaaguucuuugcggggaaggcgguggcugcugcugcugcugcugcugcugcugcugcugcugcugcugcugcugcugcugcugcugcuucuucuucuucuucguuuuuugagacaggguuucucuguauaucccuggcuguccuggcacucacuuuguaaaggcaugcgccaccaccgcccggagaaguucuuuggagagcuucuuuuugguauggaguucaacaauacaauguaaagcagagcaaagcaagccaaugcuugagcuccuacuguuggcuccuauuuauauucuuucugaacaucauguguccuuucaugcauuugcuauagcaauacauccuuuaaucucuguuuucuuuagcaaaacauccuuucaccuguguuccccagcaaaccauaacugacuuuccaaagaagccagaaguuuccacuucaugguuaauauagauuucccauuuuaggccugagcacuuagucacuuagucuuccugcauuaacuagucacugcaaaaaagaaguuucucuaagauugagagcaguuuauuuaguauugccuucagcuaaaagcaguuuugaaauccuuacuuucuugcacaauggcaacuggguccagaggugugauaaauucagguucguucccuuugguaaacauaggguauauguucauucaugacaucguguuuuaaugaugugaaucuuuuuaauucauuaaaucauugaggacagugaauugauguuucaauaacaacauuuugcuuuuuccuaauauuuuauuuccccuuauuucuuauuugguuacucaaauacauaguugauguagaacagacagaaugaacacucaguuuuuguacccuaaaaauaaaaugguaugugcauguguuuuguaugugugugcauguguaagcuagccauagacuagcauuagguaucaucauuccuuugcuguccacccacauuuacuuauuguaaguuuugaaauaggaucuucuaugccuucucaaugcugagauuauaugaacacccaguugguuugguuuuguuuuaaauguggguucugaaacuuggguccuuguacuugcaaguaagcauauuacugauuaucuucuuaguuccuucucuuuuuaggucuggccuggaauucacuauguagcccagcuuggcuuuaagcucacaguuuuauccuccugcuuuuguuuucugagugcugggauuaagguaugaucuacacucagcuuuuuucuuucuaaacauagcuuuauuuuaaaaaaaugccuaaugccuuuaugcaguguacaugugcuuuaguguaugcaauguacaugugcccauggaggccagaaaaggguauuggauccuuuggagcuguaguuacagaccacugugguucuuguaaccaaacuccaguucuugaagagcagguugcucucuuaauaauugagcugucucuagccucuaaauacagccuuugauaugauguuuugguucccugcuagauucagaagguuauguaaauguguauaccuagguacucauggauauaaacauucugaggcuaauguuuuaaauucaaaguguccauucuucuaacuaggaaaauucuauaauauaaaguugcguuuugauuuuucuugguauaaacccuaguagucuuggguaguuuccuuacuauuaguaugucagguuauuuuaggauuauuauagauuucuucccuagagcuggaaucaacuaaugugauaagacaaaaugugagauugaaggaaauuuucucuuugccaugguaagagcuuuguacccagucucuauuuuccuuuuccacuucaccuucccagguuguuucauuauugguccuacauuuuuuuccuuuaguaaaaaaauuuuugcuagaauuuaaggggaaagguuuguaaaaucuugauaaaaguagaaggcauagagugcaggcaguucuagauuugggacuuuccaaauuacaguuuggcucagucaacuucuuguuucgucuuuggaaauaccuucauuuguuauuggaaucaguuuugugguuuuaauguacugcauuguuugccaugaucuuccccuuuuacaugguucuuuacuguuaauugucuuucuauucaauguucugccacaaccuuauuaaucuguggugagaguccuugcaacaguuaccaguuucaucaccauguuagaaaagaguuauucaauauuaacuucuuuaaaaccauuuauuuuauguaguaucuaaauuaccauguaugguucuguaaguggaaacuguucuuguuuuuguuucuugacuauuugguacuggcuggccuugagcaugugauucuccugccucauccuucagaaugcuaagauuccaggugugcauuagcacaccuagcucuguucauuuuuaaguaauuuaagguuuucguuuucauucuuguaucuugccucucuuccuuuaguugaauagacauagguuuucuaauucucgugugcuuccucagccucuaagacuguuauguugagaaacccugcaauugucuucuaugaguacaggguaauaauaacaaguguuugggccaaggugagaguucacagugauacauucaauugcuauuacugugcuaguuuagucuuuggauaaaccuguaucuggucuugaggccuguguccugucuuuuuuagcugccugcuuccaacuuuuucccucuuuccuucugcuggcccuaaaaugcauguacauaauagugagaaacaguaugcaaauuaauauuugaaugggucuaggcuauuuuacuaaauuuauauuacuuauaagaugcuuaucaaaauccuacacuuacauguuuguguauguacagguauauauaaaacuuaaaauguacuuuauagguugcacugagccuuuaauaucaugauauguaauaaaauuauguaauaaaaaauuaauaauauuuuaagguacugcaauuauagaguacucuguaaagaugaggccauuauaguuuauguaauggcuaugucacuuagggcaaauugaguuaguuuccucacccuuuaaaugagggcaauaauauuuaugcaacaccuuuuuucuaaggauguacucauuggugccacauaguggagauacaaaagaugagcaauccggugcugguaagaugguucaacaguuuaaaggcaacuguuagcaaguuugauuucuaucuuaggaauccacauaguggaaggagagaacuaacgucuggcauuuguucucugacauucauauaugcaccguggcauacucacccacauuccuauguagaccauacaaaauguaguuuacaaagauaagcaacagaaauggaacuugccgggagauuuauaaaucacacugaaaugcuaguaugaacagugggaggaaugagcaaaauguuacagcaguuuauagggaagguggagggauggacugagacgagggagggaaaucugcaguugaauguaauauaugagagaaaaauacaaugaauaaaaaaaauuuaaaauaaucccauuacuaugaaaaaaaguaaagacuagcuucaugggcagcauagaucugucuaccuuuagaagacaaauuauagucaugugcugucuaacaauauaguuucugcuugugguuuguuuugagaagauaccuuauguagcccagaaacucccuguauaguugucaggaauguauucuguaguggaaggugacauuaagauuucuguaauugaaacauucauugugcaagacuaguuuauuguugcuggugguagagaucaguaaugaauuacagauacagaaauuuauauugccuauugauggugaaagauuguauuaaugacauuuguagacauuuauuuuaggauguuuccacaauaaugaaguuucccuaauagugcauuucuuauauuucuguuaagggauucauucaccagcagcuuuuaaauaguaaaaucuucuuuauauuccaccagaaaaguuggaacagagaacuuauuauacauaucagacucauuuugugggcccagauuuaaggguaauaacuggcuauaguuauuauauagucauguauaguauauaguauagugguggaguuaggcaccaaguuaggcacaaguuaaacagcccaguacugugccacuaugcuguagguuuccuuuaagcaacuugcuuuuauuucuaaauguguuaccaggugucaucuaugaaaguacagaaguuuccucacugggggaaauuugacaaaaaaaaaaaaaaaaaaaacuuaaguaaaaggcaggacuccaaagaaagccccccaccuauaaacacaccuuugaccuacauuccaguaugaguccaauuuguagccuuuuaaaaacauuucuauucuuugagaauuucauacaguguauuuugaacauuuccacugucauccucuuauggguuagccuaauuuggcagguuuuuaaggguguuuuuguuguugguuuguuuuuagaaggaauuuuuguuuugauagucucauuuuagcccaggcugaccuggcacuauguagcugaggcuagccucaaaccugugccaauccugcugccuuaaagucccuaauguuugaauuucaaauaagagccauuauaguuaacucuuuuaaagacuuuuuaaaauuuauuuuauguauaugaguguacugucacuauccucagacacauccgaagagggcaucagaucccauuacagauguugcugggaauugaacucaggaccucuggaagagcagccagugcccuuaaccacugagccaucucuccagaucccacagcuaacucuugucucuguuuucacacauauguguggacacuguaugucaauaagugggaaugaaugucgauccauaaaacuuaaguguuuucugaacugggaauguaguucauuaguggagcacuucuuuugccccaaguccuggauuuggugugagcacugaaaaagaaaauguuuucaaagcccauuuauuucucaacuuuuaaauugugaagugguauauuugcuauuuagaaaaaaaugcauauaucagaugaacuuuguuuuuacaggcuuuuuugaccauuugcuuuucuuuuguucauuugaccauuuggauauuaaucuuuaucagauaaauagcaggcaaagaguuuucuuccauucuuuuaguguuuuauucuaaguucuguuugcuguguagaaacuuaugauuucccauuugucaauucuuauuacauccagaguuuugguugacuaguaauguacuauaaucauacucaguuguugauuccuaccuaguugacccugaaucagaggguaguaucaacugaaaauuuugguuuugcauuuuuguguauguaaguaaaagcaugcauuuuaaauauguggauguuuugucugcaaguguauuugugacuuguuugugccuggugucuguggagaccagaaaagacauuggauaaucugguucugagcucuaauguagaugcugaaaaugcucuaacagucauccugaguucaguucccagcaaccauaugguggcccacaaccaucuguaaugggaucugaugcccucuucugcugugucugaaaagagcuacaguguagucauauacauaaaauaaauaaauaaaucuuaaaaaaaaaaaaaaaccagauaugguacagacccaaucauucagaacuucugagggaagugucagguaaaugguauguggauugaggguaaaauuuuaccuugagagaggugucauagugaggagguaacauuuaagcucaacuuuuagggauauucaggagucaacuuuucaaaagucuugagugcuagggaaugugaaacuuaacaagaccaaagcaugagaagaauacuauauaaugccauuuugccauuaagagagagagaugcaggucuugggugcugcuuuaguacuuauaguuaguuuuaggaauauugcuuugguaauaaugugaugaugggauuagagaucuggcaggauagagccuuaauuuagcauacuuuuaauauauagagaugguacaaugauaaccuauguaccugccacccagcuacuaacaguuaaaacagcaugcggaugugguuuuauuuauuuauacccuacucccucuuucaguuauuuugaaacagguuucuaagucauucauggauuggcacagcucucacggcugaucuguguagccaaaucuguuuauacagcuuaaaaaaauguaugacagucuccaccccagaaccgaguuugguauuuguguaacuagguauuuucaguuucuaaaaagaguuucaggggaacugagugacuugauuucugccagauuaaaauacuuuccugaacucauugauuuaucuguaaugaaauuugcuuguuagguauggacuggauuuuuucccaauuuuuuuauuagguauuuucuucauuuacauuucaaaugcuaucccgaaaguccucuauacccuccccccugcuccccuacccacccacucccacuuguuuuuuuguagacaaguuucugaaauuuuauaaagaauaguaguuuaaaggacaauuucuuaauuuucuuuuggaaguggacaauggugaagaaagcacuuauaaucuuagaaacuggaugugaugaaucaucuuuuugccaggcauugguggcgcacgccuuuaaucccaacacuugggaggcagaggcaggauuucugaguucgaggccagccuggucuacagagugaguuccaggauagcuagggcuauacagagaaacccugucuggaaaaacaaaacagaaaaaaaagagucuuuuuuuaaagauuuguuuuauuuauaugacuacacuguagguguuuccagacacaccagaagagggcauuagauccuuuacagaugguuguaagccaccaugugguuguugggaauugaaaucaggaccucuggaaagagcagucagugcuccuaaccacugagcuaucucuccaguccgauagguaguuuuguuuguuuguuuguuuguuuguuuuuguagagaaacauacaugcuuuuuuuucccuuuugguuuuuugagacagucuuucucaguuuagcccuggaugucauggaacuugcucuauuggucaaucugaccuccaacccauagagaaccaccuguuccugccuccuaaguggugggauuaaaggcgccuggggggagcauacacauuuuaucuugagauuuuaguauauucagauuuuguaugagacuuccaagcaaugucugcaaaugaguuuccagauuuuggggggggggugaguaaaggcugcuuguuuuguuauuucauuuuacugccaggucauagauuuagcugagcaauccucccaugccauuuuauguagcuaaggauagggauacuggugccuguagugaggggcggugggagugguugguaguuugaauuugcauucuuaucccugccuauagacauuuuuugaccuuaguaaauuggucacagucuucauuucucaagcugucaugaggguuagauauuaaugugugauagguaaagucuuggcuguauauuaauuggaacuuaggucagauagagaaaggcuuaaaaauuaugcuuaguccuccuucaggcaaucagugaugucuauaacucuguaaucaauagugaauaggcugggguuuuguuguguuuuuguuuguuuaguuuggucaggaauucuaaaagugauuuuucuuuuaaauuuuuugagacuaugucuacaaaauuucuuccuuccccuuuguaccuccaaaccuuucagauaccuucccucuucuuuaaauucauacucuuuuccuuuuauuaaaaauucuuuuacuuauuuuauguaugaguacuuuugucuucagacacaccagaagagagggcaucugauccuguuacaaaugguugugagccaccaugugguugcuaggaauugaacucaggaccucugaaagaacaguuggugcucuuaaccacugagccgucucuccagccccauacagucucuuuucauuaauuuuuuuuuguuuguuuguuuuuguuuugguuugguuuuugguuuuucaagacaggguuucucuguagcucuggcuguccuggaacucacuguguagaccaggcuggccuugaacucagaaauccgccuuccucugccucccaagugcugggaucaaaggcgugcgccaccacugcccagccauucauuguauuuuuuuuuuuuauuucaaggugcaucuuauugcuuucugacauggucagugcuguuccuaccuaaauuuucugguuagagaagggcaagaggcaaaaaguauuaaguauauucuuuuaugggaauuugaguuuaguguucuaguuuuguuuguuuaaauguuaccacaguuucaguugaaauuaauuaauuuuguguacuacuuugccugucugucugugucuguuuauggaaccuuucacauaccaauagaaaauucaguacuauaugucaagguuuggacacacaaaacaacuaaucuaaggcauuuguaauacugcuuuaaauuuggcccauguuauuuggcucaggaaccacuaaucuucuguaaugaaaauaauuacaagcgaugaagguuuguuauaagugaauguaugacuuacagaaaaauggaaggauuugaaaaacauaaagcauaaauaaaaguauguauuuuuucuaccaucuagaggcaaguuuuaauuuuucgagacaagguuaauuuaaacagccuuggcuguucuggaacuuucuguugcagauuggccucaaacucacagaacugccugcuucugcccccugaauacugggcuuaaaggcauacauguacgucaccaccaccuaguuagaggcaaauucuaauauuguaaaaauuuuuuuauuccuugauaguuuuauacaaugccauuuuaucauauucuuguacuccuuccugauccacccucaccuuccuccccacucaacuugaaauguuucuuuuaacacucauugagucuaauuuguguuacccagcuacuuuugggaguggggccuauccuggaguguugucaaccucuacccacccaccauaaaagaaaccugacucuccuagcagcuaucaaaugccaauagcaucucaguuaguugguagaguuucaugucuaccuccuacuauucauuuugguauuuugucugauaggagcuugcgcaugucuugugcguacuaucuuaauaacugaaucccugugugcaacuguucuguucgguggguuuuuugauauuguuuuguuuguuuuucaauguacucacccugugguagauauuuucucauuaauugucaagggaaguggaaauuuccuaguaaagauuuaagaguuuagguagaauaugauccuaguauuugugcuauucaaaacucauggaaguacucauuauuaugugaauauaaugagaagcuuaauuguuuuguacccacaacugucacagguacuauggggacucuuucaguuauguuagcuuuuucagugaguuuugcuaugucaugcagacuggccuccaagucaagccaagauccuucugucuuggugcugcauuuucuuucuuuaauucuuuucuuuucuuuuuuuuuuuuuuuuuaaagaucagguuucuuuuuauggccuugaacucacagagauaugccugcaucugcuugcuaagauuaaggucuaugccacuaugccagucuuguccuugugcuucuuaaaauuuaauauagaaaccaucuaaggaucuuaacuaaaauacagauucugguuuuucacuuacaaguggguccagaaauucaucagugcugcuuauccuuggaccaugcugaguagaaaugcuaucuacccaugcacgcaaguucuauugaguccuauuugagaacuacagguguccucggugucauauucucucucugugugugugugugugugugugagagagagagagagaacgagaacguguguacguguguguguacguguguguguguguguguguguguguacguguguguguguguguguuuguguguaugucagaggacaacuuccaggaaucuguuaucuuccacuuaaguaguaggcaauucuuauucugucucucacugaacagaacugcuaggauuauaaaaacaauacugcaccuagcuuuuuguggguucagggauaugaacucaggcuaucagacuucuguaacaagcacuuuuauucacugagccaucucuccagcuccuuacuccauguacuuuagcuguauacacuuguucuggauguaaacgaaauuuaaacuucaaagguaaauuaagguugggagaaugaugaaguggaaaaaauagaugauuaaauaaaaguauuuaaguaguagcauugguggugguuaauaauaauucuucuauuuucuuuuuuuuugguuuugggguuuuuuuguuuguuuguuuguuuguuuguuuuguucuuugguuuuucgagacaggguuucucuguguaccccuggcuguccuggaacuuacuuuguagaccaggcuggcuucgaacucagaaauccgccugccucugccucccaagugcuggauuuaaaggcgugcgccaccacaccccaauucuuccauuuucuuaauaguucuaucuucucaagcaaaauuuaagaagaaccacuugaacaaguuugauacuuauaagcaaaacauuuccagaauuuuguuuuuaaaaacuaucuucuuuuuguugggaauuucuauguaauggaguuuuuauuuguuuggccucuaagauagaauccauuccccaaucacuauucucuuuauuugugacacuguauacuaguuaaaauuuagucucucaagauucgcuaaccaaacaaggugcugauuuuccugugggccuuuuuuuccuggaaauagggacaaauugggcugaaagaauauuuguguaugaaguaauaauacaucaagucucuaacugacauguuucaaaguauauucuuuagaaugcuugaauuguuagauaccaaauaagcacuacuugaaaacacuguugugugccuuccuuaaauaaaguuguuuuuagaaucauuaaguaugucugucagccuggcaggguacuuaaaugcucauaacauuuauuuuaaauacaggauauuguuuggcuuaugaugaacacuaaguaaauauucuccuuccuguuauaauaguagguuugaacugagaacagaacuucagaauuuuaauugauaucucaaggacauacuaucuuucauuucuuuuuuuaacuguuaguauuucuugcacuugagugauagaaaacagacuagcuguucacugguuauagggagcauuuauuuguuuuggcuccucauguguguuggugagcagcauauaucagaugcucauacuuggaauuugggaccugagaugauuuacaggucuuucugcuucgaccagcaucuaaagucugguauuggcagcagaagcaccccaacuaaacugcuuuugugucccucccuuggauaugguuaccuggcuucccuuaaauucuaccauuuuccgaauguagauguaggcuccuuccaguucucugagcuacuagauacucuuucaauaaauugcuuucccgcauuaccuggcuuuuauguuguccuugacacuugaauaauauaguaucuauagucaaaacaguuuuaauuagagccagaugcuuauuucugggaauauuuuaccagugaucucaucuacaguuuuugguaaauaacagcaaaguggucauauauuuauuuuauuuaguggguaagguacuugguacuuuguucuuuggaagauuuuuuuaagugguuaauucacauagaaauugaacaguauuggcauguaucuuuaguuucagcacuugggugguauguggaucugaguuccaggauaguuagggccauguagaaaaacauuugucucaaagaauuuguauguccccacuguaaaugauuccacauuaucagcauuccuuuacuagaauggcauauuuguuacaguuaaugaaucauccaaagauuaucuauaguuuacauuugaauuuacccuuggcauuaggaauuuggggggucuugacuauauuuaaaauagcauguauuuaaccuaucguauggaaugacuucacuguauuaaaaaaucuuauguacucuauuaacuaacuccuggcaaucaguagucucaauauuuucccagaauaccauauaauuagaguagucuguuuuguuugguuuguuuuaaaaucagguugacauuucgauuguucauuuucucuggagauccaucugcuucuguacugagauuaaaggcucuauaucuggccuuucagauugacuucuuuuguucaguaaccagagauuuuuccacaucuauuucuugauagcucauuuaguacuaaauauuccuuugucugauauacaccaaaguuugacaguuacaaugcaaauaauaucuuauauuuuaugaauaugcuuaguucucuaaagccauuuuagccaucuuccaggcaaucuaagggacuucuuauucuacauccuugcuaacauucugaugucaguguucuggguuugguuauuguaauaggcauagugaaaucucagugcugauuaucacagucucuuguuguguagcaucuuuucauuaguuaauuuucuaucuguauauccucucugguaagguauccauuaaaauuuuuauugguuuauuuuuguugacuuucucuauucuuuguguuuuuugguuuuuuuggagacaggguuucucuuguguagcccuggcuguccuggaacucacucuguagaccaggcuggccucgaacucagaaaucugccugucucuaccucccaagugcugggauuaaaggugugcgccaccaacgccuggcuuucuuuguguauuuuuauauuuuuaauaauuguuuucuaugucuuuacucugucuuuugcuacuuuggauuaaaccaagcacuucaucgugagccauguccuaguuaccuugaugccuuuuuuagcaaauauuuucuccaugcuagcuagcuuuuuuuuuauucauuuaaaagagaaugcauuaauauuuuuuucuuggauggauacccuuguuuauaauuugaaacaucgucaccaaaaccuguaucaucuaacucuuuuuggagauguauuauuuuacauuuuguagauaggucuaugauccauuuugaauugccuuuucugaaaaauguggaauuuuauuguuuugucguuuuuaugaugcaugugggugcacagcuauuccaguaccuuuuaaaaaaaaucucucaugcauauauugacuuugauucuuugucagaguugaccaauuuauauggggcuauuuuagggcuucauuuucuguuccauugauuuguucuuccccccacccccauuggcuaguaccgcauuaaugaucuguaguuuuccuccuagaucugaacauauuuaaguauucuuaagcugcuuauauaaaugguauucauuucaaauccaguuguucaugguagcauauguaagaguaauugauacauuaaccuuguauucuggagguuucaggagggaguuuuucuuuguggcuauuggguguauuuuuuggauuuucuacauagaugaaaugauaagacacauuccaaucuaugugucuuuuacuuaccuuuauuuuggaccucccauaaacaaguauuuuaaaaauacuuaaaaauaaauuaauagaaaaaagugagagaucucaaucuuuugaagcacaucaagguuucaaaaaucugccaauccaaaaaccaauaaauggcaaggaauaaagauuagggaagagauuaauggaauaagcugaaagaacaauacacaaaaauccuauccuucaccuugcacauuaaucagcuagaaauugaucaaagacuuuaauccuccaaacucagucagaaacauagggaauacccuucuaggcacuggggguaaauagcaaguuuggaacagaauuuuaagagcagaguaacugaaccaaguaucagcaaacuaaauauguaauuacagaguugcuacacagcaaauaaaauuauaaagaaagcacauugacagcccacagagugggaaaaagucuuuacaagguauacuucagauaaaagguuuauauucagauuuacugagaauuacguaaacacuaagcaaauacaacuugcagucaacaucugaaugaugagauugaguacgcaguuuucagaagaaacacaauuuuguaaguagauuuuuaagcgaugucuuuaccuuauucuauguguacgacuguuugcuuguauguguguaugugcaccaugcacacccagugcccuugaaggccagaagugagccaagucccccggaguuacaacugugagcugccaugugggugcugggaacugaauccagguccucugcaagagcagccaguguucuuaaccucugagccguuucuccaguguugaaacacaauuuuaaaguauucacaucccagccaucaaggaaauacaaauaaaacuacuuugacauaccauuucacucaaugaggauagcuaccuauccagauguuugagggaaaggaaauagggaaagaagaaugaaauaggguacuucauucccaaguaccagaagauagaguaaaaauacacaaaacaauuauccaauuauucauugcugguuagcgugcaaauuaauacaacuaauaugggaaccagugugggagugcuucaaaaaauuaaaaaaacacuaccggaugacccaucguuccacucuugaacauauacucauaacuccauauccuaccguagagauauuuccacucccauguuuauugcugcucuauuuauuauuccaaggaaauggaaucaacuuauauguccaucaugauggauugauggauaaauggauaaugaaaaucugguacauauguaaaauggacuauuuaguacaaaaccauaagauuugcuggaaaugguuggacauugaauguucugucugacugagcuugggggauuaaauuaaggucuuugaucaauuucugacugauuaauguauaaagagaaagauaggaaucuaauuuuauuugauuguuuuuuuuuuuuuuaaauaaaucuuuguuuuuuuuuuuuuaagauuuauuuuauugauuauauguaaguacacuguagcugucuucagacacuucagaagagggagucagaucucauuacggaugguugugagccaccaugugguugcugggauuugaacuccggaccuucggaagagcagucgggugcucuuacccauugagccaucucaccagcccugauuguuuuuuuuaauguauuguucuuucaguuuauuuuauuaaucucuuccccagucuucauuauuccuugccauuuacuggcuuuugaauugcaguuuuuuagaaagccuuaaugugcuuuguuagauuauuuauuugagauuucucacuuuuuauuuuccauucauuuauuaauucauucaccuuacauccugaucauaguccccuguccccauuuccccucucauaguccugccucacacauaccucauuccccuucaccucugagaagggggaggucccccucuggguacuaacccacccuggcaccucaagucacugcaggacuaggugcauccucuucgacugaggccagauaagacaggggaauaggauccccaagcaggcagcaggcaggguuacccacaucaaguguugggggacccuaugaagacuaagcuauacaucugcuaaauaugggggggggacuuagguccagccuuuguaugcuuuuuguuuggugguucagucucugggagcccccaagggcccaaguuaguugacucuguuggucuuccuauggaauuucuaucccuucuggguccuuuagcccuucccacaacucuucuacaagacuccccuaguuucauccaguguuuggcucugggucugcaucuuuuucuguuagcuagguggagccucucagaagacaguuaugauaggcuccugucugcaagcauaacagaguauuaauagugacagggauuguugcuugcccguggcaugagucucaaguugacccagucauuggcuggccauucccugcauuacuuguaggcaggauaaauuuuggguugaaaguuuugugggugguuuagugacucuauugcuccacugagagucuugccuggcuacaggagguggccacuucaggcuccauauuccccacugcucuccuucacuggaucucccuccacccccacaucucucacuuucuaauaugaguacuauaaauuuuccucuuaggacugccuagguugugucucagaagggagguucuaguagguuguucucauuuuguuggugucuaggaauuuuaaauuucccuuugaauuuccuggauagcacacuguuacuucaaaauguaucacuuaguccccaaauauuuuuguaguuucucuuguagaauucuuucugcuuuuauucuuuuaugcucugauaggacacaaggaauuagugugguuucuuuuuauuuuguauuuguugggacuuuuuguucuaugauaccaauuuuggagguuccauguacugcugagaaaaaugcauauucucuguuagguagaauauuuuuaauguaucuguuaaguugauuccaucugaaguuccuuugcccauuuucauuucagaacaccuauagaaaugagugguauauugaaguuucucacuauuauuguacuuggaccuauguguuuuuuaugccuuuugcuguuucuuuuaugaaauucgaggcuccaauuauaaaugguugauucuuuucccagccuacuuaauucacccauuuuuucauagauugugcacuuucguguacaaucuuauaaaggagucuaucguccaccuuauauaauauuucuuuuuuuuuuaauuagguauuuuccucguuuacauuuucaaugcuaucccaaaggucccccauacccacccccccaauccccuacccacccacucccccuuuuuggcccugguguuccccuguacuggggcauauaaaguuugcaaguccaaugggccucucuuugcagugauggccgacuaggccaucuuuugauacauaugcagcuaaagacaagagcucccggguacugguuaguucauauuguuguuccaccuauaggguauaauauuucauuaggaauuuuucaaagugcuagcuugguuguuauugauugccauaauuuguguuugucuugaacuauccuuauuucuucaucauuuugaaagauaaacuuugcuagcuaacauucuuggcucccaguuacuucagaguuugauaagacauuacuuccuuuguguugguuucuguuugaugaugaaaagucugggcuaugucugauauuucuuuggccuuuguacguaaguugauauuuuccucauguuacuucuaguauauuuauuuacuuuguauuuuugacauccugacuaauguaucauggaguuucuucucuggucaugucuauguggaguucuuucuauaugucuuuauguguguaguuuuaucuacuuguacuauaaugccaauaaauagccuguguuucuacugauuuuaucuguuccuucuuucuacaccaugaauucuuacauuucaccucuugauuguaucccagaauuuuuagaaauaccauucauacucauucucgugugugugugugugugugugugugugugugugugugugucagagacagauagacaggcagacagacacacacacaccaaccgacugaccacuggaaccucagucaaaaccuggaucauugcccuuuaagaccacuggagucaaagcuuuagucucucagggauccuugggugccacuggggcuggagaccuaucuaaucauagucuucuuagucccuuuggagucagaggccugaacuugugguuauuccuaagcauggcuccuguugugccccuggggauucccaguuaauagaccccuggggcacccagccucugggcuagcccaggauaccagauaagcacuccacuaacaggaagccaaggggagguaggucacuugguggaguuuccaaagcagucugcuacaagaaaauggaguagaguccugggccagaggcuaacaggauaccaaguugaaguacagccucaaggugacuggagaggcaagcaggcuugagaguucuuuauauauucuaaguacuauacaugauuuguaauuauuuucucccaauaggauuuuauauaccuuuuguuuaauucugggacauuuugaguuaauuuuuaaaaauuaauuaucugaauauauacauguguguuacuguguaugugagugcagguucuuguggaguccaaaagagaacuuggaucccuuuuggcuggaguuauaugugguuaugagcuauaugaagugggugcuuggaaucgaacuugggucuucugcaagagcagcacaauuugcugaucuaucucucuaguucuuugaauuaauuuauaugagcugugacacuugggccauagauuaucacuuuguauauggauuuauucuuguucugacaacuuuuauugacaaugcuuccuugaugucacuuggguguauuuguauauugggguuuuuaaucuaucuuaaugauauacaugucucucagucaguacuacucuguguguguguguguguguguguguguguguguauacauguauagugucuuaauguauaaaaugguauagagugguaguaauaguauuugcuagggguuuggaaaauacuguccaaagaauacaagauuucaguuuaggaggaaugaauucuaggaacauuauacaccaugaugacaauaguuaauggacauaugaaaauuguugagagucgacuuuuagguguuuuucuccauacccccaaaauuuauaugaggcaguaccucauuaacuauuuuagcaauucuacaauuugugcauaguucaaaauauguuggagaccauaaaugaaugguuuguaucucuuagcuuaaaguuuaauauaaaaaauagugacuggccagaaguagugcuugggaggagaaauaggucgaucucugaauucgaggacagucuggucuaccuagaagaauucuaggacacccagggauaaacagaaaccguguuugaaaaagccagaaaaguuaguagcugauauuuaauggugguacaugccuuuaagcuuaucauucaagaaacaggcaagugggucuucagaguucaaggccagcuugguauacauagugaguuucaggacagccagagcaggucuuuauucucguuuaaaacaacaaaaauuaaaaucccucaaacccaaacaaaaaacugagaaccagccucacaaccugaaucuaaccccucaacccuacauggugaaaggaaagaaacuagcgcuugccaaguuguuuucugaccuccacaugcauauaugcauaacacaggugcaugugaacacacaagcaauuuaaaauuucugagguauggcugagauaaaaagcuguuugacccuaccccucaagaggguuagguugagccuugcaugcuuguuauccuaucacuacagggggacuaacugacccuacauagcaauacucugucuccaaaaauaguguuuaacccaugagacaagacaaacaccuccccacccccaccuacuccugucuguugggaagauaaggauuguuggggguggcaugucauuuuaugcaauagucuaacaauuguugaauuguucuugcuucagcaaauaaccuccuaucaaugcuuuuuaauuucaacucaguggggcacacacaaagagaaauagugaaaguaggaguggucuugcugggaagaagggguuccagcaggaaugggaaagagcagauugacauggaguggggcuuacaaacuaaauuuuuuauguaaacaugugaauugucaaaaauagugauuugacauuuuuauuuuuccaaguuguuucugcuauuguuauuccuuugcuuucccauacacauuuuggaauaguuuagguuuacucaagagucuuacugggauuggaguaggaauaguguuguguauugucuaucaauuuuaggagauuugacaucuaccauguugaaucuucaggauguuaugagugcucguguauaguauuugucagugcauauguauguagaagcagaguucaacuuugagugugucacucuauuguucucuaucauauuuuuuaauacugagucucugaaccugagguuuucuacuucugguagacugacugaccagugaguccccaggaucuguuuucuucucaccugccccaaacacuguaguuacagacuuuuaccuggguucuggugaacuguauucauguucuugugcuuauacugcaaguacuuuuaucacuacuaaaucugcuuggccauucugcgagguguuuuauaaauaugggauuuuuuaaaaaaaauguagauaaaacuugucuagaaauagggaaaguuguguucuuuucuggucugugugcucguuacugucuaguguuguacuauuaagggcaagaacuuccaacauugucuuugaauaaagugaugaguacacucugaguucaguuccucauucauucuaaagggaaaacaugcaccauuauauacuugaguuguacaauguuggggcagauugcuacuucucauaucagaagcaauuuaauugcuucucuacauauaccuguaucuccaauaaugggaucuaguguuagcuguaaaaucuuuuguaagaacaacaacaaaaaagccugguaguuaaguguacaaauuguucaguauaugguuucuacuccaugguuaagauuguugucaggaucuaguuggccucauuuuagguauuuugaaguuguugauaggaguuaaucuuguccuuuguguuagaugaugagguaauuuuacaagggaauuuguaguuacauauuccuaaauauuaauuauaggagaacguuguuuaauguucaaauacuguauaaaccaaauguuuugggugauaaauauuugaaaauauauuaacuuugauuuauauguaugucaaaaaugacauggccucaaauguuaauauuuaaacauaauauuuaaugugccuaucauuaaaauaaaauacuguggaacauucuuaaucuuuuaaccaucucuuccuuaauacucauugauugaguagauguaagcaaaacagauaauuaggacagaagcuaccugggauguguauguauucaugacugguuaccuuaaauagcaccagaucuuucugaagagccugaaaucuaccucuaccacugugcauguguccuuuuugauaguaggagaaauguugauuucuuacuacaauuuggucaguguaucuucaaggacuuaucuguuauuaaauguuacaggcauuacaugggucugauuaggcuguuaccuauuuuggggccuucuaaauuacuuggucuuaccaaagugauuguguuaaacugucagaacaguuuuaguagugucuuacacauuguuucuuaguauuuuuaaaaaagaauucucugauuuuuuuuuucaauuuuuauuuguuuguuuguuuguuuguuuguuuguuuuuucgagacaggguuucucuguguagcccuggcuguccuggaacuuacuuuguagaccaggcuggccccaaacucagaaauccgccugccucugccucccaagugcuggauuuaaaggcgugugccaccaccacccagcuaagaauugucuuuguuaagacuucucuuucccgaagguccugaguucaaaccccaccaaccacacguaaagagaucugauacccucuucuggugugucugaagucagcuacaguguacuacauauaaugauaaaaaucuuugggcuggagcaaguggaguugaccagagugagcagggcugaccagagcaaggagagguccuaaaauucaauucccaagaaccacaugaaggcucacaaccaucucuacagcuacaguauacucacucacauacauacauacauacauacauacauacauacauacauacauacaaaaagacauaauuuaucuuccuguuaaaaggcacauugccaaaaccaucacauggcuuagccuuaauccuuguguuuagcugugaguuaacauuacaguggggcgggggcguuauuuggcuuaugcguccacauuauacagucuauuguuaaaaggagucagggaagaaacccaaacaggaaucuaaagucgugaacugaaccagacauaggccauggagagggagagaauuuacuggcuuguucuuucugcccugcucagccuucuuguauacuccaggaccaccagggaugucacuauucacaucccuguaguaggcuggaccuuccuacaccaaucauuaauuaagaaaauguccuauagacuuuaggcagucugauagagacauuauuaagugauauuuucauuuccuuucucgaguauuuucuuuagaccuaaauuaauauuuaguugcuuuuuuauuaucuguugcccagccuagccaugaauucccauugauccuucuucugcuccagucuggaguuacaggugugaaucaugaugucugauucaguagaucuauauuucauguuauaacuuuuacuuaaucacaaacuucuguuauguaauugucugcaguauuuucuagcaguuauauagucaauucaaaaaccaauucuagagcugaagagaaaacaguuaagaucacuuuuuccugguaccuguaugguagcucacaaccauccuuauacuuucaauauaucuaauggcuucugggccccacgccucuaugauguacauacauacaugugaacgaaacacacacauaaaguaauuugauuuaaauaacaacuuuaaacaucuuaauuggggcuuuugguacuuucugauuuuucacuuuuguaccuacucaugcaauauagauuaauaauguuaaauguuuguguacaucuuuaaaauuuugccuaaauucccagaccccccccccccauaacuagaggcuuauagugaguuuuccaccccaaguuaucgaaaaaccuugcauacuuaacugugucaauaaagaguuugaaaucuuuauaauaggagaagaaaaaaagcuuuuuuguuuuggcuuaguuugguuugggguuuauuguaacggggaauguugguuaguuuuaucuaaagauacucugccauuuucugucuaauaaccauaucaucgaauuaacauaacuccaguguuacacuagguaucuugcauacucuucaucuaauauuuguauuucuaagacuguagagcuguagaauaucuguaacuuuauuuucucauuacuuugggguuuuuguuuuuugguuuuuuuuuuuugcagaucuuaaaucagaaaacugaaaacaugaaaguagacaggacuaaacugaaaaagacaccuacugaagcugugaguauccaaauuugcuuugugcauuuucuuuauuucaggaaaaaaaucauugugaccaguucagcaguucugaucuuccaaauaaguauguccaguuaauacaaaguguuaacuauaguaacuugugaaacuaggaggaauaucucuguuugucuagcaugcaugaggccuuggguugcauccugaacacuaccagaaaaaauaauacuaccuugccauuuuaacuuacuuugauuaaaaauuaguagccaagugaccaguggaaaaaggaauagugaauaauacuuuagguauuuguucccugaaagggacucucaggcuacaauauaagcauugaaagacaguaugacaauggaaaagagauguagaauuaaaauugacuauagcuaauagaacuuaagaguuuuuuguuuuguuuugaagacaaaaaugguaaguucauugacuuuuuuauuagccuuuuauuuuguauuuugacauuggaauaucaguguuuuuacuaaaugccauauauugagcauauuaauauuguuucuguaaguuuucauuugauucuguuuuugauguguuuugguauuuauaaguuuugaugacuauuauauuuaaaagugaagaauaaaaaagucuuaaggaauuaagauuuuuaaaaacaagacagugccaucagcguaauaauauauuuauacgagaguugaaaaucaggacaacuuagcauacauaagaacuuaauagagggauuauauauugugggaaagaacaguauuagucaauaaaaugugccaagacaauuacauuugauuugggugggauggugcgggggacuguuuuacugaaguaaauuguagauaagucaucaaaagucagauauuuuuaaaagaaauuauaggagaaguagaacauacaggugaauguuuaccuugucuuagguggggauugcccuuccaagcauuaaggcaaaggacaaaauaccaaaauggaaauguaaaauaccauauccaaaauaaaaggacacaugacaauagccauucuaacagguaugagguaauaucucauuaugauuuugauuugcauuucccugauuauuagugauguugaguaccuuuguaugugccauuuggccauugucuuuggagaaaagucuuuucaaauuccuuugcccacuuuaaaauuggguuauuuggggguuuuucauuaugaaguugaagaauuucuuauauuuuuaaaauuaacuccccccagaagaaugaaaagugaaauaaguuaauuacagaggaacaaauacugcaugauuccucuacuauggggcaucuaaaauagucaaaagguauguaaguaggcaacagaaugaaugauguuuaucaggggagggaauggggaauuguucuauggcuauguauaauuuaguaaaacaagugaguacaaagugaauaaaaaguuggguaugguggcuccugucuaaggagacugaggcaaaagagccacaaguucagggcuacauaguguuacccuauuugaaaagaaaaaggauaaguuucagaacuuacaguuacugguaaauugcuguguacuuuaagaauuucguugaggauaaacuucauguuaaguguuuuuaauacacacaaauacacaaagggccacaaggaaacuuagaggugauauauuuuucaccugaaauguggugaugguaaaaugaguguauggauccauauaaacucaccaaauuauguuaauuaugugcuguuuuuguauguucacaauuaagcucaguugugugggggagucaugggacaugacaagcuggagaaaauauuuguaacccaaaauaguuaauaucuuuuguaccaugucaguagaagaaaugaauaucccaaugacaaaaugggcauaaaaccuuucagagaaggaccaaagccaguaaacuagaaagagucucucuuacaggugaucagagaaaugcaaauuuuauuuuuuaugcuaagugaauuauaaggcucuuacagucacacuuauguaaauuuccuagcuucuaucagauuauuuaagaauauaaaaucacugacuagguguguuuuaaggcuuggguugccuuauuuacucaagcaacauagaagauugcccaguuucucauacugguguuaguacucgguuuuauuaagaaauguuuuguuuuucauugauuuuacuggugucaguacuagguucaguuuuuaagauuuuuuuuucauugaucauacugguaucaguacuagguuuuauuuuuaagaaacauuuuuggucuuucauugaucacuuagaauauuggcaguauuucaaaggauuucccccauagguuugauaauggaaacaaauucagguaaauccugguagcagcuuugaacugacagauggcuugccuuuuccugugagucgggacagucccacuugguuugcauuuauguacagagaaauaggaaaaauacuguaaagagaaguaaaccuuauaauuagaaaacacgagcaccuuagauuuaaauguguguaauagaugaacccugugaaaaguuggguuggaggugggccuauaccaaaucccaugagaugguucaccagguaaaagucuucuuacaauuuaaucucaaugagcucagccccuagaacauaaggugaagaaaaccaacucugcaugauugucccugucuuaugacaucugcacauauuuacucucucucccuucuuuccuccuucccuauuuccuccucccuguccccuaauccuucccucuuuccccucucagcaauaacaagucucucacucacaaguuuaaaggauuucuuugaaaauaagagagacaagaaagguuggguaugauggugcaaacuuuuuaaauccuagcaccggggaugcagaggcagguagauaucugaguuccaagaccaacgagggauacauagggagacccugucucaaaacaagaaagaauuuaagcaagaaagagaaggagacaauuguuuauaauuuuuucauauaccacaaagauagagaaauuuaauacuugaguuugggaaguagcauuuaaguauccuauuuuggucuaguccuugguaaccucuaaagcauucaguggccauuagugagguugaguucuaggaaagaugguaaaagguccaggcaagcugccuuugugccuuguauggcuuguccaguuagacucagauaucucauaacuguucaugaugccaagcagagucuuuggcaaggccauaguauccuuugcuaacaauauugcauucaagcaagaucuggcuuggguaccagguuugugagauauuaaaugccacguaaugguagacauaccaaguuuuuacaggacucagauguuaacaacaaaauggguauuaccuaacccacagaaucauaacaaugaauuagccuaucuuugucauuagaaauuuaaauacaugcauuugauacuaaauccaaguaaaugaaaaagggacagaugaacuguguuaacaggugucucaaauucuccauguuuucuguuauuuauucuucuuuacuguuuuuccuacaaucuauacauaaaagggugugaggcugaggucaagccugguuuauagaagaauuugguguuagguguuuuucauacauaucaucaccaaaauuugagguagauccuagcaaaguugagaauuuggcuuaaagaaaaucauaguuuuaaauaucuuauaggagaugggaaucuuuaggguuuccucuaguuuuagauuucacaacagcauuguuggauauauaggugguaucuaacuauucaucucuuucuugaugaggauacugagauucaaaguaagaaugacuuuaaaucuaaaucucauguucuuuguuucguuuuuaaaauuuuucucuuguguguacuuacuaaguggcagguacuugaauauacucuucaagcuagcuuguuagauuguguuuuccugguaaguaauggauaguaaguaggauucaucauaguagucauaaaaccaaaaucagaacauagauuuguuuguuuccaaagcuaguuuauucccaugacaccauuuauagaauuaaguaaaaaaaaucacuuucccaccuguuguccauuaauagaauguuucccagucucagucccuaucccauuuuccuuaccacuuucagaaccuuuauuauaaauucucaauccacuccuugauaccugauaaugguccuguucaucaauacaagauaucaggaauguauggaaaugggaauaccaaguaagaauagagucuuaguuuuacaaaguucagaagcucuaugaucuuuucuaauucaagguuuaauauuauagaaaaauaaaucauugcuagccuuuuccuuucaggcugguuggcguucucuucucucuucucucuucucucuucucucuucucucuuccauccccucauuuucccuccuucuaacauucugguuaccuuuuaagcuauguugcaaauuauuuauuuuugcuuuuagugcugcuuaguuuauuuccuuuguuucuauuguccguauacuucaaguaguuugcauauacagguuuauucagauuuaaacaaaugcauaguggauuguugggauuaaaguguuuccucacaggcuucuauuguaaucuaaacuauuuaguuuuauauaagcaaaaguugaauuucuuuguggguuuaagggucccuuuucccauucucuuuguuucuuccucauuccuaaacaccuuuuaugaauacuuguuuguuuuucuuagccugcagacugcagagccuuaauagacaaacucaaaguuuguaaugaugagcaacuccucuuggaacugcagcaaaucaaaacauggaacauuggcaagguauguaaaauccaugauaacagaggauagggaacaugcuauuaguacaucauuuugugugcuuugaugaugaacaagagaacuguaauggaauagccuuauucuauaguuacuuaaguaucuaguauaugugucacagcucuuggcuacugguauuuagccugaauuguugccaagaauuauuuuuuaaagauaaaccaaugugcugagccagagagagagaguucagaaaguaaaagcauuuauuuccaagucuggugacuugagagaucaagucuaauccccgcauccuucauaauggauggaaggaaucaauucuucuccuccccccaccaaauuuuuuucugacuucuacauguauucucuggugugcacauacccacauaaauacauugauguuugaagaagugaaaacaaagcuaaguguuaauaaaacucuacuucaaagaaccauuuaguguuaaaagaaccauuauuauuuugaugaugggccucacuguguggccuaggcuccuuggacuauauauccuucuaccuuagccuccucaauacugagauuacuagagcauaccacuaagccacuuuuaucauaauuuuauauccucuuuauccuucuuucuagugugaguuauaucacuggguggaucuguuggaccgcuuugauggaauucuggcagaugcuggacaaacaguggagaauaugucauggaugcuuguaugugauaggccagaaaaagaacagcugaaaaugcuucuauuggcuguauugaacuucacagccuugcucauugaguacagcuuuucucggcaucuguacaguuccauagagguaagagaauauaaggcuauguggucuguuuuuaacuuaaucguguguaugcacaaacaagggaauuucuguuucugaugguuguuugcuuuccuuuucauuauggauuucuuaagauaguaaguaguaguaagugguggggauuuagcucaguuguaguauacuugccuaauggguauaggccccuggguuuaauccucagaaccacaaggggaaagagauaauaguauggcauuucuuaggcauaaguauuaccugucuuaggauugaugugaaaguuucucuguuucauacuucaaggcauaaagaauauaguaccuguauugaagcauuuuauggacuauuuaguaaucuuugucaaagauuauuuagagguauuccaaguuauucuuaaacuauuaaaaauaguuugauuuucuuauuaaugugcuuauaauuuucgaugucuuuugccaaaacacauacacuccucccaucauaccuguggggggggggugaguuuaagcacccguuccuuauucagaaugguauauuugcauguaaccuacauauaucuuuguaaauacuuaaacucaccucaagauuauuuguaauacccaucacaauuauaucacuuuuguuccuaugaccaaauugcugacaagaacaagggaggaauguuuuugaggaaacagauuucauucuucaaggauggugguagucagcuucaucucauggcaguuacauacuacuuuuuuugaaccaaaaaaagcuauaaugcccaaggcuuaaacccuagugcccuaauucuaaaaguucuacaaccuuguaaaacugacuaguggcuaacuaaggguucagaaacaagcuuauagaggggcauuuuacacucaaauuguagcaguguaugugcaguguuuauaguuaacuuugucuuaggaauacugaccaaacucuguaugggaauguaccucaaaaauauaugucuauccaugguaaguugaauggaugaaugauaugggugggacuuauaagagccuauuguauucuuuguacccauaaagacugagguaaucaauccauggucaaaagggcacugaaaaggguuuaacaguugauuacuucuagcguagaacucagguuugaauuccuaccauguaagcauggaaggcuuacaacuauauguaacuccacuuccaguggaucuuauucccucuacuugauguuugcggcuacaugguucacagacauacauucagacaaaacacauuaaagaaaucuuaaauuuaguggucauaaauagaaguuauuuuccuuuagccaaacuugaugaccuugauaccacccuguuguuuuuguuuuauuuucugaaugauuuuggacaaguaguagaaugguugaacaucaagugggaauggauaaacagucagucuugauaaagaaauagaugugcugcccaaggaaguccauauaaaguaaacaaauaaaauacuuuuguuaauuucuaacucaauuacauagugauuuuaguuuuauccaguuaugugcugcaacauauuggugaauguucucuguuuggaaaaaaaagagguuacucccaagcuugucguacuuuaauaguuuugaguaauugcacacagcuguuguugauaguuuuaguuucuauguguccuuuauauauuuguuauaaaggaaauaauagcauacacuuagauucauuucacaaugcuuagaaauauaaauuuuuaguccuacauauguauuauagcauguuucuaucuugaaauucuuccuuaugagauacagauauaauaucgagcugcaauuuucaguguuuacaguuauugaacuuucuagucagcuguuccuuggaugcaggauuauauauuguaagagauugacuuauuuuuguguauuguggcucaauaacuugauagcuuuuaauguugacacacauuauuacauuaaaagaauuucuuuugaaguuuuuagugccaaguacuugauccacuaaacuuugucccuuuuuuguuucuauagcauuugacaacuuuauuggcuuccucugauaugcaaguggugcuggcaguccuuaaccuucuauauguauuuagcaaaagaucaaacuauaucacacgucuuggaucugacaagaggacuccgcuacugacacggcugcagcauuuggcagaggugagucuuuggggaagauaucagcauaugguuaaacaggcauuucuuguuuugccaaaguggauuagaauccuuuuguuaacuuucugagguuuacaaguauuugugacaguguaacaaaguuucaaaaagcacgaguauucucaacuauuaauuaaauuugaaauauuucaucaacucugcucaagaaacaaaauucuuguuucaaaacugauagugcugcuuuggagaaauucagaauaaggauucuaugugaaaaagaagcauaccgagagaaaaagguuagauucgaaucuuuaauucugauaaccaguuuucucauuucggaauuuaaauaagaauuguuuagaauaaucggagaacauuuagugcuauuuuuuccaaauuggauauuuucuuuauuuacauuuaugauguuguucucccuuccuccccccaaaaaaaacccgauguuguccccuuucccgguuuuucucuccagaaacccccuguccccuuccccccucgaccugcuucuaugaggguguuccccccacucaccuacccacucccaucucccugcccuggcauucuucuacacucggacauugaaccuuuacagggccaagagccucuccucccuuugaugccugacaaggccauccucuguugcauaugcaucuggagucauggcuugcuccauguguacgcuuugguuggugcuuuagucccugugaguucugggggggucugcuugguugauauuguuguucuuccuaugggguugcaaaccccuucagcuccuucaguccuuucaguuagugcuauuuucuaauggugguauuguauuggagucaagauuuccuacaggaaaauuuaacucuauccaaagauugugguauuccuagagguuaacugauugauaacacacaguuugcuaugaaguugucuuagaauuuuuuuucagggucuuuaucuuaguuacuauuguccuauuguugugaggacacaugaugaccaagguaacuuuagaagaaaacauuugagaguuuuuuacaguucauaaccaucauggcagaggaauacggucauagguagucauccauuuggcauuggaacaguggcugagagcuuaacauccugauuugcaagcaagaggcagaguagagacuggcccugucaugagcuuucuaaaacaucaguagcacaccccugacauggccacaacuauucacaaggccacaccuccuaauucuuccaaaauagucuacuaacuggggacuaagccuucaaacauguaauuauauggggcccauucucaaucaaccacacuugcgauagucugaagucuacccucaugaucccaucuagugcuaauauuacaggcauguauuaccacaccugauuggaggcuuguuuguuuuaauagucaauuuaaugguuaccuugggguugacucacuuuucaggcuauuuuaguuucuuuauucacaaguuuaauaaauuuuaugacuuaucagugcuagggauaaaacauggcuuugcucaugcuagacaauacuaccacuaaacuguaccucuugccaucaaaccugcuuucuaaauauauuuugaguguuuccucauuguaagaaauguaagacaguucaauaugggaucuagaguucaaaagaaaaaguuuaaucuuugauaauuaacauaauguuugcaaacaacuucaguuaaauuaagugguccauacacaaaggcaugaaaguaggaggucuuguugggaagaagaguugguuggggggaggaacggaaggauaauuauggauaauaggagcuggggggagccuugaaucucaauauucaugaggggaggcaaagacaaguagagagcucugugaguuuccggcuagccugauauacauaguuccaggacagccagauacauaauaaauuucuauucaucacguuaaucaaacauuaggguucagcaggugcuuaccaccaagcuuaacaguaaugaccagaguuugauccagacacuauauaauaagagaaugacuucuaaaaguuuccuucugaccucuacaugcauacuauagaaugcaggugugcaugccacaugcuuauuaaauaagucaguaaaaauguaguaagaacuuaaaaaaauagacauuaaguacauaaacucaggaagcucagaaguuuuaaauuuguaaauaauuaaccugugguccuaauggaugaagaaaauuuaaaaaugagcaaaaugccaaguaauucuuugucuuuuaauuuguaguagagcaaucuguagagaggauuucagcaguuuggagcguacucuuguggagggcuggagcucaauucccaauguacacacagcgccucaugguugaucaggagcauuugacaagucugaucucuuugggcaccagaacucauggacaaauuauucaacacacacaauuaaggacuuaacuguguaaugaaagaaaugauuugcaauaauuauuuuaaaaguguuuguugcagacagugggguuuucuuuugguuuccuagggagaugauacaaaauuguuagaacuggccaguauguggaaacauacaucuucaaaauccagcacuuagaaggaauaacuauuauccagugggcuacuugaguucaaggacagccuggucuauauagagaauuccaagccauccaggccuacauagaaagauccugucucaaaaaauuguuaaaauucagugugauagcuaagcaauaaaucaucacaugggaguagcacuuaauauauauaugacaccgaucugaggguaaaguuagaaaauaaucuuaacauuaauuaaaguuucauccuuaaaaaccucaagucuuuuuuuuuuucucacgucugaauacuuuaggaucucaucuuguaagguggugcuuuaagcaugcucuaagcaugacugauauauacuaguuauuuuuuagauauauaccaacuuaauuaccagggucauaugauaauccccacuggguaggugaguacauacagcaaggcuaauaaauuaaugaguauuauuuuggggggaaauguauaugggcuuaguuccuagaaaaguuaugagaugcaaaauguaauguucuuagguguuuggaauugcuggagaauuguuauuucauaccuggggucucuuuaaagccuguaaacuaguuccugagucauuuccacuugguaccauuaaagaacuuuauacccaacccuuccuggaugaaacacugucuuugacaaauucauuuauaacugagaaaacaguacaaaaacauaagauuaaaaaaaagauaauggacuagugcuguuuuaauaguccuguuuagugucuccuaaaaauuauaaacauuuguuuuggugacaaagcagauuuugcuuccuaguauuaaaauacaaauacaaaauaaggaaauugguuguggucaguuugauaaauuuucucaauauguauauuagcacuuauggcauauauaauuuuuuuuguuguuuuugguuuuuuugagacaggguuuuucuguauagcccuggcuguccuggaacucacuuuguagaccaggcuggccuggaacucagaaauccaccugccucugccucuggagugcugggauuaaaggcaugcgccaccacaccuggcaagaaacuauuucuugcucguuguucaggaucuauuucacaaagaauuauucuaagacuaggucaagguucauuuacuauuaucuuucaaaacucugaggaguucugacucaaccaggauuacuaauccgagugcugggauuaaaggcgugcaccaccaugcccggcggcauauauacuuuuauaucaugcuuuauuaguguacuagcuaaguguuuuucaguguuaucuauuacuuggggaaacagaaggaaaaaaaugauugugucaagcuucugccuuguaucuuuauauuugugguuuuuuucuuaccuguuucuuuuguguagccuguagacuuuguauauuccuauccauaugguuuucaacaaauuucuuccguggaauuccugaaaauagccaaaagaauacuagaaacauagugaggaaguacuuaaacuguuuuauaaagguauaguaauuagaauaauguacucaacugaugguucaguagguuccaaaaucauauacagcaaacauguaagaaauuaaguuauagcaaugguagugcaugccuuuaaucuugggguuggugugguuugugcuggagugggcagaucauuucuugaguaccaggacuauacagagaaacccuguugagagagaguggggagaacacauaauuuaugcuaaagaugacuguaaccgaagaugaauggauuguuaugauucaguguuacuauucaggaaacaauuugguaaaaagcaaaguuaagauaaagaacugaaugcuuaaaaauacaaauuuuuggcuaaagauguaguuucacugcuugucuaacaugcauaaacugagugugguaguguaaauguguauuccuagcacucaggaagauaagaaauugaagguaaguccuugccuauguagcaauuucaagaccaaucuaggauacaugaggcucugccuuaaacaaaaacaugacucuauaaaauaauugaaggguaauagccaggcauggcauaccacuuaaguccagcauuugggcaacagaagcaggaggauguuuaguuguugguaagccugagcuguacagcaaaacugcauuucacagagagguuggaaagaaaagagaaaacaacacagcgguaaaaagucuuuuuccgugaaggaagaaaucaguucuuucuccaauugagaaagcguaaccuuuuaugugaaaaauuugaauacagucaaauuauggcaucuaucguugucucaguuuccuuucuauuuggguaauuugcauuuuuccuauugucauaguaaauucuuuuuguucauuaauauuuuccucuuuauuucuguuucuuuccuuucuguuuuuauugcuguucccuuuacaaacuacauuuuuauacauaguauguucaucaucauaaacauaauuuuuggcuucugucaaagaacuuagauaguucugcccuaauaccuuugcugacugcaauauaauucuuaauuuugguuugguucuacuuccuguaugucacaaaccuggcuucaggggcucuuauuuagccaauuagaaugauuauacaacacuguuucuccuguauccuucauaauuuuaaagucagaaccacauaguugauaccgucaacuuuagcugccuucuuggaauggagccugcuccucccuuuaaauuauauuugcauaagaguugaucugauacuccuuuuuaggaacagaaaaucccuuaagcauuuccuuucauaaauuguaggacuaacugggugugggggucuuagcccaaggguauuauuacucuauuccauuuugugucuggccuuaucucuuuaucucuuucagcacaagccauggcaccaacauuuaauuuucugcuguuccuuuucucuuuaaauuguauauuucauauuucuuuuuugucuugcuuggccuuuuccuuuguaggccugaauaaaggugauuauuacuaaucucaaaaaagaaucaauaauaggaugucuuggauucucuauguuucaaaauaguccaaaaauuuucaguuuagcuccagggagauuuuucggaccaggacaaagacagccacauuguuuaccaaaauaucaggaguuaggaucuuuauuugcuaaugcuguuuucugaaaccucuugagcuaugccuccauaguucacuuuguucucagcacugcugucuucaaaacuccugguaggauggccuaauaagccuagcuuacaguuuucaaccacuuugcuacuucuaaagucuucuacauucuuuucaaauaauaguauggucaguccugucacagcaguagccuacuuucugguaccaccuuuugucaguaacuuuuaaauuguugugauaagagacaguauggugaaaguaguuuuuagacacacacacacacaaacauuuaauuuggugcuaagagauaagaguucauggccaucauggugaggagcauagcagcaagugggcauaguguuggagagcaguaggugagaacuuagaccuugacccacaggaaugaggcggagagaaaacuaaacuggguuuugaaauuguuagcaucauuugaccccucuuuucuguauccugugcuuuuggguuaauaaagacuuacaaaaagcuuacuuuucugggauuaggcaaauuuuguuuugucuacuaguaggguuuuguaauagagaucuuugaaugacagcuucagugauacacauuguguuauagauuuaucaaaaacaugcugacgugauuauauuucuaaagaaggaaaugauaaccuuuccuaguagaaaaacagccaaauagugguugggacacauacuggauuagugagaauuguaugaaggcguuuguguuugagcugggccaggcaugacuuaccuuaaggcaagaguaaaaguagcuuauuaaaguucguaguuguagcugagaugacuagcaauuacuuaaacaaaaacaaugcuauucuugccagaugugguggcauggaucuuuuaauaccaacaacaccaggaggcagaggcaaguggaucuuuagaaguucaaggcuagccuggucuauauuuucuaguccauccagggauauacaauuagaccuugucucaaaaaguauauauauauugcuaauaaaauuuuggcuauuucaaaggucaaagaugcagacuaguccauaagcaaaaauaauaugguuugaauuugggauauggaaguuaccaggaacugugcuacucauuaccacaggcacuuguuugaaagcuuuuauacuuagguuagcaaaacaucuuagucauguucuuuugcugugaugagauaccauaaccacagcaacucuuauuaaggaaaguacuuaguuggggcuugcuauauagguucaggggcuucguacaggaucagcaugcuaggaagcaugguggcaugcaaguagacauggugcugagagggaucuugcgagcucuacaucuggaccagaaggcagaggaaacacuggggccugacuagggcauuugaaaccuuaaagccuaucccugguuacacacuuccuccaaaaaggccacacuucuaaugcaacucccuaagcauuugaaaauaugagucuauaaaggccauucuuauucaaaccaacaugcaaauaauauagaaucuuagagagcucuugguuuaugucaagaaaacaugguuccaccauggugaaggaaaggguuaaaaaaccuagaauggugagaaaggccagcuauaacuaaauuccagcaaguaugaauuuauacauauggaauguaguagcuggcuagcauugcugcuuuguacucuuaucuugagcagcuccauagaaccauaaaauagauugcauuguuuguuuuuucauuaaacacuuuauaaacuuaugaccauaagcgugguguuaacucuuuuuuuuuuuuuuucuuuaccaagagcugggguggaaaggagaauggcuuuggacuugcagaauguugcagagacuugcaaauguuggugaguuaacuauuugggauaugauaaagucuuguucuaagccucacuuaacaaugaauguaugauauauaaauugacacuugacauuaggacuuuuguagaacuugaaaaauuagugcauaauaucuuuaggaaauuugagcuauuauuguuccuguuauagauaaaaaagucucaguaguguguguucauauaaccaguucugaaauaaguugaauuuauuuaaucaaaucccagaaagcugggaagaguaguacuuccacaucuguauuugggauauggcacgaggaagagcacgacuucaagaccagcuuugacuacauuuacuuauguacucacacaaguaucagaacucugagcaguguucaggaaugacugauaggaaauuuuuuuuuuaagaauuauuuauuacagggaucuguagacaaaucaagaguaguugaccuacauuuuauuuccagcacccuguggcaacuaaaaacauuuguaacuccagugccaagcccuaugauuagccucuucuagccucuauaggcaccaggcacuuacuuggcacagcagauaugcaugcagguaaaacacugauacaaauaacauucuaaaaauaguuuuuuaaaaacuuagguauacucuuaccuugucaccaauucucuuaaggauuuaggcuauccucccuucugcuuucugugcuucaaguagagccuagauugucauauucaucauuaaguagauaugaucaaaucuaacuaauuuaucuucuggaaauguuuaucccuuaguaggaugguucuuauuuuuaguugcagaaaucuacauauuaaagcagguuacuuucuuaccuuagcugauagaugaucuucaguaaguagcugugaauggauguugguaauaagggaaauaugucuuaaaucuuacucaguuuggaguuucaauuuugagaacauauuuuaaugaagaauucugaagcucauucugcauguuaagacuuucuggguuugugccaugacuguuuuccuguuuuaguccuuggcuuuaucaagguugagauuuggcauguuaacaguuugaaauucuuauacuuuaaaaugguacauguacacguugaacuaaauuuuaaaaugauaguacccuguccauuacaacauucccuagaaagaaaacaugaggcuaucauuguuuaccuuguauuacuuuuguagaguuauauaaaaagaugugcuuugaggguguagauuuuuuuuuugguuugguguguaucaaugcagaaagccaugaaaaauguucuagaaagguauagaaaggaguguuugaaguaauagaaaaaguguccauaaggaggcuguuaagauauuuuuacaagaaugcccuuuuucauucuuuaacugaugccaagauuuugacccuguucacuauuauuuauuaaaguuguaugcauuguuacuuggcagacuugaccccaccacaagaauaacuauagucaaaauuuauguauuaaaagaaagaguaacaguuaaucuagauguugaaaacagauuuguaucucuaaacuugagccuucugauucugcuucuaccaaauaucugauuaaagacacuauugauauauaaucuacuacugucacaauguguuugaggaaaguguuggagaugucuaaaaucaguuuaagcucgauauguuacucuguuuuauacacagaaauauccacccagugcaaccacacuacacuuugaauuuuaugcagauccuggagcugaggucaaaauugagaagagggugagucagguuauuuuguuguuauuuauagacucucuuaguuuaaaugaggggauguuuuguucucuaucacugcccuuugaagcuagauauaccuagaagcucuuuaggaaaaauuaaucauaugccuacuucucacaucauuaauuuuuuaaaauuauuuaucuacauuccauuccaccuuaccuuuccaguucccucucccagaguuccucaucccauuccuccucccccuugccucuaagagggugcucuccucucccaccccacccccaucauuagguuuuaugcugggaccugccaaaaguuacaacuccuuuuauugggcauuaccauauuuguguguuugcucagagucucuggaauguauccuaauagucuuaguuggauuucaguuucuguauuuaucucagucuauuaaaaagagcucugguuugcauguaaaauguuacuuaaaugauguucuaaauuccuggaugaucugcuaugacuugguuuggcauggaaacuccccaaugauuuuucuuccacuuucauuguuaaauuuuuuuuuccagaauaaaauugucuucaaaacaugagaaaguauucucauguauucugucuuugguaugaauacuaaaauuguggagauaguuagacaaggguuaaaaaggaacacaaaauaugaaacaugccuggcuaacagaauuauaguuaaauacuaccaguuugaaagaagcaucuugugacuguuauaugugggaaauggaugcuuuuaaugacuaugaaauuaccuugauucucaguguuucuuacaggguauuuagugaaucccuaacagguauuucaacuuuuuaauuucagacaacuaguaauacacuacauuauauucacauagaacaacuugacaagguaagagaauucuuugacaacugguuaguucauuuuuguuuguagccuuguucuuaacuaauuuuuuucuaauacagauuucagaaaguccuucugaaauaauggaaucucuuaccaaaauguacagcauuccuaaggauaagcagguaaaauacaucugaaaaauaucuugcauauuguggauuuccaaauauacuaauaaguugggcaaacagaagccauagcaaaauugauauacauuuggagucugaccauagcagauucgcuaccuagauuuguuuccucuucuugaggacaauaacuucuagcaccuuaugauagauuggaaacauaaacuuguaagcugauucaaaaugauuaucuaguaguggugauaacuuucucaacauuuuggauacauuuaggagaauucuauuguguuagcuuguucuguucuuuuuggcaguggucggauauuuauugaaaauuugaauuauuaucuauuaauguguauugacaauuuuugaaauaguaguauauugagagaucccuguuuugccacucuaguucugucaucuaaucucagaguaaauaauacuaguucaguuugauacucuagcaacaaaacuauuuuaccaagcagcauaaaaguacacaacagcucaagaaccuauccuuuguagugauuuacuaauauaagucuuacaucucuacagaugcuguuauuuacacauauacgacuggcccauggcuuuucuaaucacaggaagcgguuacaagcuguucaggccagacugcaugcaauaucuauauuagguaagaaaacacuaauuaacugguccuaaguaggcacuuugaauuugauuucugaugagugccaucuaucuuuaaugcuacgaggcuuuauuauggcaaccuaaauuauaaauguauuugcucaucccaguuacuacuguagucauucaucaucuugagcuccuuuauguacuagauaaaaggaaacuuuuauugcccaguuacaugggcuugguugucaucaucuugucccuguuauucuugauaaucccuuguccaguucucccaucuuuucagagguauaauuuugaagucugaaaauaauuaaaugguuaauacucuauacuuuuacuuugcuauaggagaauauauaggagguuuuguuuuuaauuaugcagaauucuaacaggccauuuucauguaagcauauaaugcacuuugaguguguaauaccuacuauagcucauuucucuccuuuuuggccaauuuuaccucauauuuguuccccagauaauuuuauuucuauuauuaugucaucagcacauaacugauuauguguguaaagagugugacauacaaaugagagauauguuacuuguccauuuugcaugaaguugcaucuguuuuucuacaaaugacauaacuucaucuuuauguggaagucacauguuuuugaggcucccaccaugguucugagaauuguauaccuacacacuguauucccucaggcaacuucaaguacguuauauuuggacaguauuuauaagcuauuuuaagaaaugaaagaaaauccuggaaauuguccugucacaugcuaggcacauuacaaggcaaaaaaggacaaguaucacuauuacuaccuacuuucauuuaguuucugccuacauacucuuagaacugacuacauugcuauguuuguguucauaccuaguacaauuucuggcauuauaaugauuauccaaaaaguuaaugaauguacucacgucucggccauauuuuacuucagaguguaugccacuauuaccucagugugugauucagcaaaaaaaaaaaaauaugcauuuucuugagccagggucucacuauauauagcucugucuaucuuagaacucaugguauaagccaggcuauccuugaacucacagagaucuaccugccucugucucccaaauccugggauuuaagauauagguaggcuacuaugccuucucgauauuacaaagucuuuuuuggggguggggggugggguuguuuuuguuccuuuuuggguuuuuuguuuguucguuuguuuuuuggguuugguuuuguuuuuugguuugguuugguuugguuugguuugguuugguuuuugguuuuccgagacaagguuucucuguauagcccuggcuguccuggaacucacucuguagaccaggcuggccucaaacucagaaauccccuugccucugccuccagagugcugggaucaaaggagugcgcuaccaugcccagcgauuaugcacauucuuaacuuuuaguagugccacaugaauuugacaguguacaauagucuauaaauuuucuuuguuuuaauaaggauuuguguuauaagcaaagaaagaagccaagucuauaccuuuauccaaagcauaguuacaguucaaucaaguagugaaguuaagaaaaugaacucuuugcucccuuuuccuacaaaacuucccccaaauuccuucugauaauuuuaguagaaaaauaugugguuauucagauuuuaccacaaucauauaauguagugauuuuacccuuuugugcugauuggaauguguguuauacagugguggcuuaauaacugcauuucuaccaaagucuuugcuuuucuuuugcagucuauucuaaugccuugcaagagucagcaaacaguaucuuguauaauggguugauagaggaguugguagauguccuucaaauaacagauaagcagcucaugguaaguaucuauuaauauguaccuaucaaguuuuauauugcauaugccuucuguuuuucuuaagaaguccaaaaguauccuagaaguggagccugaaccuuuuacuuuuuucuuuuuggauauuaaacugugaaauuacugaauaccaaauacacauuguuauucucuacugaccccauuuuccucaaacaguuuuaauaaaauuacugaaaauuugauuuugagauauuagcaccuucguucaguuguccauuuguuuuugacacuguuuacuuuguccucauaggaaauuaaagcugcuucuuuacgaacguuaacaucaauuguucauuuggagagaacucccaagcucagcaguauuauugacuguacuggaacugccuccuaccauggauuuuugccuguacuugugcggaacugcauucaggccaugauugguagguuugcaugguaauuauuuaccuaggaacauuucaucguuuaacauugugcuagguaaguaacugaggaaaucccaacuuucuuuguagauccuuccauggacccauacccccaucaguuugccacagcucuuuucuccuuuuuguaccaucuggcuagcuacgaugcugguggugaagccuuggucuccuguggaaugauggaagccuuacuaaagguacucugcuuuugcuuucuaauauaauugugugaaaaucaaauaagagagggcagauuuuuaauguuuuacagugaguaaauagcacagaaaguuuauccuaaaagaguuauaguuuauguucuaguugccacauguaucuauugucaauauugggacuuuuuguaauccagcguaauuugguagacuggaggcccugggucuagacaguacuacaugcauaguagugugacauuaugcauggcccuaagaaaaauguauguaagaguccuuguaaaguuuuaguuuaauuauaacaggauuuagauuaguugguugauuggcaguagguauuuugaggcaaugggucuuggccucucuggcuugcaauaaaauaagcuguauauauuuaaucaucuuuaugaauuguuaugcauguggccucaggagguugaauauaguccuugaauucauaacuuuauuauuugacaaaacauucagcauaugucuuuaucuucucuccaguuucauacuaugcugacucaaggggacaccaauacuauauuuucgaaaagcaauauuaauuuuuauagcucuguuuuuaaauuauuauguuuaccccucccuuccuugcaggucauaaaguuucuuggugaugaacaagaccagauaacauuuguaaccagagcugucagagugguugaccuuaucaccaaccuggacauggcagcuuuucagucucauaguggucuuucuaucuucaucuauagacuugagguauuauuuucuuaagacaauuugcauagacuuuauuggaucccagugagugcugagucuaggaaaauuuccaccuaucauaagcaaccaucuuaccucucuuaaauuucuagaaacugaguuuauaauuugcuuguuauucuucauuauaauuuuuuaaucccaaaaauguauaggaguuucuuaauauuuuucccuugauuguagcacgaaguagauuugugucguaaagaaugcccuuucgugaucaagccaaagauccagagacccaguaccacucaagaaggagaagaaauggaaacugauauggaugguaauuaacaaguuauuaagccaaugauauuuccauguaugugauuuuucuauuauccuauccaaauucuaauucuuacucauaaauuaaaaggcacacagguuuccagguauaucuuucaacacuuuuuauauaaaugauauauaaauuguuagggauagaccugggagguaaagcuacaguagaccacuaaagucacucuacacauuuuuuuaguuuauuaucuuauuuacacuacuaaaaccuaauaagcaccguguagucaaaauacugucuuuuuuuuuuuuuuuuuaccugauaaauuaccuggagacuauaaacucauaaaugagaccuuggaaaacuaucuuaagaucagagauuuuaauugguuauuguuuagggaucuuuuaagugacaaaauuacaauugcaaaaccagaucauuuuaguuuucauguguguuauauggguuuuuuuuaacacuuucaucucuuuccuaauagaauaaaaauucauaauagaauaaaaaauacugccccaagcagauuucuuauaauuugcaauagucuuaaugacagagauuauuauuguguaucuuacuauguuuaugauaaaaguacuacaaauguaacgcgccguuuuguuaauaguaaauaguauguuguuccuuuuucugacuuuguuuuugggcaccauuaucugugcauguugcaguccacagaaauccuuuugcucaguuucuguuucuguuuuauugggaacaagcugacauuuaaguucacaggugagauuccaaguguugaauaaaauguguuuauuaacugcugauaaauaauuguugacuauccauuguaaaucagcaauugucagaauuuaauaagcagaacaauaagugcuugguagauucuggcgccaucugaaaugcuugauucaguaaauuugcaacugaagaccaggaaacaaguauuuaaaacuaauccaaacgauugcauugaauucucaaagaaauuacauacucaauacaaagaaaguuacacagcuguucguccuuacuacuuguguaaguaggugcaugcauuaaaauaacuuuaaaauguuacauuuauaaaauuaauaagauccccuuuaaaguuuacauaacugaaacauuguagauaguaaauauuugcuuuucaaaucuaaaaguaaauguuaaugcucagucuuaacccucugccauuagcuguuaauuugaugugacucaauacaacuuuauuuccuuuucauuuucacaucuacaaguauauaguuuuuagaacagagagagaggagagcacaaacacauucugcuuuuauuguucauucuauguaucauagccauccuucccuaugaacaucagugcuuuuuauauuuguuaauuaaccucuguuaguagucuugacuuacuaccucccucuuagcaguaacauacaaaguugcauguuuuacaucucacucaguggacgaaguuuucucagaaaucuuucuuuucuuaguaccuuuuauucuaauuaguuucuuuaucauaacuuguacuuuaguugcagauguaacuauggaaagcaguccaggcucguccauaucuauggagcaccggcuggauguugaauuaagggcaucaaguuccaacagcagcacuagcaucucuggcccuggcccggguccuggcccugguccggguccuggcccugguccuggcccugguccugguccuggcccuggcccuggcccuggccccggcccuggcccugguccuggcccuggaccccguccuggugcguagacacauagauacacagucuuuuacagugacugacuuauuaaacuagugaagaagagaacauuacacggcacuuauugguacauuugaggauaaucuuauaagaacaugucuugcaacauuuuauggucuucuguuaguucacacaguaucaaaacagacauuucggagggcagauaauauccaaaagugaaguuugaaguugaaucuuuuuacucuacaguauuucuguuuuuaucuuuuucuuuuuguuccucugucugucugauuuuaauaccggucauaugcuaucuuuggugauuuaauuucagcuuucagaauacucucucucauguccagagaucucacuuuaaaugucugcuaguuuugcuuuaguggauauagacgggucucuuaguacauguuuugugugccucuucacugugauuuaauaaugagcacaauaugauacuuuuuucuuucucccauguuaggaguucaguguauuccacaacgagcagcacuucucaaguccauguugaauuuccucaagaaggccauucaagacccugcuuucucagauggcauacgacaugguauuuugauucuguauacuguuuucuaagaccacuugguuauccagauuguucuuuuucauguuuucuugauguuuuucuaaagcauacuuaguaaacugauagcuuuuuguuacuuaauauguuucuuagacaugaggguuacuuacacaacuccacuucccagcuuuggauucugaucucuucuauccuacugccaccucucauagucuccaugucuguucuuauuuugacccucuauucaagcuaacugcaugaauaaacuaaggcguuauaugaaacagaggccauagacuugaucauuuauuuacuacaguauaacauauugcuacccaucacccuugaucuucgugccucacccagacuuaucauauguggucuuuguucauauuucuuuuagugauggaugguucuuuaccuaccucucugaaacacaucaucagcaaugcagaauacuaugguccaucacucuuccuccuaggugaguagaauugaaguucgggcuagguugaauguucuggcauacauuuauaaaguaccuggaggcaaaaggcagucaguucucuugaguucaaugccagcuugcugcaugugugugcacgcaagcuuuuagaacuuuuuuuuaauuucuuuuuuuaugagauauuuuuucauuuacaacucaaaugcuaucccaaaaguccuuuauaccacucccuacccuggacccugcuuuccaacccaccuacucccacuuccugguaaaugcuacaaagcccauuguuuuaucccacuacgcacuuuggcaucacaaaugcaaguuggaacuccauuuaaaauucuauaaagcaauuuagggggagauguagaaauugcaauuucuuugaacauaguggaguguacauuguacaaauacauuaugggcagucuagagauuuguauuuauuaugacuuuaccuuuuugcuaaugaaacaguuuaugaaucuguauuucuaucuugugaucuugcagaauuuacuaguuugguuuucccuguuaaugaaccaaaauguuuccauuuacuccaaggauggcaauaugacccaguauuuccuuuuuuuagugaaacuucaugaagcagguauacuuuguaguuggaucuaugauauuccaguuacuaaauaugaguacaggucagguccuguaaaggaguuggaguugugacaaaggaaaaucagccuaagguagauugaaagaguuccuacugggaaaauuuguaucauagcagacagacaguuaaaaauagccuuaacaaaggauguugcacaugcuuuuaguuaaguaucugggaauaauacucauaaauggaaaguuaacgaggaaguauguggcaagguuacagugaucuguaguaacuacacacugaaacucaacaaauaaggaauuugacauuucuuuuuuuuuuuaaagauuuauuuauuuauuauauguaaguacacuguaguugucuucagacacaccagaagguuaguaugguagaaauauaguuuuuuuuaaaaaggcuuguuaguguugguugauaucccugggaggccugcucuuuucugaaaggaaauggaggacgaguggaucugggguaaaagggugguggagaugggguugggaggagugaagagagggaaucuguuuacugauaugugauguaugagagaaaaauacauaaaaaggaaugauaacacauaaaacucuuaauguuuauuggacuacucuugguauucugcuggaaaauuguuuucauaauaagcacacaaguuuaaauuauuaaauauuuaguguauguguuuuaagauuuugugacgggcaguguuguugcaugccuuuaaucccagcacuugggaggcagaggaaaguggauuucugaguucaaguccugccuggucuacagaguguguuccacgacagccagggcuacacaaagaaacucugucuugaaaaaaaaaacagauuuuauuuacuuuuaauaccuauggagagucucaguuucccauaauuuuucuuauuucuucuuagcuacugaaguggugacuguguuuguauuucaagagccaucacugcuguccucacuccaggacaauggacugacagaugucaugcugcaugcacugcucaucaaagaugugaguucauucuaccacuuuauaaaaaagacuacuccguuuauuuccuguuuucucagauacaucuuccacaugcuuuagaagcaaguuugaaauguuauugugugaaaaaauuuauguauguauuguugaauuuauuuuauaccuguuuaacaaauuccucagugugguaacccuaacuauauuuucuuugcauuuguauaugacauuuuuugaguugcauucaaauccuuuucgucuugacuagguuccugcuacaagggaaguccucgguucccucccaaauguauucagugcacuuugcuugaaugcccgaggucuucagucuuuuguacaaugucagccauuugaacgucucuucaaaguucuucugucuccugauuaccucccagccaugcggaggaggaggaguucugauccccuuggugaguugugcuacuauuuauuuuaaaauagaaaguugguuuuggcaaggaaaguuuuccuugacuacacaucguuucucugguuagguaugcucagcuuaacgggaauuaucaccauguauucuaauauuacagguaggaaggaauacgucauccuuagccucucucuucauaguauuuccaugcuucugaauaguucacuuuacugauguugguaacaaacagguauagggaauggugauuucuuuucuccucuccucuccucuccucuccucuccucuccucuccucuccucuccucuccucuccucuccucuccucuccucuccucuucucuuuuuuccccagugguuuauuuucaagucuaccaucuaauauacaaauuuuucuguugugaacagauuucucauuuuuuucuaaaacaguuauaaauaauuauauuuucuucucaguguauuuugaguguauauugcuaaggcaaaagagagaaaaauacuguaguuuguaaaaguguaccuguauauuaccuaggcugagucugggcauuugaauucagccugggcaauauagugaggggacaacacaacagcauucacccccuaccccucacccccuuuucaugaauaaauguauucuguacuuccauucaccacuguaucauucuagcagucuucauggagacaucccaagggucaggguauaggggacuuuggggauagcauuugaaauguaaauggaggaacuaucuaauuuuuuaaaaaugccauaagaaaguauuucuucuuuucuacuccuuugucuauaauagaguagcucagaccuugacaguggcguuugcuaaacugaucucuuuccuccucuuccuccucaaccaccaccaccaccaccaucaccaugauuugguggauugaagcuuaugugaauucauucaagcuuauguguugguagauagucacaagaagcaguucaguuuuuuucuuucugucuuaaauuggcacaaaaauuuuuggaaucaguaaaaaaaauuuuuuuuuuugccuuaaggggauacugcauccaaccuggggagugcuguugaugagcucaugagacaccagccuacccucaaaacagaugcaacaacugccaucaucaagguagggauugauaaugguuaggaauuugaucuuuuacaaaguguccuagcuuaacugggaaggguauuuuaucugccuaauuucuaagccuugcuuuuuuggacuguucuuugcaaaaccaaaaguuauaaccaguagucuuuacaagaguggacuuuauguugauuccauccuuuuuauuuauacugaaucauuuucugaauuaacacaguuccuuuguuuaguguaaaucuguuuguauugcuuucuuaugagauuaacaaauaugcaggggcuucaguuuguaugagcauccuugcuagcuucuuuucuugaauuuuucccuuccucauuucuccuuccuccaucaggaguggauuauuugauucugcauauaagauaaugaugauuuuuaaauuaggacuggcaugugaccuugugugauuuuuuuuuuuuuuuuuuuuuuuuuuuuuacuuuuuacacuuaaauuuuuucuuuuuaaaaaauggauguaaugguuaugcuucaggaguguuguguauauuacacauagaaaacucucacaaaaugucauuccuucauuauaaauaaguaauguuuuccucuuugacuuuuaguuacuugaagaaaucuguaaucuuggaagagauccuaaauacauuugucagaagccaucuauucagaaagcggaugguacugcuacugcuccuccuccaaggucuaaucaugcugcagaagaggcuuccagugaagaugaggaggaagaggaaguacaggccaugcagagcuuuaauucugcccagcagaaugaaacugagccuaaucagcaguaaguguuaauaggucagauucucuuuccuuaugauacuacuuaguaucauaauaguuuauggugaugguugugguggcacuucuaauucuacuauggcccaucucugaguuuggaggccagccagggcuauagagagagacacuggcuggagagauugggguugugggcucaauuuuuuuuuuuuaugaucagcaggauggaacucaagcaaagcaacuccauacccuuuaugucacuucagucuauaaaaaaguaaaaaauacaucagaucauuuuaaaguucuuucuggccuuuuagguguuuuguuccuuccucuguagugucagaguucuguguuguaguagcauugguugccuuugaaaauugcuauucuuaaaauuuuaguucaugauguuaaaucagaauucaguauuccaaguaauauaugaaacuuuuauuucaaauguggaagcaaugucucuagacaggggucaauauuucagcugugaguaagaauaguuuugaucugguacuaaacuggcauauuggagguaggaaaauagucuaguagaguaugaauaaagcccaggaauagcagaaguaaaaagaguuacuggaacucagcagugcacuugguggugucaguaauuuuggaggggagucauuacuuaaucuccauuugccugagacagcaggcauaaaucucuaguguuguccucaaucuaccauuaagaucauguuucuaaaagagggagacauucugacauucugaaauuauggcauuucucaauacaguauaaagaaguuacaguauuuauucccaaucuccaauugccaguaacccugcagagcugauuugcuuuuccuguucacaaaugaaaaaaagauuuguugaauguagaauguuguugguggugauuacaaaucaaguuguguguaucugcauauauuagaucuuagaucuaauauauuccaaauucaagcugcuguuaaaguaaauuaacaucuucugaauauuacucauuuuucauacuauuuuccuuacuugagauauuguauaucauuauccacauuuguuccucauuccagaacaucuuccaauugggaaaccaagcuuauauuuucccauaugcugauucuuuucuguauuaaucuguuucagugacuccuaucucuauuuaauagaauuaucaaagaacuuuagaucaagugccugucaacuuucucuuaucugcccucuuuccaguucacauuacccccccccccccggcccuggcccugcucgcuccaggccauagguuuuuuuuuuuuuaauuuguuucucauuaugagaugacugugagccaccaugugguugcugggaauugaacucaugacuucuggaagagagucagugcucuuaaagcugagccaucucaccagccccccaguuuacauucucaauuggaccuacaaauuccuguuucuuugccucuauccuucuucaaaugccauagguauauauccaaauguaauuuuuauauguauguucaaauauuucuccauccaaaaauggagcuacugaucuuacuucuauuauacaugaaauaauuuuguauauucaaaaauacccuauaaauacaaugauaauacaaaugugcaucuaaugcauaguuucuuuaauuugguuuuacuuacuguguuuugggaauuuauccauauuaguaacaugucucuguagucuugagugcguuguauaacuaugguuacauuuauuuaguuuuccucuuaaugaacuugguuuuuauuuuccugaggcuaauuccuuuuuauucuuacuuuuuaaagucaugauggcuuaugaaugauagugaaauaauaguuuuuguuggauguguagaauaagaacgcuuagguaguuuaggucuaaauucuuagguuucuaaugugcuauucacaaacuaaggucuugcuuugcagguaagaguagcugggaauucauuguacaguguccucaaacucagucuucccucuucagccuucuuuuuuuuuuaaacguauuuuccucaaugacauuuccaaugcuaucccaaaauuccccuccaccccccacccccacuucccuacccacccauucccauuuuuuggcccuggcguucuccuguacaggggcauauaaaguuugccuguccaaugggccucucuuuccagugauggccgacuaggccaucuuuugauacauacgcagcuagagucaagagcuccgggguacugguuaguucauauuguuguuccaccuauaggguugcaguucccuucagcuccuuggauacuuucucuagcuccuccauugggcacccugugauccauccaauaagugcugaggauuaugacucuguuucuggccacucuauggucucugaaacaagccuuucaaguccuacaaagaggcuuuuugauucuugcugcuuuucagggcauaguguggcauucuccuacaugacuuagguugauaauaaacaccauaguuuaaguuuuuccugguccuaaacugugaggagaagaggggcuggaccugguuauccaaccaaggccuguguucccuaacagucccugcaagugccugucagucaguucuucauucuaaaugaugggcugggauauggggaauguagccugauaccuccaggcuguugcaaauuuucaagcagcacucaaaauuuuaaaguacaggcucaugauccuugauauuaaggaacuuuuaaauaauaugcauaagucuguggucugugcagcucuguagcauuuguuugagagaauagagauugggcagaggagaauuggacaauuauaacucauuuacaaaaacagacuuuuguugcucagggaugugacugcuucaaauuagguuaaaccuaggcuuguagguagaguuccuuaggagauaacugaucauuuuuauuuuuaaaugauguaguaggaaagaacaauagauacauauaugaaugagucuguuccuggaguuauauuaagaacaauacuguugguuugucuuuuuuuuuuucuacagcuuccuuuuuagcaaugaaaggcacaccugggauucauuucguugcauuaaccugugcucuuuacuagaucauauuugacauauacaaagaggcaagaauuccauuggagugguaucuguacuuguaguuuuagagguggaucuuuagguucuuucuagggaggugaggcuuaguugaaaaggauaauuaauugauuaauaaaaugcugcaguugugcauuaucuaggaaauguucuuuucaauccuggcuuaaagauuuccuuucuuugaagggucuuaguccuuugaaggacuuaacuuucucagagugguaugaauacuuaagcugauacugaaaaucacacagcacagugccugauaaauuguggggaaaggacuauacuaguuuacuauuauuucuugugccuuuuguugucaacaaaggguaguucagagacccagaaagaccuaagauaaacuuugcaauguaaggauuaaaacagccucucagauuucaccaucaucucauuaucuaauuugguaauguggccauuugaaguuccucacaaggccagcacugccacccugcuuuguacucuguccagaaggcucuaaugaaguccucuuccugauuugaacagcacuuucuguagguacaaagggccauuuccuuuagugucucuacugcgauuuuuaauaauauacaaagcagggaaaaugaaguggaauccaauaaaauccuuuuauuaauaaagaucaaacaaaacaaacaaaaagauuuccacuuuuuguacaaaggucuuugcccaugggacuagaaaaaaaagcuggauuugccgcucuuaaugaagacaggacacaguauucauugaguuaggcggcuuacaaccacuuguaucuccaguuagccugcacucacguguauacucacauguaacauaaaguaaauuuuaacaagauucuuuugcaaguccccucccccaauuuucuucauuuaguguauauguguauaaucucauacacacaugugaaaggucagaggacaacauucaugaguugauucucugcuucccuggaugcugaggacugaacucaaauuguaaggcuuguauggugaguacuuaccugcugugcuaucucuucagcccuuuuaaaaguugaggaucuuuauaaaauccuuaacccugggcuggugagauggcucaagcggguaagagcucugacugcucuuccaaacucuucaugaguucaaaucccagcaaccacaugguagcucagaaucacccauaaugagaucugacucccucuucugguguguuugaagacagcuacaguguacuuauuauacauaauaauaaauaaaccuuuuuuaaaagccuuggauguuucauuacugaagcuauucuuaaagcuucuuuguucuuuuucacuuuucugcuaaauguuuucaugguugucaauuuuuauaauuugucagauaugagaacuauuagcauuuuaucuugcuugucucuuuuacuaucuuuucucucaacaccacuaucucuguuccuccauugccaccucuuacucagaucccaaggauacauauagcaucaucauauguuguuuccuacuuaaguuuucuucuuuucugucuuuaugaguuacauuuucuuuucaucucaguacaguauauaugguuguuucccccucucauuuucuugcaaaagacaauuuaaucuaaagauaccuuuugccgggcggugguggugcacuccuuuaaucuuagcacuugggaggcagaggcagguggauuucugaguucaaggccagccuggucuacagagugaguuccaggacagccagggauauacagagaaacccugucccaaaaaaacaaaaaagaaaaaaauauuaagauaccuuuauaaaucuauaaccuaauuagcauccaguauugaagaauuugaaaaagcuaaaaaacaugauaaauuguuucauaauucaggaacugucauccugcaauuacaaauuagcaguaaaaggaggccuucgaaaaugacuuuagcuuugacuguucauaaguauuugucagucuuaagcauuuuugauuuuuugagauaagguuucuuuguguaacagccccugauuuuucuggaaccgacuuuguacacuagccuggcccugaaagcuccuccugcccaugccucugccucuuuaaguacgaggauuaaaagcauaugccacuacuccuggcucauaguaaagauauuugaacaaaaccaaaaauccacuucuuucucagcucuuaaucuaacauaagauuaugacuguuuuauguuugcuucauugccugguccuucccuguaagcacauguuuggucuuuuaauucaguuuauuuucaguauuuuuauaauguugaauuuuuuucuaacaguaauuucucuuagaaaggaugugucauuugugguaaguauaaaauugcuauauuuuuauggccuguuuauuuuauacucugaacucuaccuucauuauugauuucagcucuuuuucuucaugucuuaguuuuaagguucauauacuaaaagaguauauacucuaggagcaugacuuauuaaaagggcuucacuuuuuuucccuuacgcuggugcuaugaauuucuguguaacugauucuuuucucuuuaacagggucguugguaccgaggaacguauaccuauaccccucauggauuacauccuuaaugugguaagauucauuguagagcuaaagaugugugcuuuucaggaaaauacaucagguugucaucagagcaaguuacuuuuucuccccuaaugccuuuaguuaguaauuaucauuuuauuuucucaacuugaaaguaccuuaugugauaacauuguauagcauuuaauguuuauuuucucuagagcuauuaaaguacagaggaaaaggugugcaaaauuggaaauauuuguucuugccccauuuucaguaaaugaaccaguauucucagccuuuuuauauuuucaacugucuguucacuguuauuauuguacauuugaauuuuaacgagauuuaguguguuaaaccaauauucugucagaauuuacccaacauguuuuucccccauuuuaccccuuccccugccccucucugaaguguauggacguucccuguaucauuaagaaaaugugaagagcacuaaaauuuucccagaauuuaauauccacuuagcauuuauucuagacuauuaagcagauaauuuuucuugugcuuuuguguacauuaauacauuuuuucuaucccucaaagaucccuauuguuuugauucaaauccugauuccuggaguucauuuuauuuauauuauaaggaugcgugggaacuguccuaacaaauggaguguauauacaguuaagacauagaccuguuucugccacuaauucagaauguugcucugaacaaggcauuuagcuucucuuugcuuucaaauugacuucuggagugguuaaaaagguagaaugggaaggguuccuuauuuucuggaugaguaugugcuaauuauuugucccuguuaauugaagugguauuacagaaaauaacugaugucuugcaaauacguugucccuauccugauccugaugaaguaaaacugaccuuuuacuuccaaguguuagccucuaacuuguuuuuaaaaaacuuucaucaccuagaugaaauuuguggaaucuauuuugagcaacaauacaacagaugaccacugucaagaauuuguaaaccagaaaggacucuuaccuuugguuaccauuuugggucuucccaaucugcccauugacuuucccacaucugcugccugucaggcuguugcaggugucugcaaauccauauugguaagaaacaucuagcgaaauauuuuacaucucuguauguauuuucauuguguucucgcuuaaggaccucuaguuaaaaauugauaaauuuguguguuuuauauuuuauacuauuucccauaguaaaauuauuuauuuucuuuguuuuugcauuugcguguaguuuugccauuugaauucauaugcgucuaaauuauuuccaggaaagcuuucuagcuuucuucauguuguuaugguacuguuuuuuuguuuuaauaugcgcauucacuuugcaguguucguuccuuuuccccaagcuuuauuagucauaaauugauauguaauuuauugcuuaaaauuugccaaaaacaguuucuuuauuucuacaacaccuuugauuuuugcaaguuacuuguucaccccuaaugccuucaguuaguaauuaucauucuauuuacucaacuugaaaguaccuuauguaauagcauuguauagcauuuaagaguguuacagugacacuaaauauuuauuaauuuugucaguuuccuuuuuaaagcuaaaugauaaaaaaaaacacaagaaaagcuaaaugauauuuuaugaaauacacucuagaucauuuuguccguuccucuguuacuggacacugagguugcuuuuauuuuagccccugaugaauacuguuauaaacuugaguguauaaauagcacuucaagauuugccuuuugaaucuuuuggauauauacuuugaagugacauaacuuaaucaaaugauaauucuauuugugugugugugugcuugcaugaaaccuucaaaguacuuuuccaagauuauuuuccauuccuaguuagcgccacauaaggauuguaauuucaccauuuccaugccagaucggucggucggucggucggucugucuuucuuucuuucuuucuuucuuucuuucuuucuuucuuucuuucuuucuuucuuuccuucuuuccuuccuuccuuccuuccuuccuuccuuccuuccuuccuucuuucuuucuuucuuucuuucuuucuuucuuucuuucuuucuuucuuucuguuuucuuaaauaauagccauccuugaagauaaaguagugcuucguuuucauuuugacuugcauuuccuaaauaauuggugguauugaucauaacguuugauuuguguacuugaguuauugucuaugugugcauccuuugcuaaacgaauacuuguguucuuuauuuuauauuuaaucaaauuaagauguuuuucuguucauuaucgaauaucucuguauauauugaacaccagccucuuuuuuucagauacaucacuugcaaauauccucauuuugucaguugccuguuuguuaccauugacauacuaaagguuuugaugcugaccaggcccauuuugucuuuuguuaucguugucauuuuuguuuuuugugcuuuuggugcugauccaagaaauuucagacaguuuaauuccuauacuuuaaucuagauauuaugaguuuuuaauucuuaggucuugauacauuuggaguagagaccgaaaagguuccacuuuauuuauuucauuuguuuauuuuauauuucccccaauaucauucauugaaaagacuguacuuuuauuaaaccaucuccuaucaacacaucucuucaaacacaauuuaacuaaaaaauuuggaguuuucuuucucagcccaauucuuuuccauugauuguccaguagcacaauuuugauuaaucaauuauaacuaaucaaaaucaaauuggaaaucaggaagugugagaccuccaaauugaguuguguucucauaccccagaaauauuuuguuuuuuuuuuuggggggggggguucuuugaaaaguuguaaaugaauuaugagggaaauuuuauaucugccuccaacccagaaaaaaaaagauugggggaauuuugauaguaauuacaauaaagcuccuuuguuggcuguuuugugcagugauaaauaauuuugagaaacugcaauuuaauguuuuauuuuguuucacucuuugcagguguaaagugcuuucauaagagaacauggggaaaggacugaucuaacuaccccaccucuaagaugcucugugaggagggauagauuuauuucaagccauaggaaggcaaauaauuucuagcuuugcauaacaagugguaaucuuuaauugccagauuuuucuuccuuaacuugaaaagaaauguaauauuuggguuugucuauuaaaauaauuugccuuccugaugccaaucucagagucaccacucuuauuuuggaaagaagacaacuuuauagcucugaaaguacuucuugauaguuugacuagccucaguagcuuuuauaauaguugcuuucucccuuauuuccuucugcaccauuuguacugcuagauauagauacagcugcuuaauuuauguaacauuguaugagguugaguuucacaugcccucucagccuccucccucaacaauauuuaauacaauacuuacuuuauucaauuauugauuuacucauuagaaauaaauagaaaacaccauuguaauguagcucauuuuuaagauuuggaacuuugccuaacauugcuccuuucuaagcaaaauuugaaacuaaccucuuacacagcaguacaacaaacagucuuguuugacauuuucauguuaugauuggcucaucaagcuuaaaaauaauaugcuauuacacaaaguagugaaauauaucauuccuggcuucauauuuugguacugccauuuauaaauugagaaauguaacugacugaaauuucggagaguuaaguaauagucacuauuacuguaaauguuaagaacauaauguauguauuucauuacguggagacacauucauaauucuuguuucagacccugucacaugaacccaaaguucuucaagaaggucuccuucaauuagacuugauccuuuccuccuuggagccuuuacaucggccgauugaauccccugggggcucaguguuacugagagaauuggcaugugcaggcaauguugcugaugcuacccucucagcucaggccacgccucuguugcaugcacucacugcagcccaugcuuacaucaugauguuuguucacacuugcagaguuggacagguaagaauaaucauggggcuaugguuucagcuuaaagccaauaaaauggcaaggaccuauauccaucugcuagauuacuggcuugggaacaaauauaccuggagucauagcugaaagaaaugcauuauuuuuauuuaguacuguuuuuuuuuucugaacaauauaucugguggugguuguggguuuauauuuuaaauugccauggagcuucauucucuuauuuuuuauuagcuguuguguaggcauauacauuuaucauaugaauagaacuuuaagaaaaaccauaauuauuauuuuuuauuacuaucuauaacaaaugacuguuuuugcaggcaaaaauuauuugaguggccauugcaucuuaccgcuaucuuuuuaaaauagcaaauaugaaacucauuucauugcauuuauuuaacuuuuguuuacuuuugugugggccugauaacuugauggguuuugagcauaccauaugggauuuggggaggccagaggacaacuuuuugaaguccauucuuuuaugcuuuuauguagauucuaaguaucaagcucagguuauugggcuucccugguaccuauauuuaucccuaauccuucucaaaaaaauuauuauuuccuaaucucuauauaaguacauauagauccaacaguggaauggcaaaaaaaauuuuuuuuaccacaaagcguuuaguuagcagacagcaacaagaagaaaaugugucaaaugcuaugucugcauucuguggucuuguucauaaagaaaacugcuguggagacagggaagcuuccucaguuucaaaauaacugcuguguaaaucugaagacuugaguuuucuucuuuuuuuuauguuuuuuuuuuuaauuuuuuuucagacagguuuuaucuguguagucccaacuguccuuaaauucaaucuguagaacaggcuggccucaaacucagagaucugccugccucugccucccgagugguagcuaggauuaaaagguuguacccccauguccagcaaagaccuggguuucaauccucagaaauucuguauaaaugccugacaacuuugcacaugcuuauaaucccaacacuguaaaaaauaggugcauuucuggggcuuuugggcuagccaaaaauugucucaaaaacuuaagguggucagcaccugaggaacagguuguuuucuagccuccauacgccuagauacucguacaugugguaacagaaguacaucuccuggcucuguguuuguguauucacuauuuuuaccauguuuaugucucaguaauuuauuacaaaaaguuguucaacaguuccaaaacuggguaagaguacguuuucuaccagcuacacuauaauguagcccagacauugcucgcacucaguauuucuugccuccaaaaaugcugggauuauaggcagaugauaucgaaccaaacaguaaagguugauauuuuaaaaauauaguauuuuuaaaguauaauuguuuguagacagucucaaauacuuauccuuugguugcagagugaaauucguucuaucucaguaaaccagugggguucacaauuggguuugaguguucugagcaagcuaagccaguuauacuguucucuggugugggaaagcacuguccuccucucucuauguacccccaacagguaagagaaugcucauuucucuuaacaucucucuuuguuuuucuaauagacaaaguuugaacaggguggaugaguuugauuaaaaagguccaguuuuuuauccuuccuaccuucuagccuauggauuuaacugacaaauuauaacauccucugaauguuuaauaugauuuccuggagauaguuguguuagcacaaugcaaacaaaucuuguuuguugcuucuucaagaaucaaaauuuuuuuuuauugcacuuaggauagcuuaggugcucuuagagguacugcccaagcaguauauaaguauauaugcagaauauaaauuguaauagcacuuaauucuguuuguuuugguuuuuuguuuguuugauuauuucccuuguuguagccuaccaucuggaugugaauuuggucaagcggacaugcagaaacuaguuccaaaggaugagaaggcagguacgacccagggcggaaaaagaucagguaacuguaagaaaaauaaaauguaaugacuguuacuucuaaguuaugucccugugacuuccacaggucaugugcuuacugugagacuuagcucuccaucauccuuagucuucaaguugauuuuuuuuauuaaauuuaguuuuuguuguuucuucuguaaaaacauacacauauuauaaaaaaauacugggguaacaacauauuuugccaccaaacauuugagaguuaucugccugauacuuuuccuuaguauauuuaagagucucuuagauauauauaucuuuguuuuguaaaugccaagaguugacuauucccagcuuaugugcuacuuaggaaaguaaaagucuuucauguaguuuuuuauaaauacaagauaguguccugacaauuaugauaccuaaagguaugguaauauuuuaauuucauuuaugacuucucaacuuuuaguauaaauucucuguaaccuguugggaaaauaauuuuucucauuuuucugaauaauaauauugaucauacuggauuaaaugauuuguuaauggaaaacuuccaccuauuuuuacuuuuuaaaauggauacucaaaguuguauguauggcuuacauucuguuucuuuuagacaguagugcuuuggaauuaucuuuuuuuuuaauugcauugcaaguuccauaauaguauaaucagaaaucacauaaaauucucugaucuugauguagcaaaugugaaggugauaaaaaaaauuuccagagauuuuaaagacccaaguaccuaaaacugaaaaauaacgaugacgauucuauguauaaagcugucagauauucuuuaaaaugaauugaaauuacugagaaggaaaccuaagcaaccaaaaucaaaauggauauaucuuaaaaauaagagcuuacagcagcuguuuguuaggagucagaauaaguauacacagacuucugagguuaauuuugaagaaaauguauauuucaaauuuuaguccauuucaaauacaacucaauaaaauuuauuaagaacuaggaaugaaauuaaaauccugaaagaauuguuucucccaauaguuuacacucuuguuugggggcguggguagccuuggucagucuucacauuuuuaccaccucguuucuagcaauuugguuaacacucaagucacaauuccuuaaaacuauuaaagaggaauucugagguuuagaaauacauagucaaaguccgguaauccuuaccauuguggcuuaaaggcaaggaggauuagcaccucugacuucauacugaguguggaaccaguuugagaacuugccucuaaaggggguggggcuuugguuggagagaugucucuuuaagaacacuuugcuacacugucaugagaauccaaguuugucuuucaguacacauacauaauuacaauaauuaaaugcugggaaauacugucagaauacuguccagaauacuguccagcaguauucuauaauguucaauuuuaauuugaaaaaacuauaagauucuaccaggacuucuucagugauagcuucaaauaugauaccgguguuaagaugcuucauauccuuucauuuggagaugccagcaaguauuuacuuauuagagcuccagacauaaaagcauauuggugucauucuuauuguuguugugcuuuggauguggaagauugguuugguuugagcuucuuaagaacuaauugaaauuuaaauagggauaagcaccauagauaacuauuuuuugagacccuucaaaaauggauccugguaaguacuagcucugcauuaucuuauuacccccuuuuacuucuaaagauggagaacaggauggaacugcuggaagcauggaugcaucugcccaggguuuauuagaaggaauugaacuagauggugacacacuggcacccauggagacagaugaaccuucuucuucagauucuaagggcaaaucuaaaaucacaccugccauggcugcaagaauuaaacaaaucaagccguugcugucaggucagugacucuccauuuuuagaacucccucuuugggcuucagagcucuaguauuccucaaacaaguuaaauuggaaaaaccauauuuuaaauaagucaauguuguagaaauguugugacucucacauguacuuuguugaaucccuauugugucucaugcucuaaauugguugcuaaagauauaaaaggagauaacuucuuccugaucuuuaucuacucuuccuuuuaaauuuuacuuguuuguucuucaguuauugcaaauggcaucuccuauuauucugcuggaaugucucccaggguaccuuacugcugagucuaccagauacuuuuuuuuaaaaauaacucuuagcuuuuuauaugaccaagcaaucacaauuuucaccagucucauuuugcuuugauuauccagaaacauaguuucuuguguuuuauuaaaguuacuuuggcagcuuucaaggagccugcauuaaagauguaaaaugauuguguuugccaccuuuugccccuuuauaugauaccaucauucagaggaccuauuuuguauauuuauuaauaguuaccauuuaggauauaagaagaaagccgggcagugguugugcacaccuuuaaucccagcacuugggaagcagaggcaggcagauuucugaguuccaggacagccagggcugcacagagaaacccugucuugggggaggaaaaaaauauauauauacacauacauacauacauccauauacauacauacacacacauaugaaagugaaaaucuaacucccaaaagcagagaaugaccuucaaauccuaaagauuuuaucguugugcuuguuuugauaugaauuuuacuaauuaucccugaauugaaguaaaguuagaugauguuuguugguauugucuuagaacauucuaagguuugugguagaucagaaccauguuuugucuguuuccuugcugaucaggcauuuuguuuucuuaccuuugauagauuuuugagcuguuuugcuaucuguucauaugugaguaauacugagaaacagggcuugguugcauuuuccuuuugacuuaaauucauuuaaguuuuuagauucugaguaugccaaaacuuccaccuaggcaguagccuguuccauaauuaauauuauacaauauaaaauuauguagaauagaagaugaauaacuuuucuguauagaugcauaaucuuacuguuuuaagcgugaucuuuaagaauaaaaagguucuauuauuuaguaauuuacauaauuuguauuuuuuauuuauaacaguguucuguguguguguguguuuguaaauuuaaauauagaaaaggucuagugaaaugacuaaagugacuacaguguaaaugagaguuuaggucuuuaacacccagauggaaagucaggugugacaacauauuuccuguaaucccagagcucauguaaagguacaaggagagaacagacuucuuaaugguguccucugaccuacagacuuacuauaaaaaugauaauuauuuuuaaaguaugaggagcauaggugugauacuguaaauugugugaauacuuuauagaauuauacuaccuucuggguuucagcuucuuccagauuaggccgagcacuugcugagcucuuuggacuccuuguuaagcuuuguguggguucuccuguccgccaaaggaggagccaucaugcugccaguaccaccacugcaccaacaccugcugcuagaucaacagcuucagcccucacuaagcuacucacaaaaggcuuaucauggcagcccccaccauauacacccacuccccgcuucaggugaguuccuguuuuagguacaggaaguagaaaguggcaauaaaaaugauguauguuucuuccuauucuacugaggaaaaguuuagaagucucuugcuuucucuuuauauauauuccauaugaaguauuuuuauuguacuuaguauagagcauggaaauuucuaaaggguuuauuguuaaacaguauuuaaguaaccuucuaauucuuaauuggguggcagauaucacaggagugccaaacuaaucuuucaccuaaauacuuugcuagccuuuccuuuagauuuuuuuuuucacuuaauuuccuguugcuuuuuuguguguaucuuaaagauguuugucuuuucuuuguuuuauuuuuuaggcugacguucuucaucuguucaguuggauucaccucuccaaugcucuuugaugagagaaaguauccuuaccaccuuaugcugcagaaauuucucugcucugguggucacaaugcucuuuuugaguaaggaucauuugcuucacaaagaauaguuucuugaacuuugaucuuuccuauguggcuuaccugcucacagcuuucuaagucauuuauccugugaugcuaggauauauaaagagagcuauuaguuguaucauuuuguguuuuaugagcaagccauguauuuccucugaagaaagucugcauuucagcuagagaggugguugagcagagaagaggacgcugcagcuuuuuccugggacccauguucuaucuccaauaccuauuuggcaucuuacuacugccuguaacucauucuaggguauaugauuaccucuuccuuggcaauaaacacacacaugucaacaaacacucauaaaaguuuuuuaaaaaaaguacgugcaugaguguauauaggaucucuuguuuuuauauuuggcuuucuauuccuacuacuacacauuuuuuucuuugaguacaguaaauuugguuuuugucuguuuuacuuuacuuggccaaaacauuuuaagaugaacuuaagcaguuugaguggauuuuuuaaagucuuuaaagcauauguaaauggcauguuaaaaguaauaagaacuucacaugagccuaacuuaauacauaaaguauugaccuuugucaagaaagguuucuucugcaguaagaaagacaauuucagaaaaccacauccacucaaaaugcugaguuauggagccuaguucuauuggauacauauacaaaauaacucuguaccuaaagcucagggaagauuguagaacaagggguaggaaaauuguaagagccggguaucggggacugugaccauaaaguuuccccaguguuucagccuauacaugaauugaacagagaaaacaacaguagauguuccaaaguguggggagaaggccacaaggacucaaaccuauacaaaggucuauacaggcuauuaaggaaugcucagagugugaguuuucccuagggaagagcguaaauggucagcccugaaaaauuugcauacaauuaacauuauacagauugaacauguuauauuuaucaauauaugaguauacauguauaugcauuuauagcaacaaagaaagaggccaugaauuugaaagagugaguaguaguauauggguguaguauuggagugagggggagggaaggagaaagugauacaauuauaaccuaaaaaacaaaauguguacgaagaggauaaaagauaagguacaaguguauuagugaucuuucaauguaaaauacuaguuaauacucuauuuacauguuuugucuuauuugaauuuagaacuuucaacugggcucuauccaugggaggaaaaguuccuguuucugagggauuggaacauucagaucuaccugaugguacaggagaauuccuagaugccuggcuuaugcuuguagaaaagaugguaaaucccaccacggugcuugaaucuccacauucguugccugcuaaauugccuggaggaguccagagcuuuccacaauuuagugcccuucgcuuccuuguaguaacucaaaaagugaguauucuacauuuuaaaaccaaagggggaaaaaaacucuucaugcuagguaguuaucacuacacucuguccauauuaaaaugugaauuuugaaaaacaaauggacuugguuuucagauuagcuuuuuuuuuuaacaaaaaacuugaaguacaugcuucugauugguucuucuuguugacuuaaauguucccacccuaucauacccaccaucuacaugccagucuaacucuuuguuguuguuguaacugacucauuguggaaggggcaugucugugagucuuauuuuccuucugaggauuugaauugauggggaaagucaucauacacuuuucaaauggcuuacaggcagccuuuacuuguaucaagaaccuguggaaccggaaaccccuuaaaguauaugggggaagaauggcugagucuaugcuggccauuuugugccacauucuccgaggggaaccugugauucgagaaagacugagcaaagagaaggaaggaucucgaggagaagaagaagcaggccaggaagaagguggcucacgcagagaaccucaagucaaccagcaacagcuacaacagguagagugcucagauucuacacuuucaccuuauauauagacucuaaugcucaaaaauuuuugauuuuuaaccucgucucacuguaggcaagacugacuucaaauucugagaguuauuugccacucaacuugcuuguaaauuuucuaagcuuucauaccacugcuuuccuugguucuuaguuucucaaagcauuuuuuuccuagugaggaaagguaaaagguauggucccaguacuuugugcagaaaacauaucuauauuuucauaaacauauuaauuacauuguuuucaggaaccugcaaaaauuuuuuugguaguacugucaacuacuuucugguuaaacgauaaggcaaacuauuauagcuaaauauauucuccaguaaaagacuuuugaaaaacuauucacuaaaccuguaugacguuaaaauaauaacauuuugaaaaauaaagaccaaaaaggggaaguuucaaagagcauuuuaacauuauuuuucuuacuuuucuuacucuuugagaauuuuacacauguauuuuaaucauauagccaccccuccaaccuccuucccuaguuuccccaacccauuucccuccuaccuucguguucuauuuuucuuuuuuuuuaaauaacccacugagucccguuaaugcugaccgcauguauguagguauauggccagccacuggaacauagaaagcuuaacaguugccagacccugaauuacucucucuuccccagcagccacaaacuaucaauagcuccucagcuagagguggggcuuugugaaccccucaccauccuuaguugaauguucauuggcuucaucauguuucagguaacuacaacucuugugaguucaugagugcaagggccaugcauguccagaaagcagcauuugagaagcauuccauuucauuucccaucuuaagaucuuucugacccccuucccaccauacuccccaagcaagccuuuggaggguggguuuaauauggacugagcacuugaaguugcuuauucucaauacuuggaguaaaagucucugcauuaacuauugccuacaacaaaaagaaacuucuuuuaaaggcugaaugcaacacuaaucuauagguauaaauauugaaaaguuagcuuaaguacaugacuuucucagccaugggcuuuugaccagguauauauauuggucccuccuguggaccaauccucaaauccaaugaggaagcaguuaguuaccuccauaauaaucaugccaccauugcauggggucuguauuguagcaugccuggauucacagccggguaagucuguuaauuacuuuucuccccaagugaccuacauagcaguuucuggcacugugaaagcuagccagcaucgaaacauaaucuagcuccauuauaauuugauuucucuguguccuguaaccaaaguguguugcaucuucagugauggggucugaacaaccuagcuaaucauuggcaaccaaaaacaaagguaauauccugugcuguuuaaagggacacugaggcuucuugaauuauaauacuuaguaacauauuccaugccuggcacuaagauuuuuauuuaauaugauccaugucuucugggagcaauguuuucuacucgugcuagguacuuccucaaauuuuuaaguaugaaguuucuuuuauucaaaucugucuuauauauauauauaugccuugcuaugucuuauuauaaaaauaaguucuuguuuaggaauuuugagacuuuauacuaauauauaauaguauauauaauuguauucuuauucaggaaauuagucuauuuuaguuggaugcuaugguauaguuuuuuuuuuaauauacaaacucuuauagguauaucuuauuucacaaucacuuugugaucauugaaauccuugaucaguuuuguagauagauuuucuguuguuacaaguuucuaauucagaauacaggugccaauuuauacuucaguguaucucaaguuauaguaaccaucuacccuggccuccauuuugagaugaugaaauugagacauauugguucuuuucaucaauaagcaacuuuaauguuuggauauuauauaacuaccaaaaugaaaagaacauugaugauaaauuacuguucugacuuauaaguacuguuaguucacauaaacaaguuguuacuuauuuuuuuuucuguuuuuguuuguuuguucguuuguuuguuuuauuucucuguuaauguggcucugggcucuugguuuuuuuguuuuguuuguuuuguuuuuaauauagcucauggacauggguuucacaagagaacaugccauggaggcacuguugaauaccaguacgauggaacaagcaacagaguaccuuuuaacccacccuccuccaaucauaggaggaguuguucgggugaguugacacagaaacaucuuaacauuuuacuguauuacuuuagcugcugagccuuuuuuacccacguccuuugccuaugcuuuauguacuaauucugaaagcuucagaagcugcuaggaucuucuauucccuggccaugcugcauuuuuuuuuuuuuuuagugcuuuguuugcagaauucuuucuuacuuaauuuucauuguaaauuuccccauugucccuguagugguuggaacccacauaagccuuauuuugguuuaauuagagagaguaauauuccagucucauucccuuuccuuaugagaguuuguuuuaauuuagguuuuauuauuaggggauuuguauauuuauuggauucucuguuguuacuuuguaggaucuuagcaugucagaagaggaccagaugaugagagcaauugcuaugucucugggacaggauauuccaauggaucaaagggcagagucaccugagguaacuaaagucuaacauucaaaaguauguuuucccauuaaucuguguauuucugugaauacuauuuuuuguauucuguaaucacuauacaaugguaggaaaaguugggggagugaauacuuauucaucucaacguuuugauauacucagcuaacuuuuaucaaccaaaaugaagcugucgaugauucaaaugaaguauuagucuuuguugucaauaaaacccaaaauggaacuaguaguaaccagucguccaaacuuagcuauaugauguuacuuaaauuuaccacacuggaaggaaacauuggauaggaucuaaaaaugaguuuucuugagaauaguacauacgauguuauaaauuucaacugacaaaguuuuugggugcucuuagucuguuuuuccuauauugcauuaaccucuuuagcuauuauguuacauucguugccauguccuuuugaaauauucaacuuuuuaacaauguagaugauauucaaagacugaaucagguacuuaauuuuuuauucuuuaccucuggcauauauuaucccacuuccuuuucuaccuccaggaaguugcuugccggaaggaggaagaagagcguaaagcucgagaaaaacaagaagaggaagaagcuaaaugucuagagaaguuucaagaugcugaccccuuggaacaagaugagcuccacacuuucacagauacaauguuaccaggcugcuuccaucuucuugaugaguugccugauacaguguaccguguuugugaucugaucaugacagcuaucaaacguaauggagcugacuaucgugauaugauucuaaagcaaguugucaaccagguaaguucucaaaauaccggauuugguaguaaaguuguuuuacuguuaucugucaacuucauuucugaaaaagucuugcauucuacaccauauguuuauauucuggauuugaauucuuuuguuugcaaucuaacucuacuugguugucuuccucaauuuauuuauuucacacgaaaaauagucuucagaagguaaaagcagaguuacguagaauaaaagucuuauguuugagguaaauuacauuucauauuaagaaaauacucauuuuuuuuucccguuguaugacuuucugauggauauucaacccaguuuuguuacuauuuuuaguguuuguuuccucucuguucuaauuauuggguugggauaagaaacaaaguauccccaaucuacacuucgagaaauaucccuguagcauuuauuuguauaucuuuauaaauuuguaucacuauauguauuuaagucuuuaagauuuuguuuuauaaaaucuuuucuuggguaucauuuaaaagaagaaaucuguggagacaaugaaaacauaaggauuguuuguuagcuuuaaaaaaaaaacaaauggaaccaaugugguagguguaucacaggaauaugugugagggguuacuuacaggagcagaaagagcugaaugacaguuauaucacuaaagcuuaccauggaugauaccucacaaaaauugggaaccuggaacacaguguacuacacuaggcucaaaauuaucuuuucuaagucaagcaucuguuuuuuucuagacagcuggccaaagcauaaauuuuuaauaaauagaaagauaaucauaaggaaaacuagauacacaaucuuuuagugaaaugugugguuacacaaauuaaauuaguuugagggagguuaaauuuuaauaaagaucagugauaucccuauacuaauuuuaaggaauugaaaauuuaauaauuaaaacuaugcuucuauucuaacauuuuaguaguuauuugaaguaaagauuggcagaaucuuuuggaaguuuacuauguauaccagaaaaguuuuuuuuacauucaugcugguuuagaauucaggcuuucuguaauaaaauuuaagaauagcugguuuagcaaaguguaaaaguaauuaccugccaagaacccacaugguacacacaaaaaggaaauuaaaaaaagguguuuagaaugauuguuaaugauuaugucuucuuuugaaacauucacuaucauaaauagguuguuauuucuacuuuucugcaaauauauugagguuggagggaauauguuuaauauuuucacagacuggguuacucuauauguacaugacuuggcugcuuauuuuguguuuguguguguguguguguugccuuuuuuaggugugggaagcugcugauguauugaucaaagcugcucuuccucuaacaacaagugacacaaaaacaguuucagaguggaucagucagauggcuacccugccacaggccuccaauuuggcuacuagaaucuugcuuuuaacacuacuuuuugagguaacagaucuuuugcccuguguaauccacuuauuaaagaauuacccagcacuuagcaauacauugaauuggagagaaguacaaaauaugguccuuguauuucauguguaccaauagacuaaaaauguacaucaugagguuagggguagaagguucuguguugggaaaguuuauauauaucacuuaugaauauaaugcgagaagaacuuuuuagaacaaguguuaagucaaaagaugauggucaguuucugucauuguaguugaguauguacauguguaaaagccauauacacaccagucagauaccauuauagaaggggauuucuucguauagcauugccugucuaggaauuagcccuguagaccaggcuggccuugaacucaaagaaauccaccugccucugccuuccaagcacugggcuuaaagauaugugucaccacugcccgaaaguaaagaacugcauguuuaugauccucuguagcauuguaauauuuuaaaaaaaaggugauucauaggaucucguuuaaaaaaauuacuaauuuuuccuuucuagucuuuuucauuuaaauaaucaugauuguuucccuauaucauauauauacauguuauuuuuucuaaauaaccaucuauuguuacuuauaauaguuuucuguuaaaaagcaaaacacuuuaauaguacugcuaagaaucauuauuuauuaucuuaguuuucuuggaauauuuuaaugcuuccuuaaaaaucaaaaacaauuuaaauguuaaggcugcauagucacuacugagugguaguggugaugggaggcagaggcaggcagaucucuugaguuugaggacagcccaguuagucuacagggcuauauagagaaacccuggcuuacuaaaaaauaaaaaaaacaaaccaaaagaguguguagccuaggugacuauuaugccugaugcuauguuuaaucauuacaaugacugaggaaguagauauaacuucucuuaacucaugaggaaaccaaaauguagaacacucugaaguuacuaaucugaguccacauagcucagcucauagguaauaaggaauagaauuugcauuuaauuaguuguauaaauguuaaccuuuguuugauugucuuuuuuaaucaggaguugaaguuaccuugugccugggugguugaaucaaguggcauucuuaauguccuaaucaaacucuuagaagugguucaacccugccuacaggcugccaaagagcaaaaggaaguccagaccccaaagugaguggcucuuuaucuauccugguuuaacuucuguuucucugagacuuggcccuugaguuuagggucugaaucacuuuucugaagcauaugugaaauccugagaucuuuauuuagacaacuauaaaauaccugacauuuuccgaauuuguguaguuuucugccuuacacuaaauaaauaauuucuucuuagguggaucaccccaguguugcuccuuauugauuuuuaugaaaagacagccaucucaucaaagagaagagcccaaaugacuaagguaugugaagcacuaugucuuuguuuuacauggccauuucauuucuuguggcaguaguagacaggaaaaaguaaagaucagaagugaaaacuguaaaaucaucccacaaaaauacaacucuugagggauuucauuaguuaaguuucucuuuuaaaugaacaguucaaguuguuguuguuguuguuguuguuguuguuguuguuagcaguagcagcagcaccauugucaguauuuuuggaaccauuugguaaaggccucaagaucuuacuaugggaauuaguaugcucuuuggcuacuugaaaaaaacugcagucucucuagaaauauuuuccugaaacaaagauuguaguauuccauaauaucucaguaaguucuuagcagcauuuguuccuuauaucucucaugaucauaauucuuuuaucaaagauaauuuaaaacaaaaggaagaauagguugucaagauaggaaauugucauggguuuuuggcuuggaaaaagaccaagaaaugaagaaaggccucuugaaaguauauuaaaugcccaguacauuuuuuuccugcauuaguuuuaagcagcugucuacugauagcugcugauuauuuugacaauaaaaguugcaggaaauaugaagauacuuuaugcauuugcauuuuauuuaguaccuacaguccaacagcaacaacuggcgcugguuugaugaccgcucugggcguugguguaguuacagugcuagcaacaacagcaccauugauucugccuggaaaucuggagaaacaaguguaagauucacugcuggccgacgaagauacacuguccaguucacuacaauggugcagguacaugcucaacuuauaauguaaacuuuauugaaaaggggauaguccucucaggcuaaggaguaggacuuuguuuuuuaaggacagcuuuguuuugucugaauucuuagguuaaugaagaaacaggaaaccgacgcccugugaugcugacucuccucagggugccacgacugaguaagaacucaaaaagcagcaauggacaggaacuagagaagacacuggaagaaagcaaggagaccgauaucaaacauaaagaaaauaaaggcaaugguaugugccuuacauuuugcauuuguuuuuccuuccaaguaagugguugcucuugcuggauauauagcucaagcuagucucauucaaaauccuucuaccucaaccacccaaguaguuggaauuagaggugugcacuuuuuguaccaugcauuuauuuuuaauccuuuuuuuuguuuuaacucugaaagaauggauuuguuuaauuguauuuaguaccuuuggaggccagaagauuauaucaaguccccuuuaagccggacuuagagauagucaugagcugccccacaguagagcugggaacugaacucagucuucuguacaugaucuuauucacagagccauaucuccagcccccucauuaugaguuauauuaacaugauuuaagguaguauggcuuauuaucugaaacucaaagagacagagagauggucuuuuccuaagaccuuuacaucuggucuuagaauuagguguguuuuucagcucaagugauggcugauuauuuuggaaggagagagaucgagugaaaugucaaauugaaaacacuuuuuuuuuccaauuuguagauauccccuuagcucuagagagcacaaacacugaaaaagaggcaagccuggaugaaacaaaaauuggggagauccuaauccagggccugacagaagauauggugacuguucuaauccgugccugugugagcaugcugggagucccuguggacccagacacuuugcaugccacccuucgucucuguuuaaggcucacccgagaccacaaauaugccaugauguuugcagaacugaagaguacacgaaugaucuugaauuugacccagagcucagguuucaauggguuuacccccuuagucacccuucucuuaaggcacaucauugaggauccuuguacucuucgucauacuauggaaaaggucaguauuuuugaagucuugugccugucuguauauuuguuuuuuuuuuuuuucuuuaauguuccugguauguugugcacugaugggccuuuaaccauuguaaaaauuagaaaauagguucuuauauuuuagaacuaaaugaauauaucaguggaagaaaugaaaaaaauuauaaaaauauuuacauuaaguauaauuaagagauaaauaucuuaaucagcaaaucuuuguaccuccuaaagacuuuugcugaauucuuauucuucuuacuaaaucauuuucaguaaucauauaaauauuaguagguuucacccucuuucuuggaacauuagaauuuuuuauucuuccuucaagaugguuuugcaucacguguccaaaaucacgagacuuagagcuguuuaaggcagcauauuugaggucagugggggaagaaauaguuacauauagacagaauuugggcuuuaaaaaacccaaauguuuaaaaugcuaaggugauguauauacagaacaugauugaaugaagagaaucuuugaaagacuuaaguauuaaauugaagcagacuacaacaggaacaaaagaagauaaguagcaaaaggcauuauugguaaggcuacaucauuguaggacaguuucauggugcagaguaagagaaccuucuagaaauuuuuuuuuaaacuuacuuucuugguggcacaugccuuuaaucccagcacucaggaggcagaggcaggcagauuucugaguucaaggccagccuggucuacaaagugauuuccaggacagccagagcuauacagagaaacccugucucaaaaaaucaaaaacaaacaaaaaaaaccugugucuccacaugauauagucuagguuuaagaccaguuuagcuguuuaagcuguugcaguaguuuggcuaaauuacacugcaaggaagcaacugcaccaaaucugaaaauuuguugguauguauguacaaaaaaguacagugcccucaaaguccaguagaucuccuggagcuggaguuauagccuguuauaaccuguucaucuuggguucuggcaacugaauuuagugucucugcaacuguacacacucuuuccauuacacaucuacauaaucuauagcuaaagauuugccucaugauaaauauugguuauacaaaaauacauagaauauaauaucaagaaaauacaagucuaauaucaaggaguagacaacuguauaaaguauaaaucauggcuuuacauauaaagcaaaacuucuguauuuuaaauuaagaaauauaacuggcuagauaagccagaucuucuaacaauuacaauaugcuauacuagauaacaugaguaguuuguuaaaauacaauauccccaaaagauuauauauuucuaaaaguuuuuaaucgcaggauacuauacauaaauuugauagcucuuuuagcugucaucucaaagugaugauugacuaaauaaagcaugaagaaauuguucuauuauguuaaauauaauugaacuauuauagcuuaaaaucacagcauuugcggagucuuagagccuacacuuaaauguggaagcuauauagcauguguaaucagaugcaccucaauaacauucauguaagaauuuaguuuugaaaaccuuuaugacuuguauaugagacuuauuuuaauuguaaagagucuugaagaacaagcguaucuuucauuacuuaaauugacaaugcuuuuuacuagguuguucgcucggcagccacaaguggagcugguaguacuacaucugguguuguaucuggcagccucgguucucgggagaucaacuauauccuuagaguccuaggaccagcugccugccgcaauccagacauauucacagaaguagccaauugcuguauccgcauugcccuuccagccccucgaggcucaggaacuggucaguuucauuugcuacuauucuuucagaaaauucucuuuaggcagauauugagacauugguugagcauuugacuuaguaaauucuguauguaauucucaguaauuucucuuggccucuuaauacaacucccaaggauucacucuagucuuuaccuacaaaguguucauuuugaugugacaauagaaguuaaauuaacugcaguugguuucuguauagugcgaucauugaaaaacaauuguuuguuugggugacagaauccaaugaaaaguuuacagugcuaccuguauucuuaccaaaaaguuaaugccuguauuucauugaggaaguaauuacauuuauaucaaauuauggaaauauuuuacugaacagcuagccuaaacccaugguaaacacgaauugaaaggaaaaauugaaguaucucagcagaugagaacggucacuucuacuuggauuggauucuggauccauuucuaggagacuuguaggauauaugaaguuucucagaaguucauacagacauuuaaaaaauugugagauuguuuauugaaauauaaaaacauuucaccgggcagugguggcgcaugccuuuaaucccagcacuuggggaggcagagucaggugaauuucugaguucaaggccagccuggccuacagaguuaguuucaggacagccagagcuacacagagaaacccugucuugaaaaacuuaaaaaaacaaaacaaaauuuguuuauaguuuauaaaagguagauuucuuuacuauaagacuugaacuuaauuuuuaaagaauuauuucuccugcuuuuuauguacuacacaauccuuguucuggguacuuucuuguugauagugaauaccaguguucuauugucugacuuuacuguuuaauuuuggccuagcuucagaugaugaauuugagaaucuuagaauuaaagguccuaaugcuguacagcugguaaagacaacaccuuugaagcccucaucucugccugucauuccugauacuauuaaggaaguuaucuaugauaugcugaaugcuuuggcugcauaccaugcuccagaggaagguauguaucugcaauugguguucugaaggcuauauuaucucgcaugaaucauuucagcuagcacauggcuuaguaagcauuauacccacaguccuggaaucaaaaggugaauaugauagggaugacauaaauggcccagaagguaagaacaccugccacucuuguagaaaaccaggauucaauuucccagcauucacaucagccaaccucaaccacuugugacucuagauucagaggauccaauacccugggcacugcagucaccugcacacagaugugcaugcacaaacacacauacauaaaauuaaaucauuaaaaaacaauuaugacaaauaauacacaccugaagagacuuacuuacuauaaaauacaagaggugugagaauaauggugaguccuuaagauaauguguguaaaucuguucugauaaugguucuugaaugauauugaugaagaguuuacagagugucuguuguuugagaaaauaauauaccauaaacagaaagcugugaacaaaaaguucuugguauuuguucacacagcauugugugaucaaauaccaaaaauuuuuuuaaagauauauuuuuauuauauauguaaguacacuguggcugucuucaaacacuccagaagagggugucagaucucauuauggaugggugugagccaccaugugguugcugggaauugaacucaggaccucuggaagagcagucagugcucuuaaccacugaaccaucucuccggcuucccaaauuuuuuuuuauucuuuuauacccaaaagcaaaaaguauauuauuagugugacauggcuuccuuuucagaccuccauccuaauccuccuuuacaugugaaugauuggaaaauuauguuugauuugcuucaaacccaagguucuaauccagccaugcuuuuaaguuuuauucaggcuauaaauagugaaaugagcagugaucauaauaacuguagaacaaugugagacuuucauuugguuuuauucaucuuuacaauauucugauccuuuccuccuauccccauaucauuacuccaucuacaaugauuuagcucuaauugauguaccuauugacuggccucauauuauacaagccuuuugcacuaaauauguucguugggggcuugauagugacaguuuaaaaauguaagacuaaugaacugcuuuggucauaagacuaauuaauguuggaauaacaaccaugcucugucaguaaugauaggcauacauuuugagaaaugcauuaacugauguguaaacauaaaggucauuugcucaaaacuaacuuggugguauaccgugcuauaaacauagguuauauuguauauaccaauaguuuuguugguucuacaacauaauuauugcacuaguacucuuaaaugcagcccuaugaacauugugcuaauauugcacaauuaaaggaccauauuuuaauuuagauguuuguuuauauuuuucuagcagacaaaucugauccuaaaccugggggaacgacccaagagguuggccagcuccugcaagacaugggugacgauguauaccagcaguaccggucacuuacucgucagagcagugacuuugauacacagucagguuuuuccuuaaauguaagucaauuucagcuguccuauauuuuccuucucuuuccacugcuccuacuuucucaguaucuuggguuauccaaaggaagcuuuaaaaguauaaguuuugucaguaugaugguucgcaccuuuaauugaucccagcauucaggagacagacguaagcagguuuuuaugaauucaaaaccaccuuggauuacauacugagacccuguuuuuagaaaaaguauuaauuuuaauauauguguaaauuauuuauugcagaaaaguaagguauauuaggcauuuuuacuuuugauuuuguuuuuuguuuuuguuuuuucuuuugaacuugacuagucugaaaacugugauagcuuccuauagauuauagggagaaugugguugaaagaucaacuaagaagaaucuguagcauucucagacauuacuuguaaaaggagucauaacacuuguauucaucacagcucacauguauucuuucagagucagguuuuugcugcagauggugccccugcugaaacuuccacaacuggaaccucccaaggagaggguaauaauuugccuuucuuuauuauuugcugcaaagaacacuuaaagaaacugguugucucugcacuagaguagaauaauaggugucagugucauauuuacauuuguuuacucaucuaagugauuucuaagggcugugucugaucuucugcagguauaggcugcugaaguuaauagaacuguaauuugcauuaacuugcuaauguugcuauaaugauguccuuugguuguauuauuuguacuaguccauauguccuuuuguucgauucccaugagcuggcuugcauaguguuugugccauugacaugauuauagcaauacacuuuuuguaguugauuccuuuaauagagcuuuaaaaauaaaauuuaggagacacuucgguuaauauacuaguuccaagagauuaaaaggugagaaaguaagcuaucuuaccuuccacaggaccugaguucaguucuuaaaagccacaugucacuuacaaucaaccagucauugaaauaauggcuuccucagaagcuuggauuguaaugauuaagagcucuaacccauauuuguucuugcagaguacccgaauucuuuucccaacacuauuucugguggcucauagcuuuuuggggcaucuuugcucauacacauauccacauacaauuaaaaauaacaucaauaggauaauugcuaaguuauuuuacuggccuuacuaacagcauauuagucaaagaaaacugucuuugcccuuaguauguggcaugcuauauuggaugccuaccuacagcuuaagaauuuugucaaaugagggagacggcaacaauuguaacuaauggaaugaacacauacuuccaugagauauagagagaccaauauuuccauauguaucuagauggcacuugaguugaauugcauaguguguaguaggcaaaagaaaggagauggauauuuaaagaauuacuacuaauucauuauuucuaggacaugaaauugcauaaacaucaggaaauagugggugccuggauguuugguccaagccuuccuacuaugucuuaugcauauucaucaucuuugucauuuaacuacagugguaauuagugauuuguacaaguggccuaaaaugaagaaauacugucuucauucuaccuguggcuugguuuuuaauguuauuccaguguaaaauugaguguuuaccuguuuucucaggagcuucaacuccagaggagacucgagaagggaagaaagauaaagaaggggaccguacaucugaggaaggcaagcagaaaagcaagggcagcaaaccuuuaaugccuaccucuacuauccuucgucuucuggcagaguuggugagguccuauguugguauugcuacccugauugcaaacuacagcuauaccgugggccagucugagcugaucaaagagguaauauuuacaguuuuuucuuucuuugauauuuugguuauauccuagacuguguuggaaacuauaauacucauugaaaggaaagcuagucuuuucaccaugaugugaagcaaucagaguaacugcaaggaaacaguugaugaaaucuuuuguaucuuguuuggcuugacaaauuuuuagauucuucuuuauuugagucauuuuucuguuugucacuaacacuguaguauugcuauguaaauuauacagaugcauaucucuuuggugauguaggcuuaagaauauuauugcugagcucuagaacaugaauuuauauagcuuuaacagaugcuaccugaaguuuaccaggguguauauucuaguaguuuaugagaguucugauugucucaccuuaugccaucacauauuucauuuuauuuguuccaguugguuuguuaguaguuuugugguuaggauuugcauuuucuuauuggccauauuuuaauguuuuuugguuauugaaaaaggguugguugguuaguggugagacucuuuuguuggccuuaaauuccugggcccaaucuuaccauccugagccacucucaagaauagcuggaacuaugcuugaaugccaguuaacacuuggcuucaaguguuucauuagauuccuuauacauuguauaugugagcccuuuuugucauacauacauucaacguguauauacuugguuucauaucaaaguuuauauucauauguuuuauuccuaauuuauggaacaaaacauuuaacuauaaauguauucgguauccugcuuauaacuuacccaaacauauuauagguguggcaaggugguuuauaaauaacauugauaugacaacuccacuuuagaguuauuaguagaaguaucuccuuagaguuaagagauaagauucagagauacaagugagggcacacuguauagggccagaaugaaaauugaaacccuugucuuugauucuaagcuaagugcuuguugugugguuacauugaaauucuuuucauauuguacuauaugacauuacuaagauucaagaaguuuuagcuuuguauuucauugagguugaguuuguccaguucuccaaucucuagaguccugaaguauacccuacuuauugauauaaauuugacauaaaaucauuauuaaaaagugugaguugagugacauuuaaaguguuacacagcuauuacuucuuacucccaaaaucuaccugaaaaauagaaccuaauucuuuuccuaaaaaucagagcagaaauuauagaguaaaagaaggguccgucuuccuuguuagacccuuuugcaauuuuuaggugauucuauauuucauuccgcucccaguuuucaguacagggucucaggcacauugcaaguguuaaaaggaauuauagaauacaaaaauggauguuugaauccucuacccuugacuaaauucuuagugcaagcuacuuuucuuuaggucucagauuauucuccucucaaauggagaaaaugcuugauuuacuucagucuauuuuauuggcuuguuauaaucaacuccauuaaagucacucaaauacaugggcuggaaagauagcucagugguuaagagcacuagcugcucuuuuagagguucugagaggucaauucucagcaaccacaugguggcucacaaccaucuguauugagaucccaaugccuccucuggugugucugaagacagcaacagugcgcucacauaaauaaaauaaauauuuuuuuguuguuguuacgaauacaaugguguuagcugucucccggaaucccaguacucuagaaagucuaccaagcuagccuaggcuaggcuauaugauucccagccucagauuuuuuauuauuaagauauaucaaguauuguuaccugugguggugugguggcacaucuuuaauccuagcacuagggagacuuaguggccacagucgucuauauaacaaguuccaagacgagcuaaacugugugagaggccacaucucaaagauaaaaaguagaaagcaacaugauaauuccaugacugucugugccaugugguaagaaauagauggaaucuggaagcuuuauacagccucuuaaagauuucuaauugguucacuacuuaccuagcuuguaccuuggaugacuugaaagaaaaaguuucuacuuugcuauuauagguaugguguggauuaauugcacuuuugaguaaaugucauaauuaaugacuuuucaggacugcagugugcuagcuuuuguccuggaccaccuccucccacacacccagaaugcagaagacaaggauacaccugcccuggcacgucuauuccuugcaagucuggcugcugcggggaguggcacagaugcucaaguggcccuagugaaugaagugaaagcagcccugggacgggcgcuugcuauggcugagaguacagagaagcacgccagguaaaagcccaugucuggccuaguacugauaaacaagaacaucuuuuacuccauggucuaaggaguuccuugaacuugaacaagaguuguguucacaccaacaauguacauagaaugucugguacccauggucaauugaaguagauauugcaacuuagaaaaaucgaagggauauuuuucgcuauauucagacacaaaauugagauuuuaaauuuucuguaguaaacaaagucuacuaacuagaaagguaauucucuuuguagauauuauuuccagaagaaaaugcaaaaggcauaagagaauuaucuaaggcauuauauauaguaaagacaucuuuuacaaaugggcuguauucacuugacagagguaucaaacuucucucccagacuucaggcagugauguguaucaucaguacuaucauggaauccugccccuccaccuccagcuucuacaguagugcuacagccaagacucagcauaauggcaugaacaacaucauucgacuguuccuaaagaagggacuagucaaugaccuggccagaguuccucacagccuagaccuguccagguaaaguaauauccugugguugguaaggaaucagcugcucucguaagaaagcaucagauguaggugaaaauuaugaugucuguacuaaaaguggauagauuuuaguugguuuuaauguuauucuugauacuuucugaaaugaugacugcuuuucuacaaaagucuugccuucuagauuugguggaguugcugccuugcaguguaauuuagccaaacuacugcaacaacuuauaccugucuuaaacccagacuauaucauguggaaacacaggguugguuuuuuguuuuuuggagacaggguuucucuguauagcccaggcuggccucaaacucagaaaucugccugccucugccuccugagugcuuggauuaaaggcaugugccaccacacccggccacggggcuuguuuguuuuuuuuuuuuuuuccaccuaccauuaguaauccuuguuaagacugacuacuaagcuggaaccuacaaucucagcaguuguuuugucucagccuucccaccaaguacuaaaauuucauguauacacauaucaugcacagcuaacauuaaauuuuuuuaauugucuaaauucuucaaacucagguuaagcucaauaauaacacuuauuaacagcacucccuaacacuaccauuuuuuuaagcuuccaaacucaagucauuuaaugguauaagucuauaguuacaucuugguaacacuuuuguuccauauguguuuugauuuucuggagcucaguucuuagaaauuaauuuuuuaaaacauacuauuuaacuccaaauacuaagcaauuauuccuaaagaugaaacauuuauauccuaaaagcuugcuauaugaugcuuaauaaucauauucucucugaucuauauucauauguucccaguuauuuuaauugucccuucaacagccuugggaguguguuuugauccaggauccaaaugaagaucauguaugacauuuuguugucaaaaagccuaggcagcacuauaucuucauuuguagauuugauccccaauguugcauaaaucaagguugguggcaaauagcuauaacucuagcacacagaaggcagaagaaaagggaccaagaauucaaggcccaccuggagcugcauaaaacagucucaaacaaaaaaaacuauugcuuuucuuugcacuuuugacaaugcugaagaauucaggguaaauguguuacagaugauugccugagucuauaugugauuuccccauuauguaaauaauacaaguuaaacauuuuaagaaaaaaaaaacaauaauaauaugauaugugggucaacuagccuucaaugauuaaacaauccuuuuauauccuuaucaccauaaguucauucaucacucucucaucaguauucuuguuacuuaaacaguucauauuccuuuuauuuuuuugaaaacuuucugauauaaugauaucccaaccucauuugugauguccaugagcuuugguucacuuuaguguuaguugguaucagagauuguggccagaucuacaggauccacaugaccucucuaguuucaguggugcccaacuuagccucauguuacaucucuaccugcaaauacuaugauauuuucacugaacucuauaaauccuacauuuuguagacuuaaaaguggucauuguguuuuuaaagacuaaaauaggugugugguagcauauaucuauaaucccaguacuuggaauuuguaaggagaaucagaaguucacugucuucauagagacuuugacuagccugagcuguaacuacaugaggcugucccaaaaaaaacgauuaaagacaaaauaaaggaguuuggagauguuuuuguuugguuaauuaguuggaaugggucuggguuuuuuuuuccuugauaaucuaagaaguauugauauuuguagucauccagaauuuauucuggcuucuacucaaggauuucucaugugcuugucauagcuucaugaaauaugacaucgacuuaacuuuugcuuuacuggguuuuauucuuaaacuuaauggaaaguugaaaauucuagacuuugcgcccuuuucucucuuagcuuccauuauaagaaccuguaugcuuaugagauuggcaccuauuauuucuauccuuaguucuuguaucuuucuuuaucucagucccaauauggccaacacagucaaugcugcucuaaaacccuuggaaacacuuucccggauuguaaaucaacccaguagccuuuuuggcagcaagagugcuucuagcaagaacaagucugagcaggaugcucaaggagcuucucaggacuccagcagccaucagcaagauccagguagggaaucagaaugaauggacugcaaaaacuggaugggugggaguuguugcuuguggaauuaaacuguucuagcuuauuguuguuuacccgggaacuugcuggucuugcagauaucugucauaaugguguggaaaucugucccacaaggaauuucuucacauuacagcuuuguuuggcuauccucacaugaagccaagucuuuuucuucaucacacauucauuuauauuuauacucugagaauuuguaaauuugccuaaagacaaaucacuguguucaugcuugccucaugaugcccagcauauaaacaccuuuugauuauuuauugugcugguugguugauuguuucaggcgagccuggggaggcagaagugcaggaggaggaucaugaugucacucagacagagguggcagauggggauaucauggauggggaggcugaaaccgacucaguggugauugccgggcagccugaggugcucaguucacaagagaugcagguagggaggcagaucauuccaacauucuucuguugcggugcugaaccaaacucccaaguguugugggugggugaguacuuuagaucuugccucaauguggucuucagaggagcacagaaugcuuaacauguguuuaaauuguuuuaguuaaaauggggcuggggacagagcccuuuggguaugguuucuuugauuuacuuggcucugaucauuauugaaaguuacuuagcgcuaucuuaugccaugccaccagaucucacuggaguauuuaaauaccagucuucuaaggauuuuaaagaaagcaugguaauuugguagcaguggguaagaaauuguuccuguauauagcagaggauggccaaguaggccauuuaugggaggagaggcccuuggucucgcaaagauuauaugccccaauacaggggaaugccagggccaggaagugggaguagguggguuggggagcagggcggggggaggguggguauaggggacuuucagagaggaaacuaggaaaggggauagcauuugaaauguaaauggaaaaaaaucuaauaaauugugccugugaaccuuagcugcuggcucuaaugugaucugcauguauuccuagacaguguuaaaacacuaaccugguauuuguugaccaggauacagacagugugaguguggauuuauuggaagcaugugguaggcucuguguuaauagcaccaauuaugugguuucuguguaacauccuaucacauauuauagaaacauaugcucccuugcuggcuuuauaaaaggguuuccgugcuagcacaaugauagacuuguugugugcauccauauguauguucucuuucucuccagguugaaaaugaacuggaggaccugauagaugaguugcuugagagggauggcggaucugggaacaguacaauuauaggugagagccccagaacugaguaaagccucuuccuuugucucagucucucuugggaggaccauuuuucucaucaucugcuugcucagcucugccuaagggcucauagccagccuagauugcugcuugucuugauguugaugaucuuaacagaaaagaaauuaacaaguuguuuauaggccuguaacaggucugaaguguuguguaugucggguggcggugaggguaacaaucaguauagaugauaacaucaggcacaccaaaaguguuuauucauggaggccuagaagaggcuguaggaugagaaaaugcuuuucuuucaguucuucaaugaaauccaggggcuuuuugccuuugugucuuaaaauguaaaaaagaguggucauuccuuaaggauggccccuuuuaagucucaaauggaaaaugacaaagguaaacaaaccagcugccaccucacugugaagguguuuauauuuuuauuuuacuggucaagaaaaccaaaggauuaauggaacuaggcauguauucuuaaaagauacaaagcuuuuucacauccaucguacucugugauugcacaauuagugggauuggcaagacagaugugaucguuccauuuuacagaugaggaaacugagacucagacagguaaagugacuggccaagcucaucuagauaguugacagcagagaaucgagguauucucccucaucggaaaaagaaaaaggagaaaaaucaaacguggauaucuauuagguguacauagcuacuuagacgcacccagucuggaaagggaaguccucuguuguucagugaaggcucugcucuguaaccuucagugagcagaaguggagaggaugaaucacaagaggacgugcugauggaugaagcuccuuccaaccucagccaagcuuccaccuugcaggccaaccgagaaggugagagugccgaggccaaaaaggccucccuucuugcccugcacgucugacagacacuacacuaggguuuuccuggaggcagcugcccacaugugcagaauaaggaagcaucugucugcaugcgcugacauacaccauccacuuuauccucagccaguuuuucaaauaacguuuuacuacugcuugcccaaaguuugucacuucuuacuugguucgcuuucuucucacccaccugcugucaucgcuccagauucccucuuaucaacaggaugcagucacuagcaaaauaggacuggaaaggcaaggggacaccaacagacuuggucaagcccuacaucguggcuccucaagcaccucccuggagccagcuuccacauuucagcaacccugcucagcgugucgaugcauuaauuggcacucucaggaaauuugggcuggcucacuaagucuguacaccacccuagaucugauucuuccucucuuagagucagauaccccaucgccuucccacucagucugccggccugcacaguggccuguuuucuagcuacucaguauaguccuccaaugugcucccuuuguuuuagauuccaugaauauccuggacccugaggaugaggaggaacauacucaggaagaggacagcaguggcaguaacgaggaugaggaugauagucaggaugaagaggaggaggaggaggaagaugaggaagaugaucaggugaggggggacuguguuuggguugguucagaugaccucuuccaugggagcacagaacuacagaaaaacggacaaucuggguuacuagcuagccucgucgccucccucccucaugugcucauguggccaugacaccaagcuucagaaaacacuuaccuccagcaauucuccaucucguauuuucccuuaaggaggaugaugaaggugaagaaggagaugaagaugaugacgacgaugguucugagauggaauuggaugaggauuacccugauaugaacgcuucucccuugguccgauuugagcgcuuugaccgggaggaugaucucaucauugaguuugacaacauguucuccagugcuaguaagauacaggggcucagcuggguuuuuaccuauugauucuuauacccuucucuaggguaaaccaagcagaacuaaagcagccaucaaucugauagaggacaccacuucuuuuacugucuugacaucccaggucaagggaugucugaauccaucucucuggauagcauacauauccuugcaagaaggaaucggaggaggcugcucuuacuaucuccaccucaguaaacagggagcucuuagagccuggacaacuugauguuuugcuugauugagaaaaugagaccaagucugacuacaugaggcaccugaaucacacugcagugacagggcaaucaauaaucuuuuauuuguaacgcuggaucucaaagguuuggauggacaucgcugagccuggcauuagggaguggauuuuauauauucacuguucaucauggauggaacugauccggagagaaaaugaaucucuccacuccuuuucuaucaacaucaacguuccuuuguagcgacgaguucuuagccucaagcugucuucaugggacaggucuuaccucaaaucacaagcauaauauagcugaaaacacuuuuaacaguuuuggucuguugucuuggccauaaucuuuuaccucugagccucaguuugucaccuguaaaugaaaagcaugaagagaaaaacaaaaugagcaguagauaauuuucaagauaucuucuaugauacucuuagaauuuuugcgguuuucgucaaccuuccuuuuauuugagccuuuguccauucaacaaaaugaaugaauaucugagaugugccuaccaguccuugguacuggggauaaggugguaaagaaaaacaggaguuuuuacccucuauaggaacuuauggucuguaaggaauuauaaguaagaagacaccacauuuaguaugcuaaugcacagaguaaagguauaucuaaccugaccuguuagacuuuagaaguaacaucuuggacugagaacaaaagaacaggugaggaagggaagcagagucuucuaggccaaggggccagcaucugaagugccuagagacaucacuguugucuugaaagugggcugggaaaagguaggauuacauugaggugguggcauaaccuaugguuguaucagauccugaauuaggugugagaaugagggagaaaggaaaaagaucacauuuccaugugagcaaagcccaggagacaugguucuacacaugaacagccauggaagaaauuuauuuuuggcacugaccccuuuugcauauuuuccuugcagcagacauucccccauccccaggaaauaucccuaccacccacccauugaugguacgucaugcagaucacaguucccugacacugggcagugguucuuccacaacucgucuuacccagggcaucggucgcagucaaaggacccucagacagcucacugccaauacaggccauaccauucauguucacuacccugggaaucgccagccuaacccuccucuuauacuccagaggugaguuuguguugaagcagaaucaaugagaaguuggauucaaugaagcucuuaagaauuauaacugaacuucaacauugucuugaccauaaggauaaacagucccucauaaauaagguugugugacccauaguaagugaaacaauuuuaaaaugaaagagugaauauaagugccuuauaaagguguacaacaaaggcauuaauaccuaacaugguaccuagcauaucaaagcuuccuaguguucaaggaacuaacuaaagaauaauaugcaguucaaucucgaaguuaucaaacugacaugcuaauaagaaugguaguaaagguuuagguucaguaugauuaaaaucuacccauaauccuauaaguuuacuagauguacaugcucgaucucaugguuaacagacuucuguggacuugaaagugaaagugguaccuuaccauuacccuacagguugcuuggucccucugcagcugcugacauucuucagcugagcagcagccuuccauuacaaagccgaggccgggcccgccuccuagugggcaaugaugacguccauaucaucgccaggucugaugacgagcugcuggaugacuuuuuucaugaccagaguacagccacuagccaagcaggcaaguuuauucaguaagagggaggauagaguucuuugauucuucuucaguccuaagaagaagaguagucucuuucuuggagaaacuacauuuuauaggagccaaaaccacuuggugacuuagccaaggacaacaacucuguugccucuggguaccuguuauguagcaaaacuuguggcagaccauggguucuuuuaggaaaauaaugcaguuuuuaggucaaucaacacuucauaaagccaagaauuucacuuuauuuuguucucuuauaggaacccuguccagcaucccaacagcucuaacccgauggacagaggaaugcaaaguucuugaugcugagaguaugcaugacuguguuucaggucugugacaacuugaauaucaggguaguaaugagccuuccggcuagaaugaguaugcagagaguuguuuuugauucucuggcuauuaacucugccucucuacuucucaaccuuuccaaaguagccucugauuuuuaccuuuuucuuguagugguuaaagugcccauugucaaucaccuggaauucuugagagaugaggagcuagaagagagaagggagaaacgcaggaaacaauuggcugaggaagaaacaaaaauaauagacaaaggcaaagaagacaaggagaacagagaucagagugcacaggugaggugacuccaaaagacuuaagagaugcagcauuuuguauuuauuaugauuuugcccugcucauaguacuaaacuacuagaaaauucuagaacauuacguugaacaugaaagauuguucauuuccagauugacuauuuacucaucugguuuuuaggcaaaaagaaaaaaaagucaaacccagagguaaauuauuucuccacuaccuuacuggggaaaugugaaccuuauacaauaguccuacuuuguaaacucuuucugaggccuaaagguagacucucacucagcucacauucuugguucucacuuccauuucacaguggacuuccagaaaauuuucccaccugaacucuauuaccaaacaacuaauguauauacauaaaagcuaauagaaacacaaaaaagaaugaaggcuguaguaugucccacucauucaucuauuaggauauuggguaauuuuuuucuuuauuugcauaccaaucaaagcuuccccucccuccucuccucgcagucccucccucuucucuuaucccuuucuccucagaaaacaggaggcugccaauggauaucaacccaccuugcuauaucaaauugcuguaggacuagaugcaucuucuguugaggcuagauaaggcagccaaaggcagacaacagaguaaggaacagccccugcuucucccacaagaccaagcuguauaucuguuagauauguggagggaccuaguuucagccccucugggcccagguuauuugauucuguagguuuucuugugguaucuuugaccuaucuggcuccuuauuggguaaauuaaaaauaaagacaugaggggcuagagauaaccacaguuucauucccaccaauguaacagcuuaaaacuaacuucaauccaggugugguggugcaugccuuuaaucccagcacuugggaggcagaggcaggccuggucuccagagugaguuacaggacaaccagggcuauacagagaaacccugucucguuaaaaaaaccuaacuccaguucccuggaguuucuuuguuuucagccuaaacaaaacaaaacaaaacaaaaaaucgccacaaauaccagguucaguucagagagcucuuaccccaaaauaauaaggcaaaaaaaaaaaaaaaaaaacuaaaauguacugggauugaaucagugguaaugugcuugcucuauauaagccaaacccacuuacuuauauguaggcacauacugcuacacaugcaaagaaaugggggggugcauuaauauugaggguauagcuuagugauagggcacucuuccagucuguacaagguccagguuugauuccuaacaugcuaaaauuagugcagacacauugagguauuuguuuauaauaacaggcuugcucuaacaaauacuuuuauuuauauaaaacuuugccuuaaaaccagcaacauuguauaugacuaaaaacuaaaauggacauuggauuauagcucaguggcaugugcaugguuugauccaaagcaauaccccaaaacaaagcuagaguggaaaaaauaauaaacccaaagaagggaaauagguggagcuaagaguuuccugucucacaauugugcuuauuucuaauguguucuuuuuuuauucuuucauuguucauuuccugcucacucccauacuuuugucuuuauguaaccuagugcauucuuucuaguguguugcuagagauaaaaaacuaggaccucacacaugguaaacuuuugaacucuccagcuggccuguauuccccaaguccucuccaaagcuguugaacauuaguauaguguauguaaaggaauuggauaauauuuuguauucugaaaugcccacauggccaggccacugaauuccuugauagucuagguaagaaauaaugacucucauauuugaccuuucuugugugcuugucucccauuacucucucuucucuuugcaguguacuguaacuaagacaaaugacuccacugaacagaaugucucagguaacccucccucccuuccacucuugcuaauuaaucaguggauucuuucuaaauagcuggccacaugggcugaagacagacacuggugcucugugggaugagguaguagauuguauaguuuuagggucauaccccaucuuggagauaacuauacagucuacugucuuucccacggugguacacuucccauccaacuagcccuguucaaguuccuguuacgguuaugcuguguuucggucugauauguacacaagcuauuuaucuuguucuuuucccccacacacucgguauauacaucuuugagguacauacuuuuguauggcacuucauuagaacaccugguggcagugguucucaguugccaguccucaaugaaaauuaacacagggaagucuaauauguguuuuagagcuagauuuguuccauucaaaagucuuuuauauuuagaaguuauauucuccuagaucuuggauaacaaacuauuguuacuaaauuauuggggguuuuuucuuacaaaaccaaaaguaaugccuaguuuaguccuuuucauucuuaaucuaaaaucuuaguggucuauggaauuuaaaaguuuuaagaacauugucuuuuaaaagugggguuuuggggaucauagcuuugugggauauauauauacacacacauacauacauacauacauuacauacauauacuucucauuccuucuaaucaucuuaacaauggucaguaaccauuuuugucauuggucaauguggucucaugcuugccucauaucuauucagaacuuucuucugcccuugaauugggagacuuguuuuaccaaagccuacauaauauuuuaaaagcacugaagagaauagcugucccagcgcucuuaauaucuagcaaaaguauaugaaagaaagaaucuaugcuacaagguaaaguggccuuuugccuacugcccuuacuagacacaucugcacaugcuggggugagguaguaaguuguauuguugugggguagggauuuuaggccccaguaagaagauaacuauacaacuuacuacuuuccuugguguguggcauauucacauuaagucuuggcaguauugacuccauuagagaaaaguuguaaauguuuauucaguaaacaggaauauaauaaaggaagguggaagggaacagaugauagagugaggcaaauaauguuaaaugacuugcccauauauuagaacauuauuauguuuauuuuaccauugaguauaaacuggacauucuucuacucuuugauucuaugauaacuucauuuagaauaugaauaugaagaauaugaauggaaacuguaggaauuuuuuuaauaagaagcaaggcauguugguucauacuuuugcaguucuaaaacuuuauaggcagaggcaagaaaagcaaacauucgaggacagccuuggcuuuagcgugagcucaguguuagccuaggcugcaugagacccugucuguaaacaacagcaggaauguagaauuaugaauaaauucugaccauuucuuguuccaaguagaucaggaaauguaaggaucuauaagcuuuuaggagguuuuuuuuuuuuucugaguagccuugaccuaucuaugguaugcaacuguucccuucuaccuggaacauagaaaggauuguacucucuagaucauuagagucauaucucugguguugagauacagauaguauuguuauuuagcccucauuauuaugauaugccauccaagaacuguuucugggaacagauugauuugagaaagauuuucaugacuuuuauuugaauggguccuuaccaggcugcaugugcugauuggauucuucccauggucauucgcuaaguuccccuuaaccucgaauaucauucuuuccaauaaagaugggacuccuaugccugacagcuauccaacaacccccucuucaacggaugcaccuacaucugaguccaaggaaacacuugguacccuacaacccucccagcaacagccagcacuuccacccccaccauccuuaggagagauuccucaggaacuacaguccccugcugaagaaguggcaaacucuacacagcuauugaugccuauagaguuggaggaauugggucccacaagaccaaguggagaagcagaaacaacucaaauggaauugucuccagcucccaccauaagugaguagaaugucaucuuuaaaagggcauaaaaaagaaaagaauugcaaucuuuguaacuuuucucugcuuucuuacuuuaaagaauuaggagcucagaauccucaguuuacacuccagcuuucuuaguagaagcucagauuucuucuuuguguccucaguuaauuauuguuguauaucuuaaugauaaguacuaagcaugccauaauuuaucuaggcaauacucauuucugaacuaacuaucaugucagguuuguuauuuaacuucuuugaaaauaauguuucagaguugguggugccuucauucauaaacugaaauucuauaucauucaguuuuccuaucauuuacauaccuacugcucacuuauuuaaaauagugcaucaaaauuuucaacaaaauacuuuuuuuuaacaaggcaaacugaaacugacuucacuauaccauaauuucuaugcuguggacuggagagauuuuuuuuaaagaugccaguuuuguuuguuuuugucagggacugucacaauuucuuuuccuguugcugugauaaaauaaucugacauaauuuuaagggaagaaggguuuauuuuacucacacuuugagguuauauucuaucauagcgggaagagucacagcagaaacuucagggagcuggucacauaucauuauucauaaaacaauacaugcaugcuucucagugccccuucuccaguuaaacagcccagggucccugggagugcuaauucccaaaugauguuuuuucaaaggcccauguccuaggcaauauuagauuuggucaaguugaugaucacaacauaaccaucacaagacaguaaccauuacaagagccuuuuuuuuuuuagauaacugagaccacuagcauguuuguguaacugguaccugcaggaaacauuagaguaacaaaaucccuacuucagauaucuagggacauuguagacguguguagaacaaacgugugguacauagaaaagucuuaaggaacuuaagggcaguugagauggaagagugggcaauagauaaucaagugguagaugagucuguauuaacuguugcaaaaggaaacaacccuaccaaagacuuugccugucauaaccuugauucaaaguagccaucuaauuucucacucuuaacuuccuucuagccucucuuuccccagagagagcugaagauucagacgcguuaacagcugucagcagucagcuggaagguucucccauggacaccagcagccuggcuuccuguacguuagaagaggcugugggugacacuccagcagcuggcaguucugagcagcccacagcagguaguuccacuccuggggaugcgccaucaguuguggcagaagugcaaggcagaccugauguaucaagagaauccaaccagccaccugaggacagguaaguacuauauagccaagaggagauuaggaaugcauuagaaguuauuucaagcuaaacacuaucaggcaugcuuguugcacugugauugauguguucuaucugagauggguauuaggaauguuuuuguuguuugguuuguguuugcuuuuuauggggaaacuguauaaagaaggaugauuucuuucccuagcucccccccugcauccucggagaguucuuccacuagagauucugccguggccaucucuggagcagauucucguggaauucuagaagagccacuaccuucaacaagcagugaagaagaagauccccuugcugguaaguuucuguuuccaaaaaaaucauugcuuggacagacauaacccuccaaacacuuuccuccaggucggugugugagucggggguggggguuguugaagauagacuagcaauaagaggaugcagguguugcgcguaauggaaugaguucaggcuuagaagucagguuagccuuagcucacucauucucuacuuuuauaaaauaggaccauuauuuaauaucucuaauccucauugacaaacacuauguuagucaguuuuccauugcugaaucaaaugucugaaauagccaacuuuuaaaagaaacgauaagcuuagcucacaguuacagaguuuucagucuuuggucaguuguuucuuggucucuguaguaagagacuacuauauaaugguggccacacacaaucuacaugaaagucuuuauaaagguugacuugacaguguauaccacuaaugaacuuuuuaaauuuauuugagcuguugaacuauuugaagcuuaggaagauggguuauggcucuucucuauaucuuugcaagcaguggaaacacaaauggcugauuuuccucaacccaugauuuguguuucuuuucucugaguauaccuuugaacauccaugaagauguaaguuccuuuacaucuuacaaucucuuuagguaucagucucccugaagguguggaucccuccuuucuggcugcucucccugaugauauccgucgggaaguccuacagaaccagcugggcauacguccaccaacccgaagugcucccuccucaaauagcucagcuccugcaguaguggggaacccugguguaacugaagugagcccugaguuccuggcugcccuaccuccagcuauucaagaggaaguauguaagcgggaacauggugagaacaguuuuagcuugaaaagagcuauacucuuacugauuucuuuucuucuauaggugcuagcacagcagagagcugaacagcagcgacgggaacuggcucagaaugcgagcucagacacccccauggacccugugacuuucauucagacuuugcccucagaucugcgccguaguguccuagaggauauggaagacaguguguuagcugugaugccaccugacauugcagcugaggcucaagcucuaagacgagaacaagaagcccgacagcggcagcucaugcaugagcgucuuuuuggacacaguaguacuucugcacucucugccauucuccgaagcccggguacacagggaggcaagugggagggcucuggaauaucuugcuuggccuuguuuuuuaauuagccuccuuuacuaccuguuaguuguuugaacccaguuucuccucaguucaccaaauucaguuuccuuuuucuuuucuuguagcuuuuaccagucgccugaguggcaaccgugggguccaguauacucgccuugcuguacagagggguggcaccuuccagaugggggguagcagcagccauaauagguacccuugucuuuuuuuuuuuaaaccucacuauacuaccuucugagucccuuaauuuuguaaguagagaagcuaaaagauuuuguggcggccaggaugaccauucugggcuauuuuccuugaaaugaguagacaagcaaaaucuguuuaaauuccaagugccacagcucaaaaaggcaggcuagcagcagauacuaguuaugguuuuaacaaaauaguggaggccuguuuggccuuaggacugcaacagauaugcuacagaaauaggggaggaguuacuuacgacuaacuaggaugaagcacaguagauuuaacauucuaaaacaauuauagaaaagaucaguccuuauaaaagaauggcagcuccuuaaucuagaaaaggcaaaaagcaagcuguggcucauagaccuuagauuuucaucacuuaguaaaugauaaaaauaugaaucucugcucucuucauagucauguaauaaagagcaaauuaucugauuuguuugagcuuuuuucacucacagucucaauaaugcuguacaacauccuucagggaaagaaguuguaaaguaccugguauaugauagauacacaauagacuuguugcuguggauuguuuugucuucuuuuacagucuuccugggauuaucccacucguucuucucucauguaccucauauacugauccuagugcuuuagcuaguguuacccagaaaccaugcucuguuuccaggccuucuggcaguaauguggacacacuacuccgccuccgaggacgacuccuucuagaccaugaagcccugucuugccucuugguccuacuuuuuguggaugagccaaagcucaauacuagccgucuacaccgaguacugagaaaucucugcuaucaugcccagacccgccacugggucauccgcagccuccuguccauuuugcagcgcagcagugaaagugaguuaugcauugagacaccuaagcucuccacaagugaagaaaggggcaagaaaucaagcaagagcugugcaucaagcagucaugagaaccguccccuggaucugcuccacaagauggaguccaaaaguuccaaucagcucuccuggcucucaguaucaauggaugcugcuuuaggcuguaggacuaacauauuccagauucaacguucuggagggcguaaacauacagagaagcaugcaagcagugguuccacuguccacauccacccccaggcugcuccuguuguuugcagacauguuuuggauacacucauucaguuggccaaggugaggagcuugaaggaauccuugaccccaggguuuuuugggcaucaacaccuugggugagaucuggacaguaaagggcuaacagaucucuuuguugauuuauuuuauauugugccauuugcuguuucugagaaauuguccaauaaauaacuucauggaguuuuaucucuguucuuuacaauuuuuaauguacuaucucagucaucgaaacaacuguuuacacucuauaugauucuuguuuuacagauaaagaagcugagauucagagcacuuuaguggcuuugucguuugacuagaaagugacaagcucaguauuuuuugaauaauaaacagugcuacuauguauugggggcccaccuguacuaggcaccaggcaaaaugcaucaccucauuuaauacuuugugucguucuccuuguuucauuaagugcagagagacaaaagauuuagaaagauuuuuaauuuugucuugcuucaaaguccuuauuuuuuuaggcugcuucaccaucuacuggauagaagucauauaauccaucugucuuguauuagcagagcuggaaaaggaauagucugagaagcaauugucuuuuccugucaggcuuauccuuuacagagacuccuuagaucgaaccuauucuuuucccugcagguguuucccagccacuuuacacagcagcggaccaaagaaacaaacugugagagugaucgggaacggggcaguaagcaggccugcagcccaugcuccucacaguccuccagcaguggcaucuguacagacuucugggacuuauugguaaaacuggacaacaugaauguuagccgaaaaggcaagaacuccgugaagucaguaccagugagcucugguggugaaggggaaacuuccccacacagccuugaagccucuccacuggggcagcucaugaacauguugucacauccagucauccgccggaguucucucuuaacugagaaacuccugagacuccucucucucaucucaauugcucucccagaaaacaaaguaucagaagugcaaacuaacuccagcaacagugguuccuccacugcugccaccucaaacacaucuacuacuaccaccaccaccacuacugccacugcccccacgcccacacccccagcugcaacuaccccugucacuucugcuccagcucugguugcugccacagcuauuuccaccauuacuguagcugcuucuaccacagugacuacccccacaacugcuaccacuacuguuucaaguaaguguuuaaagucagagcuaugggguaugggcucccaucuuacucucacuucccaauccagauaauauucucuaaaucauaauuauugugagaacaggauguguucauucuuagccuguuuucucuucauuccccuccccacaccaccaucuuccauguguaugguguaugcaccuguacauuuguauaaagccaaaccucuggcucuaccaaaagugguggaguuaaauccuaagauuuccagacuauacaauaauagacugaaugaaugcagugugcuuuaagauaacagacaucucaggaagaagagaaaauaagccagguagcagaggauucucggcagguauagguugguuaguuaguuuggggguuuggaguuuuuuguuuguugguuugguuugguuuuuuuguuuuuguuuguuuguuuguuuguuuuauuuuuuugaguaaggguuucucuguguaguccuggcuguccuggaacucacucuguagaccaggcuggccucgaacucagaaauccgccugccucugccucccaagugcugggauuaaagacaugcgccaccacugcccggugccuguauagguuuuaaaggauaaauugugggauaugauagagaaauacuuaggauuuuugguaaccuuacaaggcauaguuaagaauauagcucagugguagaaugcuuccaugguauguauaacauccuaaguucaauucucagcacaccaaaaagauuuggccuugauagguagguugucauuuucucugcuuugccauuuugaagcccuguacagugcagcacuuccagguuuaugacagucacagagcuuuaauguguucuguuuccuugaagcuucuacuacuaaaggcagcaaaucuccagcaaagguuggugaaggaggcagugguauagacuucaaaaugguguccucuggccucacugaaaaccagcuacagcucucuguagaggugagucuaagcucuuuauaccuucugaaauagaaggaaagggguagacauuucaguucucagguuagggcuuuuauuaccucuccuauauuuuaccuagguguugacaucccacucuuguucugaagaaggcuuggaagaugcggccaauguguuacugcagcucucucguggggacucugguacccgggacacuguucuuaagcugcuacuaaauggagcccgccaucuggguuauacccucuguaaacagauagguaauaauauuauucuauucugucuucuuauaagacacacacagagacacacacugaauuagaccaugcuccuaaagcucaguucuuguuuucaucuguggauuguuugagaacaagguugucugacuuucucaucaccagcaacugcuauauagcuggucaucugugcuuagugaaggaguaggggaauauuauucaugagaacaaaaagaccuacuuuuuuuucucccuaauuauuaguaucuacaagagccccaugauaaaguugcaauaacggcuuuuuuucaucuucaaagauauacguaaacuaugauaagguucaggaguuauacucacaauaauggccuccuuuguauaguuuugaugaugcaaaaguucuagcacuugaaaauuguccacgggugauacaugauuaucucauuguucuauagauagcauccuuugagggagaauaagaauaccacaaaaaccugaguagguuuuuuuugguuuuguuuuguuuuuguuguuuuucuguguaaaccggggcuguccugcaacucacuuugaagaccaggcuggccucgaacucggaaaucugcccaccucugccucccaagugcugggauuaaaggcaugcgccaccacgcccggccaccugaguagguuuaagagcuauauagauagaacauagaucaugauaugucuccagaaaaggcccuuuuuauucucuauaccaaacugcuuuuuguguagauucaguaagacaguccaaugaauugguagucccccaagugguugguccauagaaaaaacaauaaaccaaaugguaaaaauuucuguucacuuauauuuccugcaacaauguccugguaaaguucagcuuucugcuuuaaggaaauuucugaccacaugaauccucugccuaccccagguacccuacucgcugaacuacgggaauauaaucuggagcagcagcggcgagcccaaugcgagacccucucuccugauggccuaccugaggagcaaccacagaccaccaaacugaaaggcaaaaugcagagcaggugggugugggcuagaaucugaaacauuugaaaaguggcuuuggcugguuuuucucuucuguguuuuuucuauuuguucuauaacauacuugaccugguguuuuuaaaaacuucuccaauggcuaauacuauuuuuaagguuauuuuuucuaguuaauaccagaaucccuccuugcucugaguauuuauacuuugaugucaauauacauaagccaccucuacacuguacagguuugacauggcugaaaaugugguaauuguggcaucucagaagcgacccuuggguggccgggagcuccagcugccuucuauguccauguugacauccaagacaucuacccagaaguucuucuugaggguacuacaggucaucauccagcugcgggaugacacacgacgagcuaacaagaaagccaagcagacaggcaggcuagguauaaagcuagagugucuaauugaggguggugguggugauggugaugcugcugcuacuggggcuggggguggguccagagucccuggagaagcugggcuaaaauguccuguuuuguuucuauuugaccuuuccaaaaaagcaccaccaccccccuuuuuaucaaguguugauggcuguauuguauaacccauucaaucauucaccugagaaugaauagaucaaguuacaguugagggguaauugaaaucuggcaaagaaauggaaagaccagcauuucucugagaaaaacuuacaaaugugcuuucugccuccuuaaacacuccuaacuaaaauauuagccauguucucauacauuggcuucugucccauagaacacucuacaugucaccauccauuugucuggcaauccccugcucuucucuacccugggacuugauuaugaggauacaaaacugccuaaacuaaaacucaaauucaacaagauucccuauggcauccaugaaagaagaaaagaauuuugggcauucccacuuccuacauuuuauaucaugccuuuccccuuuuccucuuucucccagguuccuccgguuuaggcucagcuagcagcauccaggcagcuguucggcagcuggaggcugaggcugaugccauuauacaaaugguacgugagggucaaagggcgcggagacagcaacaagcagcaacgguuagcaugaugccuguggccccucauucauuucucuacccuccuuccugcaccaugucaucaguggggguucauugcccauaccuuguaugcuuuugcauuacguuugcuaaaugaaugccucuagacaacaagguuacuuucuguugguguuucucuugcuauucauugauuguuuuacugguuuguauugauugauaucugguugaauauaaagcuuggccaucauaccucacucccagcuauccaguuagcaguguuuugcaaauugucuuaugcuccaugccuggguucugaagggauauaggguuaaaaaaauuuaguguugugaaauaauguagagacaacuccaaaguccccugagcuugguauacauuaucuauggccacuguuccacccuauccuuuaaucucagcacuugggacaggggcaagggggaucucugugaguucaaggccaauuuggucuacauagugaguuccaggaccagagaaacccugucucaaaaaauauaguauauuacugaucacacuggacauaguacaggauuuggggaaugacuccagcagcaguaaaaagagaaaauaaagagcugcuauucuuuuuuaucugcccagucucauguccuaccugauaaagacauagcuuaaauaccccacuuauggaagauuauacugaguucaguuugaacaaauagaaauagcaggaagcauacuuucugccuaccuuacaaguauguauacaaacagaaccugguccagaaaaaccuacaauuuuugucuauauucagagcaccaguguagggguagagugggaucugagagggaauuacaugggagcagcuuauagagaaugcagucauccgggagcucuugguucauagugaaaaagaagcaugcuugucauucuuuugaccuagagagcuauauacuuugauaaccagauaggagaaaguaucuucuaagcucaaagugugagacuuucaggggccaaccucuaauuccagagaaaagcagaguugcaccuuuuaugugaccuuuucuccuuuuauccagucggagucuucuaaccagucagagacaucuguccggagagaggaaucgcccauggauguggaccagccaucuccuagugcucaagauacucaguccauuggucaguacuacuucugcuuguuuuaaaaauaaaaaaguuuuaauggaucuauaaauguucacaagauuauaaauguagcaucagccaagacaacauaggaagaaccugucuuuaaaguagcagauuagugccuggcgagaugagucagugaguaaagggcauuuauacuugucaccaagccuugacaaccugaauuugagccccagaacccacauagucaaagcagagugaccacaaauuuuacuccaacauguacccuauguguuucugcuaaauaaauaacauaaagcugaggcaagauugagcugcucauauaccaagccuacaguuacauagugaaacuaucucgaaaagaaaugaaugagcuggcuuagcagguaaggguacuugcuacagagccauuaccaaguuugacccccugguaucuuuuuuuuuuuuuuuuuuuuuuuuuuuuugguuuuuuuuuugauuuuugguuuuuuggagacaggguuucucuguauagcccuggcuguccuggaacucacuuuguaaaccaggcuggccucgaauucagaaauccaccugccucugccucccaagugcugggauuuuauaaaggcgugugccaccaugcccagcuaucccugguacuuauauggcaggaggaaaaagaaauuaacuccuucacauuuguccucugguuuccacacaugugagggcauacacacacccauacguauacacauaacaaguuuuuuuuuaaauaaguggggaaauguuaauguaaaaagaaaaaagggagccauauaugguggcacaugucuuuaauucuaguauucuagaggcaaaaguaugcauaucuaaguucaagacuacuagccugggucuacauaggaaguuucugggcagccagagguacauacugagacccugucucaaaaaaaaagugcaguauauuuuguguguggggugggggcauguucaagucuuggcucccuaguauauuuuguguguggggugggggcauguucaagucuuggcucccccguuuucuagcucugaguuacaaggcauaagcaguacuauuugggaugggaaacagcccaguguccacuguaggcaaagugcuucccaugggggaugauuucaauccuaggucaugaacacccaacaugguaacacacacucuuauaaucccaguacuaaagaaagccaagaugggcauaucucugggcuuagguuugagguugcugaccaacuggccuacccuauucagugagcuccagguuagugaaagacagguagauccuagagcaguacucagucuaugggucaagaccacuuugagggucaaaugaccccuuucauaggguucuccuaagaccauccaaaaacacagauacuuauauuaugauucauaacaguagcaaaauuacaauuguaaaauagcaacaaaauuuaagguuggggacaccgcaacaugaggaacuauauuagagaguugcagcauuaggaagguugaaaaccacugaucuaggggaauaauaucuaagauugaucuuugugcacauauacacaauuuuaaaaauauuuuuaguuaaaauaggaauaugcacaguuguuaaaauuaaauaauuuaauauguguguaauacuuaaccaaguaccuggcacauaguaaauauggcauuuuucaauaaguugcauacagaauauuuuuggugcccuuuaaacauauuacuuuaaaauaguguucucauaggacauccaguuuugaaaugcuuuauuuaauuaucuggacuuuggggggguaaauauuacucccauguucuguauccaucuuuuuuuacccaaggucacacgaucuccacgugcaacagccagaacucaaaccuagggcuaacagagccuugaagaauaguuaggauuugguuagaggacaaaagugaaggucaggaagaagccuaagcaaagcagggaucuuaugggguucugguguugcuucucuauuacuuagaagauucgacuagacuugcuacuuggcuauuaagcaguugugaauaaacuuccagagaggauagaaaaaaauaacaaccauggagaggagggagguguucaucuugcacuaaggcuucuuaagggcuuuaagaggcaugagacuuuuauuuaaaauuauugagucaaaauaucuauuuuggcgcugggcauaguggcacaugccuuuuaauuccaacacuugggaggcagaggcaggcagauuucugaguucgaggccagccugaucuacaaagugaguuccaggacagcuagggcuauucagagaaacccucuguguguguguguguguguguguguguguguguguguguguguguguguuacccuagccuuaucucuagggaaaaaaaagaaauggagaaggcaaccugauugauuacaaaggcagaauuuaucagaauuuaaugaacauaauuucuaaaacauaauuguacuggaagacaauuuuccaaaguuccauuguagcacauugcccuuacuuaacauaagagguuccuucucagcuaagggggcaaugacaagacuauacaauauauggccuuugaaaauuugaaaaagagagaaagaauugcccucucuuaguuaacucugguacuugugauuugucuuuauaauuaauugccuguuuugcuuuucugacauccucuuuuuauuuguauuauuugaggagucaaauuuguuauuuaauuuaccuucuagauguuguucaaugauuaauacucauuggccagugagcccagacugucuaguguccugugcuuuuguucugggaaaaacucucaaguaagagagacacucugcaaguuuuugacuguccuuuguguaucuaguaaucucagauggaacaccacagggagagaaggagaaagaggagaaaccaccugaguuaccccugcucagugagcaacugagccuagaugaacugugggacaugcuaggggaauguuuaaaagaacuggaggaaucucaugaccagcaugcaguauuaggugaguugcucucugagguuacagauucccagccccuuggucugcucuuggacacucucugucugguaauggugcuggcgauuaucuugcuuuuucagucuaaguuuguugaacucccucugugugucuguaacaagaauucaaaagaacugcccucucuuaguuaacucugguacuugugauuugucuuuauaauugauugccuguuuugcuuuucuaacuuccucuuuuuauuuguauuacccugcaaguuuaaauuauucuauguuuuauauuugugauguguuuaugggaagguuaaacuuuauaaaguuuauguuaaacuuuguaaagugucacuuugcugucauugcuauccuccagugcuacagccugcugucgaggccuucuuuuugguccaugccacagagcgggagagcaagccuccuguccgagauacccgugagagccagcuggcacacaucaaggaugaaccuccuccacucucccccgcccccuuaaccccagccacuccauccucccuugacccauucuucuccagggagcccucaucuaugcacauuuccucgagccugcccccugacacacagaaguuccuucgcuuugcagguacauggaacucuuagacccauagauuuuaucccuaucuaauuaagcaaaaugagagaguuggcaaacaugcuugcauacuaacauccaacacacacuuuggaaaaaaaauagaccuaguuaauuacaggagaguucugcuauagaacuucuuagauuccuugcguuccaaaggauuuggguuuuauuguaaagcuagguguuauaaaugcccauucaucccuuaggaguguagcccuugccuuuagcuauuuccugauuuaggccccuaaaacaaauaaaaccaaguugguugcuaguagacuguuuuguaguuucuuaggaccuauaauaugcugauuccugcuguuaucuuuucucucagagacucaccgcacuguguuaaaccagauacuacggcagucuaccacccaucuugcugaugggccuuuugcugucuugguagauuauauccguguccucgacuuugaugucaagcgcaaguauguacccugggauauauuggggugaaggacuauauaaacgauaccugugucaccuuccaggggaaaaaagcuauaguuguuccuaggguuauaaggguuucuuggugguacuacauuucuaaaguccccucucagccuuuagagucauagcagcaguaauauagucaaaaugagguucaagacuccuuccuugucaucucuacuccuucuuauacagauaaaugugcuuucuugauuguugcagaaaucaaauuggcucugugaucucucauucacuagaaauaggaaaauuuugaauucguaauaaaugaucuagcccagcugcuauagacuuuccggguguggggggguuaaaagaucaaagggaacaugucacugugaguuuuccuucugaacagacagauauaaguuugcuuuaaucacccccaauccuacuuccuuuccuuuucuacauccuaagauauuuccgccaagagcuggagcguuuggacgaagggcuccggaaagaagauauggcagugcauguccgccgugaccauguauuugaagacuccuaucgugagcugcaucgcaaaucuccugaagaaaugaagaaucgauuguaagaacucaggagagaaaacagcuaagaugauucagggccuauaugcuauaucguagcagugaccuaauguggccucaaguuuaggggaaguggucacaaaacucccaguagcauucuggcuuagauaauguuaauugagcuuccugcauuuggacuuggacugcugacuuagucaccaaguuuuaggcagacaaggaugucuuuaaugccuuugcagugcaagcuuaauauauuauuaggcuaggaauagaaauuugccugcaaagcagauugguaacccuggguuugggaggcaccaugugcuugagugccaccccccacuccacccccagucaguaauuguucacuggugaagccaccuggaagaaauugauagcuuguagccauaaguaucacaguagcuaaugagacagauuaaaaucauggucucuccugguacucuguuuacuucuucaucuaacaguggacucuccaaagucagauucacagaaucuuucucccuuacaugaugcuacaugaauggucagaucuguccuggcuuucugcacagcucucuuauuucugcucuuaugcagguauauaguguuugaaggagaagaagggcaggaugcuggggggcuccugcgagagugguacaugaucaucucucgagagauguucaacccuauguaugccuuguuccguaccucaccuggugaccgggucaccuacaccaucaauccaucuucccacuguaaccccaaccaccucagcuacuucaaguuuguuggacgaauuguagccaaagcuguauaugacaaccgccuccuggagugcuacuuuacuaggucuuucuacaaacacaucuugggcaaaucugucaggugagauuaugguagccuuuagacugccuuuuuagcccuaugacucucuuaucuuuaucccccuuuuauuucuguuccucaagccaugacccuaucuaauugcauuuuucuagguauacagauauggagagugaagauuaccacuucuaccagggccuaguuuaucugcuugaaaaugaugucucuacauuaggcuaugaccucaccuucagcacugagguaaguugggggauuacuuuggaacugacucucuguaucaacaguucugagaaagcacuuugacuucaucaaacaggaaauagaauugguaaaauaguccaagcugucuccuaguuucuccucaguggguaagagcacauguuuugcaagccuuauggccugaguucagaucugacacccagguauggucaugauugagugcuuggaacuuuugaauacacagugcuuggggagugcaacacaaaagagaggaucacuggagauaggcuggcugccaguuuaauucuagggagagaccuugucuagggaauaauagugcagaacacacagacaacauccucuggcuuuuuuacaugugcauauuaucgcauaaacuuacauucauacacacaugaaauaguuuuauuuauguauaugcccauguguucagguauauacaaaccagaagugagcauugggucccauggaguuacagggcucugaaccaccaaaugugagugcugagaaccaaacuugagccaucuggaaaagagagcagcuugcacuuuuaauacugaacuauaucuuucuagcuuuaauuuuuuauuuucaauaaaaguuucagagccaguaagauaguucagcagguaagccugauacuuugaguucagucccagggcucagugugguggaaggagagaacugacuccugaaaauauccucugauacacacacacucacucucucacucucucucucucucucucucucucucucucucucucucucucucucucucucucucucaauguaacauuguaacaugcaucuguaacucaagaguuggagguacaaagacagauggaaaaaaucagccaaaucaguucauugagaaacacucaaagaaagguagaacaugauaggggaagacacucuuugagcucugcccaugcccacacguacacuguuccagugcauaauucagucccaaggacaguucaucauagaaacaaaauuagaauuacccuuuucuaacuuguuuuagagccaaagauuaauuuccuucauuccauccuucagcuuuuucucucuggaacauggcaaggaguuaggauguguuuuugcaccucuguguuacuuguagcccaaaccaaaccugauguguaugauugguaucuuggauguucuagguucaagaauuuggaguaugugaaguucgugaccucaaacccaauggagccaacaucuugguaacagaggagaacaagaaggaauauguacaccugguuugccagaugagaaugacagguaggagaaguguccuuuagauagaccucugcuuguucaaggaaagaggucagccuuuuauuuauuucacauuuuuuguucuuauuuccuaugacauggccacaaauaccuugcacaaaaggagucagaauacuugaccaaaguacuuaauuccaucuacuauaauauaagggccuagaaacagugcuagcuaaggcaggcagauuucucaguauaagguguugucuuaggguuucuauuccugcacaaacaugaccaagaagcaaguuggcgaacaaaggguuuauucggcuuacacuuccauacugcuguucaucaccaaggaagucaggacuggaacucaagcagaucaggaagcaggagcugaugcagaggccauagagggauguuccuuauuggcuuccuugcucuggcuugcucagcuugcucucuuauagaacccaagacuaccagcccagagaugguugcacccacaaggggccuuucccccuugaucacuaauugagaaaaugccuuacagcuggaucucauggaggcauuuccucaacugaagcuccuuucucugugauaacuccagccugugucaaguugacacaaaacuagccaguacaggugucaaacugaggcuguauuaacucuguucaguuguaugaguucugauuccaugucacuuuuuuuuuuuuuuaaaccaggagccauccgcaaacagcuggcagccuucuuggagggcuucuaugaaaucauuccaaagcgccucauauccaucuuuacugagcaggaauuagagcugcucauaucagggcugccuaccaucgacauugaugaucuaaaaucuaacacugaguaccacaaguaccaauccaacucuauucaggugagcggagguauccccauacucuugagaaguaugaaacacuuaucagugcugguuuauggauaacaguauaccuaugccucuuuuuguucuucuggagcugauguucucaccuauccugugaaggaacaaaauauuucaaguccauugccauuuccuuaaauuucuuuacaagcucucuuuggcuuuuugugugucucuucuuacagauccagugguuuuggagagcauugcguuccuuugaccaagcagaccgugccaaguuccuccaguuugucacagguacuuccaagguaccccuacaaggauuugcugcccuugaagguaugaauggcauucagaaguuucagauucaucgagaugacagauccacagaucgccugccuucagcucacacaugguaagaaaacaacuuaaaaguuucuccuuuucagugauuuuauugagguuguagacuugaugacuucuagacaccuacccaagauugggagcacaaguauggccuagucuacaacuuuauaaagcucaguuuguuaggucuauggaggaaguugaggugagcagauaggcuaaacacaagagugauggcuggaaagacauuugcaaauagcacuuaagggaaucaugauguguuccaaagcuuugucuggcugggcaagggcuggauauacaugguucaacugguuaagagcuccuuccuacucacaggaacagaauuuaguucucagcaccuauggaggucaguuugugaccacuguaacucccaccugcaaggucaauaaugaccuccuccucuucuggauuuuauagguaccuccacuaacaugcauauacaucacuagugaaccaagauaccuccuuaaaggcaauuauuucuuaggaaauguaaugauuggaaauguguguaguucaguugguuaaaaggacuuuuccaacacaauaccaugauuccguuccucauaccacauaaauuaucuaggagguaggacaaucagaguuugagaccagccugggguacacaagaccaggucucaaaaauaauagaaaaagcuaaaaacuagaugaggggcuggauuagcagcuaagauacauacugcuuuugcagaagauucagauucaguucccagcacccacaugauggcucacaaccaucuauaacugcaguucucaguucucugaugccuucuggcaucaacaaacacacaguaaggugcacauacagacagacaggcaaaacacuuaauauacaugaaauaaucuuguuuuaaagugaagccuuaagggauagauuaaaauuuaccaacucacuauauaugugacugccagcuaucucuucuccagugcauuaaacuuuaaccuauagguuaaggccaugguguauaaguuauaguaagagccaauuuauguugcuaguauugaggccagauuagcaaguuggagaaaaaaaugggagagucagcaagaagcagugaguacaugagcucuggcucagaaaggagcagaagguuucauuguucuuuucucaugaauuuaaucuuuauucauucuaguuuuaaucaacuggaccugccugccuaugagagcuuugagaagcuccgccacaugcuacuauuggccauccaggaaugcucugaaggcuuugggcuggccuaauaaauaaggcccugccuacuucugugggguuuuucuaccauuguuggaccuggggagggggguggauuuaaaagauccagaaagaaaaugucaaaauccaauaaaugaaauucaccaacucaccaugugugucccagcugcccaucuucccuagugcauaccuguucgcuucucauucucuuuugucuccccuuuccucgccucucccuuuuccaugccguccaugauccccaccccauguguuaagaaggcaguagccuuuacagggaccuguuugucccaaaugaacagugugcuccucagauucuguguucagaaggauuugcugcauugagacuugaaaccuuuggauaggggaaaaauuauauauauauauauuuuuuuguucuguuugcauuucuuaauuugugcuuggaauguguugaugugcacagcuaaugauucaaugcgagacaagauuggcaucuguguuguggagguuucaaauaaagagcacucuucauaacucacuuuucacaacggaguuuuuuucaaacugaaaaagaaaaccccaucuuauacacauacuagacaaaugaacuuuccagaaaaccauuucugcccuuccugaucacccacccaccuccacuucugguauagaacuucuuccuucagucaguuuccccagagaaaagacugacagacaccgggaauuggggggauuuuuguuauuuaaaauggguauuuggaacacacugcagcagguacuaucaaaacaguuaacccaugcaauguuucguuugguaagcauuuaugauaaucucaaguuuaauuuucuuaaaaguuuuggucccuuucuaguaaauuuuaauaagcaaaauauuugacuagcucgccacaagaccaccuuuuuugucugucuugucauuuguuugcaaguauucacagauuaucuaguagucucuugugguuuuuacucuauccagcacuuuaucagacuuugaugguuccagccuugaacaaaaauuuaauaaaaaauuuaguuagaaaaacaau

SEQ ID NO: 12601 - RNA, 132138 nt, Mus musculus
auuguuuuucuaacuaaauuuuuuauuaaauuuuuguucaaggcuggaaccaucaaagucugauaaagugcuggauagaguaaaaaccacaagagacuacuagauaaucugugaauacuugcaaacaaaugacaagacagacaaaaaagguggucuuguggcgagcuagucaaauauuuugcuuauuaaaauuuacuagaaagggaccaaaacuuuuaagaaaauuaaacuugagauuaucauaaaugcuuaccaaacgaaacauugcauggguuaacuguuuugauaguaccugcugcaguguguuccaaauacccauuuuaaauaacaaaaauccccccaauucccggugucugucagucuuuucucuggggaaacugacugaaggaagaaguucuauaccagaaguggaggugggugggugaucaggaagggcagaaaugguuuucuggaaaguucauuugucuaguauguguauaagaugggguuuucuuuuucaguuugaaaaaaacuccguugugaaaagugaguuaugaagagugcucuuuauuugaaaccuccacaacacagaugccaaucuugucucgcauugaaucauuagcugugcacaucaacacauuccaagcacaaauuaagaaaugcaaacagaacaaaaaaauauauauauauauaauuuuuccccuauccaaagguuucaagucucaaugcagcaaauccuucugaacacagaaucugaggagcacacuguucauuugggacaaacaggucccuguaaaggcuacugccuucuuaacacaugggguggggaucauggacggcauggaaaagggagaggcgaggaaaggggagacaaaagagaaugagaagcgaacagguaugcacuagggaagaugggcagcugggacacacauggugaguuggugaauuucauuuauuggauuuugacauuuucuuucuggaucuuuuaaauccaccccccuccccagguccaacaaugguagaaaaaccccacagaaguaggcagggccuuauuuauuaggccagcccaaagccuucagagcauuccuggauggccaauaguagcauguggcggagcuucucaaagcucucauaggcaggcagguccaguugauuaaaacuagaaugaauaaagauuaaauucaugagaaaagaacaaugaaaccuucugcuccuuucugagccagagcucauguacucacugcuucuugcugacucucccauuuuuuucuccaacuugcuaaucuggccucaauacuagcaacauaaauuggcucuuacuauaacuuauacaccauggccuuaaccuauagguuaaaguuuaaugcacuggagaagagauagcuggcagucacauauauagugaguugguaaauuuuaaucuaucccuuaaggcuucacuuuaaaacaagauuauuucauguauauuaaguguuuugccugucugucuguaugugcaccuuacuguguguuuguugaugccagaaggcaucagagaacugagaacugcaguuauagaugguugugagccaucaugugggugcugggaacugaaucugaaucuucugcaaaagcaguauguaucuuagcugcuaauccagccccucaucuaguuuuuagcuuuuucuauuauuuuugagaccuggucuuguguaccccaggcuggucucaaacucugauuguccuaccuccuagauaauuuaugugguaugaggaacggaaucaugguauuguguuggaaaaguccuuuuaaccaacugaacuacacacauuuccaaucauuacauuuccuaagaaauaauugccuuuaaggagguaucuugguucacuagugauguauaugcauguuaguggagguaccuauaaaauccagaagaggaggaggucauuauugaccuugcaggugggaguuacaguggucacaaacugaccuccauaggugcugagaacuaaauucuguuccugugaguaggaaggagcucuuaaccaguugaaccauguauauccagcccuugcccagccagacaaagcuuuggaacacaucaugauucccuuaagugcuauuugcaaaugucuuuccagccaucacucuuguguuuagccuaucugcucaccucaacuuccuccauagaccuaacaaacugagcuuuauaaaguuguagacuaggccauacuugugcucccaaucuuggguaggugucuagaagucaucaagucuacaaccucaauaaaaucacugaaaaggagaaacuuuuaaguuguuuucuuaccaugugugagcugaaggcaggcgaucuguggaucugucaucucgaugaaucugaaacuucugaaugccauucauaccuucaagggcagcaaauccuuguagggguaccuuggaaguaccugugacaaacuggaggaacuuggcacggucugcuuggucaaaggaacgcaaugcucuccaaaaccacuggaucuguaagaagagacacacaaaaagccaaagagagcuuguaaagaaauuuaaggaaauggcaauggacuugaaauauuuuguuccuucacaggauaggugagaacaucagcuccagaagaacaaaaagaggcauagguauacuguuauccauaaaccagcacugauaaguguuucauacuucucaagaguauggggauaccuccgcucaccugaauagaguuggauugguacuugugguacucaguguuagauuuuagaucaucaaugucgaugguaggcagcccugauaugagcagcucuaauuccugcucaguaaagauggauaugaggcgcuuuggaaugauuucauagaagcccuccaagaaggcugccagcuguuugcggauggcuccugguuuaaaaaaaaaaaaaagugacauggaaucagaacucauacaacugaacagaguuaauacagccucaguuugacaccuguacuggcuaguuuugugucaacuugacacaggcuggaguuaucacagagaaaggagcuucaguugaggaaaugccuccaugagauccagcuguaaggcauuuucucaauuagugaucaagggggaaaggccccuugugggugcaaccaucucugggcugguagucuuggguucuauaagagagcaagcugagcaagccagagcaaggaagccaauaaggaacaucccucuauggccucugcaucagcuccugcuuccugaucugcuugaguuccaguccugacuuccuuggugaugaacagcaguauggaaguguaagccgaauaaacccuuuguucgccaacuugcuucuuggucauguuugugcaggaauagaaacccuaagacaacaccuuauacugagaaaucugccugccuuagcuagcacuguuucuaggcccuuauauuauaguagauggaauuaaguacuuuggucaaguauucugacuccuuuugugcaagguauuuguggccaugucauaggaaauaagaacaaaaaaugugaaauaaauaaaaggcugaccucuuuccuugaacaagcagaggucuaucuaaaggacacuucuccuaccugucauucucaucuggcaaaccagguguacauauuccuucuuguucuccucuguuaccaagauguuggcuccauuggguuugaggucacgaacuucacauacuccaaauucuugaaccuagaacauccaagauaccaaucauacacaucagguuugguuugggcuacaaguaacacagaggugcaaaaacacauccuaacuccuugccauguuccagagagaaaaagcugaaggauggaaugaaggaaauuaaucuuuggcucuaaaacaaguuagaaaaggguaauucuaauuuuguuucuaugaugaacuguccuugggacugaauuaugcacuggaacaguguacgugugggcaugggcagagcucaaagagugucuuccccuaucauguucuaccuuucuuugaguguuucucaaugaacugauuuggcugauuuuuuccaucugucuuuguaccuccaacucuugaguuacagaugcauguuacaauguuacauugagagagagagagagagagagagagagagagagagagagagagagagagagagagagagugagagagugaguguguguguaucagaggauauuuucaggagucaguucucuccuuccaccacacugagcccugggacugaacucaaaguaucaggcuuaccugcugaacuaucuuacuggcucugaaacuuuuauugaaaauaaaaaauuaaagcuagaaagauauaguucaguauuaaaagugcaagcugcucucuuuuccagauggcucaaguuugguucucagcacucacauuuggugguucagagcccuguaacuccaugggacccaaugcucacuucugguuuguauauaccugaacacaugggcauauacauaaauaaaacuauuucauguguguaugaauguaaguuuaugcgauaauaugcacauguaaaaaagccagaggauguugucuguguguucugcacuauuauucccuagacaaggucucucccuagaauuaaacuggcagccagccuaucuccagugauccucucuuuuguguugcacuccccaagcacuguguauucaaaaguuccaagcacucaaucaugaccauaccugggugucagaucugaacucaggccauaaggcuugcaaaacaugugcucuuacccacugaggagaaacuaggagacagcuuggacuauuuuaccaauucuauuuccuguuugaugaagucaaagugcuuucucagaacuguugauacagagagucaguuccaaaguaaucccccaacuuaccucagugcugaaggugaggucauagccuaauguagagacaucauuuucaagcagauaaacuaggcccugguagaagugguaaucuucacucuccauaucuguauaccuagaaaaaugcaauuagauagggucauggcuugaggaacagaaauaaaagggggauaaagauaagagagucauagggcuaaaaaggcagucuaaaggcuaccauaaucucaccugacagauuugcccaagauguguuuguagaaagaccuaguaaaguagcacuccaggaggcgguugucauauacagcuuuggcuacaauucguccaacaaacuugaaguagcugaggugguugggguuacagugggaagauggauugaugguguaggugacccggucaccaggugagguacggaacaaggcauacauaggguugaacaucucucgagagaugaucauguaccacucucgcaggagccccccagcauccugcccuucuucuccuucaaacacuauauaccugcauaagagcagaaauaagagagcugugcagaaagccaggacagaucugaccauucauguagcaucauguaagggagaaagauucugugaaucugacuuuggagaguccacuguuagaugaagaaguaaacagaguaccaggagagaccaugauuuuaaucugucucauuagcuacugugauacuuauggcuacaagcuaucaauuucuuccagguggcuucaccagugaacaauuacugacuggggguggagugggggguggcacucaagcacauggugccucccaaacccaggguuaccaaucugcuuugcaggcaaauuucuauuccuagccuaauaauauauuaagcuugcacugcaaaggcauuaaagacauccuugucugccuaaaacuuggugacuaagucagcaguccaaguccaaaugcaggaagcucaauuaacauuaucuaagccagaaugcuacugggaguuuugugaccacuuccccuaaacuugaggccacauuaggucacugcuacgauauagcauauaggcccugaaucaucuuagcuguuuucucuccugaguucuuacaaucgauucuucauuucuucaggagauuugcgaugcagcucacgauaggagucuucaaauacauggucacggcggacaugcacugccauaucuucuuuccggagcccuucguccaaacgcuccagcucuuggcggaaauaucuuaggauguagaaaaggaaaggaaguaggauugggggugauuaaagcaaacuuauaucugucuguucagaaggaaaacucacagugacauguucccuuugaucuuuuaacccccccacacccggaaagucuauagcagcugggcuagaucauuuauuacgaauucaaaauuuuccuauuucuagugaaugagagaucacagagccaauuugauuucugcaacaaucaagaaagcacauuuaucuguauaagaaggaguagagaugacaaggaaggagucuugaaccucauuuugacuauauuacugcugcuaugacucuaaaggcugagaggggacuuuagaaauguaguaccaccaagaaacccuuauaacccuaggaacaacuauagcuuuuuuccccuggaaggugacacagguaucguuuauauaguccuucaccccaauauaucccaggguacauacuugcgcuugacaucaaagucgaggacacggauauaaucuaccaagacagcaaaaggcccaucagcaagaugggugguagacugccguaguaucugguuuaacacagugcggugagucucugagagaaaagauaacagcaggaaucagcauauuauagguccuaagaaacuacaaaacagucuacuagcaaccaacuugguuuuauuuguuuuaggggccuaaaucaggaaauagcuaaaggcaagggcuacacuccuaagggaugaaugggcauuuauaacaccuagcuuuacaauaaaacccaaauccuuuggaacgcaaggaaucuaagaaguucuauagcagaacucuccuguaauuaacuaggucuauuuuuuuuccaaaguguguguuggauguuaguaugcaagcauguuugccaacucucucauuuugcuuaauuagauagggauaaaaucuaugggucuaagaguuccauguaccugcaaagcgaaggaacuucugugugucagggggcaggcucgaggaaaugugcauagaugagggcucccuggagaagaaugggucaagggaggauggaguggcugggguuaagggggcgggggagaguggaggagguucauccuugaugugugccagcuggcucucacggguaucucggacaggaggcuugcucucccgcucuguggcauggaccaaaaagaaggccucgacagcaggcuguagcacuggaggauagcaaugacagcaaagugacacuuuacaaaguuuaacauaaacuuuauaaaguuuaaccuucccauaaacacaucacaaauauaaaacauagaauaauuuaaacuugcaggguaauacaaauaaaaagaggaaguuagaaaagcaaaacaggcaaucaauuauaaagacaaaucacaaguaccagaguuaacuaagagagggcaguucuuuugaauucuuguuacagacacacagagggaguucaacaaacuuagacugaaaaagcaagauaaucgccagcaccauuaccagacagagaguguccaagagcagaccaaggggcugggaaucuguaaccucagagagcaacucaccuaauacugcaugcuggucaugagauuccuccaguucuuuuaaacauuccccuagcaugucccacaguucaucuaggcucaguugcucacugagcagggguaacucaggugguuucuccucuuucuccuucucucccugugguguuccaucugagauuacuagauacacaaaggacagucaaaaacuugcagagugucucucuuacuugagaguuuuucccagaacaaaagcacaggacacuagacagucugggcucacuggccaaugaguauuaaucauugaacaacaucuagaagguaaauuaaauaacaaauuugacuccucaaauaauacaaauaaaaagaggaugucagaaaagcaaaacaggcaauuaauuauaaagacaaaucacaaguaccagaguuaacuaagagagggcaauucuuucucucuuuuucaaauuuucaaaggccauauauuguauagucuugucauugcccccuuagcugagaaggaaccucuuauguuaaguaagggcaaugugcuacaauggaacuuuggaaaauugucuuccaguacaauuauguuuuagaaauuauguucauuaaauucugauaaauucugccuuuguaaucaaucagguugccuucuccauuucuuuuuuuucccuagagauaaggcuaggguaacacacacacacacacacacacacacacacacacacacacacacacacagaggguuucucugaauagcccuagcuguccuggaacucacuuuguagaucaggcuggccucgaacucagaaaucugccugccucugccucccaaguguuggaauuaaaaggcaugugccacuaugcccagcgccaaaauagauauuuugacucaauaauuuuaaauaaaagucucaugccucuuaaagcccuuaagaagccuuagugcaagaugaacaccucccuccucuccaugguuguuauuuuuuucuauccucucuggaaguuuauucacaacugcuuaauagccaaguagcaagucuagucgaaucuucuaaguaauagagaagcaacaccagaaccccauaagaucccugcuuugcuuaggcuucuuccugaccuucacuuuuguccucuaaccaaauccuaacuauucuucaaggcucuguuagcccuagguuugaguucuggcuguugcacguggagaucgugugaccuuggguaaaaaaagauggauacagaacaugggaguaauauuuacccccccaaaguccagauaauuaaauaaagcauuucaaaacuggauguccuaugagaacacuauuuuaaaguaauauguuuaaagggcaccaaaaauauucuguaugcaacuuauugaaaaaugccauauuuacuaugugccagguacuugguuaaguauuacacacauauuaaauuauuuaauuuuaacaacugugcauauuccuauuuuaacuaaaaauauuuuuaaaauuguguauaugugcacaaagaucaaucuuagauauuauuccccuagaucagugguuuucaaccuuccuaaugcugcaacucucuaauauaguuccucauguugcgguguccccaaccuuaaauuuuguugcuauuuuacaauuguaauuuugcuacuguuaugaaucauaauauaaguaucuguguuuuuggauggucuuaggagaacccuaugaaaggggucauuugacccucaaaguggucuugacccauagacugaguacugcucuaggaucuaccugucuuucacuaaccuggagcucacugaauaggguaggccaguuggucagcaaccucaaaccuaagcccagagauaugcccaucuuggcuuucuuuaguacugggauuauaagaguguguguuaccauguuggguguucaugaccuaggauugaaaucaucccccaugggaagcacuuugccuacaguggacacugggcuguuucccaucccaaauaguacugcuuaugccuuguaacucagagcuagaaaacgggggagccaagacuugaacaugcccccaccccacacacaaaauauacuagggagccaagacuugaacaugcccccaccccacacacaaaauauacugcacuuuuuuuuugagacagggucucaguauguaccucuggcugcccagaaacuuccuauguagacccaggcuaguagucuugaacuuagauaugcauacuuuugccucuagaauacuagaauuaaagacaugugccaccauauauggcucccuuuuuucuuuuuacauuaacauuuccccacuuauuuaaaaaaaaacuuguuauguguauacguauggguguguguaugcccucacauguguggaaaccagaggacaaaugugaaggaguuaauuucuuuuuccuccugccauauaaguaccagggauagcugggcaugguggcacacgccuuuauaaaaucccagcacuugggaggcagaggcagguggauuucugaauucgaggccagccugguuuacaaagugaguuccaggacagccagggcuauacagagaaacccugucuccaaaaaaccaaaaaucaaaaaaaaaaccaaaaaaaaaaaaaaaaaaaaaaaaaaaaagauaccagggggucaaacuugguaauggcucuguagcaaguacccuuaccugcuaagccagcucauucauuucuuuucgagauaguuucacuauguaacuguaggcuugguauaugagcagcucaaucuugccucagcuuuauguuauuuauuuagcagaaacacauaggguacauguuggaguaaaauuuguggucacucugcuuugacuauguggguucuggggcucaaauucagguugucaaggcuuggugacaaguauaaaugcccuuuacucacugacucaucucgccaggcacuaaucugcuacuuuaaagacagguucuuccuauguugucuuggcugaugcuacauuuauaaucuugugaacauuuauagauccauuaaaacuuuuuuauuuuuaaaacaagcagaaguaguacugaccaauggacugaguaucuugagcacuaggagauggcugguccacauccaugggcgauuccucucuccggacagaugucucugacugguuagaagacuccgacuggauaaaaggagaaaaggucacauaaaaggugcaacucugcuuuucucuggaauuagagguuggccccugaaagucucacacuuugagcuuagaagauacuuucuccuaucugguuaucaaaguauauagcucucuaggucaaaagaaugacaagcaugcuucuuuuucacuaugaaccaagagcucccggaugacugcauucucuauaagcugcucccauguaauucccucucagaucccacucuaccccuacacuggugcucugaauauagacaaaaauuguagguuuuucuggaccagguucuguuuguauacauacuuguaagguaggcagaaaguaugcuuccugcuauuucuauuuguucaaacugaacucaguauaaucuuccauaagugggguauuuaagcuaugucuuuaucagguaggacaugagacugggcagauaaaaaagaauagcagcucuuuauuuucucuuuuuacugcugcuggagucauuccccaaauccuguacuauguccagugugaucaguaauauacuauauuuuuugagacaggguuucucugguccuggaacucacuauguagaccaaauuggccuugaacucacagagaucccccuugccccugucccaagugcugagauuaaaggauaggguggaacaguggccauagauaauguauaccaagcucaggggacuuuggaguugucucuacauuauuucacaacacuaaauuuuuuuaacccuauaucccuucagaacccaggcauggagcauaagacaauuugcaaaacacugcuaacuggauagcugggagugagguaugauggccaagcuuuauauucaaccagauaucaaucaauacaaaccaguaaaacaaucaaugaauagcaagagaaacaccaacagaaaguaaccuuguugucuagaggcauucauuuagcaaacguaaugcaaaagcauacaagguaugggcaaugaacccccacugaugacauggugcaggaaggaggguagagaaaugaaugaggggccacaggcaucaugcuaaccguugcugcuuguugcugucuccgcgcccuuugacccucacguaccauuuguauaauggcaucagccucagccuccagcugccgaacagcugccuggaugcugcuagcugagccuaaaccggaggaaccugggagaaagaggaaaaggggaaaggcaugauauaaaauguaggaagugggaaugcccaaaauucuuuucuucuuucauggaugccauagggaaucuuguugaauuugaguuuuaguuuaggcaguuuuguauccucauaaucaagucccaggguagagaagagcaggggauugccagacaaauggauggugacauguagaguguucuaugggacagaagccaauguaugagaacauggcuaauauuuuaguuaggaguguuuaaggaggcagaaagcacauuuguaaguuuuucucagagaaaugcuggucuuuccauuucuuugccagauuucaauuaccccucaacuguaacuugaucuauucauucucaggugaaugauugaauggguuauacaauacagccaucaacacuugauaaaaaggggggugguggugcuuuuuuggaaaggucaaauagaaacaaaacaggacauuuuagcccagcuucuccagggacucuggacccacccccagccccaguagcagcagcaucaccaucaccaccaccacccucaauuagacacucuagcuuuauaccuagccugccugucugcuuggcuuucuuguuagcucgucgugugucaucccgcagcuggaugaugaccuguaguacccucaagaagaacuucuggguagaugucuuggaugucaacauggacauagaaggcagcuggagcucccggccacccaagggucgcuucugagaugccacaauuaccacauuuucagccaugucaaaccuguacaguguagagguggcuuauguauauugacaucaaaguauaaauacucagagcaaggagggauucugguauuaacuagaaaaaauaaccuuaaaaauaguauuagccauuggagaaguuuuuaaaaacaccaggucaaguauguuauagaacaaauagaaaaaacacagaagagaaaaaccagccaaagccacuuuucaaauguuucagauucuagcccacacccaccugcucugcauuuugccuuucaguuugguggucugugguugcuccucagguaggccaucaggagagagggucucgcauugggcucgccgcugcugcuccagauuauauucccguaguucagcgaguaggguaccugggguaggcagaggauucauguggucagaaauuuccuuaaagcagaaagcugaacuuuaccaggacauuguugcaggaaauauaagugaacagaaauuuuuaccauuugguuuauuguuuuuucuauggaccaaccacuugggggacuaccaauucauuggacugucuuacugaaucuacacaaaaagcaguuugguauagagaauaaaaagggccuuuucuggagacauaucaugaucuauguucuaucuauauagcucuuaaaccuacucagguggccgggcgugguggcgcaugccuuuaaucccagcacuugggaggcagaggugggcagauuuccgaguucgaggccagccuggucuucaaagugaguugcaggacagccccgguuuacacagaaaaacaacaaaaacaaaacaaaaccaaaaaaaaccuacucagguuuuugugguauucuuauucucccucaaaggaugcuaucuauagaacaaugagauaaucauguaucacccguggacaauuuucaagugcuagaacuuuugcaucaucaaaacuauacaaaggaggccauuauugugaguauaacuccugaaccuuaucauaguuuacguauaucuuugaagaugaaaaaaagccguuauugcaacuuuaucauggggcucuuguagauacuaauaauuagggagaaaaaaaaguaggucuuuuuguucucaugaauaauauuccccuacuccuucacuaagcacagaugaccagcuauauagcaguugcuggugaugagaaagucagacaaccuuguucucaaacaauccacagaugaaaacaagaacugagcuuuaggagcauggucuaauucagugugugucucugugugugucuuauaagaagacagaauagaauaauauuauuaccuaucuguuuacagaggguauaacccagauggcgggcuccauuuaguagcagcuuaagaacagugucccggguaccagaguccccacgagagagcugcaguaacacauuggccgcaucuuccaagccuucuucagaacaagagugggaugucaacaccuagguaaaauauaggagagguaauaaaagcccuaaccugagaacugaaaugucuaccccuuuccuucuauuucagaagguauaaagagcuuagacucaccucuacagagagcuguagcugguuuucagugaggccagaggacaccauuuugaagucuauaccacugccuccuucaccaaccuuugcuggagauuugcugccuuuaguaguagaagcuucaaggaaacagaacacauuaaagcucugugacugucauaaaccuggaagugcugcacuguacagggcuucaaaauggcaaagcagagaaaaugacaaccuaccuaucaaggccaaaucuuuuuggugugcugagaauugaacuuaggauguuauacauaccauggaagcauucuaccacugagcuauauucuuaacuaugccuuguaagguuaccaaaaauccuaaguauuucucuaucauaucccacaauuuauccuuuaaaaccuauacaggcaccgggcagugguggcgcaugucuuuaaucccagcacuugggaggcagaggcaggcggauuucugaguucgaggccagccuggucuacagagugaguuccaggacagccaggacuacacagagaaacccuuacucaaaaaaauaaaacaaacaaacaaacaaacaaaaacaaaaaaaccaaaccaaaccaacaaacaaaaaacuccaaacccccaaacuaacuaaccaaccuauaccugccgagaauccucugcuaccuggcuuauuuucucuucuuccugagaugucuguuaucuuaaagcacacugcauucauucagucuauuauuguauagucuggaaaucuuaggauuuaacuccaccacuuuugguagagccagagguuuggcuuuauacaaauguacaggugcauacaccauacacauggaagauggugguguggggaggggaaugaagagaaaacaggcuaagaaugaacacauccuguucucacaauaauuaugauuuagagaauauuaucuggauugggaagugagaguaagaugggagcccauaccccauagcucugacuuuaaacacuuacuugaaacaguagugguagcaguuguggggguagucacugugguagaagcagcuacaguaaugguggaaauagcuguggcagcaaccagagcuggagcagaagugacagggguaguugcagcugggggugugggcgugggggcaguggcaguaguggugguggugguaguaguagauguguuugagguggcagcaguggaggaaccacuguugcuggaguuaguuugcacuucugauacuuuguuuucugggagagcaauugagaugagagagaggagucucaggaguuucucaguuaagagagaacuccggcggaugacuggaugugacaacauguucaugagcugccccaguggagaggcuucaaggcuguguggggaaguuuccccuucaccaccagagcucacugguacugacuucacggaguucuugccuuuucggcuaacauucauguuguccaguuuuaccaauaagucccagaagucuguacagaugccacugcuggaggacugugaggagcaugggcugcaggccugcuuacugccccguucccgaucacucucacaguuuguuucuuugguccgcugcuguguaaaguggcugggaaacaccugcagggaaaagaauagguucgaucuaaggagucucuguaaaggauaagccugacaggaaaagacaauugcuucucagacuauuccuuuuccagcucugcuaauacaagacagauggauuauaugacuucuauccaguagauggugaagcagccuaaaaaaauaaggacuuugaagcaagacaaaauuaaaaaucuuucuaaaucuuuugucucucugcacuuaaugaaacaaggagaacgacacaaaguauuaaaugaggugaugcauuuugccuggugccuaguacaggugggcccccaauacauaguagcacuguuuauuauucaaaaaauacugagcuugucacuuucuagucaaacgacaaagccacuaaagugcucugaaucucagcuucuuuaucuguaaaacaagaaucauauagaguguaaacaguuguuucgaugacugagauaguacauuaaaaauuguaaagaacagagauaaaacuccaugaaguuauuuauuggacaauuucucagaaacagcaaauggcacaauauaaaauaaaucaacaaagagaucuguuagcccuuuacuguccagaucucacccaagguguugaugcccaaaaaacccuggggucaaggauuccuucaagcuccucaccuuggccaacugaaugaguguauccaaaacaugucugcaaacaacaggagcagccuggggguggauguggacaguggaaccacugcuugcaugcuucucuguauguuuacgcccuccagaacguugaaucuggaauauguuaguccuacagccuaaagcagcauccauugauacugagagccaggagagcugauuggaacuuuuggacuccaucuuguggagcagauccaggggacgguucucaugacugcuugaugcacagcucuugcuugauuucuugccccuuucuucacuuguggagagcuuaggugucucaaugcauaacucacuuucacugcugcgcugcaaaauggacaggaggcugcggaugacccaguggcgggucugggcaugauagcagagauuucucaguacucgguguagacggcuaguauugagcuuuggcucauccacaaaaaguaggaccaagaggcaagacagggcuucauggucuagaaggagucguccucggaggcggaguaguguguccacauuacugccagaaggccuggaaacagagcaugguuucuggguaacacuagcuaaagcacuaggaucaguauaugagguacaugagagaagaacgagugggauaaucccaggaagacuguaaaagaagacaaaacaauccacagcaacaagucuauuguguaucuaucauauaccagguacuuuacaacuucuuucccugaaggauguuguacagcauuauugagacugugagugaaaaaagcucaaacaaaucagauaauuugcucuuuauuacaugacuaugaagagagcagagauucauauuuuuaucauuuacuaagugaugaaaaucuaaggucuaugagccacagcuugcuuuuugccuuuucuagauuaaggagcugccauucuuuuauaaggacugaucuuuucuauaauuguuuuagaauguuaaaucuacugugcuucauccuaguuagucguaaguaacuccuccccuauuucuguagcauaucuguugcaguccuaaggccaaacaggccuccacuauuuuguuaaaaccauaacuaguaucugcugcuagccugccuuuuugagcuguggcacuuggaauuuaaacagauuuugcuugucuacucauuucaaggaaaauagcccagaauggucauccuggccgccacaaaaucuuuuagcuucucuacuuacaaaauuaagggacucagaagguaguauagugagguuuaaaaaaaaaaagacaaggguaccuauuauggcugcugcuaccccccaucuggaaggugccaccccucuguacagcaaggcgaguauacuggaccccacgguugccacucaggcgacugguaaaagcuacaagaaaagaaaaaggaaacugaauuuggugaacugaggagaaacuggguucaaacaacuaacagguaguaaaggaggcuaauuaaaaaacaaggccaagcaagauauuccagagcccucccacuugccucccuguguacccgggcuucggagaauggcagagagugcagaaguacuacuguguccaaaaagacgcucaugcaugagcugccgcugucgggcuucuuguucucgucuuagagcuugagccucagcugcaaugucagguggcaucacagcuaacacacugucuuccauauccucuaggacacuacggcgcagaucugagggcaaagucugaaugaaagucacaggguccaugggggugucugagcucgcauucugagccaguucccgucgcugcuguucagcucucugcugugcuagcaccuauagaagaaaagaaaucaguaagaguauagcucuuuucaagcuaaaacuguucucaccauguucccgcuuacauacuuccucuugaauagcuggagguagggcagccaggaacucagggcucacuucaguuacaccaggguuccccacuacugcaggagcugagcuauuugaggagggagcacuucggguugguggacguaugcccagcugguucuguaggacuucccgacggauaucaucagggagagcagccagaaaggagggauccacaccuucagggagacugauaccuaaagagauuguaagauguaaaggaacuuacaucuucauggauguucaaagguauacucagagaaaagaaacacaaaucauggguugaggaaaaucagccauuuguguuuccacugcuugcaaagauauagagaagagccauaacccaucuuccuaagcuucaaauaguucaacagcucaaauaaauuuaaaaaguucauuagugguauacacugucaagucaaccuuuauaaagacuuucauguagauuguguguggccaccauuauauaguagucucuuacuacagagaccaagaaacaacugaccaaagacugaaaacucuguaacugugagcuaagcuuaucguuucuuuuaaaaguuggcuauuucagacauuugauucagcaauggaaaacugacuaacauaguguuugucaaugaggauuagagauauuaaauaaugguccuauuuuauaaaaguagagaaugagugagcuaaggcuaaccugacuucuaagccugaacucauuccauuacgcgcaacaccugcauccucuuauugcuagucuaucuucaacaacccccacccccgacucacacaccgaccuggaggaaaguguuuggaggguuaugucuguccaagcaaugauuuuuuuggaaacagaaacuuaccagcaaggggaucuucuucuucacugcuuguugaagguaguggcucuucuagaauuccacgagaaucugcuccagagauggccacggcagaaucucuaguggaagaacucuccgaggaugcagggggggagcuagggaaagaaaucauccuucuuuauacaguuuccccauaaaaagcaaacacaaaccaaacaacaaaaacauuccuaauacccaucucagauagaacacaucaaucacagugcaacaagcaugccugauaguguuuagcuugaaauaacuucuaaugcauuccuaaucuccucuuggcuauauaguacuuaccuguccucagguggcugguuggauucucuugauacaucaggucugccuugcacuucugccacaacugauggcgcauccccaggaguggaacuaccugcugugggcugcucagaacugccagcugcuggagugucacccacagccucuucuaacguacaggaagccaggcugcugguguccaugggagaaccuuccagcugacugcugacagcuguuaacgcgucugaaucuucagcucucucuggggaaagagaggcuagaaggaaguuaagagugagaaauuagauggcuacuuugaaucaagguuaugacaggcaaagucuuugguaggguuguuuccuuuugcaacaguuaauacagacucaucuaccacuugauuaucuauugcccacucuuccaucucaacugcccuuaaguuccuuaagacuuuucuauguaccacacguuuguucuacacacgucuacaaugucccuagauaucugaaguagggauuuuguuacucuaauguuuccugcagguaccaguuacacaaacaugcuaguggucucaguuaucuaaaaaaaaaaaggcucuuguaaugguuacugucuugugaugguuauguugugaucaucaacuugaccaaaucuaauauugccuaggacaugggccuuugaaaaaacaucauuugggaauuagcacucccagggacccugggcuguuuaacuggagaaggggcacugagaagcaugcauguauuguuuuaugaauaaugauaugugaccagcucccugaaguuucugcugugacucuucccgcuaugauagaauauaaccucaaagugugaguaaaauaaacccuucuucccuuaaaauuaugucagauuauuuuaucacagcaacaggaaaagaaauugugacagucccugacaaaaacaaacaaaacuggcaucuuuaaaaaaaaucucuccaguccacagcauagaaauuaugguauagugaagucaguuucaguuugccuuguuaaaaaaaaguauuuuguugaaaauuuugaugcacuauuuuaaauaagugagcaguagguauguaaaugauaggaaaacugaaugauauagaauuucaguuuaugaaugaaggcaccaccaacucugaaacauuauuuucaaagaaguuaaauaacaaaccugacaugauaguuaguucagaaaugaguauugccuagauaaauuauggcaugcuuaguacuuaucauuaagauauacaacaauaauuaacugaggacacaaagaagaaaucugagcuucuacuaagaaagcuggaguguaaacugaggauucugagcuccuaauucuuuaaaguaagaaagcagagaaaaguuacaaagauugcaauucuuuucuuuuuuaugcccuuuuaaagaugacauucuacucacuuauggugggagcuggagacaauuccauuugaguuguuucugcuucuccacuuggucuugugggacccaauuccuccaacucuauaggcaucaauagcuguguagaguuugccacuucuucagcaggggacuguaguuccugaggaaucucuccuaaggaugguggggguggaagugcuggcuguugcugggaggguuguaggguaccaaguguuuccuuggacucagauguaggugcauccguugaagaggggguuguuggauagcugucaggcauaggagucccaucuuuauuggaaagaaugauauucgagguuaaggggaacuuagcgaaugaccaugggaagaauccaaucagcacaugcagccugguaaggacccauucaaauaaaagucaugaaaaucuuucucaaaucaaucuguucccagaaacaguucuuggauggcauaucauaauaaugagggcuaaauaacaauacuaucuguaucucaacaccagagauaugacucuaaugaucuagagaguacaauccuuucuauguuccagguagaagggaacaguugcauaccauagauaggucaaggcuacucagaaaaaaaaaaaaaccuccuaaaagcuuauagauccuuacauuuccugaucuacuuggaacaagaaauggucagaauuuauucauaauucuacauuccugcuguuguuuacagacagggucucaugcagccuaggcuaacacugagcucacgcuaaagccaaggcuguccucgaauguuugcuuuucuugccucugccuauaaaguuuuagaacugcaaaaguaugaaccaacaugccuugcuucuuauuaaaaaaauuccuacaguuuccauucauauucuucauauucauauucuaaaugaaguuaucauagaaucaaagaguagaagaauguccaguuuauacucaaugguaaaauaaacauaauaauguucuaauauaugggcaagucauuuaacauuauuugccucacucuaucaucuguucccuuccaccuuccuuuauuauauuccuguuuacugaauaaacauuuacaacuuuucucuaauggagucaauacugccaagacuuaaugugaauaugccacacaccaaggaaaguaguaaguuguauaguuaucuucuuacuggggccuaaaaucccuaccccacaacaauacaacuuacuaccucaccccagcaugugcagaugugucuaguaagggcaguaggcaaaaggccacuuuaccuuguagcauagauucuuucuuucauauacuuuugcuagauauuaagagcgcugggacagcuauucucuucagugcuuuuaaaauauuauguaggcuuugguaaaacaagucucccaauucaagggcagaagaaaguucugaauagauaugaggcaagcaugagaccacauugaccaaugacaaaaaugguuacugaccauuguuaagaugauuagaaggaaugagaaguauauguauguaauguauguauguauguauguguguguauauauauaucccacaaagcuaugauccccaaaaccccacuuuuaaaagacaauguucuuaaaacuuuuaaauuccauagaccacuaagauuuuagauuaagaaugaaaaggacuaaacuaggcauuacuuuugguuuuguaagaaaaaacccccaauaauuuaguaacaauaguuuguuauccaagaucuaggagaauauaacuucuaaauauaaaagacuuuugaauggaacaaaucuagcucuaaaacacauauuagacuucccuguguuaauuuucauugaggacuggcaacugagaaccacugccaccagguguucuaaugaagugccauacaaaaguauguaccucaaagauguauauaccgagugugugggggaaaagaacaagauaaauagcuuguguacauaucagaccgaaacacagcauaaccguaacaggaacuugaacagggcuaguuggaugggaaguguaccaccgugggaaagacaguagacuguauaguuaucuccaagaugggguaugacccuaaaacuauacaaucuacuaccucaucccacagagcaccagugucugucuucagcccauguggccagcuauuuagaaagaauccacugauuaauuagcaagaguggaagggagggaggguuaccugagacauucuguucaguggagucauuugucuuaguuacaguacacugcaaagagaagagagaguaaugggagacaagcacacaagaaaggucaaauaugagagucauuauuucuuaccuagacuaucaaggaauucaguggccuggccaugugggcauuucagaauacaaaauauuauccaauuccuuuacauacacuauacuaauguucaacagcuuuggagaggacuuggggaauacaggccagcuggagaguucaaaaguuuaccaugugugagguccuaguuuuuuaucucuagcaacacacuagaaagaaugcacuagguuacauaaagacaaaaguaugggagugagcaggaaaugaacaaugaaagaauaaaaaaagaacacauuagaaauaagcacaauugugagacaggaaacucuuagcuccaccuauuucccuucuuuggguuuauuauuuuuuccacucuagcuuuguuuugggguauugcuuuggaucaaaccaugcacaugccacugagcuauaauccaauguccauuuuaguuuuuagucauauacaauguugcugguuuuaaggcaaaguuuuauauaaauaaaaguauuuguuagagcaagccuguuauuauaaacaaauaccucaaugugucugcacuaauuuuagcauguuaggaaucaaaccuggaccuuguacagacuggaagagugcccuaucacuaagcuauacccucaauauuaaugcacccccccauuucuuugcauguguagcaguaugugccuacauauaaguaaguggguuuggcuuauauagagcaagcacauuaccacugauucaaucccaguacauuuuaguuuuuuuuuuuuuuuuuuugccuuauuauuuugggguaagagcucucugaacugaaccugguauuuguggcgauuuuuuguuuuguuuuguuuuguuuaggcugaaaacaaagaaacuccagggaacuggaguuagguuuuuuuaacgagacaggguuucucuguauagcccugguuguccuguaacucacucuggagaccaggccugccucugccucccaagugcugggauuaaaggcaugcaccaccacaccuggauugaaguuaguuuuaagcuguuacauuggugggaaugaaacugugguuaucucuagccccucaugucuuuauuuuuaauuuacccaauaaggagccagauaggucaaagauaccacaagaaaaccuacagaaucaaauaaccugggcccagaggggcugaaacuaggucccuccacauaucuaacagauauacagcuuggucuugugggagaagcaggggcuguuccuuacucuguugucugccuuuggcugccuuaucuagccucaacagaagaugcaucuaguccuacagcaauuugauauagcaagguggguugauauccauuggcagccuccuguuuucugaggagaaagggauaagagaagagggagggacugcgaggagaggagggaggggaagcuuugauugguaugcaaauaaagaaaaaaauuacccaauauccuaauagaugaaugagugggacauacuacagccuucauucuuuuuuguguuucuauuagcuuuuauguauauacauuaguuguuugguaauagaguucaggugggaaaauuuucuggaaguccacugugaaauggaagugagaaccaagaaugugagcugagugagagucuaccuuuaggccucagaaagaguuuacaaaguaggacuauuguauaagguucacauuuccccaguaagguaguggagaaauaauuuaccucuggguuugacuuuuuuuucuuuuugccuaaaaaccagaugaguaaauagucaaucuggaaaugaacaaucuuucauguucaacguaauguucuagaauuuucuaguaguuuaguacuaugagcagggcaaaaucauaauaaauacaaaaugcugcaucucuuaagucuuuuggagucaccucaccugugcacucugaucucuguucuccuugucuucuuugccuuugucuauuauuuuuguuucuuccucagccaauuguuuccugcguuucucccuucucucuucuagcuccucaucucucaagaauuccaggugauugacaaugggcacuuuaaccacuacaagaaaaagguaaaaaucagaggcuacuuuggaaagguugagaaguagagaggcagaguuaauagccagagaaucaaaaacaacucucugcauacucauucuagccggaaggcucauuacuacccugauauucaaguugucacagaccugaaacacagucaugcauacucucagcaucaagaacuuugcauuccucuguccaucggguuagagcuguugggaugcuggacaggguuccuauaagagaacaaaauaaagugaaauucuuggcuuuaugaaguguugauugaccuaaaaacugcauuauuuuccuaaaagaacccauggucugccacaaguuuugcuacauaacagguacccagaggcaacagaguuguuguccuuggcuaagucaccaagugguuuuggcuccuauaaaauguaguuucuccaagaaagagacuacucuucuucuuaggacugaagaagaaucaaagaacucuauccucccucuuacugaauaaacuugccugcuuggcuaguggcuguacucuggucaugaaaaaagucauccagcagcucgucaucagaccuggcgaugauauggacgucaucauugcccacuaggaggcgggcccggccucggcuuuguaauggaaggcugcugcucagcugaagaaugucagcagcugcagagggaccaagcaaccuguaggguaaugguaagguaccacuuucacuuucaaguccacagaagucuguuaaccaugagaucgagcauguacaucuaguaaacuuauaggauuauggguagauuuuaaucauacugaaccuaaaccuuuacuaccauucuuauuagcaugucaguuugauaacuucgagauugaacugcauauuauucuuuaguuaguuccuugaacacuaggaagcuuugauaugcuagguaccauguuagguauuaaugccuuuguuguacaccuuuauaaggcacuuauauucacucuuucauuuuaaaauuguuucacuuacuaugggucacacaaccuuauuuaugagggacuguuuauccuuauggucaagacaauguugaaguucaguuauaauucuuaagagcuucauugaauccaacuucucauugauucugcuucaacacaaacucaccucuggaguauaagaggaggguuaggcuggcgauucccaggguagugaacaugaaugguauggccuguauuggcagugagcugucugaggguccuuugacugcgaccgaugcccuggguaagacgaguuguggaagaaccacugcccagugucagggaacugugaucugcaugacguaccaucaaugggugggugguagggauauuuccuggggaugggggaaugucugcugcaaggaaaauaugcaaaaggggucagugccaaaaauaaauuucuuccauggcuguucauguguagaaccaugucuccugggcuuugcucacauggaaaugugaucuuuuuccuuucucccucauucucacaccuaauucaggaucugauacaaccauagguuaugccaccaccucaauguaauccuaccuuuucccagcccacuuucaagacaacagugaugucucuaggcacuucagaugcuggccccuuggccuagaagacucugcuucccuuccucaccuguucuuuuguucucaguccaagauguuacuucuaaagucuaacaggucagguuagauauaccuuuacucugugcauuagcauacuaaauguggugucuucuuacuuauaauuccuuacagaccauaaguuccuauagaggguaaaaacuccuguuuuucuuuaccaccuuauccccaguaccaaggacugguaggcacaucucagauauucauucauuuuguugaauggacaaaggcucaaauaaaaggaagguugacgaaaaccgcaaaaauucuaagaguaucauagaagauaucuugaaaauuaucuacugcucauuuuguuuuucucuucaugcuuuucauuuacaggugacaaacugaggcucagagguaaaagauuauggccaagacaacagaccaaaacuguuaaaaguguuuucagcuauauuaugcuugugauuugagguaagaccugucccaugaagacagcuugaggcuaagaacucgucgcuacaaaggaacguugauguugauagaaaaggaguggagagauucauuuucucuccggaucaguuccauccaugaugaacagugaauauauaaaauccacucccuaaugccaggcucagcgauguccauccaaaccuuugagauccagcguuacaaauaaaagauuauugauugcccugucacugcagugugauucaggugccucauguagucagacuuggucucauuuucucaaucaagcaaaacaucaaguuguccaggcucuaagagcucccuguuuacugagguggagauaguaagagcagccuccuccgauuccuucuugcaaggauauguaugcuauccagagagauggauucagacaucccuugaccugggaugucaagacaguaaaagaagugguguccucuaucagauugauggcugcuuuaguucugcuugguuuacccuagagaaggguauaagaaucaauagguaaaaacccagcugagccccuguaucuuacuagcacuggagaacauguugucaaacucaaugaugagaucauccucccggucaaagcgcucaaaucggaccaagggagaagcguucauaucaggguaauccucauccaauuccaucucagaaccaucgucgucaucaucuucaucuccuucuucaccuucaucauccuccuuaagggaaaauacgagauggagaauugcuggagguaaguguuuucugaagcuuggugucauggccacaugagcacaugagggagggaggcgacgaggcuagcuaguaacccagauuguccguuuuucuguaguucugugcucccauggaagaggucaucugaaccaacccaaacacaguccccccucaccugaucaucuuccucaucuuccuccuccuccuccucuucauccugacuaucauccucauccucguuacugccacugcuguccucuuccugaguauguuccuccucauccucaggguccaggauauucauggaaucuaaaacaaagggagcacauuggaggacuauacugaguagcuagaaaacaggccacugugcaggccggcagacugagugggaaggcgaugggguaucugacucuaagagaggaagaaucagaucuagggugguguacagacuuagugagccagcccaaauuuccugagagugccaauuaaugcaucgacacgcugagcaggguugcugaaauguggaagcuggcuccagggaggugcuugaggagccacgauguagggcuugaccaagucuguugguguccccuugccuuuccaguccuauuuugcuagugacugcauccuguugauaagagggaaucuggagcgaugacagcaggugggugagaagaaagcgaaccaaguaagaagugacaaacuuugggcaagcaguaguaaaacguuauuugaaaaacuggcugaggauaaaguggaugguguaugucagcgcaugcagacagaugcuuccuuauucugcacaugugggcagcugccuccaggaaaacccuaguguagugucugucagacgugcagggcaagaagggaggccuuuuuggccucggcacucucaccuucucgguuggccugcaagguggaagcuuggcugagguuggaaggagcuucauccaucagcacguccucuugugauucauccucuccacuucugcucacugaagguuacagagcagagccuucacugaacaacagaggacuucccuuuccagacugggugcgucuaaguagcuauguacaccuaauagauauccacguuugauuuuucuccuuuuucuuuuuccgaugagggagaauaccucgauucucugcugucaacuaucuagaugagcuuggccagucacuuuaccugucugagucucaguuuccucaucuguaaaauggaacgaucacaucugucuugccaaucccacuaauugugcaaucacagaguacgauggaugugaaaaagcuuuguaucuuuuaagaauacaugccuaguuccauuaauccuuugguuuucuugaccaguaaaauaaaaauauaaacaccuucacagugagguggcagcugguuuguuuaccuuugucauuuuccauuugagacuuaaaaggggccauccuuaaggaaugaccacucuuuuuuacauuuuaagacacaaaggcaaaaagccccuggauuucauugaagaacugaaagaaaagcauuuucucauccuacagccucuucuaggccuccaugaauaaacacuuuuggugugccugauguuaucaucuauacugauuguuacccucaccgccacccgacauacacaacacuucagaccuguuacaggccuauaaacaacuuguuaauuucuuuucuguuaagaucaucaacaucaagacaagcagcaaucuaggcuggcuaugagcccuuaggcagagcugagcaagcagaugaugagaaaaaugguccucccaagagagacugagacaaaggaagaggcuuuacucaguucuggggcucucaccuauaauuguacuguucccagauccgccaucccucucaagcaacucaucuaucagguccuccaguucauuuucaaccuggagagaaagagaacauacauauggaugcacacaacaagucuaucauugugcuagcacggaaacccuuuuauaaagccagcaagggagcauauguuucuauaauaugugauaggauguuacacagaaaccacauaauuggugcuauuaacacagagccuaccacaugcuuccaauaaauccacacucacacugucuguauccuggucaacaaauaccagguuaguguuuuaacacugucuaggaauacaugcagaucacauuagagccagcagcuaagguucacaggcacaauuuauuagauuuuuuuccauuuacauuucaaaugcuauccccuuuccuaguuuccucucugaaaguccccuauacccacccuccccccgcccugcuccccaacccaccuacucccacuuccuggcccuggcauuccccuguauuggggcauauaaucuuugcgagaccaagggccucuccucccauaaauggccuacuuggccauccucugcuauauacaggaacaauuucuuacccacugcuaccaaauuaccaugcuuucuuuaaaauccuuagaagacugguauuuaaauacuccagugagaucugguggcauggcauaagauagcgcuaaguaacuuucaauaaugaucagagccaaguaaaucaaagaaaccauacccaaagggcucuguccccagccccauuuuaacuaaaacaauuuaaacacauguuaagcauucugugcuccucugaagaccacauugaggcaagaucuaaaguacucacccacccacaacacuugggaguuugguucagcaccgcaacagaagaauguuggaaugaucugccucccuaccugcaucucuugugaacugagcaccucaggcugcccggcaaucaccacugagucgguuucagccuccccauccaugauauccccaucugccaccucugucugagugacaucaugauccuccuccugcacuucugccuccccaggcucgccugaaacaaucaaccaaccagcacaauaaauaaucaaaagguguuuauaugcugggcaucaugaggcaagcaugaacacagugauuugucuuuaggcaaauuuacaaauucucagaguauaaauauaaaugaaugugugaugaagaaaaagacuuggcuucaugugaggauagccaaacaaagcuguaaugugaagaaauuccuugugggacagauuuccacaccauuaugacagauaucugcaagaccagcaaguucccggguaaacaacaauaagcuagaacaguuuaauuccacaagcaacaacucccacccauccaguuuuugcaguccauucauucugauucccuaccuggaucuugcugauggcugcuggaguccugagaagcuccuugagcauccugcucagacuuguucuugcuagaagcacucuugcugccaaaaaggcuacuggguugauuuacaauccgggaaaguguuuccaaggguuuuagagcagcauugacuguguuggccauauugggacugagauaaagaaagauacaagaacuaaggauagaaauaauaggugccaaucucauaagcauacagguucuuauaauggaagcuaagagagaaaagggcgcaaagucuagaauuuucaacuuuccauuaaguuuaagaauaaaacccaguaaagcaaaaguuaagucgaugucauauuucaugaagcuaugacaagcacaugagaaauccuugaguagaagccagaauaaauucuggaugacuacaaauaucaauacuucuuagauuaucaaggaaaaaaaaacccagacccauuccaacuaauuaaccaaacaaaaacaucuccaaacuccuuuauuuugucuuuaaucguuuuuuuugggacagccucauguaguuacagcucaggcuagucaaagucucuaugaagacagugaacuucugauucuccuuacaaauuccaaguacugggauuauagauauaugcuaccacacaccuauuuuagucuuuaaaaacacaaugaccacuuuuaagucuacaaaauguaggauuuauagaguucagugaaaauaucauaguauuugcagguagagauguaacaugaggcuaaguugggcaccacugaaacuagagaggucauguggauccuguagaucuggccacaaucucugauaccaacuaacacuaaagugaaccaaagcucauggacaucacaaaugagguugggauaucauuauaucagaaaguuuucaaaaaaauaaaaggaauaugaacuguuuaaguaacaagaauacugaugagagagugaugaaugaacuuauggugauaaggauauaaaaggauuguuuaaucauugaaggcuaguugacccacauaucauauuauuauuguuuuuuuuuucuuaaaauguuuaacuuguauuauuuacauaauggggaaaucacauauagacucaggcaaucaucuguaacacauuuacccugaauucuucagcauugucaaaagugcaaagaaaagcaauaguuuuuuuuguuugagacuguuuuaugcagcuccaggugggccuugaauucuuggucccuuuucuucugccuucugugugcuagaguuauagcuauuugccaccaaccuugauuuaugcaacauuggggaucaaaucuacaaaugaagauauagugcugccuaggcuuuuugacaacaaaaugucauacaugaucuucauuuggauccuggaucaaaacacacucccaaggcuguugaagggacaauuaaaauaacugggaacauaugaauauagaucagagagaauaugauuauuaagcaucauauagcaagcuuuuaggauauaaauguuucaucuuuaggaauaauugcuuaguauuuggaguuaaauaguauguuuuaaaaaauuaauuucuaagaacugagcuccagaaaaucaaaacacauauggaacaaaaguguuaccaagauguaacuauagacuuauaccauuaaaugacuugaguuuggaagcuuaaaaaaaugguaguguuagggagugcuguuaauaaguguuauuauugagcuuaaccugaguuugaagaauuuagacaauuaaaaaaauuuaauguuagcugugcaugauauguguauacaugaaauuuuaguacuuggugggaaggcugagacaaaacaacugcugagauuguagguuccagcuuaguagucagucuuaacaaggauuacuaaugguagguggaaaaaaaaaaaaaaacaaacaagccccguggccgggugugguggcacaugccuuuaauccaagcacucaggaggcagaggcaggcagauuucugaguuugaggccagccugggcuauacagagaaacccugucuccaaaaaacaaaaaaccaacccuguguuuccacaugauauagucuggguuuaagacagguauaaguuguugcaguaguuuggcuaaauuacacugcaaggcagcaacuccaccaaaucuagaaggcaagacuuuuguagaaaagcagucaucauuucagaaaguaucaagaauaacauuaaaaccaacuaaaaucuauccacuuuuaguacagacaucauaauuuucaccuacaucugaugcuuucuuacgagagcagcugauuccuuaccaaccacaggauauuacuuuaccuggacaggucuaggcugugaggaacucuggccaggucauugacuagucccuucuuuaggaacagucgaaugauguuguucaugccauuaugcugagucuuggcuguagcacuacuguagaagcuggagguggaggggcaggauuccaugauaguacugaugauacacaucacugccugaagucugggagagaaguuugauaccucugucaagugaauacagcccauuuguaaaagaugucuuuacuauauauaaugccuuagauaauucucuuaugccuuuugcauuuucuucuggaaauaauaucuacaaagagaauuaccuuucuaguuaguagacuuuguuuacuacagaaaauuuaaaaucucaauuuugugucugaauauagcgaaaaauaucccuucgauuuuucuaaguugcaauaucuacuucaauugaccauggguaccagacauucuauguacauuguuggugugaacacaacucuuguucaaguucaaggaacuccuuagaccauggaguaaaagauguucuuguuuaucaguacuaggccagacaugggcuuuuaccuggcgugcuucucuguacucucagccauagcaagcgcccgucccagggcugcuuucacuucauucacuagggccacuugagcaucugugccacuccccgcagcagccagacuugcaaggaauagacgugccagggcagguguauccuugucuucugcauucugggugugugggaggaggugguccaggacaaaagcuagcacacugcaguccugaaaagucauuaauuaugacauuuacucaaaagugcaauuaauccacaccauaccuauaauagcaaaguagaaacuuuuucuuucaagucauccaagguacaagcuagguaaguagugaaccaauuagaaaucuuuaagaggcuguauaaagcuuccagauuccaucuauuucuuaccacauggcacagacagucauggaauuaucauguugcuuucuacuuuuuaucuuugagauguggccucucacacaguuuagcucgucuuggaacuuguuauauagacgacuguggccacuaagucucccuagugcuaggauuaaagaugugccaccacaccaccacagguaacaauacuugauauaucuuaauaauaaaaaaucugaggcugggaaucauauagccuagccuaggcuagcuugguagacuuucuagaguacugggauuccgggagacagcuaacaccauuguauucguaacaacaacaaaaaaauauuuauuuuauuuaugugagcgcacuguugcugucuucagacacaccagaggaggcauugggaucucaauacagaugguugugagccaccaugugguugcugagaauugaccucucagaaccucuaaaagagcagcuagugcucuuaaccacugagcuaucuuuccagcccauguauuugagugacuuuaauggaguugauuauaacaagccaauaaaauagacugaaguaaaucaagcauuuucuccauuugagaggagaauaaucugagaccuaaagaaaaguagcuugcacuaagaauuuagucaaggguagaggauucaaacauccauuuuuguauucuauaauuccuuuuaacacuugcaaugugccugagacccuguacugaaaacugggagcggaaugaaauauagaaucaccuaaaaauugcaaaagggucuaacaaggaagacggacccuucuuuuacucuauaauuucugcucugauuuuuaggaaaagaauuagguucuauuuuucagguagauuuugggaguaagaaguaauagcuguguaacacuuuaaaugucacucaacucacacuuuuuaauaaugauuuuaugucaaauuuauaucaauaaguaggguauacuucaggacucuagagauuggagaacuggacaaacucaaccucaaugaaauacaaagcuaaaacuucuugaaucuuaguaaugucauauaguacaauaugaaaagaauuucaauguaaccacacaacaagcacuuagcuuagaaucaaagacaaggguuucaauuuucauucuggcccuauacagugugcccucacuuguaucucugaaucuuaucucuuaacucuaaggagauacuucuacuaauaacucuaaaguggaguugucauaucaauguuauuuauaaaccaccuugccacaccuauaauauguuuggguaaguuauaagcaggauaccgaauacauuuauaguuaaauguuuuguuccauaaauuaggaauaaaacauaugaauauaaacuuugauaugaaaccaaguauauacacguugaauguauguaugacaaaaagggcucacauauacaauguauaaggaaucuaaugaaacacuugaagccaaguguuaacuggcauucaagcauaguuccagcuauucuugagaguggcucaggaugguaagauugggcccaggaauuuaaggccaacaaaagagucucaccacuaaccaaccaacccuuuuucaauaaccaaaaaacauuaaaauauggccaauaagaaaaugcaaauccuaaccacaaaacuacuaacaaaccaacuggaacaaauaaaaugaaauaugugauggcauaaggugagacaaucagaacucucauaaacuacuagaauauacacccugguaaacuucagguagcaucuguuaaagcuauauaaauucauguucuagagcucagcaauaauauucuuaagccuacaucaccaaagagauaugcaucuguauaauuuacauagcaauacuacaguguuagugacaaacagaaaaaugacucaaauaaagaagaaucuaaaaauuugucaagccaaacaagauacaaaagauuucaucaacuguuuccuugcaguuacucugauugcuucacaucauggugaaaagacuagcuuuccuuucaaugaguauuauaguuuccaacacagucuaggauauaaccaaaauaucaaagaaagaaaaaacuguaaauauuaccucuuugaucagcucagacuggcccacgguauagcuguaguuugcaaucaggguagcaauaccaacauaggaccucaccaacucugccagaagacgaaggauaguagagguaggcauuaaagguuugcugcccuugcuuuucugcuugccuuccucagauguacgguccccuucuuuaucuuucuucccuucucgagucuccucuggaguugaagcuccugagaaaacagguaaacacucaauuuuacacuggaauaacauuaaaaaccaagccacagguagaaugaagacaguauuucuucauuuuaggccacuuguacaaaucacuaauuaccacuguaguuaaaugacaaagaugaugaauaugcauaagacauaguaggaaggcuuggaccaaacauccaggcacccacuauuuccugauguuuaugcaauuucauguccuagaaauaaugaauuaguaguaauucuuuaaauauccaucuccuuucuuuugccuacuacacacuaugcaauucaacucaagugccaucuagauacauauggaaauauuggucucucuauaucucauggaaguauguguucauuccauuaguuacaauuguugccgucucccucauuugacaaaauucuuaagcuguagguaggcauccaauauagcaugccacauacuaagggcaaagacaguuuucuuugacuaauaugcuguuaguaaggccaguaaaauaacuuagcaauuauccuauugauguuauuuuuaauuguauguggauauguguaugagcaaagaugccccaaaaagcuaugagccaccagaaauaguguugggaaaagaauucggguacucugcaagaacaaauauggguuagagcucuuaaucauuacaauccaagcuucugaggaagccauuauuucaaugacugguugauuguaagugacauguggcuuuuaagaacugaacucagguccuguggaagguaagauagcuuacuuucucaccuuuuaaucucuuggaacuaguauauuaaccgaagugucuccuaaauuuuauuuuuaaagcucuauuaaaggaaucaacuacaaaaaguguauugcuauaaucaugucaauggcacaaacacuaugcaagccagcucaugggaaucgaacaaaaggacauauggacuaguacaaauaauacaaccaaaggacaucauuauagcaacauuagcaaguuaaugcaaauuacaguucuauuaacuucagcagccuauaccugcagaagaucagacacagcccuuagaaaucacuuagaugaguaaacaaauguaaauaugacacugacaccuauuauucuacucuagugcagagacaaccaguuucuuuaaguguucuuugcagcaaauaauaaagaaaggcaaauuauuacccucuccuugggagguuccaguuguggaaguuucagcaggggcaccaucugcagcaaaaaccugacucugaaagaauacaugugagcugugaugaauacaaguguuaugacuccuuuuacaaguaaugucugagaaugcuacagauucuucuuaguugaucuuucaaccacauucucccuauaaucuauaggaagcuaucacaguuuucagacuagucaaguucaaaagaaaaaacaaaaacaaaaaacaaaaucaaaaguaaaaaugccuaauauaccuuacuuuucugcaauaaauaauuuacacauauauuaaaauuaauacuuuuucuaaaaacagggucucaguauguaauccaaggugguuuugaauucauaaaaaccugcuuacgucugucuccugaaugcugggaucaauuaaaggugcgaaccaucauacugacaaaacuuauacuuuuaaagcuuccuuuggauaacccaagauacugagaaaguaggagcaguggaaagagaaggaaaauauaggacagcugaaauugacuuacauuuaaggaaaaaccugacuguguaucaaagucacugcucugacgaguaagugaccgguacugcugguauacaucgucacccaugucuugcaggagcuggccaaccucuugggucguucccccagguuuaggaucagauuugucugcuagaaaaauauaaacaaacaucuaaauuaaaauaugguccuuuaauugugcaauauuagcacaauguucauagggcugcauuuaagaguacuagugcaauaauuauguuguagaaccaacaaaacuauugguauauacaauauaaccuauguuuauagcacgguauaccaccaaguuaguuuugagcaaaugaccuuuauguuuacacaucaguuaaugcauuucucaaaauguaugccuaucauuacugacagagcaugguuguuauuccaacauuaauuagucuuaugaccaaagcaguucauuagucuuacauuuuuaaacugucacuaucaagcccccaacgaacauauuuagugcaaaaggcuuguauaauaugaggccagucaauagguacaucaauuagagcuaaaucauuguagauggaguaaugauauggggauaggaggaaaggaucagaauauuguaaagaugaauaaaaccaaaugaaagucucacauuguucuacaguuauuaugaucacugcucauuucacuauuuauagccugaauaaaacuuaaaagcauggcuggauuagaaccuuggguuugaagcaaaucaaacauaauuuuccaaucauucacauguaaaggaggauuaggauggaggucugaaaaggaagccaugucacacuaauaauauacuuuuugcuuuuggguauaaaagaauaaaaaaaaauuugggaagccggagagaugguucagugguuaagagcacugacugcucuuccagagguccugaguucaauucccagcaaccacaugguggcucacacccauccauaaugagaucugacacccucuucuggaguguuugaagacagccacaguguacuuacauauauaauaaaaauauaucuuuaaaaaaauuuuugguauuugaucacacaaugcugugugaacaaauaccaagaacuuuuuguucacagcuuucuguuuaugguauauuauuuucucaaacaacagacacucuguaaacucuucaucaauaucauucaagaaccauuaucagaacagauuuacacacauuaucuuaaggacucaccauuauucucacaccucuuguauuuuauaguaaguaagucucuucagguguguauuauuugucauaauuguuuuuuaaugauuuaauuuuauguauguguguuugugcaugcacaucugugugcaggugacugcagugcccaggguauuggauccucugaaucuagagucacaagugguugagguuggcugaugugaaugcugggaaauugaauccugguuuucuacaagaguggcagguguucuuaccuucugggccauuuaugucaucccuaucauauucaccuuuugauuccaggacuguggguauaaugcuuacuaagccaugugcuagcugaaaugauucaugcgagauaauauagccuucagaacaccaauugcagauacauaccuuccucuggagcaugguaugcagccaaagcauucagcauaucauagauaacuuccuuaauaguaucaggaaugacaggcagagaugagggcuucaaagguguugucuuuaccagcuguacagcauuaggaccuuuaauucuaagauucucaaauucaucaucugaagcuaggccaaaauuaaacaguaaagucagacaauagaacacugguauucacuaucaacaagaaaguacccagaacaaggauuguguaguacauaaaaagcaggagaaauaauucuuuaaaaauuaaguucaagucuuauaguaaagaaaucuaccuuuuauaaacuauaaacaaauuuuguuuuguuuuuuuaaguuuuucaagacaggguuucucuguguagcucuggcuguccugaaacuaacucuguaggccaggcuggccuugaacucagaaauucaccugacucugccuccccaagugcugggauuaaaggcaugcgccaccacugcccggugaaauguuuuuauauuucaauaaacaaucucacaauuuuuuaaaugucuguaugaacuucugagaaacuucauauauccuacaagucuccuagaaauggauccagaauccaauccaaguagaagugaccguucucaucugcugagauacuucaauuuuuccuuucaauucguguuuaccauggguuuaggcuagcuguucaguaaaauauuuccauaauuugauauaaauguaauuacuuccucaaugaaauacaggcauuaacuuuuugguaagaauacagguagcacuguaaacuuuucauuggauucugucacccaaacaaacaauuguuuuucaaugaucgcacuauacagaaaccaacugcaguuaauuuaacuucuauugucacaucaaaaugaacacuuuguagguaaagacuagagugaauccuugggaguuguauuaagaggccaagagaaauuacugagaauuacauacagaauuuacuaagucaaaugcucaaccaaugucucaauaucugccuaaagagaauuuucugaaagaauaguagcaaaugaaacugaccaguuccugagccucgaggggcuggaagggcaaugcggauacagcaauuggcuacuucugugaauaugucuggauugcggcaggcagcugguccuaggacucuaaggauauaguugaucucccgagaaccgaggcugccagauacaacaccagauguaguacuaccagcuccacuuguggcugccgagcgaacaaccuaguaaaaagcauugucaauuuaaguaaugaaagauacgcuuguucuucaagacucuuuacaauuaaaauaagucucauauacaagucauaaagguuuucaaaacuaaauucuuacaugaauguuauugaggugcaucugauuacacaugcuauauagcuuccacauuuaaguguaggcucuaagacuccgcaaaugcugugauuuuaagcuauaauaguucaauuauauuuaacauaauagaacaauuucuucaugcuuuauuuagucaaucaucacuuugagaugacagcuaaaagagcuaucaaauuuauguauaguauccugcgauuaaaaacuuuuagaaauauauaaucuuuuggggauauuguauuuuaacaaacuacucauguuaucuaguauagcauauuguaauuguuagaagaucuggcuuaucuagccaguuauauuucuuaauuuaaaauacagaaguuuugcuuuauauguaaagccaugauuuauacuuuauacaguugucuacuccuugauauuagacuuguauuuucuugauauuauauucuauguauuuuuguauaaccaauauuuaucaugaggcaaaucuuuagcuauagauuauguagauguguaauggaaagaguguguacaguugcagagacacuaaauucaguugccagaacccaagaugaacagguuauaacaggcuauaacuccagcuccaggagaucuacuggacuuugagggcacuguacuuuuuuguacauacauaccaacaaauuuucagauuuggugcaguugcuuccuugcaguguaauuuagccaaacuacugcaacagcuuaaacagcuaaacuggucuuaaaccuagacuauaucauguggagacacagguuuuuuuuguuuguuuuugauuuuuugagacaggguuucucuguauagcucuggcuguccuggaaaucacuuuguagaccaggcuggccuugaacucagaaaucugccugccucugccuccugagugcugggauuaaaggcaugugccaccaagaaaguaaguuuaaaaaaaaauuucuagaagguucucuuacucugcaccaugaaacuguccuacaaugauguagccuuaccaauaaugccuuuugcuacuuaucuucuuuuguuccuguuguagucugcuucaauuuaauacuuaagucuuucaaagauucucuucauucaaucauguucuguauauacaucaccuuagcauuuuaaacauuuggguuuuuuaaagcccaaauucugucuauauguaacuauuucuucccccacugaccucaaauaugcugccuuaaacagcucuaagucucgugauuuuggacacgugaugcaaaaccaucuugaaggaagaauaaaaaauucuaauguuccaagaaagagggugaaaccuacuaauauuuauaugauuacugaaaaugauuuaguaagaagaauaagaauucagcaaaagucuuuaggagguacaaagauuugcugauuaagauauuuaucucuuaauuauacuuaauguaaauauuuuuauaauuuuuuucauuucuuccacugauauauucauuuaguucuaaaauauaagaaccuauuuucuaauuuuuacaaugguuaaaggcccaucagugcacaacauaccaggaacauuaaagaaaaaaaaaaaaaacaaauauacagacaggcacaagacuucaaaaauacugaccuuuuccauaguaugacgaagaguacaaggauccucaaugaugugccuuaagagaagggugacuaaggggguaaacccauugaaaccugagcucugggucaaauucaagaucauucguguacucuucaguucugcaaacaucauggcauauuuguggucucgggugagccuuaaacagagacgaaggguggcaugcaaagugucuggguccacagggacucccagcaugcucacacaggcacggauuagaacagucaccauaucuucugucaggcccuggauuaggaucuccccaauuuuuguuucauccaggcuugccucuuuuucaguguuugugcucucuagagcuaaggggauaucuacaaauuggaaaaaaaaaguguuuucaauuugacauuucacucgaucucucuccuuccaaaauaaucagccaucacuugagcugaaaaacacaccuaauucuaagaccagauguaaaggucuuaggaaaagaccaucucucugucucuuugaguuucagauaauaagccauacuaccuuaaaucauguuaauauaacucauaaugagggggcuggagauauggcucugugaauaagaucauguacagaagacugaguucaguucccagcucuacuguggggcagcucaugacuaucucuaaguccggcuuaaaggggacuugauauaaucuucuggccuccaaagguacuaaauacaauuaaacaaauccauucuuucagaguuaaaacaaaaaaaaggauuaaaaauaaaugcaugguacaaaaagugcacaccucuaauuccaacuacuugggugguugagguagaaggauuuugaaugagacuagcuugagcuauauauccagcaagagcaaccacuuacuuggaaggaaaaacaaaugcaaaauguaaggcacauaccauugccuuuauuuucuuuauguuugauaucggucuccuugcuuucuuccagugucuucucuaguuccuguccauugcugcuuuuugaguucuuacucagucguggcacccugaggagagucagcaucacagggcgucgguuuccuguuucuucauuaaccuaagaauucagacaaaacaaagcuguccuuaaaaaacaaaguccuacuccuuagccugagaggacuauccccuuuucaauaaaguuuacauuauaaguugagcauguaccugcaccauuguagugaacuggacaguguaucuucgucggccagcagugaaucuuacacuuguuucuccagauuuccaggcagaaucaauggugcuguuguugcuagcacuguaacuacaccaacgcccagagcggucaucaaaccagcgccaguuguugcuguuggacuguagguacuaaauaaaaugcaaaugcauaaaguaucuucauauuuccugcaacuuuuauugucaaaauaaucagcagcuaucaguagacagcugcuuaaaacuaaugcaggaaaaaaauguacugggcauuuaauauacuuucaagaggccuuucuucauuucuuggucuuuuuccaagccaaaaacccaugacaauuuccuaucuugacaaccuauucuuccuuuuguuuuaaauuaucuuugauaaaagaauuaugaucaugagagauauaaggaacaaaugcugcuaagaacuuacugagauauuauggaauacuacaaucuuuguuucaggaaaauauuucuagagagacugcaguuuuuuucaaguagccaaagagcauacuaauucccauaguaagaucuugaggccuuuaccaaaugguuccaaaaauacugacaauggugcugcugcuacugcuaacaacaacaacaacaacaacaacaacaacaacaacuugaacuguucauuuaaaagagaaacuuaacuaaugaaaucccucaagaguuguauuuuugugggaugauuuuacaguuuucacuucugaucuuuacuuuuuccugucuacuacugccacaagaaaugaaauggccauguaaaacaaagacauagugcuucacauaccuuagucauuugggcucuucucuuugaugagauggcugucuuuucauaaaaaucaauaaggagcaacacuggggugauccaccuaagaagaaauuauuuauuuaguguaaggcagaaaacuacacaaauucggaaaaugucagguauuuuauaguugucuaaauaaagaucucaggauuucacauaugcuucagaaaagugauucagacccuaaacucaagggccaagucucagagaaacagaaguuaaaccaggauagauaaagagccacucacuuuggggucuggacuuccuuuugcucuuuggcagccuguaggcaggguugaaccacuucuaagaguuugauuaggacauuaagaaugccacuugauucaaccacccaggcacaagguaacuucaacuccugauuaaaaaagacaaucaaacaaagguuaacauuuauacaacuaauuaaaugcaaauucuauuccuuauuaccuaugagcugagcuauguggacucagauuaguaacuucagaguguucuacauuuugguuuccucaugaguuaagagaaguuauaucuacuuccucagucauuguaaugauuaaacauagcaucaggcauaauagucaccuaggcuacacacucuuuugguuuguuuuuuuuauuuuuuaguaagccaggguuucucuauauagcccuguagacuaacugggcuguccucaaacucaagagaucugccugccucugccucccaucaccacuaccacucaguagugacuaugcagccuuaacauuuaaauuguuuuugauuuuuaaggaagcauuaaaauauuccaagaaaacuaagauaauaaauaaugauucuuagcaguacuauuaaaguguuuugcuuuuuaacagaaaacuauuauaaguaacaauagaugguuauuuagaaaaaauaacauguauauauaugauauagggaaacaaucaugauuauuuaaaugaaaaagacuagaaaggaaaaauuaguaauuuuuuuaaacgagauccuaugaaucaccuuuuuuuuaaaauauuacaaugcuacagaggaucauaaacaugcaguucuuuacuuucgggcaguggugacacauaucuuuaagcccagugcuuggaaggcagaggcagguggauuucuuugaguucaaggccagccuggucuacagggcuaauuccuagacaggcaaugcuauacgaagaaauccccuucuauaaugguaucugacugguguguauauggcuuuuacacauguacauacucaacuacaaugacagaaacugaccaucaucuuuugacuuaacacuuguucuaaaaaguucuucucgcauuauauucauaagugauauauauaaacuuucccaacacagaaccuucuaccccuaaccucaugauguacauuuuuagucuauugguacacaugaaauacaaggaccauauuuuguacuucucuccaauucaauguauugcuaagugcuggguaauucuuuaauaaguggauuacacagggcaaaagaucuguuaccucaaaaaguaguguuaaaagcaagauucuaguagccaaauuggaggccuguggcaggguagccaucugacugauccacucugaaacuguuuuugugucacuuguuguuagaggaagagcagcuuugaucaauacaucagcagcuucccacaccuaaaaaaggcaacacacacacacacacaaacacaaaauaagcagccaagucauguacauauagaguaacccagucugugaaaauauuaaacauauucccuccaaccucaauauauuugcagaaaaguagaaauaacaaccuauuuaugauagugaauguuucaaaagaagacauaaucauuaacaaucauucuaaacaccuuuuuuuaauuuccuuuuuguguguaccauguggguucuuggcagguaauuacuuuuacacuuugcuaaaccagcuauucuuaaauuuuauuacagaaagccugaauucuaaaccagcaugaauguaaaaaaaacuuuucugguauacauaguaaacuuccaaaagauucugccaaucuuuacuucaaauaacuacuaaaauguuagaauagaagcauaguuuuaauuauuaaauuuucaauuccuuaaaauuaguauagggauaucacugaucuuuauuaaaauuuaaccucccucaaacuaauuuaauuuguguaaccacacauuucacuaaaagauuguguaucuaguuuuccuuaugauuaucuuucuauuuauuaaaaauuuaugcuuuggccagcugucuagaaaaaaacagaugcuugacuuagaaaagauaauuuugagccuaguguaguacacuguguuccagguucccaauuuuugugagguaucauccaugguaagcuuuagugauauaacugucauucagcucuuucugcuccuguaaguaaccccucacacauauuccugugauacaccuaccacauugguuccauuuguuuuuuuuuuaaagcuaacaaacaauccuuauguuuucauugucuccacagauuucuucuuuuaaaugauacccaagaaaagauuuuauaaaacaaaaucuuaaagacuuaaauacauauagugauacaaauuuauaaagauauacaaauaaaugcuacagggauauuucucgaaguguagauuggggauacuuuguuucuuaucccaacccaauaauuagaacagagaggaaacaaacacuaaaaauaguaacaaaacuggguugaauauccaucagaaagucauacaacgggaaaaaaaaaugaguauuuucuuaauaugaaauguaauuuaccucaaacauaagacuuuuauucuacguaacucugcuuuuaccuucugaagacuauuuuucgugugaaauaaauaaauugaggaagacaaccaaguagaguuagauugcaaacaaaagaauucaaauccagaauauaaacauaugguguagaaugcaagacuuuuucagaaaugaaguugacagauaacaguaaaacaacuuuacuaccaaauccgguauuuugagaacuuaccugguugacaacuugcuuuagaaucauaucacgauagucagcuccauuacguuugauagcugucaugaucagaucacaaacacgguacacuguaucaggcaacucaucaagaagauggaagcagccugguaacauuguaucugugaaaguguggagcucaucuuguuccaaggggucagcaucuugaaacuucucuagacauuuagcuucuuccucuucuuguuuuucucgagcuuuacgcucuucuuccuccuuccggcaagcaacuuccuggagguagaaaaggaagugggauaauauaugccagagguaaagaauaaaaaauuaaguaccugauucagucuuugaauaucaucuacauuguuaaaaaguugaauauuucaaaaggacauggcaacgaauguaacauaauagcuaaagagguuaaugcaauauaggaaaaacagacuaagagcacccaaaaacuuugucaguugaaauuuauaacaucguauguacuauucucaagaaaacucauuuuuagauccuauccaauguuuccuuccagugugguaaauuuaaguaacaucauauagcuaaguuuggacgacugguuacuacuaguuccauuuuggguuuuauugacaacaaagacuaauacuucauuugaaucaucgacagcuucauuuugguugauaaaaguuagcugaguauaucaaaacguugagaugaauaaguauucacucccccaacuuuuccuaccauuguauagugauuacagaauacaaaaaauaguauucacagaaauacacagauuaaugggaaaacauacuuuugaauguuagacuuuaguuaccucaggugacucugcccuuugauccauuggaauauccugucccagagacauagcaauugcucucaucaucugguccucuucugacaugcuaagauccuacaaaguaacaacagagaauccaauaaauauacaaauccccuaauaauaaaaccuaaauuaaaacaaacucucauaaggaaagggaaugagacuggaauauuacucucucuaauuaaaccaaaauaaggcuuauguggguuccaaccacuacagggacaauggggaaauuuacaaugaaaauuaaguaagaaagaauucugcaaacaaagcacuaaaaaaaaaaaaaaaugcagcauggccagggaauagaagauccuagcagcuucugaagcuuucagaauuaguacauaaagcauaggcaaaggacguggguaaaaaaggcucagcagcuaaaguaauacaguaaaauguuaagauguuucugugucaacucacccgaacaacuccuccuaugauuggaggaggguggguuaaaagguacucuguugcuuguuccaucguacugguauucaacagugccuccauggcauguucucuugugaaacccauguccaugagcuauauuaaaaacaaaacaaacaaaacaaaaaaaccaagagcccagagccacauuaacagagaaauaaaacaaacaaacgaacaaacaaacaaaaacagaaaaaaaaauaaguaacaacuuguuuaugugaacuaacaguacuuauaagucagaacaguaauuuaucaucaauguucuuuucauuuugguaguuauauaauauccaaacauuaaaguugcuuauugaugaaaagaaccaauaugucucaauuucaucaucucaaaauggaggccaggguagaugguuacuauaacuugagauacacugaaguauaaauuggcaccuguauucugaauuagaaacuuguaacaacagaaaaucuaucuacaaaacugaucaaggauuucaaugaucacaaagugauugugaaauaagauauaccuauaagaguuuguauauuaaaaaaaaaacuauaccauagcauccaacuaaaauagacuaauuuccugaauaagaauacaauuauauauacuauuauauauuaguauaaagucucaaaauuccuaaacaagaacuuauuuuuauaauaagacauagcaaggcauauauauauauauaagacagauuugaauaaaagaaacuucauacuuaaaaauuugaggaaguaccuagcacgaguagaaaacauugcucccagaagacauggaucauauuaaauaaaaaucuuagugccaggcauggaauauguuacuaaguauuauaauucaagaagccucagugucccuuuaaacagcacaggauauuaccuuuguuuuugguugccaaugauuagcuagguuguucagaccccaucacugaagaugcaacacacuuugguuacaggacacagagaaaucaaauuauaauggagcuagauuauguuucgaugcuggcuagcuuucacagugccagaaacugcuauguaggucacuuggggagaaaaguaauuaacagacuuacccggcugugaauccaggcaugcuacaauacagaccccaugcaaugguggcaugauuauuauggagguaacuaacugcuuccucauuggauuugaggauugguccacaggagggaccaauauauauaccuggucaaaagcccauggcugagaaagucauguacuuaagcuaacuuuucaauauuuauaccuauagauuaguguugcauucagccuuuaaaagaaguuucuuuuuguuguaggcaauaguuaaugcagagacuuuuacuccaaguauugagaauaagcaacuucaagugcucaguccauauuaaacccacccuccaaaggcuugcuuggggaguauggugggaagggggucagaaagaucuuaagaugggaaaugaaauggaaugcuucucaaaugcugcuuucuggacaugcauggcccuugcacucaugaacucacaagaguuguaguuaccugaaacaugaugaagccaaugaacauucaacuaaggauggugagggguucacaaagccccaccucuagcugaggagcuauugauaguuuguggcugcuggggaagagagaguaauucagggucuggcaacuguuaagcuuucuauguuccaguggcuggccauauaccuacauacaugcggucagcauuaacgggacucaguggguuauuuaaaaaaaaagaaaaauagaacacgaagguaggagggaaauggguuggggaaacuagggaaggagguuggagggguggcuauaugauuaaaauacauguguaaaauucucaaagaguaagaaaaguaagaaaaauaauguuaaaaugcucuuugaaacuuccccuuuuuggucuuuauuuuucaaaauguuauuauuuuaacgucauacagguuuagugaauaguuuuucaaaagucuuuuacuggagaauauauuuagcuauaauaguuugccuuaucguuuaaccagaaaguaguugacaguacuaccaaaaaaauuuuugcagguuccugaaaacaauguaauuaauauguuuaugaaaauauagauauguuuucugcacaaaguacugggaccauaccuuuuaccuuuccucacuaggaaaaaaaugcuuugagaaacuaagaaccaaggaaagcagugguaugaaagcuuagaaaauuuacaagcaaguugaguggcaaauaacucucagaauuugaagucagucuugccuacagugagacgagguuaaaaaucaaaaauuuuugagcauuagagucuauauauaaggugaaaguguagaaucugagcacucuaccuguuguagcuguugcugguugacuugagguucucugcgugagccaccuucuuccuggccugcuucuucuucuccucgagauccuuccuucucuuugcucagucuuucucgaaucacagguuccccucggagaauguggcacaaaauggccagcauagacucagccauucuucccccauauacuuuaagggguuuccgguuccacagguucuugauacaaguaaaggcugccuguaagccauuugaaaaguguaugaugacuuuccccaucaauucaaauccucagaaggaaaauaagacucacagacaugccccuuccacaaugagucaguuacaacaacaacaaagaguuagacuggcauguagaugguggguaugauagggugggaacauuuaagucaacaagaagaaccaaucagaagcauguacuucaaguuuuuuguuaaaaaaaaaagcuaaucugaaaaccaaguccauuuguuuuucaaaauucacauuuuaauauggacagaguguagugauaacuaccuagcaugaagaguuuuuuucccccuuugguuuuaaaauguagaauacucacuuuuugaguuacuacaaggaagcgaagggcacuaaauuguggaaagcucuggacuccuccaggcaauuuagcaggcaacgaauguggagauucaagcaccguggugggauuuaccaucuuuucuacaagcauaagccaggcaucuaggaauucuccuguaccaucagguagaucugaauguuccaaucccucagaaacaggaacuuuuccucccauggauagagcccaguugaaaguucuaaauucaaauaagacaaaacauguaaauagaguauuaacuaguauuuuacauugaaagaucacuaauacacuuguaccuuaucuuuuauccucuucguacacauuuuguuuuuuagguuauaauuguaucacuuucuccuucccucccccucacuccaauacuacacccauauacuacuacucacucuuucaaauucauggccucuuucuuuguugcuauaaaugcauauacauguauacucauauauugauaaauauaacauguucaaucuguauaauguuaauuguaugcaaauuuuucagggcugaccauuuacgcucuucccuagggaaaacucacacucugagcauuccuuaauagccuguauagaccuuuguauagguuugaguccuuguggccuucuccccacacuuuggaacaucuacuguuguuuucucuguucaauucauguauaggcugaaacacuggggaaacuuuauggucacaguccccgauacccggcucuuacaauuuuccuaccccuuguucuacaaucuucccugagcuuuagguacagaguuauuuuguauauguauccaauagaacuaggcuccauaacucagcauuuugaguggaugugguuuucugaaauugucuuucuuacugcagaagaaaccuuucuugacaaaggucaauacuuuauguauuaaguuaggcucaugugaaguucuuauuacuuuuaacaugccauuuacauaugcuuuaaagacuuuaaaaaauccacucaaacugcuuaaguucaucuuaaaauguuuuggccaaguaaaguaaaacagacaaaaaccaaauuuacuguacucaaagaaaaaaauguguaguaguaggaauagaaagccaaauauaaaaacaagagauccuauauacacucaugcacguacuuuuuuuaaaaaacuuuuaugaguguuuguugacauguguguguuuauugccaaggaagagguaaucauauacccuagaaugaguuacaggcaguaguaagaugccaaauagguauuggagauagaacaugggucccaggaaaaagcugcagcguccucuucucugcucaaccaccucucuagcugaaaugcagacuuucuucagaggaaauacauggcuugcucauaaaacacaaaaugauacaacuaauagcucucuuuauauauccuagcaucacaggauaaaugacuuagaaagcugugagcagguaagccacauaggaaagaucaaaguucaagaaacuauucuuugugaagcaaaugauccuuacucaaaaagagcauugugaccaccagagcagagaaauuucugcagcauaaggugguaaggauacuuucucucaucaaagagcauuggagaggugaauccaacugaacagaugaagaacgucagccuaaaaaauaaaacaaagaaaagacaaacaucuuuaagauacacacaaaaaagcaacaggaaauuaagugaaaaaaaaaaucuaaaggaaaggcuagcaaaguauuuaggugaaagauuaguuuggcacuccugugauaucugccacccaauuaagaauuagaagguuacuuaaauacuguuuaacaauaaacccuuuagaaauuuccaugcucuauacuaaguacaauaaaaauacuucauauggaauauauauaaagagaaagcaagagacuucuaaacuuuuccucaguagaauaggaagaaacauacaucauuuuuauugccacuuucuacuuccuguaccuaaaacaggaacucaccugaagcggggaguggguguauauggugggggcugccaugauaagccuuuugugaguagcuuagugagggcugaagcuguugaucuagcagcagguguuggugcaguggugguacuggcagcaugauggcuccuccuuuggcggacaggagaacccacacaaagcuuaacaaggaguccaaagagcucagcaagugcucggccuaaucuggaagaagcugaaacccagaagguaguauaauucuauaaaguauucacacaauuuacaguaucacaccuaugcuccucauacuuuaaaaauaauuaucauuuuuauaguaagucuguaggucagaggacaccauuaagaagucuguucucuccuuguaccuuuacaugagcucugggauuacaggaaauauguugucacaccugacuuuccaucuggguguuaaagaccuaaacucucauuuacacuguagucacuuuagucauuucacuagaccuuuucuauauuuaaauuuacaaacacacacacacacagaacacuguuauaaauaaaaaauacaaauuauguaaauuacuaaauaauagaaccuuuuuauucuuaaagaucacgcuuaaaacaguaagauuaugcaucuauacagaaaaguuauucaucuucuauucuacauaauuuuauauuguauaauauuaauuauggaacaggcuacugccuagguggaaguuuuggcauacucagaaucuaaaaacuuaaaugaauuuaagucaaaaggaaaaugcaaccaagcccuguuucucaguauuacucacauaugaacagauagcaaaacagcucaaaaaucuaucaaagguaagaaaacaaaaugccugaucagcaaggaaacagacaaaacaugguucugaucuaccacaaaccuuagaauguucuaagacaauaccaacaaacaucaucuaacuuuacuucaauucagggauaauuaguaaaauucauaucaaaacaagcacaacgauaaaaucuuuaggauuugaaggucauucucugcuuuugggaguuagauuuucacuuucauauguguguguauguauguauauggauguauguauguauguguauauauauauuuuuuuccucccccaagacaggguuucucugugcagcccuggcuguccuggaacucagaaaucugccugccucugcuucccaagugcugggauuaaaggugugcacaaccacugcccggcuuucuucuuauauccuaaaugguaacuauuaauaaauauacaaaauagguccucugaaugaugguaucauauaaaggggcaaaagguggcaaacacaaucauuuuacaucuuuaaugcaggcuccuugaaagcugccaaaguaacuuuaauaaaacacaagaaacuauguuucuggauaaucaaagcaaaaugagacuggugaaaauugugauugcuuggucauauaaaaagcuaagaguuauuuuuaaaaaaaaguaucugguagacucagcaguaagguacccugggagacauuccagcagaauaauaggagaugccauuugcaauaacugaagaacaaacaaguaaaauuuaaaaggaagaguagauaaagaucaggaagaaguuaucuccuuuuauaucuuuagcaaccaauuuagagcaugagacacaauagggauucaacaaaguacaugugagagucacaacauuucuacaacauugacuuauuuaaaauaugguuuuuccaauuuaacuuguuugaggaauacuagagcucugaagcccaaagagggaguucuaaaaauggagagucacugaccugacagcaacggcuugauuuguuuaauucuugcagccauggcaggugugauuuuagauuugcccuuagaaucugaagaagaagguucaucugucuccaugggugccagugugucaccaucuaguucaauuccuucuaauaaacccugggcagaugcauccaugcuuccagcaguuccauccuguucuccaucuuuagaaguaaaaggggguaauaagauaaugcagagcuaguacuuaccaggauccauuuuugaagggucucaaaaaauaguuaucuauggugcuuaucccuauuuaaauuucaauuaguucuuaagaagcucaaaccaaaccaaucuuccacauccaaagcacaacaacaauaagaaugacaccaauaugcuuuuaugucuggagcucuaauaaguaaauacuugcuggcaucuccaaaugaaaggauaugaagcaucuuaacaccgguaucauauuugaagcuaucacugaagaaguccugguagaaucuuauaguuuuuucaaauuaaaauugaacauuauagaauacugcuggacaguauucuggacaguauucugacaguauuucccagcauuuaauuauuguaauuauguauguguacugaaagacaaacuuggauucucaugacaguguagcaaaguguucuuaaagagacaucucuccaaccaaagccccacccccuuuagaggcaaguucucaaacugguuccacacucaguaugaagucagaggugcuaauccuccuugccuuuaagccacaaugguaaggauuaccggacuuugacuauguauuucuaaaccucagaauuccucuuuaauaguuuuaaggaauugugacuugaguguuaaccaaauugcuagaaacgaggugguaaaaaugugaagacugaccaaggcuacccacgcccccaaacaagaguguaaacuauugggagaaacaauucuuucaggauuuuaauuucauuccuaguucuuaauaaauuuuauugaguuguauuugaaauggacuaaaauuugaaauauacauuuucuucaaaauuaaccucagaagucuguguauacuuauucugacuccuaacaaacagcugcuguaagcucuuauuuuuaagauauauccauuuugauuuugguugcuuagguuuccuucucaguaauuucaauucauuuuaaagaauaucugacagcuuuauacauagaaucgucaucguuauuuuucaguuuuagguacuugggucuuuaaaaucucuggaaauuuuuuuuaucaccuucacauuugcuacaucaagaucagagaauuuuaugugauuucugauuauacuauuauggaacuugcaaugcaauuaaaaaaaaagauaauuccaaagcacuacugucuaaaagaaacagaauguaagccauacauacaacuuugaguauccauuuuaaaaaguaaaaauagguggaaguuuuccauuaacaaaucauuuaauccaguaugaucaauauuauuauucagaaaaaugagaaaaauuauuuucccaacagguuacagagaauuuauacuaaaaguugagaagucauaaaugaaauuaaaauauuaccauaccuuuagguaucauaauugucaggacacuaucuuguauuuauaaaaaacuacaugaaagacuuuuacuuuccuaaguagcacauaagcugggaauagucaacucuuggcauuuacaaaacaaagauauauauaucuaagagacucuuaaauauacuaaggaaaaguaucaggcagauaacucucaaauguuugguggcaaaauauguuguuaccccaguauuuuuuuauaauauguguauguuuuuacagaagaaacaacaaaaacuaaauuuaauaaaaaaaaucaacuugaagacuaaggaugauggagagcuaagucucacaguaagcacaugaccuguggaagucacagggacauaacuuagaaguaacagucauuacauuuuauuuuucuuacaguuaccugaucuuuuuccgcccugggucguaccugccuucucauccuuuggaacuaguuucugcauguccgcuugaccaaauucacauccagaugguaggcuacaacaagggaaauaaucaaacaaacaaaaaaccaaaacaaacagaauuaagugcuauuacaauuuauauucugcauauauacuuauauacugcuugggcaguaccucuaagagcaccuaagcuauccuaagugcaauaaaaaaaaauuuugauucuugaagaagcaacaaacaagauuuguuugcauugugcuaacacaacuaucuccaggaaaucauauuaaacauucagaggauguuauaauuugucaguuaaauccauaggcuagaagguaggaaggauaaaaaacuggaccuuuuuaaucaaacucauccacccuguucaaacuuugucuauuagaaaaacaaagagagauguuaagagaaaugagcauucucuuaccuguuggggguacauagagagaggaggacagugcuuucccacaccagagaacaguauaacuggcuuagcuugcucagaacacucaaacccaauugugaaccccacugguuuacugagauagaacgaauuucacucugcaaccaaaggauaaguauuugagacugucuacaaacaauuauacuuuaaaaauacuauauuuuuaaaauaucaaccuuuacuguuugguucgauaucaucugccuauaaucccagcauuuuuggaggcaagaaauacugagugcgagcaaugucugggcuacauuauaguguagcugguagaaaacguacucuuacccaguuuuggaacuguugaacaacuuuuuguaauaaauuacugagacauaaacaugguaaaaauagugaauacacaaacacagagccaggagauguacuucuguuaccacauguacgaguaucuaggcguauggaggcuagaaaacaaccuguuccucaggugcugaccaccuuaaguuuuugagacaauuuuuggcuagcccaaaagccccagaaaugcaccuauuuuuuacaguguugggauuauaagcaugugcaaaguugucaggcauuuauacagaauuucugaggauugaaacccaggucuuugcuggacauggggguacaaccuuuuaauccuagcuaccacucgggaggcagaggcaggcagaucucugaguuugaggccagccuguucuacagauugaauuuaaggacaguugggacuacacagauaaaaccugucugaaaaaaaauuaaaaaaaaaaacauaaaaaaaagaagaaaacucaagucuucagauuuacacagcaguuauuuugaaacugaggaagcuucccugucuccacagcaguuuucuuuaugaacaagaccacagaaugcagacauagcauuugacacauuuucuucuuguugcugucugcuaacuaaacgcuuugugguaaaaaaaauuuuuuuugccauuccacuguuggaucuauauguacuuauauagagauuaggaaauaauaauuuuuuugagaaggauuagggauaaauauagguaccagggaagcccaauaaccugagcuugauacuuagaaucuacauaaaagcauaaaagaauggacuucaaaaaguuguccucuggccuccccaaaucccauaugguaugcucaaaacccaucaaguuaucaggcccacacaaaaguaaacaaaaguuaaauaaaugcaaugaaaugaguuucauauuugcuauuuuaaaaagauagcgguaagaugcaauggccacucaaauaauuuuugccugcaaaaacagucauuuguuauagauaguaauaaaaaauaauaauuaugguuuuucuuaaaguucuauucauaugauaaauguauaugccuacacaacagcuaauaaaaaauaagagaaugaagcuccauggcaauuuaaaauauaaacccacaaccaccaccagauauauuguucagaaaaaaaaaacaguacuaaauaaaaauaaugcauuucuuucagcuaugacuccagguauauuuguucccaagccaguaaucuagcagauggauauagguccuugccauuuuauuggcuuuaagcugaaaccauagccccaugauuauucuuaccuguccaacucugcaagugugaacaaacaucaugauguaagcaugggcugcagugagugcaugcaacagaggcguggccugagcugagaggguagcaucagcaacauugccugcacaugccaauucucucaguaacacugagcccccaggggauucaaucggccgauguaaaggcuccaaggaggaaaggaucaagucuaauugaaggagaccuucuugaagaacuuuggguucaugugacagggucugaaacaagaauuaugaaugugucuccacguaaugaaauacauacauuauguucuuaacauuuacaguaauagugacuauuacuuaacucuccgaaauuucagucaguuacauuucucaauuuauaaauggcaguaccaaaauaugaagccaggaaugauauauuucacuacuuuguguaauagcauauuauuuuuaagcuugaugagccaaucauaacaugaaaaugucaaacaagacuguuuguuguacugcuguguaagagguuaguuucaaauuuugcuuagaaaggagcaauguuaggcaaaguuccaaaucuuaaaaaugagcuacauuacaaugguguuuucuauuuauuucuaaugaguaaaucaauaauugaauaaaguaaguauuguauuaaauauuguugagggaggaggcugagagggcaugugaaacucaaccucauacaauguuacauaaauuaagcagcuguaucuauaucuagcaguacaaauggugcagaaggaaauaagggagaaagcaacuauuauaaaagcuacugaggcuagucaaacuaucaagaaguacuuucagagcuauaaaguugucuucuuuccaaaauaagaguggugacucugagauuggcaucaggaaggcaaauuauuuuaauagacaaacccaaauauuacauuucuuuucaaguuaaggaagaaaaaucuggcaauuaaagauuaccacuuguuaugcaaagcuagaaauuauuugccuuccuauggcuugaaauaaaucuaucccuccucacagagcaucuuagaggugggguaguuagaucaguccuuuccccauguucucuuaugaaagcacuuuacaccugcaaagagugaaacaaaauaaaacauuaaauugcaguuucucaaaauuauuuaucacugcacaaaacagccaacaaaggagcuuuauuguaauuacuaucaaaauucccccaaucuuuuuuuuucuggguuggaggcagauauaaaauuucccucauaauucauuuacaacuuuucaaagaacccccccccccaaaaaaaaaaacaaaauauuucugggguaugagaacacaacucaauuuggaggucucacacuuccugauuuccaauuugauuuugauuaguuauaauugauuaaucaaaauugugcuacuggacaaucaauggaaaagaauugggcugagaaagaaaacuccaaauuuuuuaguuaaauuguguuugaagagauguguugauaggagaugguuuaauaaaaguacagucuuuucaaugaaugauauugggggaaauauaaaauaaacaaaugaaauaaauaaaguggaaccuuuucggucucuacuccaaauguaucaagaccuaagaauuaaaaacucauaauaucuagauuaaaguauaggaauuaaacugucugaaauuucuuggaucagcaccaaaagcacaaaaaacaaaaaugacaacgauaacaaaagacaaaaugggccuggucagcaucaaaaccuuuaguaugucaaugguaacaaacaggcaacugacaaaaugaggauauuugcaagugauguaucugaaaaaaagaggcugguguucaauauauacagagauauucgauaaugaacagaaaaacaucuuaauuugauuaaauauaaaauaaagaacacaaguauucguuuagcaaaggaugcacacauagacaauaacucaaguacacaaaucaaacguuaugaucaauaccaccaauuauuuaggaaaugcaagucaaaaugaaaacgaagcacuacuuuaucuucaaggauggcuauuauuuaagaaaacagaaagaaagaaagaaagaaagaaagaaagaaagaaagaaagaaagaaagaaggaaggaaggaaggaaggaaggaaggaaggaaggaaggaaagaaggaaagaaagaaagaaagaaagaaagaaagaaagaaagaaagaaagaaagaaagaaagacagaccgaccgaccgaccgaccgaucuggcauggaaauggugaaauuacaauccuuauguggcgcuaacuaggaauggaaaauaaucuuggaaaaguacuuugaagguuucaugcaagcacacacacacacaaauagaauuaucauuugauuaaguuaugucacuucaaaguauauauccaaaagauucaaaaggcaaaucuugaagugcuauuuauacacucaaguuuauaacaguauucaucaggggcuaaaauaaaagcaaccucaguguccaguaacagaggaacggacaaaaugaucuagaguguauuucauaaaauaucauuuagcuuuucuuguguuuuuuuuuaucauuuagcuuuaaaaaggaaacugacaaaauuaauaaauauuuagugucacuguaacacucuuaaaugcuauacaaugcuauuacauaagguacuuucaaguugaguaaauagaaugauaauuacuaacugaaggcauuaggggugaacaaguaacuugcaaaaaucaaagguguuguagaaauaaagaaacuguuuuuggcaaauuuuaagcaauaaauuacauaucaauuuaugacuaauaaagcuuggggaaaaggaacgaacacugcaaagugaaugcgcauauuaaaacaaaaaaacaguaccauaacaacaugaagaaagcuagaaagcuuuccuggaaauaauuuagacgcauaugaauucaaauggcaaaacuacacgcaaaugcaaaaacaaagaaaauaaauaauuuuacuaugggaaauaguauaaaauauaaaacacacaaauuuaucaauuuuuaacuagagguccuuaagcgagaacacaaugaaaauacauacagagauguaaaauauuucgcuagauguuucuuaccaauauggauuugcagacaccugcaacagccugacaggcagcagaugugggaaagucaaugggcagauugggaagacccaaaaugguaaccaaagguaagaguccuuucugguuuacaaauucuugacaguggucaucuguuguauuguugcucaaaauagauuccacaaauuucaucuaggugaugaaaguuuuuuaaaaacaaguuagaggcuaacacuuggaaguaaaaggucaguuuuacuucaucaggaucaggauagggacaacguauuugcaagacaucaguuauuuucuguaauaccacuucaauuaacagggacaaauaauuagcacauacucauccagaaaauaaggaacccuucccauucuaccuuuuuaaccacuccagaagucaauuugaaagcaaagagaagcuaaaugccuuguucagagcaacauucugaauuaguggcagaaacaggucuaugucuuaacuguauauacacuccauuuguuaggacaguucccacgcauccuuauaauauaaauaaaaugaacuccaggaaucaggauuugaaucaaaacaauagggaucuuugagggauagaaaaaauguauuaauguacacaaaagcacaagaaaaauuaucugcuuaauagucuagaauaaaugcuaaguggauauuaaauucugggaaaauuuuagugcucuucacauuuucuuaaugauacagggaacguccauacacuucagagaggggcaggggaagggguaaaaugggggaaaaacauguuggguaaauucugacagaauauugguuuaacacacuaaaucucguuaaaauucaaauguacaauaauaacagugaacagacaguugaaaauauaaaaaggcugagaauacugguucauuuacugaaaauggggcaagaacaaauauuuccaauuuugcacaccuuuuccucuguacuuuaauagcucuagagaaaauaaacauuaaaugcuauacaauguuaucacauaagguacuuucaaguugagaaaauaaaaugauaauuacuaacuaaaggcauuaggggagaaaaaguaacuugcucugaugacaaccugauguauuuuccugaaaagcacacaucuuuagcucuacaaugaaucuuaccacauuaaggauguaauccaugagggguauagguauacguuccucgguaccaacgacccuguuaaagagaaaagaaucaguuacacagaaauucauagcaccagcguaagggaaaaaaagugaagcccuuuuaauaagucaugcuccuagaguauauacucuuuuaguauaugaaccuuaaaacuaagacaugaagaaaaagagcugaaaucaauaaugaagguagaguucagaguauaaaauaaacaggccauaaaaauauagcaauuuuauacuuaccacaaaugacacauccuuucuaagagaaauuacuguuagaaaaaaauucaacauuauaaaaauacugaaaauaaacugaauuaaaagaccaaacaugugcuuacagggaaggaccaggcaaugaagcaaacauaaaacagucauaaucuuauguuagauuaagagcugagaaagaaguggauuuuugguuuuguucaaauaucuuuacuaugagccaggaguaguggcauaugcuuuuaauccucguacuuaaagaggcagaggcaugggcaggaggagcuuucagggccaggcuaguguacaaagucgguuccagaaaaaucaggggcuguuacacaaagaaaccuuaucucaaaaaaucaaaaaugcuuaagacugacaaauacuuaugaacagucaaagcuaaagucauuuucgaaggccuccuuuuacugcuaauuuguaauugcaggaugacaguuccugaauuaugaaacaauuuaucauguuuuuuagcuuuuucaaauucuucaauacuggaugcuaauuagguuauagauuuauaaagguaucuuaauauuuuuuucuuuuuuguuuuuuugggacaggguuucucuguauaucccuggcuguccuggaacucacucuguagaccaggcuggccuugaacucagaaauccaccugccucugccucccaagugcuaagauuaaaggagugcaccaccaccgcccggcaaaagguaucuuuagauuaaauugucuuuugcaagaaaaugagagggggaaacaaccauauauacuguacugagaugaaaagaaaauguaacucauaaagacagaaaagaagaaaacuuaaguaggaaacaacauaugaugaugcuauauguauccuugggaucugaguaagagguggcaauggaggaacagagauagugguguugagagaaaagauaguaaaagagacaagcaagauaaaaugcuaauaguucucauaucugacaaauuauaaaaauugacaaccaugaaaacauuuagcagaaaagugaaaaagaacaaagaagcuuuaagaauagcuucaguaaugaaacauccaaggcuuuuaaaaaagguuuauuuauuauuauguauaauaaguacacuguagcugucuucaaacacaccagaagagggagucagaucucauuaugggugauucugagcuaccaugugguugcugggauuugaacucaugaagaguuuggaagagcagucagagcucuuacccgcuugagccaucucaccagcccaggguuaaggauuuuauaaagauccucaacuuuuaaaagggcugaagagauagcacagcagguaaguacucaccauacaagccuuacaauuugaguucaguccucagcauccagggaagcagagaaucaacucaugaauguuguccucugaccuuucacauguguguaugagauuauacacauauacacuaaaugaagaaaauugggggaggggacuugcaaaagaaucuuguuaaaauuuacuuuauguuacaugugaguauacacgugagugcaggcuaacuggagauacaagugguuguaagccgccuaacucaaugaauacuguguccugucuucauuaagagcggcaaauccagcuuuuuuuucuagucccaugggcaaagaccuuuguacaaaaaguggaaaucuuuuuguuuguuuuguuugaucuuuauuaauaaaaggauuuuauuggauuccacuucauuuucccugcuuuguauauuauuaaaaaucgcaguagagacacuaaaggaaauggcccuuuguaccuacagaaagugcuguucaaaucaggaagaggacuucauuagagccuucuggacagaguacaaagcaggguggcagugcuggccuugugaggaacuucaaauggccacauuaccaaauuagauaaugagaugauggugaaaucugagaggcuguuuuaauccuuacauugcaaaguuuaucuuaggucuuucugggucucugaacuacccuuuguugacaacaaaaggcacaagaaauaauaguaaacuaguauaguccuuuccccacaauuuaucaggcacugugcugugugauuuucaguaucagcuuaaguauucauaccacucugagaaaguuaaguccuucaaaggacuaagacccuucaaagaaaggaaaucuuuaagccaggauugaaaagaacauuuccuagauaaugcacaacugcagcauuuuauuaaucaauuaauuauccuuuucaacuaagccucaccucccuagaaagaaccuaaagauccaccucuaaaacuacaaguacagauaccacuccaauggaauucuugccucuuuguauaugucaaauaugaucuaguaaagagcacagguuaaugcaacgaaaugaaucccaggugugccuuucauugcuaaaaaggaagcuguagaaaaaaaaaaagacaaaccaacaguauuguucuuaauauaacuccaggaacagacucauucauauauguaucuauuguucuuuccuacuacaucauuuaaaaauaaaaaugaucaguuaucuccuaaggaacucuaccuacaagccuagguuuaaccuaauuugaagcagucacaucccugagcaacaaaagucuguuuuuguaaaugaguuauaauuguccaauucuccucugcccaaucucuauucucucaaacaaaugcuacagagcugcacagaccacagacuuaugcauauuauuuaaaaguuccuuaauaucaaggaucaugagccuguacuuuaaaauuuugagugcugcuugaaaauuugcaacagccuggagguaucaggcuacauuccccauaucccagcccaucauuuagaaugaagaacugacugacaggcacuugcagggacuguuagggaacacaggccuugguuggauaaccagguccagccccucuucuccucacaguuuaggaccaggaaaaacuuaaacuaugguguuuauuaucaaccuaagucauguaggagaaugccacacuaugcccugaaaagcagcaagaaucaaaaagccucuuuguaggacuugaaaggcuuguuucagagaccauagaguggccagaaacagagucauaauccucagcacuuauuggauggaucacagggugcccaauggaggagcuagagaaaguauccaaggagcugaagggaacugcaacccuauagguggaacaacaauaugaacuaaccaguaccccggagcucuugacucuagcugcguauguaucaaaagauggccuagucggccaucacuggaaagagaggcccauuggacaggcaaacuuuauaugccccuguacaggagaacgccagggccaaaaaaugggaauggguggguagggaagugggggugggggguggaggggaauuuugggauagcauuggaaaugucauugaggaaaauacguuuaaaaaaaaaagaaggcugaagagggaagacugaguuugaggacacuguacaaugaauucccagcuacucuuaccugcaaagcaagaccuuaguuugugaauagcacauuagaaaccuaagaauuuagaccuaaacuaccuaagcguucuuauucuacacauccaacaaaaacuauuauuucacuaucauucauaagccaucaugacuuuaaaaaguaagaauaaaaaggaauuagccucaggaaaauaaaaaccaaguucauuaagaggaaaacuaaauaaauguaaccauaguuauacaacgcacucaagacuacagagacauguuacuaauauggauaaauucccaaaacacaguaaguaaaaccaaauuaaagaaacuaugcauuagaugcacauuuguauuaucauuguauuuauaggguauuuuugaauauacaaaauuauuucauguauaauagaaguaagaucaguagcuccauuuuuggauggagaaauauuugaacauacauauaaaaauuacauuuggauauauaccuauggcauuugaagaaggauagaggcaaagaaacaggaauuuguagguccaauugagaauguaaacuggggggcuggugagauggcucagcuuuaagagcacugacucucuuccagaagucaugaguucaauucccagcaaccacaugguggcucacagucaucucauaaugagaaacaaauuaaaaaaaaaaaaaccuauggccuggagcgagcagggccagggccggggggggggggguaaugugaacuggaaagagggcagauaagagaaaguugacaggcacuugaucuaaaguucuuugauaauucuauuaaauagagauaggagucacugaaacagauuaauacagaaaagaaucagcauaugggaaaauauaagcuugguuucccaauuggaagauguucuggaaugaggaacaaauguggauaaugauauacaauaucucaaguaaggaaaauaguaugaaaaaugaguaauauucagaagauguuaauuuacuuuaacagcagcuugaauuuggaauauauuagaucuaagaucuaauauaugcagauacacacaacuugauuuguaaucaccaccaacaacauucuacauucaacaaaucuuuuuuucauuugugaacaggaaaagcaaaucagcucugcaggguuacuggcaauuggagauugggaauaaauacuguaacuucuuuauacuguauugagaaaugccauaauuucagaaugucagaaugucucccucuuuuagaaacaugaucuuaaugguagauugaggacaacacuagagauuuaugccugcugucucaggcaaauggagauuaaguaaugacuccccuccaaaauuacugacaccaccaagugcacugcugaguuccaguaacucuuuuuacuucugcuauuccugggcuuuauucauacucuacuagacuauuuuccuaccuccaauaugccaguuuaguaccagaucaaaacuauucuuacucacagcugaaauauugaccccugucuagagacauugcuuccacauuugaaauaaaaguuucauauauuacuuggaauacugaauucugauuuaacaucaugaacuaaaauuuuaagaauagcaauuuucaaaggcaaccaaugcuacuacaacacagaacucugacacuacagaggaaggaacaaaacaccuaaaaggccagaaagaacuuuaaaaugaucugauguauuuuuuacuuuuuuauagacugaagugacauaaaggguauggaguugcuuugcuugaguuccauccugcugaucauaaaaaaaaaaaauugagcccacaaccccaaucucuccagccagugucucucucuauagcccuggcuggccuccaaacucagagaugggccauaguagaauuagaagugccaccacaaccaucaccauaaacuauuaugauacuaaguaguaucauaaggaaagagaaucugaccuauuaacacuuacugcugauuaggcucaguuucauucugcugggcagaauuaaagcucugcauggccuguacuuccucuuccuccucaucuucacuggaagccucuucugcagcaugauuagaccuuggaggaggagcaguagcaguaccauccgcuuucugaauagauggcuucugacaaauguauuuaggaucucuuccaagauuacagauuucuucaaguaacuaaaagucaaagaggaaaacauuacuuauuuauaaugaaggaaugacauuuugugagaguuuucuauguguaauauacacaacacuccugaagcauaaccauuacauccauuuuuuaaaaagaaaaaauuuaaguguaaaaaguaaaaaaaaaaaaaaaaaaaaaaaaaaaaaucacacaaggucacaugccaguccuaauuuaaaaaucaucauuaucuuauaugcagaaucaaauaauccacuccugauggaggaaggagaaaugaggaagggaaaaauucaagaaaagaagcuagcaaggaugcucauacaaacugaagccccugcauauuuguuaaucucauaagaaagcaauacaaacagauuuacacuaaacaaaggaacuguguuaauucagaaaaugauucaguauaaauaaaaaggauggaaucaacauaaaguccacucuuguaaagacuacugguuauaacuuuugguuuugcaaagaacaguccaaaaaagcaaggcuuagaaauuaggcagauaaaauacccuucccaguuaagcuaggacacuuuguaaaagaucaaauuccuaaccauuaucaaucccuaccuugaugauggcaguuguugcaucuguuuugaggguaggcuggugucucaugagcucaucaacagcacuccccagguuggaugcaguauccccuuaaggcaaaaaaaaaaauuuuuuuuacugauuccaaaaauuuuugugccaauuuaagacagaaagaaaaaaacugaacugcuucuugugacuaucuaccaacacauaagcuugaaugaauucacauaagcuucaauccaccaaaucauggugauggugguggugguggugguugaggaggaagaggaggaaagagaucaguuuagcaaacgccacugucaaggucugagcuacucuauuauagacaaaggaguagaaaagaagaaauacuuucuuauggcauuuuuaaaaaauuagauaguuccuccauuuacauuucaaaugcuauccccaaaguccccuauacccugacccuugggaugucuccaugaagacugcuagaaugauacaguggugaauggaaguacagaauacauuuauucaugaaaagggggugagggguagggggugaaugcuguuguguuguccccucacuauauugcccaggcugaauucaaaugcccagacucagccuagguaauauacagguacacuuuuacaaacuacaguauuuuucucucuuuugccuuagcaauauacacucaaaauacacugagaagaaaauauaauuauuuauaacuguuuuagaaaaaaaugagaaaucuguucacaacagaaaaauuuguauauuagaugguagacuugaaaauaaaccacuggggaaaaaagagaagaggagaggagaggagaggagaggagaggagaggagaggagaggagaggagaggagaggagaggagaggagaggagaggagaaaagaaaucaccauucccuauaccuguuuguuaccaacaucaguaaagugaacuauucagaagcauggaaauacuaugaagagagaggcuaaggaugacguauuccuuccuaccuguaauauuagaauacauggugauaauucccguuaagcugagcauaccuaaccagagaaacgauguguagucaaggaaaacuuuccuugccaaaaccaacuuucuauuuuaaaauaaauaguagcacaacucaccaaggggaucagaacuccuccuccuccgcauggcugggagguaaucaggagacagaagaacuuugaagagacguucaaauggcugacauuguacaaaagacugaagaccucgggcauucaagcaaagugcacugaauacauuugggagggaaccgaggacuucccuuguagcaggaaccuagucaagacgaaaaggauuugaaugcaacucaaaaaaugucauauacaaaugcaaagaaaauauaguuaggguuaccacacugaggaauuuguuaaacagguauaaaauaaauucaacaauacauacauaaauuuuuucacacaauaacauuucaaacuugcuucuaaagcauguggaagauguaucugagaaaacaggaaauaaacggaguagucuuuuuuauaaagugguagaaugaacucacaucuuugaugagcagugcaugcagcaugacaucugucaguccauuguccuggagugaggacagcagugauggcucuugaaauacaaacacagucaccacuucaguagcuaagaagaaauaagaaaaauuaugggaaacugagacucuccauagguauuaaaaguaaauaaaaucuguuuuuuuuuucaagacagaguuucuuuguguagcccuggcugucguggaacacacucuguagaccaggcaggacuugaacucagaaauccacuuuccucugccucccaagugcugggauuaaaggcaugcaacaacacugcccgucacaaaaucuuaaaacacauacacuaaauauuuaauaauuuaaacuugugugcuuauuaugaaaacaauuuuccagcagaauaccaagaguaguccaauaaacauuaagaguuuuauguguuaucauuccuuuuuauguauuuuucucucauacaucacauaucaguaaacagauucccucucuucacuccucccaaccccaucuccaccacccuuuuaccccagauccacucguccuccauuuccuuucagaaaagagcaggccucccagggauaucaaccaacacuaacaagccuuuuuaaaaaaaacuauauuucuaccauacuaaccuucuggugugucugaagacaacuacaguguacuuacauauaauaaauaaauaaaucuuuaaaaaaaaaaagaaaugucaaauuccuuauuuguugaguuucaguguguaguuacuacagaucacuguaaccuugccacauacuuccucguuaacuuuccauuuaugaguauuauucccagauacuuaacuaaaagcaugugcaacauccuuuguuaaggcuauuuuuaacugucugucugcuaugauacaaauuuucccaguaggaacucuuucaaucuaccuuaggcugauuuuccuuugucacaacuccaacuccuuuacaggaccugaccuguacucauauuuaguaacuggaauaucauagauccaacuacaaaguauaccugcuucaugaaguuucacuaaaaaaaggaaauacugggucauauugccauccuuggaguaaauggaaacauuuugguucauuaacagggaaaaccaaacuaguaaauucugcaagaucacaagauagaaauacagauucauaaacuguuucauuagcaaaaagguaaagucauaauaaauacaaaucucuagacugcccauaauguauuuguacaauguacacuccacuauguucaaagaaauugcaauuucuacaucucccccuaaauugcuuuauagaauuuuaaauggaguuccaacuugcauuugugaugccaaagugcguagugggauaaaacaaugggcuuuguagcauuuaccaggaagugggaguagguggguuggaaagcaggguccaggguagggagugguauaaaggacuuuugggauagcauuugaguuguaaaugaaaaaauaucucauaaaaaaagaaauuaaaaaaaaguucuaaaagcuugcgugcacacacaugcagcaagcuggcauugaacucaagagaacugacugccuuuugccuccagguacuuuauaaauguaugccagaacauucaaccuagcccgaacuucaauucuacucaccuaggaggaagagugauggaccauaguauucugcauugcugaugauguguuucagagagguagguaaagaaccauccaucacuaaaagaaauaugaacaaagaccacauaugauaagucugggugaggcacgaagaucaagggugauggguagcaauauguuauacuguaguaaauaaaugaucaagucuauggccucuguuucauauaacgccuuaguuuauucaugcaguuagcuugaauagagggucaaaauaagaacagacauggagacuaugagagguggcaguaggauagaagagaucagaauccaaagcugggaaguggaguuguguaaguaacccucaugucuaagaaacauauuaaguaacaaaaagcuaucaguuuacuaaguaugcuuuagaaaaacaucaagaaaacaugaaaaagaacaaucuggauaaccaaguggucuuagaaaacaguauacagaaucaaaauaccaugucguaugccaucugagaaagcagggucuugaauggccuucuugaggaaauucaacauggacuugagaagugcugcucguuguggaauacacugaacuccuaacaugggagaaagaaaaaaguaucauauugugcucauuauuaaaucacagugaagaggcacacaaaacauguacuaagagacccgucuauauccacuaaagcaaaacuagcagacauuuaaagugagaucucuggacaugagagagaguauucugaaagcugaaauuaaaucaccaaagauagcauaugaccgguauuaaaaucagacagacagaggaacaaaaagaaaaagauaaaaacagaaauacuguagaguaaaaagauucaacuucaaacuucacuuuuggauauuaucugcccuccgaaaugucuguuuugauacugugugaacuaacagaagaccauaaaauguugcaagacauguucuuauaagauuauccucaaauguaccaauaagugccguguaauguucucuucuucacuaguuuaauaagucagucacuguaaaagacuguguaucuaugugucuacgcaccaggacgggguccagggccaggaccagggccagggccggggccagggccagggccagggccaggaccaggaccagggccaggaccagggccaggacccggaccagggccaggacccgggccagggccagagaugcuagugcugcuguuggaacuugaugcccuuaauucaacauccagccggugcuccauagauauggacgagccuggacugcuuuccauaguuacaucugcaacuaaaguacaaguuaugauaaagaaacuaauuagaauaaaagguacuaagaaaagaaagauuucugagaaaacuucguccacugagugagauguaaaacaugcaacuuuguauguuacugcuaagagggagguaguaagucaagacuacuaacagagguuaauuaacaaauauaaaaagcacugauguucauagggaaggauggcuaugauacauagaaugaacaauaaaagcagaauguguuugugcucuccucucucucuguucuaaaaacuauauacuuguagaugugaaaaugaaaaggaaauaaaguuguauugagucacaucaaauuaacagcuaauggcagaggguuaagacugagcauuaacauuuacuuuuagauuugaaaagcaaauauuuacuaucuacaauguuucaguuauguaaacuuuaaaggggaucuuauuaauuuuauaaauguaacauuuuaaaguuauuuuaaugcaugcaccuacuuacacaaguaguaaggacgaacagcuguguaacuuucuuuguauugaguauguaauuucuuugagaauucaaugcaaucguuuggauuaguuuuaaauacuuguuuccuggucuucaguugcaaauuuacugaaucaagcauuucagauggcgccagaaucuaccaagcacuuauuguucugcuuauuaaauucugacaauugcugauuuacaauggauagucaacaauuauuuaucagcaguuaauaaacacauuuuauucaacacuuggaaucucaccugugaacuuaaaugucagcuuguucccaauaaaacagaaacagaaacugagcaaaaggauuucuguggacugcaacaugcacagauaauggugcccaaaaacaaagucagaaaaaggaacaacauacuauuuacuauuaacaaaacggcgcguuacauuuguaguacuuuuaucauaaacauaguaagauacacaauaauaaucucugucauuaagacuauugcaaauuauaagaaaucugcuuggggcaguauuuuuuauucuauuaugaauuuuuauucuauuaggaaagagaugaaaguguuaaaaaaaacccauauaacacacaugaaaacuaaaaugaucugguuuugcaauuguaauuuugucacuuaaaagaucccuaaacaauaaccaauuaaaaucucugaucuuaagauaguuuuccaaggucucauuuaugaguuuauagucuccagguaauuuaucagguaaaaaaaaaaaaaaaaagacaguauuuugacuacacggugcuuauuagguuuuaguaguguaaauaagauaauaaacuaaaaaaauguguagagugacuuuaguggucuacuguagcuuuaccucccaggucuaucccuaacaauuuauauaucauuuauauaaaaaguguugaaagauauaccuggaaaccugugugccuuuuaauuuaugaguaagaauuagaauuuggauaggauaauagaaaaaucacauacauggaaauaucauuggcuuaauaacuuguuaauuaccauccauaucaguuuccauuucuucuccuucuugagugguacugggucucuggaucuuuggcuugaucacgaaagggcauucuuuacgacacaaaucuacuucgugcuacaaucaagggaaaaauauuaagaaacuccuauacauuuuugggauuaaaaaauuauaaugaagaauaacaagcaaauuauaaacucaguuucuagaaauuuaagagagguaagaugguugcuuaugauagguggaaauuuuccuagacucagcacucacugggauccaauaaagucuaugcaaauugucuuaagaaaauaauaccucaagucuauagaugaagauagaaagaccacuaugagacugaaaagcugccauguccagguuggugauaaggucaaccacucugacagcucugguuacaaauguuaucuggucuuguucaucaccaagaaacuuuaugaccugcaaggaagggagggguaaacauaauaauuuaaaaacagagcuauaaaaauuaauauugcuuuucgaaaauauaguauugguguccccuugagucagcauaguaugaaacuggagagaagauaaagacauaugcugaauguuuugucaaauaauaaaguuaugaauucaaggacuauauucaaccuccugaggccacaugcauaacaauucauaaagaugauuaaauauauacagcuuauuuuauugcaagccagagaggccaagacccauugccucaaaauaccuacugccaaucaaccaacuaaucuaaauccuguuauaauuaaacuaaaacuuuacaaggacucuuacauacauuuuucuuagggccaugcauaaugucacacuacuaugcauguaguacugucuagacccagggccuccagucuaccaaauuacgcuggauuacaaaaagucccaauauugacaauagauacauguggcaacuagaacauaaacuauaacucuuuuaggauaaacuuucugugcuauuuacucacuguaaaacauuaaaaaucugcccucucuuauuugauuuucacacaauuauauuagaaagcaaaagcagaguaccuuuaguaaggcuuccaucauuccacaggagaccaaggcuucaccaccagcaucguagcuagccagaugguacaaaaaggagaaaagagcuguggcaaacugauggggguauggguccauggaaggaucuacaaagaaaguugggauuuccucaguuacuuaccuagcacaauguuaaacgaugaaauguuccuagguaaauaauuaccaugcaaaccuaccaaucauggccugaaugcaguuccgcacaaguacaggcaaaaauccaugguaggaggcaguuccaguacagucaauaauacugcugagcuugggaguucucuccaaaugaacaauugauguuaacguucguaaagaagcagcuuuaauuuccuaugaggacaaaguaaacagugucaaaaacaaauggacaacugaacgaaggugcuaauaucucaaaaucaaauuuucaguaauuuuauuaaaacuguuugaggaaaauggggucaguagagaauaacaauguguauuugguauucaguaauuucacaguuuaauauccaaaaagaaaaaaguaaaagguucaggcuccacuucuaggauacuuuuggacuucuuaagaaaaacagaaggcauaugcaauauaaaacuugauagguacauauuaauagauacuuaccaugagcugcuuaucuguuauuugaaggacaucuaccaacuccucuaucaacccauuauacaagauacuguuugcugacucuugcaaggcauuagaauagacugcaaaagaaaagcaaagacuuugguagaaaugcaguuauuaagccaccacuguauaacacacauuccaaucagcacaaaaggguaaaaucacuacauuauaugauugugguaaaaucugaauaaccacauauuuuucuacuaaaauuaucagaaggaauuugggggaaguuuuguaggaaaagggagcaaagaguucauuuucuuaacuucacuacuugauugaacuguaacuaugcuuuggauaaagguauagacuuggcuucuuucuuugcuuauaacacaaauccuuauuaaaacaaagaaaauuuauagacuauuguacacugucaaauucauguggcacuacuaaaaguuaagaaugugcauaaucgcugggcaugguagcgcacuccuuugaucccagcacucuggaggcagaggcaaggggauuucugaguuugaggccagccuggucuacagagugaguuccaggacagccagggcuauacagagaaaccuugucucggaaaaccaaaaaccaaaccaaaccaaaccaaaccaaaccaaaccaaaaaacaaaaccaaacccaaaaaacaaacgaacaaacaaaaaacccaaaaaggaacaaaaacaaccccaccccccacccccaaaaaagacuuuguaauaucgagaaggcauaguagccuaccuauaucuuaaaucccaggauuugggagacagaggcagguagaucucugugaguucaaggauagccuggcuuauaccaugaguucuaagauagacagagcuauauauagugagacccuggcucaagaaaaugcauauuuuuuuuuuuuugcugaaucacacacugagguaauaguggcauacacucugaaguaaaauauggccgagacgugaguacauucauuaacuuuuuggauaaucauuauaaugccagaaauuguacuagguaugaacacaaacauagcaauguagucaguucuaagaguauguaggcagaaacuaaaugaaaguagguaguaauagugauacuuguccuuuuuugccuuguaaugugccuagcaugugacaggacaauuuccaggauuuucuuucauuucuuaaaauagcuuauaaauacuguccaaauauaacguacuugaaguugccugagggaauacaguguguagguauacaauucucagaaccauggugggagccucaaaaacaugugacuuccacauaaagaugaaguuaugucauuuguagaaaaacagaugcaacuucaugcaaaauggacaaguaacauaucucucauuuguaugucacacucuuuacacacauaaucaguuaugugcugaugacauaauaauagaaauaaaauuaucuggggaacaaauaugagguaaaauuggccaaaaaggagagaaaugagcuauaguagguauuacacacucaaagugcauuauaugcuuacaugaaaauggccuguuagaauucugcauaauuaaaaacaaaaccuccuauauauucuccuauagcaaaguaaaaguauagaguauuaaccauuuaauuauuuucagacuucaaaauuauaccucugaaaagaugggagaacuggacaagggauuaucaagaauaacagggacaagaugaugacaaccaagcccauguaacugggcaauaaaaguuuccuuuuaucuaguacauaaaggagcucaagaugaugaaugacuacaguaguaacugggaugagcaaauacauuuauaauuuagguugccauaauaaagccucguagcauuaaagauagauggcacucaucagaaaucaaauucaaagugccuacuuaggaccaguuaauuaguguuuucuuaccuaauauagauauugcaugcagucuggccugaacagcuuguaaccgcuuccugugauuagaaaagccaugggccagucguauauguguaaauaacagcaucuguagagauguaagacuuauauuaguaaaucacuacaaaggauagguucuugagcuguuguguacuuuuaugcugcuugguaaaauaguuuuguugcuagaguaucaaacugaacuaguauuauuuacucugagauuagaugacagaacuagaguggcaaaacagggaucucucaauauacuacuauuucaaaaauugucaauacacauuaauagauaauaauucaaauuuucaauaaauauccgaccacugccaaaaagaacagaacaagcuaacacaauagaauucuccuaaauguauccaaaauguugagaaaguuaucaccacuacuagauaaucauuuugaaucagcuuacaaguuuauguuuccaaucuaucauaaggugcuagaaguuauuguccucaagaagaggaaacaaaucuagguagcgaaucugcuauggucagacuccaaauguauaucaauuuugcuauggcuucuguuugcccaacuuauuaguauauuuggaaauccacaauaugcaagauauuuuucagauguauuuuaccugcuuauccuuaggaaugcuguacauuuugguaagagauuccauuauuucagaaggacuuucugaaaucuguauuagaaaaaaauuaguuaagaacaaggcuacaaacaaaaaugaacuaaccaguugucaaagaauucucuuaccuugucaaguuguucuaugugaauauaauguaguguauuacuaguugucugaaauuaaaaaguugaaauaccuguuagggauucacuaaauacccuguaagaaacacugagaaucaagguaauuucauagucauuaaaagcauccauuucccacauauaacagucacaagaugcuucuuucaaacugguaguauuuaacuauaauucuguuagccaggcauguuucauauuuuguguuccuuuuuaacccuugucuaacuaucuccacaauuuuaguauucauaccaaagacagaauacaugagaauacuuucucauguuuugaagacaauuuuauucuggaaaaaaaaauuuaacaaugaaaguggaagaaaaaucauuggggaguuuccaugccaaaccaagucauagcagaucauccaggaauuuagaacaucauuuaaguaacauuuuacaugcaaaccagagcucuuuuuaauagacugagauaaauacagaaacugaaauccaacuaagacuauuaggauacauuccagagacucugagcaaacacacaaauaugguaaugcccaauaaaaggaguuguaacuuuuggcaggucccagcauaaaaccuaaugauggggguggggugggagaggagagcacccucuuagaggcaagggggaggaggaaugggaugaggaacucugggagagggaacuggaaagguaagguggaauggaauguagauaaauaauuuuaaaaaauuaaugaugugagaaguaggcauaugauuaauuuuuccuaaagagcuucuagguauaucuagcuucaaagggcagugauagagaacaaaacauccccucauuuaaacuaagagagucuauaaauaacaacaaaauaaccugacucacccucuucucaauuuugaccucagcuccaggaucugcauaaaauucaaaguguagugugguugcacuggguggauauuucuguguauaaaacagaguaacauaucgagcuuaaacugauuuuagacaucuccaacacuuuccucaaacacauugugacaguaguagauuauauaucaauagugucuuuaaucagauauuugguagaagcagaaucagaaggcucaaguuuagagauacaaaucuguuuucaacaucuagauuaacuguuacucuuucuuuuaauacauaaauuuugacuauaguuauucuugugguggggucaagucugccaaguaacaaugcauacaacuuuaauaaauaauagugaacagggucaaaaucuuggcaucaguuaaagaaugaaaaagggcauucuuguaaaaauaucuuaacagccuccuuauggacacuuuuucuauuacuucaaacacuccuuucuauaccuuucuagaacauuuuucauggcuuucugcauugauacacaccaaaccaaaaaaaaaaucuacacccucaaagcacaucuuuuuauauaacucuacaaaaguaauacaagguaaacaaugauagccucauguuuucuuucuagggaauguuguaauggacaggguacuaucauuuuaaaauuuaguucaacguguacauguaccauuuuaaaguauaagaauuucaaacuguuaacaugccaaaucucaaccuugauaaagccaaggacuaaaacaggaaaacagucauggcacaaacccagaaagucuuaacaugcagaaugagcuucagaauucuucauuaaaauauguucucaaaauugaaacuccaaacugaguaagauuuaagacauauuucccuuauuaccaacauccauucacagcuacuuacugaagaucaucuaucagcuaagguaagaaaguaaccugcuuuaauauguagauuucugcaacuaaaaauaagaaccauccuacuaagggauaaacauuuccagaagauaaauuaguuagauuugaucauaucuacuuaaugaugaauaugacaaucuaggcucuacuugaagcacagaaagcagaagggaggauagccuaaauccuuaagagaauuggugacaagguaagaguauaccuaaguuuuuaaaaaacuauuuuuagaauguuauuuguaucaguguuuuaccugcaugcauaucugcugugccaaguaagugccuggugccuauagaggcuagaagaggcuaaucauagggcuuggcacuggaguuacaaauguuuuuaguugccacagggugcuggaaauaaaauguaggucaacuacucuugauuugucuacagaucccuguaauaaauaauucuuaaaaaaaaaauuuccuaucagucauuccugaacacugcucagaguucugauacuugugugaguacauaaguaaauguagucaaagcuggucuugaagucgugcucuuccucgugccauaucccaaauacagauguggaaguacuacucuucccagcuuucugggauuugauuaaauaaauucaacuuauuucagaacugguuauaugaacacacacuacugagacuuuuuuaucuauaacaggaacaauaauagcucaaauuuccuaaagauauuaugcacuaauuuuucaaguucuacaaaaguccuaaugucaagugucaauuuauauaucauacauucauuguuaagugaggcuuagaacaagacuuuaucauaucccaaauaguuaacucaccaacauuugcaagucucugcaacauucugcaaguccaaagccauucuccuuuccaccccagcucuugguaaagaaaaaaaaaaaaaaagaguuaacaccacgcuuauggucauaaguuuauaaaguguuuaaugaaaaaacaaacaaugcaaucuauuuuaugguucuauggagcugcucaagauaagaguacaaagcagcaaugcuagccagcuacuacauuccauauguauaaauucauacuugcuggaauuuaguuauagcuggccuuucucaccauucuagguuuuuuaacccuuuccuucaccaugguggaaccauguuuucuugacauaaaccaagagcucucuaagauucuauauuauuugcauguugguuugaauaagaauggccuuuauagacucauauuuucaaaugcuuagggaguugcauuagaaguguggccuuuuuggaggaaguguguaaccagggauaggcuuuaagguuucaaaugcccuagucaggccccaguguuuccucugccuucugguccagauguagagcucgcaagaucccucucagcaccaugucuacuugcaugccaccaugcuuccuagcaugcugauccuguacgaagccccugaaccuauauagcaagccccaacuaaguacuuuccuuaauaagaguugcugugguuaugguaucucaucacagcaaaagaacaugacuaagauguuuugcuaaccuaaguauaaaagcuuucaaacaagugccugugguaaugaguagcacaguuccugguaacuuccauaucccaaauucaaaccauauuauuuuugcuuauggacuagucugcaucuuugaccuuugaaauagccaaaauuuuauuagcaauauauauauacuuuuugagacaaggucuaauuguauaucccuggauggacuagaaaauauagaccaggcuagccuugaacuucuaaagauccacuugccucugccuccugguguuguugguauuaaaagauccaugccaccacaucuggcaagaauagcauuguuuuuguuuaaguaauugcuagucaucucagcuacaacuacgaacuuuaauaagcuacuuuuacucuugccuuaagguaagucaugccuggcccagcucaaacacaaacgccuucauacaauucucacuaauccaguaugugucccaaccacuauuuggcuguuuuucuacuaggaaagguuaucauuuccuucuuuagaaauauaaucacgucagcauguuuuugauaaaucuauaacacaauguguaucacugaagcugucauucaaagaucucuauuacaaaacccuacuaguagacaaaacaaaauuugccuaaucccagaaaaguaagcuuuuuguaagucuuuauuaacccaaaagcacaggauacagaaaagaggggucaaaugaugcuaacaauuucaaaacccaguuuaguuuucucuccgccucauuccugugggucaaggucuaaguucucaccuacugcucuccaacacuaugcccacuugcugcuaugcuccucaccaugauggccaugaacucuuaucucuuagcaccaaauuaaauguuugugugugugugugucuaaaaacuacuuucaccauacugucucuuaucacaacaauuuaaaaguuacugacaaaaggugguaccagaaaguaggcuacugcugugacaggacugaccauacuauuauuugaaaagaauguagaagacuuuagaaguagcaaagugguugaaaacuguaagcuaggcuuauuaggccauccuaccaggaguuuugaagacagcagugcugagaacaaagugaacuauggaggcauagcucaagagguuucagaaaacagcauuagcaaauaaagauccuaacuccugauauuuugguaaacaauguggcugucuuuguccugguccgaaaaaucucccuggagcuaaacugaaaauuuuuggacuauuuugaaacauagagaauccaagacauccuauuauugauucuuuuuugagauuaguaauaaucaccuuuauucaggccuacaaaggaaaaggccaagcaagacaaaaaagaaauaugaaauauacaauuuaaagagaaaaggaacagcagaaaauuaaauguuggugccauggcuugugcugaaagagauaaagagauaaggccagacacaaaauggaauagaguaauaauacccuugggcuaagacccccacacccaguuaguccuacaauuuaugaaaggaaaugcuuaagggauuuucuguuccuaaaaaggaguaucagaucaacucuuaugcaaauauaauuuaaagggaggagcaggcuccauuccaagaaggcagcuaaaguugacgguaucaacuaugugguucugacuuuaaaauuaugaaggauacaggagaaacaguguuguauaaucauucuaauuggcuaaauaagagccccugaagccagguuugugacauacaggaaguagaaccaaaccaaaauuaagaauuauauugcagucagcaaagguauuagggcagaacuaucuaaguucuuugacagaagccaaaaauuauguuuaugaugaugaacauacuauguauaaaaauguaguuuguaaagggaacagcaauaaaaacagaaaggaaagaaacagaaauaaagaggaaaauauuaaugaacaaaaagaauuuacuaugacaauaggaaaaaugcaaauuacccaaauagaaaggaaacugagacaacgauagaugccauaauuugacuguauucaaauuuuucacauaaaagguuacgcuuucucaauuggagaaagaacugauuucuuccuucacggaaaaagacuuuuuaccgcuguguuguuuucucuuuucuuuccaaccucucugugaaaugcaguuuugcuguacagcucaggcuuaccaacaacuaaacauccuccugcuucuguugcccaaaugcuggacuuaagugguaugccaugccuggcuauuacccuucaauuauuuuauagagucauguuuuuguuuaaggcagagccucauguauccuagauuggucuugaaauugcuacauaggcaaggacuuaccuucaauuucuuaucuuccugagugcuaggaauacacauuuacacuaccacacucaguuuaugcauguuagacaagcagugaaacuacaucuuuagccaaaaauuuguauuuuuaagcauucaguucuuuaucuuaacuuugcuuuuuaccaaauuguuuccugaauaguaacacugaaucauaacaauccauucaucuucgguuacagucaucuuuagcauaaauuauguguucuccccacucucucucaacaggguuucucuguauaguccugguacucaagaaaugaucugcccacuccagcacaaaccacaccaaccccaagauuaaaggcaugcacuaccauugcuauaacuuaauuucuuacauguuugcuguauaugauuuuggaaccuacugaaccaucaguugaguacauuauucuaauuacuauaccuuuauaaaacaguuuaaguacuuccucacuauguuucuaguauucuuuuggcuauuuucaggaauuccacggaagaaauuuguugaaaaccauauggauaggaauauacaaagucuacaggcuacacaaaagaaacagguaagaaaaaaaccacaaauauaaagauacaaggcagaagcuugacacaaucauuuuuuuccuucuguuuccccaaguaauagauaacacugaaaaacacuuagcuaguacacuaauaaagcaugauauaaaaguauauaugccgccgggcaugguggugcacgccuuuaaucccagcacucggauuaguaauccugguugagucagaacuccucagaguuuugaaagauaauaguaaaugaaccuugaccuagucuuagaauaauucuuugugaaauagauccugaacaacgagcaagaaauaguuucuugccaggugugguggcgcaugccuuuaaucccagcacuccagaggcagaggcagguggauuucugaguuccaggccagccuggucuacaaagugaguuccaggacagccagggcuauacagaaaaacccugucucaaaaaaaccaaaaacaacaaaaaaaauuauauaugccauaagugcuaauauacauauugagaaaauuuaucaaacugaccacaaccaauuuccuuauuuuguauuuguauuuuaauacuaggaagcaaaaucugcuuugucaccaaaacaaauguuuauaauuuuuaggagacacuaaacaggacuauuaaaacagcacuaguccauuaucuuuuuuuuaaucuuauguuuuuguacuguuuucucaguuauaaaugaauuugucaaagacaguguuucauccaggaaggguuggguauaaaguucuuuaaugguaccaaguggaaaugacucaggaacuaguuuacaggcuuuaaagagaccccagguaugaaauaacaauucuccagcaauuccaaacaccuaagaacauuacauuuugcaucucauaacuuuucuaggaacuaagcccauauacauuuccccccaaaauaauacucauuaauuuauuagccuugcuguauguacucaccuacccaguggggauuaucauaugacccugguaauuaaguugguauauaucuaaaaaauaacuaguauauaucagucaugcuuagagcaugcuuaaagcaccaccuuacaagaugagauccuaaaguauucagacgugagaaaaaaaaaaagacuugagguuuuuaaggaugaaacuuuaauuaauguuaagauuauuuucuaacuuuacccucagaucggugucauauauauauuaagugcuacucccaugugaugauuuauugcuuagcuaucacacugaauuuuaacaauuuuuugagacaggaucuuucuauguaggccuggauggcuuggaauucucuauauagaccaggcuguccuugaacucaaguagcccacuggauaauaguuauuccuucuaagugcuggauuuugaagauguauguuuccacauacuggccaguucuaacaauuuuguaucaucucccuaggaaaccaaaagaaaaccccacugucugcaacaaacacuuuuaaaauaauuauugcaaaucauuucuuucauuacacaguuaaguccuuaauuguguguguugaauaauuuguccaugaguucuggugcccaaagagaucagacuugucaaaugcuccugaucaaccaugaggcgcuguguguacauugggaauugagcuccagcccuccacaagaguacgcuccaaacugcugaaauccucucuacagauugcucuacuacaaauuaaaagacaaagaauuacuuggcauuuugcucauuuuuaaauuuucuucauccauuaggaccacagguuaauuauuuacaaauuuaaaacuucugagcuuccugaguuuauguacuuaaugucuauuuuuuuaaguucuuacuacauuuuuacugacuuauuuaauaagcauguggcaugcacaccugcauucuauaguaugcauguagaggucagaaggaaacuuuuagaagucauucucuuauuauauagugucuggaucaaacucuggucauuacuguuaagcuuggugguaagcaccugcugaacccuaauguuugauuaacgugaugaauagaaauuuauuauguaucuggcuguccuggaacuauguauaucaggcuagccggaaacucacagagcucucuacuugucuuugccuccccucaugaauauugagauucaaggcuccccccagcuccuauuauccauaauuauccuuccguuccuccccccaaccaacucuucuucccaacaagaccuccuacuuucaugccuuuguguauggaccacuuaauuuaacugaaguuguuugcaaacauuauguuaauuaucaaagauuaaacuuuuucuuuugaacucuagaucccauauugaacugucuuacauuucuuacaaugaggaaacacucaaaauauauuuagaaagcagguuugauggcaagagguacaguuuagugguaguauugucuagcaugagcaaagccauguuuuaucccuagcacugauaagucauaaaauuuauuaaacuugugaauaaagaaacuaaaauagccugaaaagugagucaaccccaagguaaccauuaaauugacuauuaaaacaaacaagccuccaaucaggugugguaauacaugccuguaauauuagcacuagaugggaucaugaggguagacuucagacuaucgcaagugugguugauugagaaugggccccauauaauuacauguuugaaggcuuaguccccaguuaguagacuauuuuggaagaauuaggagguguggccuugugaauaguuguggccaugucaggggugugcuacugauguuuuagaaagcucaugacagggccagucucuacucugccucuugcuugcaaaucaggauguuaagcucucagccacuguuccaaugccaaauggaugacuaccuaugaccguauuccucugccaugaugguuaugaacuguaaaaaacucucaaauguuuucuucuaaaguuaccuuggucaucauguguccucacaacaauaggacaauaguaacuaagauaaagacccugaaaaaaaauucuaagacaacuucauagcaaacuguguguuaucaaucaguuaaccucuaggaauaccacaaucuuuggauagaguuaaauuuuccuguaggaaaucuugacuccaauacaauaccaccauuagaaaauagcacuaacugaaaggacugaaggagcugaagggguuugcaaccccauaggaagaacaacaauaucaaccaagcagacccccccagaacucacagggacuaaagcaccaaccaaagcguacacauggagcaagccaugacuccagaugcauaugcaacagaggauggccuugucaggcaucaaagggaggagaggcucuuggcccuguaaagguucaauguccgaguguagaagaaugccagggcagggagaugggaguggguaggugaguggggggaacacccucauagaagcaggucgaggggggaaggggacaggggguuucuggagagaaaaaccgggaaaggggacaacaucggguuuuuuuuggggggaggaagggagaacaacaucauaaauguaaauaaagaaaauauccaauuuggaaaaaauagcacuaaauguucuccgauuauucuaaacaauucuuauuuaaauuccgaaaugagaaaacugguuaucagaauuaaagauucgaaucuaaccuuuuucucucgguaugcuucuuuuucacauagaauccuuauucugaauuucuccaaagcagcacuaucaguuuugaaacaagaauuuuguuucuugagcagaguugaugaaauauuucaaauuuaauuaauaguugagaauacucgugcuuuuugaaacuuuguuacacugucacaaauacuuguaaaccucagaaaguuaacaaaaggauucuaauccacuuuggcaaaacaagaaaugccuguuuaaccauaugcugauaucuuccccaaagacucaccucugccaaaugcugcagccgugucaguagcggaguccucuugucagauccaagacgugugauauaguuugaucuuuugcuaaauacauauagaagguuaaggacugccagcaccacuugcauaucagaggaagccaauaaaguugucaaaugcuauagaaacaaaaaagggacaaaguuuaguggaucaaguacuuggcacuaaaaacuucaaaagaaauucuuuuaauguaauaaugugugucaacauuaaaagcuaucaaguuauugagccacaauacacaaaaauaagucaaucucuuacaauauauaauccugcauccaaggaacagcugacuagaaaguucaauaacuguaaacacugaaaauugcagcucgauauuauaucuguaucucauaaggaagaauuucaagauagaaacaugcuauaauacauauguaggacuaaaaauuuauauuucuaagcauugugaaaugaaucuaaguguaugcuauuauuuccuuuauaacaaauauauaaaggacacauagaaacuaaaacuaucaacaacagcugugugcaauuacucaaaacuauuaaaguacgacaagcuugggaguaaccucuuuuuuuuccaaacagagaacauucaccaauauguugcagcacauaacuggauaaaacuaaaaucacuauguaauugaguuagaaauuaacaaaaguauuuuauuuguuuacuuuauauggacuuccuugggcagcacaucuauuucuuuaucaagacugacuguuuauccauucccacuugauguucaaccauucuacuacuuguccaaaaucauucagaaaauaaaacaaaaacaacagggugguaucaaggucaucaaguuuggcuaaaggaaaauaacuucuauuuaugaccacuaaauuuaagauuucuuuaauguguuuugucugaauguaugucugugaaccauguagccgcaaacaucaaguagagggaauaagauccacuggaaguggaguuacauauaguuguaagccuuccaugcuuacaugguaggaauucaaaccugaguucuacgcuagaaguaaucaacuguuaaacccuuuucagugcccuuuugaccauggauugauuaccucagucuuuauggguacaaagaauacaauaggcucuuauaagucccacccauaucauucauccauucaacuuaccauggauagacauauauuuuugagguacauucccauacagaguuuggucaguauuccuaagacaaaguuaacuauaaacacugcacauacacugcuacaauuugaguguaaaaugccccucuauaagcuuguuucugaacccuuaguuagccacuagucaguuuuacaagguuguagaacuuuuagaauuagggcacuaggguuuaagccuugggcauuauagcuuuuuuugguucaaaaaaaguaguauguaacugccaugagaugaagcugacuaccaccauccuugaagaaugaaaucuguuuccucaaaaacauuccucccuuguucuugucagcaauuuggucauaggaacaaaagugauauaauugugauggguauuacaaauaaucuugaggugaguuuaaguauuuacaaagauauauguagguuacaugcaaauauaccauucugaauaaggaacgggugcuuaaacucaccccccccccacagguaugaugggaggaguguauguguuuuggcaaaagacaucgaaaauuauaagcacauuaauaagaaaaucaaacuauuuuuaauaguuuaagaauaacuuggaauaccucuaaauaaucuuugacaaagauuacuaaauaguccauaaaaugcuucaauacagguacuauauucuuuaugccuugaaguaugaaacagagaaacuuucacaucaauccuaagacagguaauacuuaugccuaagaaaugccauacuauuaucucuuuccccuugugguucugaggauuaaacccaggggccuauacccauuaggcaaguauacuacaacugagcuaaauccccaccacuuacuacuacuuacuaucuuaagaaauccauaaugaaaaggaaagcaaacaaccaucagaaacagaaauucccuuguuugugcauacacacgauuaaguuaaaaacagaccacauagccuuauauucucuuaccucuauggaacuguacagaugccgagaaaagcuguacucaaugagcaaggcugugaaguucaauacagccaauagaagcauuuucagcuguucuuuuucuggccuaucacauacaagcauccaugacauauucuccacuguuuguccagcaucugccagaauuccaucaaagcgguccaacagauccacccagugauauaacucacacuagaaagaaggauaaagaggauauaaaauuaugauaaaaguggcuuagugguaugcucuaguaaucucaguauugaggaggcuaagguagaaggauauauaguccaaggagccuaggccacacagugaggcccaucaucaaaauaauaaugguucuuuuaacacuaaaugguucuuugaaguagaguuuuauuaacacuuagcuuuguuuucacuucuucaaacaucaauguauuuauguggguaugugcacaccagagaauacauguagaagucagaaaaaaauuugguggggggaggagaagaauugauuccuuccauccauuaugaaggaugcggggauuagacuugaucucucaagucaccagacuuggaaauaaaugcuuuuacuuucugaacucucucucucuggcucagcacauugguuuaucuuuaaaaaauaauucuuggcaacaauucaggcuaaauaccaguagccaagagcugugacacauauacuagauacuuaaguaacuauagaauaaggcuauuccauuacaguucucuuguucaucaucaaagcacacaaaaugauguacuaauagcauguucccuauccucuguuaucauggauuuuacauaccuugccaauguuccauguuuugauuugcugcaguuccaagaggaguugcucaucauuacaaacuuugaguuugucuauuaaggcucugcagucugcaggcuaagaaaaacaaacaaguauucauaaaagguguuuaggaaugaggaagaaacaaagagaaugggaaaagggacccuuaaacccacaaagaaauucaacuuuugcuuauauaaaacuaaauaguuuagauuacaauagaagccugugaggaaacacuuuaaucccaacaauccacuaugcauuuguuuaaaucugaauaaaccuguauaugcaaacuacuugaaguauacggacaauagaaacaaaggaaauaaacuaagcagcacuaaaagcaaaaauaaauaauuugcaacauagcuuaaaagguaaccagaauguuagaaggagggaaaaugaggggauggaagagagaagagagaagagagaagagagaagagagaagagaacgccaaccagccugaaaggaaaaggcuagcaaugauuuauuuuucuauaauauuaaaccuugaauuagaaaagaucauagagcuucugaacuuuguaaaacuaagacucuauucuuacuugguauucccauuuccauacauuccugauaucuuguauugaugaacaggaccauuaucagguaucaaggaguggauugagaauuuauaauaaagguucugaaagugguaaggaaaaugggauagggacugagacugggaaacauucuauuaauggacaacaggugggaaagugauuuuuuuuacuuaauucuauaaauggugucaugggaauaaacuagcuuuggaaacaaacaaaucuauguucugauuuugguuuuaugacuacuaugaugaauccuacuuacuauccauuacuuaccaggaaaacacaaucuaacaagcuagcuugaagaguauauucaaguaccugccacuuaguaaguacacacaagagaaaaauuuuaaaaacgaaacaaagaacaugagauuuagauuuaaagucauucuuacuuugaaucucaguauccucaucaagaaagagaugaauaguuagauaccaccuauauauccaacaaugcuguugugaaaucuaaaacuagaggaaacccuaaagauucccaucuccuauaagauauuuaaaacuaugauuuucuuuaagccaaauucucaacuuugcuaggaucuaccucaaauuuuggugaugauauguaugaaaaacaccuaacaccaaauucuucuauaaaccaggcuugaccucagccucacacccuuuuauguauagauuguaggaaaaacaguaaagaagaauaaauaacagaaaacauggagaauuugagacaccuguuaacacaguucaucugucccuuuuucauuuacuuggauuuaguaucaaaugcauguauuuaaauuucuaaugacaaagauaggcuaauucauuguuaugauucuguggguuagguaauacccauuuuguuguuaacaucugaguccuguaaaaacuugguaugucuaccauuacguggcauuuaauaucucacaaaccugguacccaagccagaucuugcuugaaugcaauauuguuagcaaaggauacuauggccuugccaaagacucugcuuggcaucaugaacaguuaugagauaucugagucuaacuggacaagccauacaaggcacaaaggcagcuugccuggaccuuuuaccaucuuuccuagaacucaaccucacuaauggccacugaaugcuuuagagguuaccaaggacuagaccaaaauaggauacuuaaaugcuacuucccaaacucaaguauuaaauuucucuaucuuugugguauaugaaaaaauuauaaacaauugucuccuucucuuucuugcuuaaauucuuucuuguuuugagacagggucucccuauguaucccucguuggucuuggaacucagauaucuaccugccucugcauccccggugcuaggauuuaaaaaguuugcaccaucauacccaaccuuucuugucucucuuauuuucaaagaaauccuuuaaacuugugagugagagacuuguuauugcugagaggggaaagagggaaggauuaggggacagggaggaggaaauagggaaggaggaaagaagggagagagaguaaauaugugcagaugucauaagacagggacaaucaugcagaguugguuuucuucaccuuauguucuaggggcugagcucauugagauuaaauuguaagaagacuuuuaccuggugaaccaucucaugggauuugguauaggcccaccuccaacccaacuuuucacaggguucaucuauuacacacauuuaaaucuaaggugcucguguuuucuaauuauaagguuuacuucucuuuacaguauuuuuccuauuucucuguacauaaaugcaaaccaagugggacugucccgacucacaggaaaaggcaagccaucugucaguucaaagcugcuaccaggauuuaccugaauuuguuuccauuaucaaaccuaugggggaaauccuuugaaauacugccaauauucuaagugaucaaugaaagaccaaaaauguuucuuaaaaauaaaaccuaguacugauaccaguaugaucaaugaaaaaaaaaucuuaaaaacugaaccuaguacugacaccaguaaaaucaaugaaaaacaaaacauuucuuaauaaaaccgaguacuaacaccaguaugagaaacugggcaaucuucuauguugcuugaguaaauaaggcaacccaagccuuaaaacacaccuagucagugauuuuauauucuuaaauaaucugauagaagcuaggaaauuuacauaagugugacuguaagagccuuauaauucacuuagcauaaaaaauaaaauuugcauuucucugaucaccuguaagagagacucuuucuaguuuacuggcuuugguccuucucugaaagguuuuaugcccauuuugucauugggauauucauuucuucuacugacaugguacaaaagauauuaacuauuuuggguuacaaauauuuucuccagcuugucaugucccaugacucccccacacaacugagcuuaauugugaacauacaaaaacagcacauaauuaacauaauuuggugaguuuauauggauccauacacucauuuuaccaucaccacauuucaggugaaaaauauaucaccucuaaguuuccuuguggcccuuuguguauuuguguguauuaaaaacacuuaacaugaaguuuauccucaacgaaauucuuaaaguacacagcaauuuaccaguaacuguaaguucugaaacuuauccuuuuucuuuucaaauaggguaacacuauguagcccugaacuuguggcucuuuugccucagucuccuuagacaggagccaccauacccaacuuuuuauucacuuuguacucacuuguuuuacuaaauuauacauagccauagaacaauuccccauucccuccccugauaaacaucauucauucuguugccuacuuacauaccuuuugacuauuuuagaugccccauaguagaggaaucaugcaguauuuguuccucuguaauuaacuuauuucacuuuucauucuucuggggggaguuaauuuuaaaaauauaagaaauucuucaacuucauaaugaaaaacccccaaauaacccaauuuuaaagugggcaaaggaauuugaaaagacuuuucuccaaagacaauggccaaauggcacauacaaagguacucaacaucacuaauaaucagggaaaugcaaaucaaaaucauaaugagauauuaccucauaccuguuagaauggcuauugucauguguccuuuuauuuuggauaugguauuuuacauuuccauuuugguauuuuguccuuugccuuaaugcuuggaagggcaauccccaccuaagacaagguaaacauucaccuguauguucuacuucuccuauaauuucuuuuaaaaauaucugacuuuugaugacuuaucuacaauuuacuucaguaaaacagucccccgcaccaucccacccaaaucaaauguaauugucuuggcacauuuuauugacuaauacuguucuuucccacaauauauaaucccucuauuaaguucuuauguaugcuaaguuguccugauuuucaacucucguauaaauauauuauuacgcugauggcacugucuuguuuuuaaaaaucuuaauuccuuaagacuuuuuuauucuucacuuuuaaauauaauagucaucaaaacuuauaaauaccaaaacacaucaaaaacagaaucaaaugaaaacuuacagaaacaauauuaauaugcucaauauauggcauuuaguaaaaacacugauauuccaaugucaaaauacaaaauaaaaggcuaauaaaaaagucaaugaacuuaccauuuuugucuucaaaacaaaacaaaaaacucuuaaguucuauuagcuauagucaauuuuaauucuacaucucuuuuccauugucauacugucuuucaaugcuuauauuguagccugagagucccuuucagggaacaaauaccuaaaguauuauucacuauuccuuuuuccacuggucacuuggcuacuaauuuuuaaucaaaguaaguuaaaauggcaagguaguauuauuuuuucugguaguguucaggaugcaacccaaggccucaugcaugcuagacaaacagagauauuccuccuaguuucacaaguuacuauaguuaacacuuuguauuaacuggacauacuuauuuggaagaucagaacugcugaacuggucacaaugauuuuuuuccugaaauaaagaaaaugcacaaagcaaauuuggauacucacagcuucaguaggugucuuuuucaguuuaguccugucuacuuucauguuuucaguuuucugauuuaagaucugcaaaaaaaaaaaaccaaaaaacaaaaaccccaaaguaaugagaaaauaaaguuacagauauucuacagcucuacagucuuagaaauacaaauauuagaugaagaguaugcaagauaccuaguguaacacuggaguuauguuaauucgaugauaugguuauuagacagaaaauggcagaguaucuuuagauaaaacuaaccaacauuccccguuacaauaaaccccaaaccaaacuaagccaaaacaaaaaagcuuuuuuucuucuccuauuauaaagauuucaaacucuuuauugacacaguuaaguaugcaagguuuuucgauaacuugggguggaaaacucacuauaagccucuaguuauggggggggggggucugggaauuuaggcaaaauuuuaaagauguacacaaacauuuaacauuauuaaucuauauugcaugaguagguacaaaagugaaaaaucagaaaguaccaaaagccccaauuaagauguuuaaaguuguuauuuaaaucaaauuacuuuauguguguguuucguucacauguauguauguacaucauagaggcguggggcccagaagccauuagauauauugaaaguauaaggaugguugugagcuaccauacagguaccaggaaaaagugaucuuaacuguuuucucuucagcucuagaauugguuuuugaauugacuauauaacugcuagaaaauacugcagacaauuacauaacagaaguuugugauuaaguaaaaguuauaacaugaaauauagaucuacugaaucagacaucaugauucacaccuguaacuccagacuggagcagaagaaggaucaaugggaauucauggcuaggcugggcaacagauaauaaaaaagcaacuaaauauuaauuuaggucuaaagaaaauacucgagaaaggaaaugaaaauaucacuuaauaaugucucuaucagacugccuaaagucuauaggacauuuucuuaauuaaugauugguguaggaagguccagccuacuacagggaugugaauagugacaucccuggugguccuggaguauacaagaaggcugagcagggcagaaagaacaagccaguaaauucucucccucuccauggccuaugucugguucaguucacgacuuuagauuccuguuuggguuucuucccugacuccuuuuaacaauagacuguauaauguggacgcauaagccaaauaacgcccccgccccacuguaauguuaacucacagcuaaacacaaggauuaaggcuaagccaugugaugguuuuggcaaugugccuuuuaacaggaagauaaauuaugucuuuuuguauguauguauguauguauguauguauguauguauguauguaugugagugaguauacuguagcuguagagaugguugugagccuucaugugguucuugggaauugaauuuuaggaccucuccuugcucuggucagcccugcucacucuggucaacuccacuugcuccagcccaaagauuuuuaucauuauauguaguacacuguagcugacuucagacacaccagaagaggguaucagaucucuuuacgugugguuggugggguuugaacucaggaccuucgggaaagagaagucuuaacaaagacaauucuuagcuggguggugguggcacacgccuuuaaauccagcacuugggaggcagaggcaggcggauuucugaguuuggggccagccuggucuacaaaguaaguuccaggacagccagggcuacacagagaaacccugucucgaaaaaacaaacaaacaaacaaacaaacaaacaaauaaaaauugaaaaaaaaaaucagagaauucuuuuuuaaaaauacuaagaaacaauguguaagacacuacuaaaacuguucugacaguuuaacacaaucacuuugguaagaccaaguaauuuagaaggccccaaaauagguaacagccuaaucagacccauguaaugccuguaacauuuaauaacagauaaguccuugaagauacacugaccaaauuguaguaagaaaucaacauuucuccuacuaucaaaaaggacacaugcacagugguagagguagauuucaggcucuucagaaagaucuggugcuauuuaagguaaccagucaugaauacauacacaucccagguagcuucuguccuaauuaucuguuuugcuuacaucuacucaaucaaugaguauuaaggaagagaugguuaaaagauuaagaauguuccacaguauuuuauuuuaaugauaggcacauuaaauauuauguuuaaauauuaacauuugaggccaugucauuuuugacauacauauaaaucaaaguuaauauauuuucaaauauuuaucacccaaaacauuugguuuauacaguauuugaacauuaaacaacguucuccuauaauuaauauuuaggaauauguaacuacaaauucccuuguaaaauuaccucaucaucuaacacaaaggacaagauuaacuccuaucaacaacuucaaaauaccuaaaaugaggccaacuagauccugacaacaaucuuaaccauggaguagaaaccauauacugaacaauuuguacacuuaacuaccaggcuuuuuuguuguuguucuuacaaaagauuuuacagcuaacacuagaucccauuauuggagauacagguauauguagagaagcaauuaaauugcuucugauaugagaaguagcaaucugccccaacauuguacaacucaaguauauaauggugcauguuuucccuuuagaaugaaugaggaacugaacucagaguguacucaucacuuuauucaaagacaauguuggaaguucuugcccuuaauaguacaacacuagacaguaacgagcacacagaccagaaaagaacacaacuuucccuauuucuagacaaguuuuaucuacauuuuuuuuaaaaaaucccauauuuauaaaacaccucgcagaauggccaagcagauuuaguagugauaaaaguacuugcaguauaagcacaagaacaugaauacaguucaccagaacccagguaaaagucuguaacuacaguguuuggggcaggugagaagaaaacagauccuggggacucacuggucagucagucuaccagaaguagaaaaccucagguucagagacucaguauuaaaaaauaugauagagaacaauagagugacacacucaaaguugaacucugcuucuacauacauaugcacugacaaauacuauacacgagcacucauaacauccugaagauucaacaugguagaugucaaaucuccuaaaauugauagacaauacacaacacuauuccuacuccaaucccaguaagacucuugaguaaaccuaaacuauuccaaaauguguaugggaaagcaaaggaauaacaauagcagaaacaacuuggaaaaauaaaaaugucaaaucacuauuuuugacaauucacauguuuacauaaaaaauuuaguuuguaagccccacuccaugucaaucugcucuuucccauuccugcuggaaccccuucuucccagcaagaccacuccuacuuucacuauuucucuuugugugugccccacugaguugaaauuaaaaagcauugauaggagguuauuugcugaagcaagaacaauucaacaauuguuagacuauugcauaaaaugacaugccacccccaacaauccuuaucuucccaacagacaggaguagguggggguggggagguguuugucuugucucauggguuaaacacuauuuuuggagacagaguauugcuauguagggucaguuagucccccuguagugauaggauaacaagcaugcaaggcucaaccuaacccucuugagggguagggucaaacagcuuuuuaucucagccauaccucagaaauuuuaaauugcuuguguguucacaugcaccuguguuaugcauauaugcauguggaggucagaaaacaacuuggcaagcgcuaguuucuuuccuuucaccauguaggguugagggguuagauucagguugugaggcugguucucaguuuuuuguuuggguuugagggauuuuaauuuuuguuguuuuaaacgagaauaaagaccugcucuggcuguccugaaacucacuauguauaccaagcuggccuugaacucugaagacccacuugccuguuucuugaaugauaagcuuaaaggcauguaccaccauuaaauaucagcuacuaacuuuucuggcuuuuucaaacacgguuucuguuuaucccuggguguccuagaauucuucuagguagaccagacuguccucgaauucagagaucgaccuauuucuccucccaagcacuacuucuggccagucacuauuuuuuauauuaaacuuuaagcuaagagauacaaaccauucauuuauggucuccaacauauuuugaacuaugcacaaauuguagaauugcuaaaauaguuaaugagguacugccucauauaaauuuuggggguauggagaaaaacaccuaaaagucgacucucaacaauuuucauauguccauuaacuauugucaucaugguguauaauguuccuagaauucauuccuccuaaacugaaaucuuguauucuuuggacaguauuuuccaaaccccuagcaaauacuauuacuaccacucuauaccauuuuauacauuaagacacuauacauguauacacacacacacacacacacacacacacacacagaguaguacugacugagagacauguauaucauuaagauagauuaaaaaccccaauauacaaauacacccaagugacaucaaggaagcauugucaauaaaaguugucagaacaagaauaaauccauauacaaagugauaaucuauggcccaagugucacagcucauauaaauuaauucaaagaacuagagagauagaucagcaaauugugcugcucuugcagaagacccaaguucgauuccaagcacccacuucauauagcucauaaccacauauaacuccagccaaaagggauccaaguucucuuuuggacuccacaagaaccugcacucacauacacaguaacacacauguauauauucagauaauuaauuuuuaaaaauuaacucaaaaugucccagaauuaaacaaaagguauauaaaauccuauugggagaaaauaauuacaaaucauguauaguacuuagaauauauaaagaacucucaagccugcuugccucuccagucaccuugaggcuguacuucaacuugguauccuguuagccucuggcccaggacucuacuccauuuucuuguagcagacugcuuuggaaacuccaccaagugaccuaccuccccuuggcuuccuguuaguggagugcuuaucugguauccugggcuagcccagaggcugggugccccaggggucuauuaacugggaauccccaggggcacaacaggagccaugcuuaggaauaaccacaaguucaggccucugacuccaaagggacuaagaagacuaugauuagauaggucuccagccccaguggcacccaaggaucccugagagacuaaagcuuugacuccaguggucuuaaagggcaaugauccagguuuugacugagguuccaguggucagucgguuggugugugugugucugucugccugucuaucugucucugacacacacacacacacacacacacacacacacacacacacgagaaugaguaugaaugguauuucuaaaaauucugggauacaaucaagaggugaaauguaagaauucaugguguagaaagaaggaacagauaaaaucaguagaaacacaggcuauuuauuggcauuauaguacaaguagauaaaacuacacacauaaagacauauagaaagaacuccacauagacaugaccagagaagaaacuccaugauacauuagucaggaugucaaaaauacaaaguaaauaaauauacuagaaguaacaugaggaaaauaucaacuuacguacaaaggccaaagaaauaucagacauagcccagacuuuucaucaucaaacagaaaccaacacaaaggaaguaaugucuuaucaaacucugaaguaacugggagccaagaauguuagcuagcaaaguuuaucuuucaaaaugaugaagaaauaaggauaguucaagacaaacacaaauuauggcaaucaauaacaaccaagcuagcacuuugaaaaauuccuaaugaaauauuauacccuauagguggaacaacaauaugaacuaaccaguacccgggagcucuugucuuuagcugcauauguaucaaaagauggccuagucggccaucacugcaaagagaggcccauuggacuugcaaacuuuauaugccccaguacaggggaacaccagggccaaaaagggggaguggguggguaggggauuggggggguggguaugggggaccuuugggauagcauugaaaauguaaacgaggaaaauaccuaauuaaaaaaaaaagaaauauuauauaagguggacgauagacuccuuuauaagauuguacacgaaagugcacaaucuaugaaaaaaugggugaauuaaguaggcugggaaaagaaucaaccauuuauaauuggagccucgaauuucauaaaagaaacagcaaaaggcauaaaaaacacauagguccaaguacaauaauagugagaaacuucaauauaccacucauuucuauagguguucugaaaugaaaaugggcaaaggaacuucagauggaaucaacuuaacagauacauuaaaaauauucuaccuaacagagaauaugcauuuuucucagcaguacauggaaccuccaaaauugguaucauagaacaaaaagucccaacaaauacaaaauaaaaagaaaccacacuaauuccuuguguccuaucagagcauaaaagaauaaaagcagaaagaauucuacaagagaaacuacaaaaauauuuggggacuaagugauacauuuugaaguaacagugugcuauccaggaaauucaaagggaaauuuaaaauuccuagacaccaacaaaaugagaacaaccuacuagaaccucccuucugagacacaaccuaggcaguccuaagaggaaaauuuauaguacucauauuagaaagugagagauguggggguggagggagauccagugaaggagagcaguggggaauauggagccugaaguggccaccuccuguagccaggcaagacucucaguggagcaauagagucacuaaaccacccacaaaacuuucaacccaaaauuuauccugccuacaaguaaugcagggaauggccagccaaugacugggucaacuugagacucaugccacgggcaagcaacaaucccugucacuauuaauacucuguuaugcuugcagacaggagccuaucauaacugucuucugagaggcuccaccuagcuaacagaaaaagaugcagacccagagccaaacacuggaugaaacuaggggagucuuguagaagaguugugggaagggcuaaaggacccagaagggauagaaauuccauaggaagaccaacagagucaacuaacuugggcccuugggggcucccagagacugaaccaccaaacaaaaagcauacaaaggcuggaccuaagucccccccccauauuuagcagauguauagcuuagucuucauagggucccccaacacuugauguggguaacccugccugcugccugcuuggggauccuauuccccugucuuaucuggccucagucgaagaggaugcaccuaguccugcagugacuugaggugccaggguggguuaguacccagagggggaccucccccuucucagaggugaaggggaaugagguaugugugaggcaggacuaugagaggggaaauggggacaggggacuaugaucaggauguaaggugaaugaauuaauaaaugaauggaaaauaaaaagugagaaaucucaaauaaauaaucuaacaaagcacauuaaggcuuucuaaaaaacugcaauucaaaagccaguaaauggcaaggaauaaugaagacuggggaagagauuaauaaaauaaacugaaagaacaauacauuaaaaaaaacaaucagggcuggugagauggcucaauggguaagagcacccgacugcucuuccgaagguccggaguucaaaucccagcaaccacaugguggcucacaaccauccguaaugagaucugacucccucuucugaagugucugaagacagcuacaguguacuuacauauaaucaauaaaauaaaucuuaaaaaaaaaaaaacaaagauuuauuuaaaaaaaaaaaaaacaaucaaauaaaauuagauuccuaucuuucucuuuauacauuaaucagucagaaauugaucaaagaccuuaauuuaaucccccaagcucagucagacagaacauucaauguccaaccauuuccagcaaaucuuaugguuuuguacuaaauaguccauuuuacauauguaccagauuuucauuauccauuuauccaucaauccaucaugauggacauauaaguugauuccauuuccuuggaauaauaaauagagcagcaauaaacaugggaguggaaauaucucuacgguaggauauggaguuaugaguauauguucaagaguggaacgaugggucauccgguaguguuuuuuuaauuuuuugaagcacucccacacugguucccauauuaguuguauuaauuugcacgcuaaccagcaaugaauaauuggauaauuguuuuguguauuuuuacucuaucuucugguacuugggaaugaaguacccuauuucauucuucuuucccuauuuccuuucccucaaacaucuggauagguagcuauccucauugagugaaaugguaugucaaaguaguuuuauuuguauuuccuugauggcugggaugugaauacuuuaaaauuguguuucaacacuggagaaacggcucagagguuaagaacacuggcugcucuugcagaggaccuggauucaguucccagcacccacauggcagcucacaguuguaacuccgggggacuuggcucacuucuggccuucaagggcacugggugugcauggugcacauacacacauacaagcaaacagucguacacauagaauaagguaaagacaucgcuuaaaaaucuacuuacaaaauuguguuucuucugaaaacugcguacucaaucucaucauucagauguugacugcaaguuguauuugcuuaguguuuacguaauucucaguaaaucugaauauaaaccuuuuaucugaaguauaccuuguaaagacuuuuucccacucugugggcugucaaugugcuuucuuuauaauuuuauuugcuguguagcaacucuguaauuacauauuuaguuugcugauacuugguucaguuacucugcucuuaaaauucuguuccaaacuugcuauuuacccccagugccuagaaggguauucccuauguuucugacugaguuuggaggauuaaagucuuugaucaauuucuagcugauuaaugugcaaggugaaggauaggauuuuuguguauuguucuuucagcuuauuccauuaaucucuucccuaaucuuuauuccuugccauuuauugguuuuuggauuggcagauuuuugaaaccuugaugugcuucaaaagauugagaucucucacuuuuuucuauuaauuuauuuuuaaguauuuuuaaaauacuuguuuaugggagguccaaaauaaagguaaguaaaagacacauagauuggaaugugucuuaucauuucaucuauguagaaaauccaaaaaauacacccaauagccacaaagaaaaacucccuccugaaaccuccagaauacaagguuaauguaucaauuacucuuacauaugcuaccaugaacaacuggauuugaaaugaauaccauuuauauaagcagcuuaagaauacuuaaauauguucagaucuaggaggaaaacuacagaucauuaaugcgguacuagccaauggggguggggggaagaacaaaucaauggaacagaaaaugaagcccuaaaauagccccauauaaauuggucaacucugacaaagaaucaaagucaauauaugcaugagagauuuuuuuuaaaagguacuggaauagcugugcacccacaugcaucauaaaaacgacaaaacaauaaaauuccacauuuuucagaaaaggcaauucaaaauggaucauagaccuaucuacaaaauguaaaauaauacaucuccaaaaagaguuagaugauacagguuuuggugacgauguuucaaauuauaaacaaggguauccauccaagaaaaaaauauuaaugcauucucuuuuaaaugaauaaaaaaaaagcuagcuagcauggagaaaauauuugcuaaaaaaggcaucaagguaacuaggacauggcucacgaugaagugcuugguuuaauccaaaguagcaaaagacagaguaaagacauagaaaacaauuauuaaaaauauaaaaauacacaaagaaagccaggcguugguggcgcacaccuuuaaucccagcacuugggagguagagacaggcagauuucugaguucgaggccagccuggucuacagagugaguuccaggacagccagggcuacacaagagaaacccugucuccaaaaaaaccaaaaaacacaaagaauagagaaagucaacaaaaauaaaccaauaaaaauuuuaauggauaccuuaccagagaggauauacagauagaaaauuaacuaaugaaaagaugcuacacaacaagagacugugauaaucagcacugagauuucacuaugccuauuacaauaaccaaacccagaacacugacaucagaauguuagcaaggauguagaauaagaagucccuuagauugccuggaagauggcuaaaauggcuuuagagaacuaagcauauucauaaaauauaagauauuauuugcauuguaacugucaaacuuugguguauaucagacaaaggaauauuuaguacuaaaugagcuaucaagaaauagauguggaaaaaucucugguuacugaacaaaagaagucaaucugaaaggccagauauagagccuuuaaucucaguacagaagcagauggaucuccagagaaaaugaacaaucgaaaugucaaccugauuuuaaaacaaaccaaacaaaacagacuacucuaauuauaugguauucugggaaaauauugagacuacugauugccaggaguuaguuaauagaguacauaagauuuuuuaauacagugaagucauuccauacgauagguuaaauacaugcuauuuuaaauauagucaagaccccccaaauuccuaaugccaaggguaaauucaaauguaaacuauagauaaucuuuggaugauucauuaacuguaacaaauaugccauucuaguaaaggaaugcugauaauguggaaucauuuacaguggggacauacaaauucuuugagacaaauguuuuucuacauggcccuaacuauccuggaacucagauccacauaccacccaagugcugaaacuaaagauacaugccaauacuguucaauuucuaugugaauuaaccacuuaaaaaaaucuuccaaagaacaaaguaccaaguaccuuacccacuaaauaaaauaaauauaugaccacuuugcuguuauuuaccaaaaacuguagaugagaucacugguaaaauauucccagaaauaagcaucuggcucuaauuaaaacuguuuugacuauagauacuauauuauucaagugucaaggacaacauaaaagccagguaaugcgggaaagcaauuuauugaaagaguaucuaguagcucagagaacuggaaggagccuacaucuacauucggaaaaugguagaauuuaagggaagccagguaaccauauccaagggagggacacaaaagcaguuuaguuggggugcuucugcugccaauaccagacuuuagaugcuggucgaagcagaaagaccuguaaaucaucucaggucccaaauuccaaguaugagcaucugauauaugcugcucaccaacacacaugaggagccaaaacaaauaaaugcucccuauaaccagugaacagcuagucuguuuucuaucacucaagugcaagaaauacuaacaguuaaaaaaagaaaugaaagauaguauguccuugagauaucaauuaaaauucugaaguucuguucucaguucaaaccuacuauuauaacaggaaggagaauauuuacuuaguguucaucauaagccaaacaauauccuguauuuaaaauaaauguuaugagcauuuaaguacccugccaggcugacagacauacuuaaugauucuaaaaacaacuuuauuuaaggaaggcacacaacaguguuuucaaguagugcuuauuugguaucuaacaauucaagcauucuaaagaauauacuuugaaacaugucaguuagagacuugauguauuauuacuucauacacaaauauucuuucagcccaauuugucccuauuuccaggaaaaaaaggcccacaggaaaaucagcaccuuguuugguuagcgaaucuugagagacuaaauuuuaacuaguauacagugucacaaauaaagagaauagugauuggggaauggauucuaucuuagaggccaaacaaauaaaaacuccauuacauagaaauucccaacaaaaagaagauaguuuuuaaaaacaaaauucuggaaauguuuugcuuauaaguaucaaacuuguucaagugguucuucuuaaauuuugcuugagaagauagaacuauuaagaaaauggaagaauuggggugugguggcgcacgccuuuaaauccagcacuugggaggcagaggcaggcggauuucugaguucgaagccagccuggucuacaaaguaaguuccaggacagccagggguacacagagaaacccugucucgaaaaaccaaagaacaaaacaaacaaacaaacaaacaaacaaaaaaaccccaaaaccaaaaaaaaagaaaauagaagaauuauuauuaaccaccaccaaugcuacuacuuaaauacuuuuauuuaaucaucuauuuuuuccacuucaucauucucccaaccuuaauuuaccuuugaaguuuaaauuucguuuacauccagaacaaguguauacagcuaaaguacauggaguaaggagcuggagagauggcucagugaauaaaagugcuuguuacagaagucugauagccugaguucauaucccugaacccacaaaaagcuaggugcaguauuguuuuuauaauccuagcaguucuguucagugagagacagaauaagaauugccuacuacuuaaguggaagauaacagauuccuggaaguuguccucugacauacacacaaacacacacacacacacacguacacacacacacacacacacacacacguacacacacacguacacacguucucguucucucucucucucucacacacacacacacacacacagagagagaauaugacaccgaggacaccuguaguucucaaauaggacucaauagaacuugcgugcauggguagauagcauuucuacucagcaugguccaaggauaagcagcacugaugaauuucuggacccacuuguaagugaaaaaccagaaucuguauuuuaguuaagauccuuagaugguuucuauauuaaauuuuaagaagcacaaggacaagacuggcauaguggcauagaccuuaaucuuagcaagcagaugcaggcauaucucugugaguucaaggccauaaaaagaaaccugaucuuuaaaaaaaaaaaaaaaaagaaaagaaaagaauuaaagaaagaaaaugcagcaccaagacagaaggaucuuggcuugacuuggaggccagucugcaugacauagcaaaacucacugaaaaagcuaacauaacugaaagaguccccauaguaccugugacaguuguggguacaaaacaauuaagcuucucauuauauucacauaauaaugaguacuuccaugaguuuugaauagcacaaauacuaggaucauauucuaccuaaacucuuaaaucuuuacuaggaaauuuccacuucccuugacaauuaaugagaaaauaucuaccacagggugaguacauugaaaaacaaacaaaacaauaucaaaaaacccaccgaacagaacaguugcacacagggauucaguuauuaagauaguacgcacaagacaugcgcaagcuccuaucagacaaaauaccaaaaugaauaguaggagguagacaugaaacucuaccaacuaacugagaugcuauuggcauuugauagcugcuaggagagucagguuucuuuuaugguggguggguagagguugacaacacuccaggauaggccccacucccaaaaguagcuggguaacacaaauuagacucaaugaguguuaaaagaaacauuucaaguugaguggggaggaaggugaggguggaucaggaaggaguacaagaauaugauaaaauggcauuguauaaaacuaucaaggaauaaaaaaauuuuuacaauauuagaauuugccucuaacuaggugguggugacguacauguaugccuuuaagcccaguauucagggggcagaagcaggcaguucugugaguuugaggccaaucugcaacagaaaguuccagaacagccaaggcuguuuaaauuaaccuugucucgaaaaauuaaaacuugccucuagaugguagaaaaaauacauacuuuuauuuaugcuuuauguuuuucaaauccuuccauuuuucuguaagucauacauucacuuauaacaaaccuucaucgcuuguaauuauuuucauuacagaagauuagugguuccugagccaaauaacaugggccaaauuuaaagcaguauuacaaaugccuuagauuaguuguuuuguguguccaaaccuugacauauaguacugaauuuucuauugguaugugaaagguuccauaaacagacacagacagacaggcaaaguaguacacaaaauuaauuaauuucaacugaaacugugguaacauuuaaacaaacaaaacuagaacacuaaacucaaauucccauaaaagaauauacuuaauacuuuuugccucuugcccuucucuaaccagaaaauuuagguaggaacagcacugaccaugucagaaagcaauaagaugcaccuugaaauaaaaaaaaaaaauacaaugaauggcugggcagugguggcgcacgccuuugaucccagcacuugggaggcagaggaaggcggauuucugaguucaaggccagccuggucuacacagugaguuccaggacagccagagcuacagagaaacccugucuugaaaaaccaaaaaccaaaccaaaacaaaaacaaacaaacaaaaaaaaauuaaugaaaagagacuguauggggcuggagagacggcucagugguuaagagcaccaacuguucuuucagagguccugaguucaauuccuagcaaccacaugguggcucacaaccauuuguaacaggaucagaugcccucucuucuggugugucugaagacaaaaguacucauacauaaaauaaguaaaagaauuuuuaauaaaaggaaaagaguaugaauuuaaagaagagggaagguaucugaaagguuuggagguacaaaggggaaggaagaaauuuuguagacauagucucaaaaaauuuaaaagaaaaaucacuuuuagaauuccugaccaaacuaaacaaacaaaaacacaacaaaaccccagccuauucacuauugauuacagaguuauagacaucacugauugccugaaggaggacuaagcauaauuuuuaagccuuucucuaucugaccuaaguuccaauuaauauacagccaagacuuuaccuaucacacauuaauaucuaacccucaugacagcuugagaaaugaagacugugaccaauuuacuaaggucaaaaaaugucuauaggcagggauaagaaugcaaauucaaacuaccaaccacucccaccgccccucacuacaggcaccaguaucccuauccuuagcuacauaaaauggcaugggaggauugcucagcuaaaucuaugaccuggcaguaaaaugaaauaacaaaacaagcagccuuuacucaccccccccccaaaaucuggaaacucauuugcagacauugcuuggaagucucauacaaaaucugaauauacuaaaaucucaagauaaaauguguaugcuccccccaggcgccuuuaaucccaccacuuaggaggcaggaacaggugguucucuauggguuggaggucagauugaccaauagagcaaguuccaugacauccagggcuaaacugagaaagacugucucaaaaaaccaaaagggaaaaaaaagcauguauguuucucuacaaaaacaaacaaacaaacaaacaaacaaaacuaccuaucggacuggagagauagcucagugguuaggagcacugacugcucuuuccagagguccugauuucaauucccaacaaccacaugguggcuuacaaccaucuguaaaggaucuaaugcccucuucuggugugucuggaaacaccuacaguguagucauauaaauaaaacaaaucuuuaaaaaaagacucuuuuuuuucuguuuuguuuuuccagacaggguuucucuguauagcccuagcuauccuggaacucacucuguagaccaggcuggccucgaacucagaaauccugccucugccucccaaguguugggauuaaaggcgugcgccaccaaugccuggcaaaaagaugauucaucacauccaguuucuaagauuauaagugcuuucuucaccauuguccacuuccaaaagaaaauuaagaaauuguccuuuaaacuacuauucuuuauaaaauuucagaaacuugucuacaaaaaaacaagugggaguggguggguaggggagcaggggggaggguauagaggacuuucgggauagcauuugaaauguaaaugaagaaaauaccuaauaaaaaaauugggaaaaaauccaguccauaccuaacaagcaaauuucauuacagauaaaucaaugaguucaggaaaguauuuuaaucuggcagaaaucaagucacucaguuccccugaaacucuuuuuagaaacugaaaauaccuaguuacacaaauaccaaacucgguucugggguggagacugucauacauuuuuuuaagcuguauaaacagauuuggcuacacagaucagccgugagagcugugccaauccaugaaugacuuagaaaccuguuucaaaauaacugaaagagggaguaggguauaaauaaauaaaaccacauccgcaugcuguuuuaacuguuaguagcuggguggcagguacauagguuaucauuguaccaucucuauauauuaaaaguaugcuaaauuaaggcucuauccugccagaucucuaaucccaucaucacauuauuaccaaagcaauauuccuaaaacuaacuauaaguacuaaagcagcacccaagaccugcaucucucucucuuaauggcaaaauggcauuauauaguauucuucucaugcuuuggucuuguuaaguuucacauucccuagcacucaagacuuuugaaaaguugacuccugaauaucccuaaaaguugagcuuaaauguuaccuccucacuaugacaccucucucaagguaaaauuuuacccucaauccacauaccauuuaccugacacuucccucagaaguucugaaugauugggucuguaccauaucugguuuuuuuuuuuuuuuaagauuuauuuauuuauuuuauguauaugacuacacuguagcucuuuucagacacagcagaagagggcaucagaucccauuacagaugguugugggccaccauaugguugcugggaacugaacucaggaugacuguuagagcauuuucagcaucuacauuagagcucagaaccagauuauccaaugucuuuucuggucuccacagacaccaggcacaaacaagucacaaauacacuugcagacaaaacauccacauauuuaaaaugcaugcuuuuacuuacauacacaaaaaugcaaaaccaaaauuuucaguugauacuacccucugauucagggucaacuagguaggaaucaacaacugaguaugauuauaguacauuacuagucaaccaaaacucuggauguaauaagaauugacaaaugggaaaucauaaguuucuacacagcaaacagaacuuagaauaaaacacuaaaagaauggaagaaaacucuuugccugcuauuuaucugauaaagauuaauauccaaauggucaaaugaacaaaagaaaagcaaauggucaaaaaagccuguaaaaacaaaguucaucugauauaugcauuuuuuucuaaauagcaaauauaccacuucacaauuuaaaaguugagaaauaaaugggcuuugaaaacauuuucuuuuucagugcucacaccaaauccaggacuuggggcaaaagaagugcuccacuaaugaacuacauucccaguucagaaaacacuuaaguuuuauggaucgacauucauucccacuuauugacauacaguguccacacauaugugugaaaacagagacaagaguuagcugugggaucuggagagauggcucagugguuaagggcacuggcugcucuuccagagguccugaguucaauucccagcaacaucuguaaugggaucugaugcccucuucggaugugucugaggauagugacaguacacucauauacauaaaauaaauuuuaaaaagucuuuaaaagaguuaacuauaauggcucuuauuugaaauucaaacauuagggacuuuaaggcagcaggauuggcacagguuugaggcuagccucagcuacauagugccaggucagccugggcuaaaaugagacuaucaaaacaaaaauuccuucuaaaaacaaaccaacaacaaaaacacccuuaaaaaccugccaaauuaggcuaacccauaagaggaugacaguggaaauguucaaaauacacuguaugaaauucucaaagaauagaaauguuuuuaaaaggcuacaaauuggacucauacuggaauguaggucaaagguguguuuauagguggggggcuuucuuuggaguccugccuuuuacuuaaguuuuuuuuuuuuuuuuuuuugucaaauuucccccagugaggaaacuucuguacuuucauagaugacaccugguaacacauuuagaaauaaaagcaaguugcuuaaaggaaaccuacagcauaguggcacaguacugggcuguuuaacuugugccuaacuuggugccuaacuccaccacuauacuauauacuauacaugacuauauaauaacuauagccaguuauuacccuuaaaucugggcccacaaaaugagucugauauguauaauaaguucucuguuccaacuuuucugguggaauauaaagaagauuuuacuauuuaaaagcugcuggugaaugaaucccuuaacagaaauauaagaaaugcacuauuagggaaacuucauuauuguggaaacauccuaaaauaaaugucuacaaaugucauuaauacaaucuuucaccaucaauaggcaauauaaauuucuguaucuguaauucauuacugaucucuaccaccagcaacaauaaacuagucuugcacaaugaauguuucaauuacagaaaucuuaaugucaccuuccacuacagaauacauuccugacaacuauacagggaguuucugggcuacauaagguaucuucucaaaacaaaccacaagcagaaacuauauuguuagacagcacaugacuauaauuugucuucuaaagguagacagaucuaugcugcccaugaagcuagucuuuacuuuuuuucauaguaaugggauuauuuuaaauuuuuuuuauucauuguauuuuucucucauauauuacauucaacugcagauuucccucccucgucucaguccaucccuccaccuucccuauaaacugcuguaacauuuugcucauuccucccacuguucauacuagcauuucagugugauuuauaaaucucccggcaaguuccauuucuguugcuuaucuuuguaaacuacauuuuguauggucuacauaggaaugugggugaguaugccacggugcauauaugaaugucagagaacaaaugccagacguuaguucucuccuuccacuauguggauuccuaagauagaaaucaaacuugcuaacaguugccuuuaaacuguugaaccaucuuaccagcaccggauugcucaucuuuuguaucuccacuauguggcaccaaugaguacauccuuagaaaaaagguguugcauaaauauuauugcccucauuuaaagggugaggaaacuaacucaauuugcccuaagugacauagccauuacauaaacuauaauggccucaucuuuacagaguacucuauaauugcaguaccuuaaaauauuauuaauuuuuuauuacauaauuuuauuacauaucaugauauuaaaggcucagugcaaccuauaaaguacauuuuaaguuuuauauauaccuguacauacacaaacauguaaguguaggauuuugauaagcaucuuauaaguaauauaaauuuaguaaaauagccuagacccauucaaauauuaauuugcauacuguuucucacuauuauguacaugcauuuuagggccagcagaaggaaagagggaaaaaguuggaagcaggcagcuaaaaaagacaggacacaggccucaagaccagauacagguuuauccaaagacuaaacuagcacaguaauagcaauugaauguaucacugugaacucucaccuuggcccaaacacuuguuauuauuacccuguacucauagaagacaauugcaggguuucucaacauaacagucuuagaggcugaggaagcacacgagaauuagaaaaccuaugucuauucaacuaaaggaagagaggcaagauacaagaaugaaaacgaaaaccuuaaauuacuuaaaaaugaacagagcuaggugugcuaaugcacaccuggaaucuuagcauucugaaggaugaggcaggagaaucacaugcucaaggccagccaguaccaaauagucaagaaacaaaaacaagaacaguuuccacuuacagaaccauacaugguaauuuagauacuacauaaaauaaaugguuuuaaagaaguuaauauugaauaacucuuuucuaacauggugaugaaacugguaacuguugcaaggacucucaccacagauuaauaagguuguggcagaacauugaauagaaagacaauuaacaguaaagaaccauguaaaaggggaagaucauggcaaacaaugcaguacauuaaaaccacaaaacugauuccaauaacaaaugaagguauuuccaaagacgaaacaagaaguugacugagccaaacuguaauuuggaaagucccaaaucuagaacugccugcacucuaugccuucuacuuuuaucaagauuuuacaaaccuuuccccuuaaauucuagcaaaaauuuuuuuacuaaaggaaaaaaauguaggaccaauaaugaaacaaccugggaaggugaaguggaaaaggaaaauagagacuggguacaaagcucuuaccauggcaaagagaaaauuuccuucaaucucacauuuugucuuaucacauuaguugauuccagcucuagggaagaaaucuauaauaauccuaaaauaaccugacauacuaauaguaaggaaacuacccaagacuacuaggguuuauaccaagaaaaaucaaaacgcaacuuuauauuauagaauuuuccuaguuagaagaauggacacuuugaauuuaaaacauuagccucagaauguuuauauccaugaguaccuagguauacacauuuacauaaccuucugaaucuagcagggaaccaaaacaucauaucaaaggcuguauuuagaggcuagagacagcucaauuauuaagagagcaaccugcucuucaagaacuggaguuugguuacaagaaccacaguggucuguaacuacagcuccaaaggauccaauacccuuuucuggccuccaugggcacauguacauugcauacacuaaagcacauguacacugcauaaaggcauuaggcauuuuuuuaaaauaaagcuauguuuagaaagaaaaaagcugaguguagaucauaccuuaaucccagcacucagaaaacaaaagcaggaggauaaaacugugagcuuaaagccaagcugggcuacauagugaauuccaggccagaccuaaaaagagaaggaacuaagaagauaaucaguaauaugcuuacuugcaaguacaaggacccaaguuucagaacccacauuuaaaacaaaaccaaaccaacuggguguucauauaaucucagcauugagaaggcauagaagauccuauuucaaaacuuacaauaaguaaauguggguggacagcaaaggaaugaugauaccuaaugcuagucuauggcuagcuuacacaugcacacacauacaaaacacaugcacauaccauuuuauuuuuaggguacaaaaacugaguguucauucugucuguucuacaucaacuauguauuugaguaaccaaauaagaaauaaggggaaauaaaauauuaggaaaaagcaaaauguuguuauugaaacaucaauucacuguccucaaugauuuaaugaauuaaaaagauucacaucauuaaaacacgaugucaugaaugaacauauacccuauguuuaccaaagggaacgaaccugaauuuaucacaccucuggacccaguugccauugugcaagaaaguaaggauuucaaaacugcuuuuagcugaaggcaauacuaaauaaacugcucucaaucuuagagaaacuucuuuuuugcagugacuaguuaaugcaggaagacuaagugacuaagugcucaggccuaaaaugggaaaucuauauuaaccaugaaguggaaacuucuggcuucuuuggaaagucaguuaugguuugcuggggaacacaggugaaaggauguuuugcuaaagaaaacagagauuaaaggauguauugcuauagcaaaugcaugaaaggacacaugauguucagaaagaauauaaauaggagccaacaguaggagcucaagcauuggcuugcuuugcucugcuuuacauuguauuguugaacuccauaccaaaaagaagcucuccaaagaacuucuccgggcggugguggcgcaugccuuuacaaagugagugccaggacagccagggauauacagagaaacccugucucaaaaaacgaagaagaagaagaagcagcagcagcagcagcagcagcagcagcagcagcagcagcagcagcagcagcagcagcagccaccgccuuccccgcaaagaacuucccacgaggagguuuccugcagcuucuuggugcuuuugcagagaccuuccuguugccaagcuuugugcuuucuucuggauugaacuccccuugcugguuccuguauggagacugccaaguagacuagaccgcagcugcugauuuauauuuggucuucccuacuggacugaacggcugguauccagacaacaaagauuggacucacccccaaacaacuacuucuaaagagauccaauucccccauguuguaauaacuuuucucuucuacuaccucugguggguggugggcuagaagagguuugaacccuauuaaaggaaauuggaaaaaaaaaccugcaaggcucaggaaauaggaagaggcagaaagaacauuaaugccagaggacaggggaaaaugccuuaaaauaaugucuucuggauacgauauuuccauugcacuuguaaacucacaguagcugugauuaccugucuguauaagaucaagcuaaucaaaauucuagcauggauaggggaaggacacgcaagaccuacacccuaguuugaggagccacuggcagccaacggccauuguagagggaaagucauuuuucuuugggaaaaguggacauugguaaguuacacaugauccacauuaugcacauuaagaacaauaaucacuuuuuaaacaugaaacugggacaggaacugggugguuaguuaaugaccaaaaugcauuguauacacauguaaaauucucaaagaauguauuuacuuuagcugaaggugacaguaaauaagacuaaagaguaaaguguuucacucucugagaaaucaguccagaaacagaaguagauaaaauucugcaccaacuacaauuauaugauagcaccacuaucaccuggaaacccacaaaugcaaaaucuauuccccaucaaauuauggaaucaaaaauuagugauacagcaaucugguuuaauaaaccuucuaggugaucugauguucccuaaaguuuuaaagccacuauuuacuauuaaugauucauguacuuaguucaacuuauccaaaauccuaugugaugauagguaacaaucauuauuuuacacuccagauuuuaauuuuuuuaauuagauauuuucuuuauauacauuucaaaugcuauccugaaaguucccuauacccacccccucucccccugucccccccaccucccgcuucuuggcccuggcauucccuuguacuggggcauauaaaguuugcaaucccaaagggccucaaucauuacuuuauaaaggaacaacuucacuauagcauaaagaggucaauuuguacgagaugacacagcagauaagaaauuggaucagagcagggcagcgguggugcacgccuuuaaucccagcacuugggaggcagaggcagguagauuucugaggccagccuggucuacaaagugcgucccaggacagccagggcuguacagagaaacccugucucgaaaaacaaaaacaaacaaagaaauuggaucagaacuugaacugagggaauacucuuuaucauuguauagaaagaagucuuuccaccaauaaaaacucaauuccuagaaugcuguaacagugaaaggagagcuuccugcaguggcaaauaccuguaguuucagcuacucaaagcuaaagcuaaaucaccaauaucugugcacaaacauauaaaaccaacuuggggugaggaaaagagaaguguauggaaaaacacuagcaaagacuaguauauacuucaauuaaaaaauaggcaaauaaauaaauuuagcaaauaacaaccauagaaaaacuuucucuaaaaacuguuccaaaauguaagcaccuaccaaauacaauaugcuuaauuuuaagaacuuaaaaccugaguugcuuaaggugauucauuguaguccaucugcacuuagcaaccuucuagguuuuuaaaaauuauuuauuugcaugaauauuuuauuugacuucaugcauguauaugugcacuauguguguaucuggugcacuaagaggucaguagaagguaugagauccccuggagcugcaauuucauaugguugugagcugccaugugagugcuagaaaccaaaccugugucuuaacugguaagcuaucucucuaggcccuaaucuuuuuaauuuuaaauuacaaaaaaaauuuaaguucucccucuaguuuuuacuuuuaguuccuuuuauuuaccacuauuuuuuaaaaaaagauuuuauuuauuccauguaugugaguaaacugccacugucuucagacacuccagaagagggcauagaucccacuacagaugguugauagcaaccaugugguugauaggaauugaacucaagaccucuggaagagcaaucaguuuucuuaaccacugagacaucuccaacaccaccaccccgcccccuuuuuaaaaaaaagauuuauuuauuuugaguacucuguugcuuucuucagacacaucagaagauacacccauuacagaugguugugagcaaccaugugauugcugggaauugaacucaggaucucuggaagggcauuuccuagccacugagccaucuguccagcccuacuuaucacuauuaaaaaaguaaaacugcuuucuuucaacucuuaagauuaugugaacaaagucucuaagaugaauauauaccuaguucaaucagcugaaucagauuuauaauacaacuugcauuuuauaguacuucauaaaagcacaaauuccaacauucuguaaaaucacuuuccaugucaccauuaugauuuuuaaaagacaaccguugaacuacuuuuuuaagaaacucaaaguuggaaacuauuagguuaacaccucaaacuuguuuuccucagagugccacuccuucauuaaaagcauuucuauaaccagaaaaccaagauggucaacaaguacaucaaguuuuaccgacucaaccucuaugacacaucaacuaagaagcuuccagagaaucuuaagagcugaauuaucccugacauuaacauauauaaacauuugguaaccagucauugaaggggucaaaaaaaaaauacaagaaaauccuaagaguacaagcaccugugaccugucuggccgugugauccacugcaaagcaguccaacauggucacagcuacacaacagacuuagaaacuuaaucuuauuccaugagaggcaauguggaaugugaagggcaaauauuuucaaagcaaccaaguuggcauuucaaugauacuuugaacugguggcuaaaaacacacaacaaaaggagaauuaaaaagccaacacuguuuccauugugaacuuccaguguuaagaagggggugauucaaauauuggaaugucuacugugcacaauucuguaccagucauccuaguuucauaaaauaggauuugggucuaagugguuuugcuuaaacuauaagaacuuaaguguuaauauuuaaucacuauaucuaacaugcucguuuuuuuuuucccuguugaaagcaugagcuugcuggaaucuccccaaaauuccuuuaauauuuaaucaauuuucaaacagggacuuauuucuccaaugaugaacacagcugaaauaccugaacaccugaccagugauucauaaucguauuuucuccaaugaugaacacagcugaaauaccugaacaccugaccagugauucauaaucguauuuaucuaaauaauucaaaauuuuucauucaugacuuuucuacuuucuguuccuuuaacuugcaguucuuacuauuuuaaagauaggaacaaaaaccguugcucuguccacauuuguguaugagcuaaaggcuggcuggaggcugaaggauauguguucaacucucauuuucugguuuugaccauaguacagacccagaauggcuaacacugcacaagcaaaauaauucaucaaccaguucuuaauaucuaagcucugaaucagagaaucuaggauaacagagcauaaaaacaacaaaacaaccuaaggauauuacaaauacacauuaaaaaaaacuuuuucuuccagaaggccuauauuucauauggaaaacuaaaaucagguaucaaaucagagggccacagaaaaaggaacccaugacuagcuauuuuaguauaccaacuaagccagcaguaucaccuaagagaucacauaagagauuacuaccauuauuguuucauuauaauagauuaccuauggucuuuaacaagaaugagcuagacaucacuauagacuguaauuuucaaaugugaggaaaugcaaaaaggacuuaacaaauaaauuggagaaaaaaaaacaagagaaauauaaccugaagaauaaaacagacuuaaagucuacauaaacuauuucauaaauggacuuuucucuggaucaugagucaaacuuaaaauaucacggaaauuuuaaaaugagcccauuuucuaccuuuaaauuuucaauuucuucaacugaaaaugaauucuggguuauacugucaagaacucucucaauaucuauacaauuuuugguauggauaaaaauaacacaucaagagagguuuauuucaaaauaauucuaugggaaaggggggugccauaggguaaaacuaaaaaggcuaaaguugauaaauguuaaaaauaccugggggaguagacaacauacuacucaguuauguuucaaauuuugugaaaaucaugcacugacaauauacauuuaaaacaauuccuuuuaauugucuaaugagcuccauccaauaaaauuauuuaaaaaaaaaaauaaaacaaaccugacccauauaauggaaccaaagcagcacaagcaaaaaauguaaauuccagccccaucuccauuucaagauguaaaauacaaauaccaaccgcaaagaucuuaaaaaaaacaaaaacaaaaaaaaaacuaaccuaaaaucacagccaaucauagucauccuggugggaaaucccaacacugcuccaauagcuuccugaaacuuccugaccaaguucuggucuacugguuuguuccucugaagcacuaacacucaggucaggcuacugaaggaccuacaaaaaaagauuguggaaaagaaguauauuauucauuagaauuggguaguuaaccacuguaucaauagacacaaucaguuauuuuugaagcaauagcccuuaaaugccaacuugcauuuuuagaaccugcuuugagcaguaacuaaacacucugaaaaagaacuguauaguguuucuagugacacuuagacaauaccccugaaaacuguuuucaacucaaacaaaaugauagcauguuuaacaaacugacacuaaggaaaacauauuuuaugaaaagaaaaagcuguacacauuaaaauuauuuuucaccuucauaagugcuuuuuggccauacugggagacaaacgauaaacauccuggaaauucagguugaacuuugucacugaaccuuagacaaaguuuuuauuugguacugccacuccuuccucucuucucagagaucuaccuagaauaaauuaaaccuuuuaggucaugccuugaucaucauucccagauuuaguauaauucuaaaggacaagaguuagugauuauugcuuaacccacuguaaaaggaaucaagacaagagucucaaaauaaagugaccugucuuucaaugaaagaggaaauucauuuuccuaaagcacuuccaacucaaacccugaagcucaaaacggaaauccacaaauaguuaauuaucagauguuacccacuaaaaugucaaugauaguauacuucuugcaacuauauuccuacuugaaccccaucacccaaccaacauaauuaaggaaaaaaaccacucuaguguugaucuaauaaaaauauaguaguaagaaaaacuacuuccgaguaaaauguuagaaaauauaaaauggcaaaagcacaacaggagguaguuaucaaagagucaucugugguugccuuugagggggaaaugaugguauuuaauuagaucaaccuuccuaaugucuugcauauagguauuauccuacuuaaauaaaaagacugccaaauaugccccccauacugacccaacuuagacaaaguuugucuaaaaaugauagagguaaagagaaauaaaugagguaaagagaaagaaauaaaaacacuugaagcuuaaguucucuuuaacacugcaaacuggcaauggcaugaaauuucaagacuuuugugaggugaaggacaggacagacuguauuugaaggaguggcaaaaaugaguaggcaagggaugaggcacucccuuccaaaagguagaacacuugggugugguucaugaccgaaacauagcugguggucauuccaagagaaugauuuugcauucaaaagucuuacaccaguagaagcuucaaauagugagaacauauucaaacaugaaccacugaucauacaaaguggcuuaugaggaaaaaauuaaaagcagacaggagcgaauagguauuauuccuaaacauagaaaaauacagcugaagaaauaacaauuuuuaaaaaccuuaccaggcuauaaagguagaauauggcacaaaaacauuuaucuaccaauacaguuucacauuaaaaaggcacccaaacuuucugaggcaaauuuucuacaagguaagcauuacuacccucauuauauaaacaaacaaaaucugaaaaguaauuugcccaaggucaugaguucaaugugaacuggaagcaaacacuaacuuucuaaaucaggcugcuuccuaugaauuggaaauguuggcagcaucuccucaaucuaugcaacacuggugcuaaauaaaaaguaauucaaaucauguuaucuacaaaggaaacacgugauagggaauuaauugucuauaauagaagugauuugaggagaaaggaaguaaauuuaaauuuaaaaggagcgugacuguuuuagggguaaaacuccuggaggaaggaaaagguacugggggucgacaccuugcuaggggauucagcuccugggggugggaggaagagcaguuaagagagaaauauaaggauuaagaagugagacuuaguucuuaaauguugguuagcuguaacaaaacaaaaagauauacagaccagcagacuacagaaacauaggcgggaaagggggcgggucccagagcuuguagcguggaagggguuggaaaggcaaaguuucaccuagugggggcacgaaggagaccacuaagacugcaauuauccgaccacugacccguuuauuguucugcccaaguauggucucaaaacauucaaaguugaagaaaucaguacgcuguccccgcgucagggauaaacaagcaagaggaccuaggaaaauggaagguuacugcugauccauccacaaagauggaguaaaugcagggaauaagauaagcucuuuuaacaucugcgccaaaagcaccacggaaggacaugggacaggguagaugauucaggcuaggcucuaaauuaggacuacagaggaggagugauaggauuuuuuuuaacuucuccccuuaauaaugcaucccgauauucacguagcugagcgauuugacagggagacagaauuugggaaagggaagguacucuaaugacucuacagauugaccucucaaaccuuagcccgaaagccgcgggagcagggaagcagagcccaccucggaucaagaaaaacuagggguuucauaugggucgcugcaagggcugagaagcagcaagcgcgcaauaauuaugagaacaaucuuaggugcgucccucucucccacuuuuuaaucuaauccccagcccacuacccaaugaacuauggacucccucccgcacuucccaacccgcccacugcgacgacgaaaacagaggcgaagagcgauugguggggcaaaggcaggcccacacgaggcagaggccgggggaaauggugucgcuuuaaccgguaagaaacaggauggucuucagcucaggaaggauuuaccggcaccacgacguuucgccauucgucaucuccuuaacgucugguaccugagaagcgucacaaacgcggauagcuaaccccuugguaccguguaagagcaagacaggcagccgccgccgccgccaucuuaacaggcggcccgacccuagucacugcccccccacccccaagguaucuccgccaccgccggcgaauccccacgaggacguaacccugcucccgcgagaacucaccggcuaagaacggcagcaccagaagacgcugcucgcgccuccgcagcuccugcacucaguagccaaccucggccgccgccuucgcgugaucccaggagaaccuccaccggaccaggaaaaacugagcccagcccgucccaacccucgcuugccaccaaaccccaaaucgccaccgcuccgcucucaccccacgcgaagcgaaaagcaaaugacgcacaaccucacggagcacuacggggcggagccagcaugccgccgccggcucccgcaugcgccguaggaacuaucg

SEQ ID NO: 12602 - RNA, 5634 nt, Mus musculus
aggcgcugugggaguggggcaggcgcugugggaggggacgucagagcgagguggugagcagagcuggucgcgugagguguggcggcuccgcuucaagugugacugguggcuacggccuugucugagagccgcagagccaguguugugagugcggucaccauggaccgcccggacgaggggccuccggccaagaccccccgccugagcagcucggaaccccgucagcgcgaccugccgcccccgccacccccaccgcuccagcgacugccccugccuccaccccagcagcguccgagaccccaggaagaaaccgaggcugcacaggugcuggcugacaugaggggggugggccccacgcugcccccaccacugcccuaugucauucuugaggaaggggggauccgcgcguauuucacccugagugcugagagucccggaugggaucacgcaauggagucaggguucggggaggccccuuccacagggaucauggaaacgcucccaucuucagaaaucucugggggaagccuggcaauugacuuucagguugcagagcccagcagccucggagagaaggcccuagaaaccuguagcuuaggagggugggggccccagauguuaguugguccgaagaggaaggaggaggcuaucauaauaguggaagaugaggaugaggaugacaaggagagugugaggaggcggcagcgucggaggaggaggagaaggaagcagaggaaggcgaaggagagccgagagaggagugcccagaggauggagagcauacugcaggcccuggagagcauucaaauggaccuggaggcggugaacaucaaggcaggcaaggccuucuugcgucucaagcgcaaauucauccagaugcgaaggcccuuuuuggagcgcagagaccucaucauccagcauaucccaggcuucugggucaaagcaguauccuucucaucaguaugcaugggccagaagcccaugacugaaggggagauguguggaagagagagaagaggugugggggagggucagagaugaggaugaugaauccccauuagaagauucuagaaggcguggaagagggauggcaagagggcaaaaucgcaucuaaaacuagacugcagaagggaaaaagaguagcauugcaacauuuaaaaagaaaauggaucccagacaauaaaagagggagggguaacggaaaaggcacacagcccauaaacggagcaacagauagagaaaggaggagaggaggggggaguacaggugaugaacugacuaaggagggagggcgcauaagcucuucgggaagcgugcucaaaccacacaaggcuccauaaaccugggucucugcuuagauaccuagaaaucccaaaucugucuaccauccucuccauuagaggggagagaguagaaaugggauggaacccugaagaaucaggagaaagaccacuugguugugaggcucaagugguuaaaugaagggaaagguacaacaggaagaauccaauccacuauuggugacuguugagcucauucccagggaaacacguaugcaacauuugaaaugcacacauuuuaguagaauuuauauagauauaaacacuuggcccaugauuaaaaagugucacaugaucauaggcucucgggagucaggcacaggguaucaaguagauacagauacauaacuuccauaucuagacaugaggcaacugggccuaagcacacagacuucuagaggcauucauccauuauguggacacugagcaucaacaccuauacauguaacauuuaaaugcagguccucgguaaccaaauguaucuguacuuagacuugggcuuuuagcucccagacauacaguauucugugaacauaagcacaagaaucacauggacauggucagagacccuuagcaucuagaccuacagcaaauaugaaccauggcaaggcucccugaugcugagguuuaacauugcauaagcacucaccuacuccucagacaucacucaaacacagaaggaccccccuugcuucagccuguuuugcucugcccucccuggcauugaacaguaaauccuugaccuaaacugcuccacucaucaguuccucaaccaccccagaauuucaaucuugaucaaccaacgugacagagacauuuuccgcuacuugaccaaucuucaggucaggccaaagaagaaagccaaggaaucuggucuuuggaggugagggggugggugggaagggcccugggagggauagauaccacuauuaccccacccugagcagguacaggaccucagacauaucuccaugggcuacaaaaugaagcuguacuuccagacaaacccauacuuuacaaacauggugaucgucaaggaguuccagcgcaaccgcucagguaagugauagucccaggauaaaccuauggccccuauacuaucauuuccccuuccuucuguaucucuuccucuucuaggccgguuggugucucauucuaccccaauacguuggcaccggggccaggaaccccaggccuauaaucgcaggagccaugacaccagagaaagcuucuucaacugguuuuccaaucacagccucccagaagcugacagaauugcugaggugaggccccuccuggcauugccagggaaagccuuucaagacuugucccugggugccugagaaauugugaguggguucuaggacuuaaacuccuugaacuccuuuucacucucccccuccccaccccucaacagaucaucaagaacgaccuguggguuaacccaguacgcuacuauaugagacgagguggcuacagaucaagcagaaagaagcaacacggaaaggaaaggugaugagagaaauggugccugagagguugggggguuguuuuuaaauagggcagagacuaaccuaguguugcacaggacuuauagagacacaggggaccacugagguaauccaaugaauaccuuguuuacaaaugagcaaugauccccagaaguggcaaugggacuuucccccauucuuagaaauccuaguaccuuacucccaauaacauuauacuaaguucuaaacuugcccacaguagagccaagaaucaauaugaaauggugaucauggaagaugcucaugaccauuaugcaauugaagacauucucagugacaucucagaaauugaugagaucacugacaaugagaccauucacgacaucaagaucucugacuucauggagaccaccgacuacuucgagacuacugauaaugaggugaccgaugccaaugagaaccugugcgacagugagaauccugaccacagugaaggcuacaacaccaagaucacugacaacaaagggagcguugccgcaaauccagaugacaacagugaugacccagaggaaaagaauaccuaugacagugaggauuccaacagcgagaaagcugauggugauaacacaacccuacgugacaaccagcagguuacuaauauccaggacagcagugauagugacaauggagaugagggcagugaugaugaagaugaugaugguaaugagggggacaaugagggcagugaugaugaugaugaugacaaugagggcagugaugaugaugacagggacauuagauacuauaagaauggcccugaagucuuugacaaggcucuggauaaccgcaccaaccagaaugacuaugaggaggagguagaacucaucucugaagacucaguugaagaagaggaagagaccagugaggaaggugagauauaggccccucccccuuccuuucucuucugagaacacccagguuucuuuaggcaacugguggugagguaaacacuguguguucucuccggucagaggacagggcaguuaauuuuaccucaaggagugggaaaggagagggagagcuaggggaaggagguaccauuauugucgagccuucuccauggcauggauuagcgacacaauguuuggcaaggcuuccaagauuaucagaggacccuucacucauucauuguugaucaaauguguuaggcaaauaauacauaaauauccucuacacauucuaagaauccugccuuuaaaaccccuauuucacuuugcagagcuccacauuucccagaccucuugaccacaaaacauguucuuuguccaacacuguauacauuugggaaacugcuuaggaaagacugcacauggaagucugagggcuaaugcaauauuuaaauugacucccagguuuaguucugaucuggaagacugggaaaagaacucauuugaaccuggcugugggcagacaaaggagaggugaaccccagggguagguggcagagauaggaaaaccagccacgucugaagguuuaagcaaggcacuaagggugaaagugugcagaagggaggauccacagacacacauuuugggguaggcuggggaaacuaagggaauugucaguccucuuugccucccaucugacaccaucucuuuucuccaaaaauuggaggcagagcugccuagcucuggaguggaguggggauggggaacaagacugaagaaggcagacuacagccuauguuugggucacacuaggugcaaaaaguaauaaguaaaaagccaaggccucacucagaaacagaagcacuuugaggagugugggagcaggagaaaggggaauguaucaguuuugaucugacaaagaugaaugcccugcugucuugccucccucccucccucccucuucuaaccuuggauaugagcacaaucucaauggcacuuuaucuccccuuccucccugucccaaacagaggcacuggugacuagugguccccagcccucaaaagccacagccauuuuguucuguucacuuuucaagggguauccaacuaccuuccccuguguccuccucucuccuucacagccagccagcuaagugaggacagcuaugaagaugagcgaaucuauggggaggaaagaagugaggugaacuccgaagauucugauauucaggaagugcugccggucccaaaagcuugggccagccuggggaagaaagggaaaaucggauaaacaucuugcccucuaggggcucucuauauauaccccuaugcccucucccauuugcccuccucuucagcuagggcugugcggccccauauugcacuucuggggggagacagacuuauuacacggguuuaaaguuuauuuuuaugguuuaguaauugcagaguucuuauuuggaggagggaccacgcuccccuucggcccuccuccacugcaggcuucugugugcugcuaaucuuauuuauugugaugccuuggucagggccccucuagcccccuucucgugagcuuaggcccaagccccucucuccgugcugcguggacauccuaucucuaagcgagaagggccgcugugaccuucgucacaauugcacuguggccucagacucugcuaccccuucuccagaguuacucugcaacuccuuucuucccuucaacagcccugacugcuagcccgccucagugucuuugcaaggcagcuucgccuuugugggauuccugcuccccagaagccccgccccuuuccccgugacccucaacgagccuaauaaaacugagcaaauucaaagugc

SEQ ID NO: 12603 - RNA, 18720 nt, Mus musculus
gcuaaacacacugcuuuauuuuuacagcccacgucuuucaugaggauaugaauuguuaagaggcagucuuguuuugcuuuucaaagacauuuuguagagauuuuucacuaccguaaaucugauuuuaucuacucaauucuguagagauuaaguaaauauguaugaugaaauuaacagcuucuguguauuauucuuugguugcucauguggcucauacaaaucuauauauacuaugagagaugggagcaugcacacccacccacccuuccacaucuucuaaaagaacaaaacaaacuuuauuuuaaaacuuuauuucugcaaagccaaucaagaaguguuggaaggaaaaaguguaaaaguuauccucgcauauuugggaacuugagcaagcacuuuaaaaguuugagaaaaugacaguugaaucaaaggcaauacccagcaaugugugucuuaaaacaaugauguccguucuuaagcaacauuccuuuuuauccccuaauagcuacaauaugauacaguacgcaacagcucacuugaaagugcuagaaucagaggguaaagaaugccagaagccgucccacuuacauuuccuacuauacaaugccuuuuuggcgcuugacaaaucaagcauucauguagcaauacauucaauaaaaacaacucauacuuuggguuuaagauccuugccccuccaguuccgaugccgugacaucugacucuucaucauuguaaauauuuucagccuggagauaacaaccaaauagguaaaaacagaauuuacuaucaauuaaaggguguuucagugacucuaaauuauuugccaugcacuguuuagucacuuccuucagucaucaaguguguagcacaauaucaagaucccagcugacagugcaaugucaauugauauagugcauguguuuuauuauuauaugaguguggguaaauuuuacuagguuguuaaaauguuaagaaaauuuugugcaugguuggggaguugguucuuuccucucccuuuuacaugaguuccaggcauguaaucuuagaucauauggugguuuauaaaacaagugagccuguugagccaucuugcaggcucagaaaagguuucuuuaaacugcuuccacccuacaaauuauaagucaccuaaauaaugaauaucauuagugaaaugguuuuacaggaguuaugaaaaaaauauuucaacucaccaucugccauaucugcaugauguuaucuucagacacagagcaaaugacccaagguucauugggauuccagcugaagucagaaaucuuggcagugugcccuccaugaauaaacuuaauaaaaacaaaggucuugauuucauauccuuucuuauucuaaauacaacaguugucuuaaguagccugccccguaauuuagagguagagugacaugagcucuauauaauucauuaccacuccaauauucugaaggacuagaauucuguccauacauucaaaugucucaguacauuauucauauguuaaguuccaggaaauauuuauuucaucccuaacaauucuagccucugcccauuucuuauaacugugccaccacuuccaagugaauaaccaccaagcauuuccaacaugucugcucauaugcucuuucauaugccugacagaggagucuuccugguucuucucuagcugucuuucacaguagccuuuucucaauauucccaaggcacaauauaacaggguugcaaaaauaaauacuuuaagguccagacuugcagcauaggccaaugaaacuuuccccaaaaauguaaaagggugggaucuuguuuucuacaaggcacuaugccuaacaaaccuuguaguacagcuuuaucaguuuuaaaaaaacugagauaaacaaaccaagauggggggggggugucacacauaucucagagcacacauaucucugugagugaggccuuggcuacagaaaaaacuaaaagcaacaauuucacauaagugaaaugguaugguaaacagcuuuacaaauaaauaacuucguguuuuucucuccuuggggggggggggggcaagcuugcuucuaucaguugaaccguuucucuucacugacaacuuacuagucuuaaauuuaaauguccuuugauuucaagcuuucuuaugaguaccauaauagacuuuuuaaaaguuucaauuauaugggcauguaugccuauauauauauauaugaguacagugccuauggaagccagauaugucugaucucucuggagcuagaauuauagggcauugugugccaccuggcaugaguacugaggacugaauucugguccccuugccaagaacaguagguauuuaaaugcugagcugccucacuagccccauaaugguguuccuuaaggacuauaaaacuauugcaaauucauaauauauacacagagaaaacuagcuguagacaaaaggccuuugugaaaaaaaaaucaugaaggcuaagagucaggcacaauaaaguauuuuggacacuaccaucuguauaccacacacucaaugucucaucccccuaccccaccaccgccauggccucaaagcucauggccuuccugcuugagccuccuggguuauagaauuauuuuuuaaagcagcaaugauauaaaugucaaacacacuggucuaaaaauccccuauccuucucuugcucauuucugccuggcgcuacugugcacagaagccaaagagacaagggagcuugcacaagguuagcacuagugaacaccuucugugucuuggacuuacucucaaaggguuuuuuucaccuuaaaauucaugcaccauaaauucucaccuauguuagagacaaugaccaaauguuuggaggagacacauggugaacaauucagaaaagggacaaagagcuacuacuaagccugucaguauuucacagaaaaguguuaacuuccauaugguuagagaaaaccaugcugguaaucaaacagcagugauacuaccucccaaucccccucccagcagaaaaacaaaaacaaaacaagccucaaaaaacaccauaccugaaaucaauaggaacuuaaaguuacccucacugaaacauuuccagaaacuucuggggcuccauuuaccauuuguaauaaaugucagagccuacagagccuaaucacaaaaacuuccuggauuuccuuuuuuuuuuuuuuuuuuugaaaucacuggcaagcuaaaauuugaagcucugacugaccuaaaauagucuaguaaaaaaguacucaagugugcauaauaugacauuuaaucuaaugcauaccaggagcucuggaggcccaucuucugcaucuucugcugauuguucuucuccaauuuuacuauuaagaaaauaaagcuuucauuacugcaaagucuuauagcaugcauguguguuuuauuaacccagaaaguauuucucuaugagaaguacuuaagacagguuucucaacccauggguugccacucugugugggcuaaacgacauuuucacaggugcgugaaaacacacauuuauauuaugauucauaacaguagcaaaauuacaguuauggaguagccagaaaaauaacuuuaugguuggggggguucaccacaacaagaggaacugaacuuuaaaggguggcagcaucaagaaugcugagaacagacuuaaguauucuuuauuauugugaguuguucauuuggagccacuaauaaauuaaagcugcacaaugaagaaauauugcucauaauaaacauuaguucaauuucuuuuuuaacugugguuuuaaugaaguauaagccaaagaaagauuuguuaggaaaagucaagaauaucaugaguuugaggccagucugaucugagcuacacaaugcccugugucacaaaaaaugaaagcgaaaacacucaauccaacaauucucuuuucuaugcuacaugcaaggagacacugacaguauuuuaaugcuugugguacuagagacugaacccacaaccuuguguaugcuagcucuaucauugagcuacaacccuagugaacuguagcaaaagguauuuuaauuugcuaagcacacauaacaaagacuugagcaacaaagaaauagggcuggagugguaguggcucagcaguuaaggccacuuguugcugaugcacaacaggguuuaugucccagcccccacauuguacuaucccuauacaacuacucauagucccuguucuggggaucugauaugaguaccuggcacacauguguuacacacacaggcaaaacacucauacaaaauacaugaccaauuuauguuaauugcugauuuacuuuucuaucacagaacagaaacucuuaagguaguuaggaguuuauugaaguuggaucagcaaauugcuuuccugguuuaugaguucuauuauguaaucuguuagauugacacauuuaugcaguuccuugucaccagauccuaaauuaccuuaaaucccacacauucaggcggcgaucaguaccacuugaggccagaauaguuucauuauguggagaccaguggaccuagcaauacagauuuugaaaacuuauuuaaagagccuugguaccuuggucuguaaguaucauucuaaucuguauuuccuuaccucacauucuguauccgcuuagccuagagacuugacuguccaaggcuuuaaagugagcccuaccaauccaccuugauggcagcacugaacccaacacuuugugcuugcucuaccacugagcuacguacccaaauccuuagcuacucccagcuccccaagccugcaggcaggaagucauguuucuaguacugaagaagucaggaaucccagaaaucuuuagacccauaaccauccauaaaaccuuuaaaauuagccuauaaucucuaauccaaaacuauguauaggaccauuuuuacagugcacccaccauauugucacucuuaauugaaaaauccuugaaaauguacuucaaacugauuccauugaagaauuuuuucuuacuucuggaugggaggggacucucaaaaacaaugacagcaacaacaaaaauauccaucaccuugauuuauauagaauuaugaggagcuuuaucaaaaacaaaauguccaaauuccaccaaauaaaaaaaacuucagccgggcagugguggcacaggccuuuaaucccagcacuugggaggcagaggcagguggauuucugaguucgaggccagccuggucuacagagugaguuccgggacagccagggcuacacagagaaacccugucucgagaaaacaaaaccaaccaaccaaacaaccaaaaaacuucaaauauuugccccucacaugaaguccuugacauaaagcuaucugaaaaccaggccagcaagacaccuuaaugaauaaagcugcuugccauaacaaaaccugacaaguggaguuuagucacuaauccccucaagguagcaggauaaacuuauucccagaaaguguccuucaaccucccucuacaugccuguuucagcaugcccauacauauacacacaauuauaaauaaaacaauuaaaaguuacccucaaacucucacauaccuggaaaauuucauccuuaugcgauucaaagguguggaguuuuaguuucagauuacgcaggucccauaaagcuacagucuguagagaagaaacccaaugaaaaugauuucuauacuuuaugugugaucuuuaaaaugcuuauuaaaguacaaaacaggacuugguuaacaccaaaaccaaaagaaagcuaugaaaccuuaucugcagagccaguugccagaaugaacucgcuguagggauugaaugagaggcaguugaccucagcggugugugcauccaccaaauggcucggcuuagaagugguauuggaucuggugucccaucugaaacacacaaaaagacaagucauacagcuccaaacacuuggcucagucgagguuauuuauuucuguacaaagcucugauaugcuuacccauucacaaauauacaaaccauacauagcuagcaauuugggcuuuugucuauuaaaugacauauuuuaaaccuccaaauaacuaggaccacuacucuaauuccuuuuugauuuuuaucuuaauuacauaccaucuuaaauguacacaaaauacagauuauaggaucuaacauuuacuuuaccuauaauuagccuugccaaauucuaguauauucuucuccuacucuuaguaguacaauaguuacuuaugaaacaugaguuaccaggcuggagagauggcucagugguuaagagcacugacugcucuuccagagguucugaguuuaaaucccagcaaccacaugguggcucacaaccaucuguaaugggauguaacauuguacucauaaaaaaaaaaaagaaagaaaaaaagaguuaccaagugauuuuaaugcagcuccauggccacacccugauggaaacaacucuuccucccugagcuuuacucaguuaacucuagaucacaaauuuauaaauuauucaagccuuuuucuucauauuucuguagcaauuuuuaacaaaauaaacuguucacuauccacaugcagguaauuauuuaucaaguauaacccacaaaaagcuauuugucaucuuaaaacaacaacauaacuuucaagaaacagaacacaaucagucuaccaaucacugcugguuacccauccagauuacccaucaagguuccacucaaccuuccaucuuacaucauaaguuucugaucaucagcaacagauccaaacaaggacucaugcagcagaugccaggccacauccucuacaacagcugaguggccaguaaagauugcuuuagcauccacaauuuugccuuccuuugguccugcauuuauaucccacaggcagacagucuaaggaagaacaaaaaagaacaaaagcuaugaaaacgccaguuuuaaaagguaacagguuauuuaggaacauauucaucuccuuaaagcaaaauagacaguuguuacuguggaugcccaccagaacuagauguucguauccuauuguugaagacaauacauagaucuuaugguugcaggauggagaaaucaagcuagaacugaguuacauguuuuuacuacuugcuggauagccauccuggugccagaaggugcaaugcugguagcugugguagagaggucauuaacaauuuauuccgcuuuaaacucuacauaccaaggcaaaccaagccaagaugugcacacuggugcaaaaguggcaagacuguuacagaaaagacugaucccuuucuuguuuggaugugagaggcacacccaaagcagagaaucuggagauauaagccuguguaaguccaguuuaggaugccauaggccaauauucaacuacagcuuuuguuagauggagagcaaggaguaauugcauaacaucuauggaauaugaaaauaaaaauagugguaacacauguacaacuuuugaaaauagaaccuguuaaauuuuacacaaauaguagaaagguaaauuugucagucuucuuuuaaaugaugguaacccuccaaucuucaaaagagcuuugugaaauucuaaagcucuaacaguagucucaugaaaccauuguuuuaaaaccuaggaaagugguggcucacgccuuuaauucuagcacuuggugggcagaggcuggcggauuucugaguucggggccagccuggucuacagagugaguuccaggauagccagagcuauacagagaaacccugucucgaaaaaccaaaaaaaaaaaaaaaaaaaaaaaaccaaaaccuaggaaaauguuaacacaacaaucuauguaugauguuaucuuuuaaaaaaaauuucaaucuaugcagagauccuauagcuuagauuuaggacuuucacgaauaacauacaacagauuaagaaaaacucggcucuuacauggucaucagaugcacucaggagaugcccacucagauuagaauuccaggaaagaccauagccuuccuuuuggugaccucuuaaucuaagaucaggauuacauucuccacuuggaucuaagaagaaaaaagaaacacauugaccacuaaguuaccuguuuaucagaauuguaaagagccaagcuucaaauuccuuucauugagugaaccaaaagagcaauucuacaagaacaaagacuucaucugcugggcgugguggcacacuccuuuaauuccagcacuugggaggcuagaggcagguggauuucugaguucaaggccagccuggucuacugagcuacuuccaguauagccagggcuacacagagaagaaacccugucucaaacaaacaaacaaacaaaccaaccaaccaagaguacauauaacccacaagugcuuugacugguuuuggggaaaaaaaacaacaguauuaucacuauuacagaaauguugacaaguacagcuauuccaucuguguaguagcuaccccaucauucucaucccaaggcaauuuuuagaaauauaucuaacaugucugguuacucauuuaguccuugcauacccaggguaucuugaaaccaugaaugaccuuuggccaaccuuucagaaugugacaugcucagagcagugaaaacaugcugcagcaacuuguaguacaguuuaucaaguauucaucuaacuucauuguugaagcugcugguuuucauuaccaugaguguacacagagccuguaaccaaauuuaccuuagaagccccagaccuugggccucaaacaggcuccucuggacagucacuuagcaaaaauuccuguacuuuucugcuacagaaaaagcauguccuguuugaucccagaaaggaaauacucagaagccugucuggguccccgaucuaccugauucaucuuuuuuucuucugcuuuugcccuggauccacaccugcaaguauaaucugcuaucagguucuagcaaaucaccaaacuugcaggugguuaugagauuccucacuuugaaaguuauaaaauaacugccaugugggugcugggaauugaaugcacauccucugaagagcagccagaguuucuaacugcuguugagccaucucuccagccuacacaguacaguacuuuauuuuuaaaauauuaucgucuccaaucaacaaagauguguacuggccuggcuuuauuauuacauaccugguuuugcaggguguuuuguauagucaaaaaccaaaacaucagaagaugguguuuuuguggcaaugaugugaggauucuguggcauauaacgagcacgauucacuucuccuucaugguuaauuuuaauuucacauucaauuuucccuguuacagaaccaaagccaccgaauucuaaugugaggagacauaaaacauauacauucaggauuauuacucacaagucauuuaacucaaucaacucaaccaaauuuacaguccgaauagaaaacagauaguggagaaaaagaaaaucuccaaaauacaaguuaucugcuauaugaaauugaucucaaagcccaucugcauuauauggauugcuaccucauguuaauacaguugguucuaccuuggauauaaaaaaauuuaaaaacuggccuuucuaguuaagaucugauuauuuauaaaaaucucaccuuacauaccaguuuuucuuuucauucuuaguugcagaguaauauuuuaaacacacuauaauguacuuaaucaaugucccaugacccucuuauuuugcuacacugauccuaauuucuugguacuguauauguuacugugaaaaaaccucaacacauaugugugacuacuucuuuuaaguuaccccccccccaaaaaaaccaacaaagaacaaaagccaggcaguggugucgcauaccuuuaaucccagcacuuggguggcaaaggcagacagauuugaguucaaggucagccuagucuacagagugaguuccaggauagauagccggagcuacacagagaaacccugugucgacccccacccaaaaaaaaaaaaaaaccaaauaaaaguuacauggcuaagccaaaagcugacuacaaauuuuaaucuacaugcuaagaugacuccucccuuugacguuaauguugaaauauguaguauacccaccucccuugucacugucacagugggaagcaucaaacugugcaucaucauugggaauaugaacucgagcaaccaccagaugguucugcucaucagauguaugagugcccagcacuagccaaugaagggcauaauccuuuccuucuggucuguuuaggagaaaaaaaaagugaaacuaauccuauacaauuuucagcugcuaacaaauuuagucugguucccucaaaauuagcaugaacauuucuucagcaaauauauagagaacaccaacaaaacccugcuucccaucuaauuaccaacuuuauuauccccauacuuucaaauguaagaaaacauucuauuugaagaguuuaguuuuucuuuccugccuggagagucaucuuccuugccuucaauuaucauugugaaugcuaccuuucuuagaacagcauuaaggacaguagauucaacucaccaaacauaccaacaucuaucuacauagaaguucaucacugauccaauacucuagacuucucaaauuguacauuuagccuauagcugauguuuauuaugcuagauguuucuguuuucccaaugagauaaaacagaaugagugaagugguaagggaaaaaagggggguuuauauacugguucaaacuaaaucuagcuauauaugcaaccuauaaaaauagcuguauguacaaccucucuccagucucauucucuucaccugaaaaauagguuaagugaaauggcaugauauaaaaucauuucuuuuuguuuaugauaccuaugcaaugcacauucucaaguguuucugucaccuuacucuauggagauucacuuucaggcugaagaacuugccagugucuuuugccaccaucgaccaaacagcaauuuuugcacugcuauuaaguaucaacaaugcuuucccauugucuuauccagaagaauuucaacugcgccccacugucccacaaagaagucccaaaaccagacaaguuaggucacauaucuguuuguuccuaaauuucuccuguacaaaggaagcaguaacguuuaaaaauaacaaccaagaguuggaaauuauguccaugcauguccuuuaguaauaacuuacaaaauuaagugcuaucaaauuaaaauuuggcuuaugguaaaacaacacacaacuccugaaaauagguaggaguuacuaagcaauacgaaguuuagagaggaggguagcuauugguugaugcauacauaguaagccaaaaauauggcuuugggugagggcaggcauauguauauuuauuuuuacucagaaaaguuauuguggaaauuuuaggcuuuugcuggguguccuacaucuauaaucuuaauuauucaggcugcgaaagcaagaagaucacaaacuaaggccugccaaaaccaugcagugaguucagguucacagccagugugcacaacuaagcagaggcccugacucaaaaaaaaaaaaagagagugaguugggaauauagcuugguaguaguauagcauucaacucucaugcgugaaauccuggguucaauuucuaguguuagagacggggaaaggccuucaauaauguaauuuagaacauggacaaacuaaaaccuuuauagggaucuuaaauauaucucaaaagagaccuguuauggaggagaaacaaaagguuauuuuuuaguggagcuaugcaggaaaaugaagaccauuaaguauauauaauaaaagcagucagauagacaguuuaucuaucaucuaugaccuuuggaagaaguauuguuccagcuaaacugggggaaaucuuaaaaauuugauucaaauucaaauauuccaguuucacaugacuuguuucucucacauaaagauuuauuuuuauguuuuacuaauaaguccuucauuagaucaaaccuacuucagaucauggugguacacaccuuuaaccuccagcacuugggaggcagagguagguggaucucuaacuuugaggccagacuggucaacagaaacaaccuacuuuccuuuaaaaaaaaauuuauuauuuauauguaaguacacuguagccaucuuaagacacaccaguagagggcgucaaaucucauuacagaugguugugagccaccacaugguugcugggauuuaaacucagggccuucggaagagaagucagugcucuuaaccgcuaagccaucucuccagcccccaacaaccugcuuuccugaacucauuauuuuucucaauauuggacacacucaaagguaccaaugacaaaacaucuaugcuacgcauggugguacacaccuuuaauuucaguacucugagguugaggcaggugguggaucucuaagagcagaccucaucccuggucuacacaauaagcuucaggucaggcaaagcuacacagugagauagacccuaucucaaguuuauaaagauccuaucuagcuuuaguaccaaaauccuugcaauacuaagaaauugacccaacaaucacaaaaauaugcuguauuacaagacuauuuccaguagcacuguuuauagcagcaaaggaccaaaaacaaccuaaauaaauacccaucaacaaacaaguuaauagugacauaaacuguauucguaaguagaauuguguggcaucuucauaaagaaugggugugugucagcauauugaauaguaaagucuccaauauauucuuuuuguuuugagagauggggccuaugcaacccuggcugcccuagaacuuuguauguagaccagguccugcugucucugucucccaaguacugagauuaauuaaaguuaugugccaccacaauuggcuuuccaauacacuuuuauuaaguuaagucaaccagagguccugaguucaauucccagcaauaaauaguggcuuccaacuauuuguaauagggucugaugcccucuucugguaucugaagacagcuacaguguacucauaaaaaauaaaagaguacuuuaaaaagaaaaagguaaaucaacaacuugcuaucauaaaaaauaaaucccaggaacugaaagguagaggucaguugguaucaaacaaacaaacaccuaaggaguccaggucuggugauauaguguuguuaucagagcuacucaaaagcugagguaggaggauucauguucaaggccacucccaguagcugacacuuuauuucaaauuuuaaaaaaguguuugggacuaaugcuuggugggagagugcuugaccagcaauuaugaagcccuggauucaaucuucaggacaaaaaaaaauuaauguacuucuauauucucuuaauuaagauggacgaaaaauguaaggcagagggaguacucgcaauggaaaaacuucuucauaccauauacuucuuuuuuuuuuuuaaagauucauuuauuuauuauauguaaguacacuguagcugucuucagacaauccagaagaggaagucagaucuuguuacggaugguugugagccaccaugugguugcugggauuugaacuccuaaccuuuggaagagcagucgggugcucuuacccacugagccaucucaccagcccauaccauauacuucuguacugucugucacuucaauuauuuaauaaggaacaggaauauaauccaguuguagagugcaugcccugaaugcagcugaguucacuuuccaauuuauaaaacuuuucaaaaaccuaaaucaauuguucagacaaguccaaauaaucauuagaaaguauauuaaauauaagcaggacaugaaggagaguauggucuuguuacucaaagaaggcaggcauuuuguaaaaaucagccaauauuuccacccccaagauaacacguaaaauauaugcaaauaaaacucuccaaaaaugcagauucugcuuccaagcacauaagggauacucaaucuucauuauuuuuuuaaacuuuuauguaaaauacaaagguaacauuaaaaauacuuuuuacuggguaugauaacacaggucuuucagaaggcagagggacaggcacaucucugaguuuugggguagugaaggauacauaagaagugguauuuuaauccuuaaaauuacuucugaacaggccuggcaugauggcacacacuuuuaaucccaguacuuuagaagcugagucaggagugaaacaguucuaggcuagccuuagguacagggugagcuccaguccagccagggcuauauaguaagacccuuucuuuaaaauaaaaaagggcuagagauggcuuaaugguuaagagcacuggcuggucuuccagagguccugaguuguauguagucccagcaaccacauugguggcucacaaccaucuguaaugugaucugaugcccucuucuggccuaaaggcauauauccaaacaacacuguauacauaauaaagccuuguuuuagguagauagguagagauugaaaucagggucaaguaggaaucaguaagucaucacuuaacuguguuuuuacuccacacaagacacuuaccacgcaggagauaauuuaguaauuuccccacauguaagacaguacuacuaacaucuucagguaucuguaaaugaaauaacuaaaaaagacaagaguguacaaccugcacacaaagcuaauaagcaaaggcaauacuggcaaaaccuaagucucugacauccaaguucccacucuugggcuggugauauggcucagugguuaagaucacugacugcuguguucaauucccagcaaccacaugguggcucacagccaucuguauugggaucagaugcccucuucuggugugucugaagacagcaacaguguacucauaugcauaaaguaaauaaagcuaggcaguggugacacacgccuuuaaucccagcagagacagagacagguggaucucuugaguucuaggccagccuggucuacauagugaguuccaggacagccagggcuauacagagaaacccugucucggaaaaaccaaaaaaaaauuuuuaaauguaaauaaaaauaagucuuuuaaaaaauucaaaaaagccucuaucaugcuucaguuaaguaaaaagguuaaaaaaaaaaaaaccaaacuguucauaauuguuaauuaacagaaaaacaaaaagacaaaugcagcaaaauuccaaagaaccugaauacccuuguuaauagauagguugauguuuuuguuguuauucuuuaauuuuuuucaagauuugaaguauagcaguguuuucucugccucaggccuguguaagugagagaagagcaucaucucuuaggaccuggauuacagaaggcugacauaccagcugggcgcugggaaucagaaacccaaguacuuuguaagagcagcuagugcucuuaaccacuuaacuuauuccuuugcccuuuggauuuuuuugucuuccugagaaacacagucuugcuagguggugguaggguacaucuuuaauacuagcacuugggaggcagguggaucuuugugagcuaguggacaaccuggugucuguguguguguauguguauuuguuuauuuccagggcagccaaggcuacagaaaaaacaaugucucaaaaaagagggggggggaauauggucuuggggcuggagauggcucagugguuaagagcacuggcugcucuuucaaagguccugaguucaaucccccagcaaccacaugguggcucacaccaucuguaaugggaucuaaugccgccuucuggugugugucuaaagacagcuacaguguacucauauaaauaaaucuuaaaaaaacaaaaacaaaaauccauggucuuaugaguauaccucaggcaggccuauaacuuagaauuauacccaugugccaucacacccagcucauucuauuuuuauucuauuuacuuauuuauuuauuguguguggauaugcaugucuacaacaguguacauguguagaucaaaagacaacuugcaggagucaaugcuuucuaguucuggagacugaauucauguucuuaggcuuggaagcaagugccuuaccaugcgaagccaccuugccaacccucagucuauuuuagaaucuguucaaaacaccuuagccacagagcacaugccuacuaugcugaggcccuggguuugaaccaccuccagugcugaaaaaauuaaaaucaaugccuauaagcccccauuauguagcaauucaagacucuucucacuggacauuuagauuuuuaaaauggaauuuuaacauaaaaaaaccugcaaauaaaaaacaugagauuuugagacagcaagcccacaucuggaaggucaauauucauauauggaaccuagcccuuucaagugauuuuaaaacuagcuucuuuuuaccacuggucacaaauucuuccuuguauauuaguuucauuugacccuaauuauaggcucacuauacaaaaaaaagacaaaaaaaaaaaaucaauauacuuuuaagguaugugcccauauuccuauagaaaaaguacaugccaggcuggugagauggcucacuugguaagagcacccgacugcucuuccaaaggucugaaguucaaaucccagcaaccacaugguggcucacaaccguccguaaugagaucugauucccucuucuggaguguuugaagacagcuacaguguacuuacauauaauaaaaauaaauaaaucuuuuaaaaaaauuacaaaaaaaagguacaugccuaccuaaagguagucuagugaaggaagugccuugauucuggagccaaccgguuuugguugguugagcccuaguuuguaagcuaugagaucgccaguagugagcgcuugagcaccgugcuuaaaauucucauccccuuuccucacugguaaaucucugaaucgcaacaguaguucuguuaugaggcuuaaacucuucagaugugucagguucuauuauucuaagugcuccauaaauaucaguaauuaugccaaaucuuacaaauauucaagaaaaucacuuaaugcaucaagccauaauagcuuuuaauuuguuauguauguaaucuuuccuauuaaguuugaaaauaauguauugaucuagaguccagagauguuggucauggaauggcaaaauagucaucguuuccuauacacaguauuacacaauauucucuccucucaacacaccucuacgauagaaaccaucuuaaguuuugaacaaccacuugccgccucacccucggccuaaccaauuagguauuuauguucuguguguaaaauaacauuaacaauaccuagaaauuuaacaugguacuuaaaucuacacaaaauagaaguuggcagaaacccuuacuuagucacuucaggaagccacugaacgguaagacugggccacugaagagcaugggucauaaccaggucauacagaaacgguguauucuucuuccagauuuuauacucuucguugaugacacgcuccuccacaguaucuucaaacacugaaauuuggagaaagcccacaauuaaguggcugagaaggcucggagucaaaggcauggcuacggauccuggaggucaccucgagacggccacaccuuaucuauucuuuccuuuuaccuauccugcucacacgaacugcucucccacaaagugagaagaucaacaucaggaagcguuuucgccuccacuuccaagaucgggauuccggcgcuuacccgaauugggucauuaauugcccuaccaccgagcucgucagccuuuuuauagccgcucgcaccuguucuacgaugauccgcauuguaaaccggugccccgacccacucgaauagauccaauccacguggaacagcagcagcccacaggccugcucccuccaccccccacccucgcaggaggccccagcuccccaccaagccacgaucggcagccauaguccggcgggauccagcuccuccccccccucccgacacggacacgggccgcgaccccagacggacgacgaccacgcgcacggaagaauccgcgcccgccgcugacuucucgggccgcgagcgccugcgcccccgagccaagggcgucggagggagcuaggccgcggggugggggugggggugggggaaggggggccucucucucggcccccgcgcccggcuccggaaaugcucccggcccucggcggcgaccaggccccgugucgcgcaggcccccuugcaggcgcgcggcgagucucgcgcccagccccgcccccugcuccucacgccaauucgcgccuuucgucagcgcgugccgaggccucgggagcccgccagccccccggagucccggcgcccgcacgcccgcccgccccacagggcaggcauccuuacucucuuuacucgccaucuugcgucgggucguuucgccccccuuggccgccucggacuucucucucgcuagucaagagcagcccggcaggcgcuccuugccucucccaggcacgucacgcaguccucgcucggaaaagccugaguucggucuggccgucuggguucuccccccagacgccgcgaucuccucuucugccuccuccccgcuggcggguagcgaggucugagccgcucuccucucucucccucucgccaaacuuggaacgagacuuuucaacccgcgccucucagcccgcccaggcagcugagcgcaggcgcagccgcccugggaaauugg

SEQ ID NO: 12604 - RNA, 38110 nt, Homo sapiens
ccccuggccccagcaccugcgcucuugccugcccgccaccccuggcgccuacuguuuccucauaugauccucccugcucccucuucacgggcacuucccaggcuggcuucuucccaagccuuaaucccacucagcucuccuggccauaucuagccacggcaaugcaguggccuccaaaucccccugccccuccauccugcugccaacugagcuuccauuuggccugugacauuuaaaaauaucuguccagccuuggcguauagaaccuaauauccccagcuguuuaaauaccacugccucauucggcccccaugccugugcguccaauaaaagcagaaacugacccugaacacggggccacuggaacccucuauuccaaucaugccauucuuaauuuggcuccuuugucaaaugggucaucagugcgagccaguuccugccccuacaaggagaaggcuggcaggggcuuggggggcuuuggagaggcaggucaagguguggccaucuguaugccugugacgggcgcacgugccuggagcaugcggugauguccgccacagcuguccuccaucccccccgucucccgaccccagugggccccauggccuugcuauuaauacagugcaaagaggcccagcagcuggccggggccaggucuuuccacauggauggugacaacugccaucacccuggaugugggcucugcacguucccaaugugccuucugucagaaggggcagagcugcaguccgcugggguacugucugcugaaaauguccacucugacuuggcaaugggggaaaucaccaaugaucaacuugggagucgugaaagggggcucaaaagaugaguggucgcuuuagagcacuccuagugcucacaggaacaagggucugcuccccuaaccgcgccaucagccugcauuugcauggaggccccaggccacaggcuucuucucucaucaucgauacauagguccagcacaaugcccagcacaaacaugcagccaaguacacaccuaugcagcgaggaaaucccccacagggagauacagagaaaggcuucauuuuccugacacgcucucuuuggggaggaagaggucggcuucaacauauccuaaaagaacccaugaagaacgaacuguuagguggaucagagccacaaauccagaagagaagaacccagucuacuguccaaaacugccaggggugaaacacuaugauuucugggauuugcugugaagggcuccagaagaaaagguguggugacagaggaaaccagagcagcagaagcugacgggcagcgcagcugcgcuggccuccucucugccuuggugugcuugaaaauuuccauaacaacaaguuuaaaaauacacaugugaaaaauuguucaacaaauauuuacugagggccuaauaugugcuaagaacucuucugaggguucuuaauuuguauagaaagaagaaaggugagcaaagucccaccaugcuggucagcagcagcucagccucaaaacaaccuccuuuugccauagcacagcaggcccacccccaaaugcccuggguugguuucagcugucccaugccacugacccauggaggcaguccgaauacguacuuuuaaaauuuaguauuuaaaaauacuaucauucaaccccugugacccuaugcagcccaacccgagaaagaacacagccaagaacuucaucuagcagaauguccuucucccacuccuuguggucuccccugccagaagaaaccaaaugcagaagcugaguuuaucauaugcucgcuguaaacauuuuaucaugcaugcauuacuugguuuugccugcuuuugaacuugaugaagagagcauuguacuuucuggcauccuaucaagaacugagagcacuaugggagaacagacccagcuccccucacccaauccccagaaaagcugggagugagaacagaggugaguggauggguucugugagaggccuucuggcuggaacacugcuucagagcaugccagcaggaagugagaagugcccgggcucaucucgcuggggcuugggacacagcucuaccgacugucucuuggcugcguccgcaaacauaaacacgugaagugggagcaaaugucaugguaaaggcagaucaagacaacuccaucuguugacuuauuauuagacaacaaaugucaugggaagaaaaugugccccaaguaauuuagccccguugaaacucaacaggcuuccgcugguuggaaugagaacucuuccuaccucuccuuagcuaagaggcaccugaccagacacugggagcaaaaccucauuuauccccuuuggugggaaaucuuuguguccuagaagaccaucucucaccaucucuccuagaguccagaugagcauuucucaggucaaugaagagacuggguggauggggacaggaucaaggaggugcucagggcugcaccuggagggacaucagccacgcugccauuuccagagcaugcacuugucuucaugaguauuuuuaaaauacuuaaccagacgccagggauacugguaaucuuucaauagcaguuguauaauuuuccuuuaaaaaccaauguauuuacauaaaaaaacagcugacuuagagagaagugugaagugcaguucaguauuggaauauggcaaaaaccgugaagguggugcgaaaauaauugaagucagcaaaaaugaccucgauauuccuaaagggguggaauuuuuguucuaauuucuaagguacuuuugcgcuuagaugguuuuaacuguagucucugccaacaaaggccacucauaacccccagucugaacggacccuacccuguucaaggcccagagcuguggggcauccuagcccugcuaggagaggcugcaaugcucccggcauggacgagaggggagcauggaagcccagagucccugccacugcugcugcugcacaaagccacgacaacugguggccacaggccuugugucucucaaucagcagccccaagaaaggucucugagagugcgccauucucuuucuccugagcuugcucuuuugcuuaccuuuagacgaugacuucagcgagaaagacagaugagcaaaugucacuuucaugcagauaguucacccaacugcauaagugcucucaaugggagaacuuucagcacacugaagucuauuuaaaaauagugggagaagggaaguuacuucucuuuuaaaagugcuaauaauaauaacauuaauacgaauuauuuguagaguuaugugacugaacauauacauuuuuuugcaauguugucauacuacuauuaacaacacugcugcugucaugacgggagggcugggggcccaaacagccugcucugcugccccugucaucccagcaucccccugguuagcacugccuuucaugcauaaaaaugucccagguggaugacaaauguuaugguaacccuaguuauacaccaugacuaacucaucuaugccuacgacgagugggcagggggaggguuuggggccaaaggggaacagggaccugaauuucaaaggcuggagagcauucuuuaaauuguggccauucccggcuuaaacuguuuagauccuggauuagcagaggggaccuggguuuaaaaugaucagauggugagggagagauacaugauuuauaaucggggagagaugcaugguuuauaauuggggcacuauuaagaguucuccaauggcaguuugaacuauguuacuucuuucuuuucuuccuuuuuuuuucuuuuuuuagacagagucucacucugccacccaggcuggaguguaguggcaugauccuggcuccuggauucaagcaauucgccugccucagccucccgaguagcugggacuacaggcgcgcgccaccaugccuggcuuuuuuuuuuuuuuuuuuuuuguauuuuuaguagagaugguguuucaucauguugccaggcuggucuugaacuccugaccucaagugaucugccugccucggccucccaaagugcugggauuacaggugugaggcaccgcaccuggcugaacuauguuauuucuaaaacagcucagucaccuucaugaaggacuaaaagaaacuggacacagaaccugggauacacuuggccucucuuuucuaacaucuuuuaguuagguuuucccuagcccucuccuuguggcaaauuucugagauauauuucacugaaguucaacuuuucuugacaggcuagagaaaauauugaugaagccaaggucaugggccucagaaacccagccccacaagcagagcaggaaaacagcuccaugcccucucuccugacucauagagggccuggggaugccacaggucuuacugucuccucuaccagaaagaagagggucgugcuagcaggggaugggagacaaauacucaggcccugcugguggggacacacugguugccucguagagaagugcaguguagccaaggcucuguguuggccuaugagcagcagcuccacugcuugauaucaucuccagagaaacacuugugacauuuacauggagguguguacuacgacauggucagcagugcaguuucuaacagggacaaaguggcaagagcugaaugcacgucgacagggaugugacugcugacugucuuuauucagcccagacgaugaggugauggugaaauagaacaaggcaaauccuacaggaaucagcaggaaagggucuccaagauauguagauagaugaaaaggcugcaaugugaagcccaaugaaacacaugaaacuauguuuguguuuuucaagaugacauccucuauggaaacccauuauuugugaaguugguaaccucugggggauuugagaggugauguaugaaaacuguggcuggugcagggucaucaaagcagacauuagccuuagcuuuaucgaauauuuuaaagcuauuagauaauacauguaauucauauaauugcaugcgcaguuacacauuauaguuaagaagucauggcugggagaagcugcugauauguuaucagucacaguguagacaucuugaaaaaggaucucgagaaaaaugaacuucccuuucuuguaccuuaaugcuccuauuuuaggggccaauuuuaaguaauaacuggugcuuuuggaacaaccaagagaaaaagagagugccaccaaguccuacuggcuuuagccuuggccaaacccuucccggcugccauguggacuuugccaggcugauuacuaaagacaugguauagucuauuucuaccuuccaaaccacuucuagccagcucuugcuuugcucuuucuuuaauaaggagcuggaggaaugucaguucuaaagugaucaagaaaagaaugugaagcugugaacuguccauuugguugcugacaaaaaauagaucugauaucaagggggcugacaucugagcccuuggcucauguuccaccuucacgggaagauucucugcuugguguaguaaacaauugagggauagaacuaggacuagaaaaauucagucuaagaguggcuuuaccacuaaccagcuggucccaccucucuaagccucaguuuccuuacuuguaaaauaaaagggcugagacucgaucucuccagugccauccagcuccaggaugacuccuguugauaaugacuuugguuggaaacucaauuuggaguguuccucucuugucucccacuuagcacuagacuuuuucugcuucuaugacagccuuuccacugugcccgagaccuagaacaucuuucuaccugucugauaccuugucuugauaccuugucacgugcagccuaaaggcaccuuguucucaacagaccaaaggcagaacucuuagccccaccaccccacucaacauggcagagcuccuggccccaccgccccacucaacauggcagagcuccuggccccaccgccccacucaacauggcagagcuccuggccccaccgccccacucaacauggcagagcuccuggccccaccgccccacucaacauggcagagcuccuggccccacugccccacucaacauggcagagcuccuggccccaccgccccacucaacauggcagagcucuuggccccaccaccccacucaacauggcagaacucauggccuccugcuaccucacaccugggccucuuucccugcuucucuaccucagugaaaaguacuagcuuccaucuaguucuaccugggugucauccugacacagccaauuccccacauccauguuaucaccaagccuuguaagacacucuccuaaauaacucuaaaagccacucucacuauccucagcuuuauguauuucuaaaaccaaccaccucccuagacccagcuacuaucaacucuagcuuccucucaaauuccauccccguacucuguggccagagaggucuuuaaaauagacaacuugauuuuggucccucauggccaucaggacaaaggcuucccaugguuuauggcuguucaagacaacagaaagacugcaguuuaaccuguugggcccagagaucccugcccagcccuccagauucaucucuguucuccagcucugcugaccugugaguuucccuaacaggcuuagcuucuuuccgccagagagcuggcaaauacacuauuccucgcuuggaacugcaccacccucuggcuacuccucaacuuggaacugcaccaacccccugcugccacaugcucacccuucaguucucagcucaagugugcacguaucacuuuuucaguaaaguauucccugccuugcccaaauauaggguggcuucuucugcuguauacucagggggaaaaaaacaaaagaacaucuuucuuuuccagugcccuuagcuuagguuauaaggagaccuuccuuagcgcgaugacucauuauuuccagaucccccucacugcaugcauucaccauuguauucccagugccucgcagaguacaggaccuagaaugggcauccagugcaguugugcagaccaaacucuacagcuucuaaggcuuuccauuaagaauccacuaaaagagaacuggaaagugaaauuaaaaagaaaaauccaacucgacugccaacuccaacuuuauuuuaggcucuuucugcauggcugggcuccucaaacuccugcccccucacucucucaccucuuggccauuaccaccaccauaccaccaccaccaccacugcuauaccacuaucauaaccaccaccaccacaucaccaucaucaccaccaccaccacaccaccaucaccacaaucaccaccaccaccaucaacgccacaccaucaccaccaccgccacaccaccaucaccaccaccaucaccaccaccaccacaccaucaucaucaccaccaccaucaccaccacaccaccaucaccaccaccacaacaccaucaccacaaucaccaccaccaucacugccacaccaccaucaccaccaccgccacaccaccaucauuaccaccaccaccaucaccaccaccacaccaccaucaucaccaucaccaccaucaccaccacaccaccaucaucaccaccacaccaccaucauaccaucagcaccaccaucaccaccaccaucaccaccaccacaccaccaccaccacaaucaccaccaccaccaucaccaccacaccaccaucaccaccaccgccacaccaccacaccaccaucaccaccaccaccaucaccaucaccacuaccaucacaaccaccacuaccaucaccaccaaugcuacaccaccaucauaaccagcaccaucaccgccaccaggcauagucacuggucagcuagcaagcagaaggaggcaagauuuauauccaggccugugugaucccaaaucuggcuucugguuucucaccuccaaacuuucuguugagcccucucauaagauaccaucuauuuucccuuugaagcccaccuaaauacugucagagaaaagacauuagagaaaaaucccuuuaaaaacagauauaaaacgagggugcccccauuucacccuucucucuccuacacacuuucagaggacaacgcaaggcauagacaaaggaugaagucagagaaagccaaaauaaguaacaaaaacaucaaucuaacuggcacuacuaacuagaagaacccaaaagaauaaacuaaaaaugauuuuaaaauauaaaaagaaguccagauuuaccaaauaucacaacuguaaaacccaaaggacaucgaauuggagguuccuagauuuugagauuuuagaccaaaaucuacgaacaguggcauaagccacugugcccggccagaccacgcuaauauuucaaaagaaauguguggcacucacaucggguugccagcuguuuugcuuuuuuuuaaaaaaaucugcuagauaaagucacugaaaacuaaauaaaagcaaaauuuaaaaaacaacaucagcgggcgcaguggcucaugccuguaaucccagaacuuugggaggccgaggcgggcagaucacgagaucaggagauggagaccauccuggcuaacauggugaaaccucgucucuacuaaaaauacaaaaacaaaauuagccgggagaauggcaugaaccggggagguggagcuugcagugagccgagauugagccacugcauuccagucugggcgauagagcgagacucugucucaaaaacaaaaaaaaacaaaaacaaaaaaagaucuaaaaucuuuuggggaggguagaauucaagcaguuuuauucauucauucauucauucauuuauuauaaggauuucugauuuauuuauuuucaaagacucuaaaaucuuaaagcaaaacaaaaccccuaauuaucaucuacaauccuucuagaaagaaaugauaucaaaauucuaaaaggcaggaagcuuauauagccucaaaaucaagaaucaaaaucaaaagucccuccccugaauaaauuuggcuugaugaaagccccacuacaacaucuuucguuuucucauuucacuguggacuggcauuugggaaccgcugacuuaguucaacucuuucccugaugagguagucucuucuaccaaauccuccagaaaccuucucugaguguuugccugaguaggcugcugguugccucaaaaaccaaccaauucugaaaguggcagaagaugagaaaaacguacaaaaaucaauaccauuucuauaaauacauaauaagaggccugaaaauauaauuaaaaaaagagugcccacucacaaugcaacaaaagcaucuaauacuugggaaauauaugauauauauucacauaucaaacucacauaggauauauuaaaauuacaugaagaaaacacaaauccuuaaugagagaaauagugaccugaacagauugagaggccauacuucuggcuuaagacuaaaugcagaaaagaugauaauauuucccaacuuaauuuauaaauugaacgccauuccagucaaaauaucaccaaggucauuuauaaaacuugauaaaaaugguucuuaaauucauauagaaaaauaaauggacaaaacaucagagaaugcugagauacugugcagugagaaggcauuugccccagcagaucuuaaacuacagucuaaaaucaucauuauuaaggcuguagggcagucacgcuaagauacugggaaaaugucgcaauuucacuaacugagcaggaaugaaaccacuagcaauuaaaacuacagaacccacagaaggccacaacacuccgaggacagagagaugucuugcaaaacucucuuaucucaguuguggacaggaagcuuuuguuuuuguuuuucuaacuaacugagcaaggucaaaaauuuacgaagugacaagaugaagauuuccugacagcauaaaacaagccucuccuuaaguauuuuccaagguucaucucaauccccacacagcaccucauuccuagaaugcuuauggucaaaaaucacacuuuggaaguuaauuaaauucccguuguccucuaauugugagugugagugugugacacaggcuggcggcuacaacuccugucccagaggcucuuuugccagggacccugcaccaucuccaccaggugcccaggcacucaggaggcacugcuggacuucuugcugggccauuggcucccuaaauacacagauuauugcuuaaaggcgaggaucuccuccacuuaagucaaaucucacaugccucaaugccuuuucuuuuuauauguggcuccucacaugccugaaaccaaaucugccauuuggaaaaccggaaagucuucucuugcuccucuucccucccuccucagugaagagcagggagagaagugacggcugcuuccugagggaacuucuagaccaguaaagggaaggacucccaauuuaugaugacuuuuagccgaaacaauggauggggaagcggggguccagaaguaaucaccagccuccagugcauucucauuucugacguugagaggcccuucuuucauucuccuggcuccaugauauuuuaucaugcacaauguaugucacucaugggcccuauuaggaauccuaucauccuagcaguggaggugaccuuguagaccaacccauccaacaccucaggguucucauacacaaggaaagaagaaguggaaagaaaacccugauguggaaaccaaguauccaccacaaggaagccaaggaugcacccggcuagggcacugaucugauuaucaacucguccagaucaaccccacacacaccugacugagaccuaagggguccacacauccuaacaccagcacgaggcaggaccucaucuucacuggacugucuuuuagaaaaaugaagccaagcgaaaauaacaaacaaauaccuuagaauucucuuuaacgcaaagcaaugcuacagugaaugacgccgauuucuccccaguuaucaggauggacugauuacagugcccagauucauuugccugaagauaauugccucaauuauccacuucacuuugcacauauagaaauagucccaaucuacuggagccucagugacuagacauguaaaauuggucuaaucauauuuugaagagcucgagcugcaaggauuucuaugagcgugugccuaaaccgugacaacacuaaggguuucuccccuccgggcucgaggcgcgcucgcucucucccucccagaagucugauggggugagucagauccucagcagauaagaugaaaacaacuuugaggcucucugucagggcuaggggcuagaggaaagauaggauguccaggacagcuggacaaaagacaaagcuaugagccgagagcuuuccugacgguugagugguccuuugcaaucagcaguguuuucacccacagcucacuggcuggcauggcugcuggugggcagggcagagguggacaucuggggccagaaccccguagacuggggguguccugggacaaugaugucucaacuggcugcaggaaagaaccagacaagcucaguguagguccggcugggcagacagccggaacucaagaugaagcaaggcagggugucagaguccagggucugaaccggagaauacagaaugccaagcuccagggccacgggagagaaaugagacaccacguccaagagggccuguaccccucuuggguacugaugcuuugccugagcaagggggcuucuagaugcuucccguuggauccagagucuagaaauugcuccuccuguggcagagggagagagagggagauaggcacuuaucaguaggagaagcucaacagagcacgaagugaagagaaaguaagggagcuccugggaagacagcuccgagcaaucucuacgcacagaacgaaggcuccuuucugauccuacgcccuuuaaaaacgaauggcacaaauacaguauuguaaucccaaaaauggccuggacagaaaccagccaugucaaaaaggugauuauuucccucuauuguuugcuuuuagcucuagauggcauucccccaaaucucaaaaucaggagcucgagguuuucaccauuucuacuggugagagccaauugauaucagcgcagucugaauagcagcaaaauagcacccuagagagcugagccaaaugcuucugcauuguaccugguccucucuggggaacaggcgggaggggccaauaccaaauucucggugggguugagccuuacuggcugauugccacagugagggguagcgagugcugcaaacucccugaauucauuucuguccaaaggaaaguuggaaaagcucuucaucuccaaaaauaguccuuuccaaugauuauccaaaaaauaucuucaagagugauuauacccgcucaccaggcagggcagaaccaauccauuaucuugaguuucaucuuagaaaaugcauugaggucugugggaccucugacaauagccugcaagccuucugagaacccaugauucaucugucucccccagggccacuggcacauggcuuugcacacgguagacacaugguuagaaacaaguggauugaaagcaauucucaugggcuuuuaaaaaucaaaagaaaaucucagagucagacuagguaaagacucaucucuuucugaaaaucacaagaugaacuguaccucugauucuaaccaguuacucaacuucccucccugucuaucugggcuggaauguauuacucuacaccugucagcaaucugguuuuaauauuugggggcacuucacaucaaugugugugauguuggauggcaggaauugcucauccucaauuacuucgaucuccccacagugcccggaauagugucuugaucauagaaguggcucaauuuaugauugcuaaauagccaauuucauuuguaauuuccgagacagcuccaggagaggaggcaaagagaaccaauguaauuaacagauggacuugacucauuucuuugcuucaacaagugaugaguuguggagcaaagagccuccacgcccugccuuggugaggaaagcuccacaggccgcuggguccauugcacacaucuguuugcccugucuuaaaacugccaccccaacacuccuuccugucacugagccacuugcacuuucaaugcuuccaaaauaguaaaaagugggggcgggggggaggaucguguccaucaguagagcccccaaacccuucucccacagccuacagaggccuucaauggaaucagaggcuaaccugauaagacugcggugggcaccgaguuccaaccccacuugcucacgcacaccacgaaaaacaucuccagugugugguuaccuguccuuugacuucacauugcuucugacaaagcgccaacuuucugacagcccacuccaugucagauucuucuuuggguugcgcugaaggcuuucugcuacaacuaccaccgauagguucuaauuuugcccucuagagccauauauaauaaaucuuaaggccucuuccacaugaaaauccuuuaaggagcuagagacaauauucuucacaauuuauccgaaucagaagcuuacuguaugauacuguagugagcugggaacugcgcuuuccuguccaacugguuuaggagccucccuccagcagagacccgcaagugauauaugcccauacuuuauuuaccagcagacagagagagccccuuguuccucagcccgguaacaacagaggugguucaucacccacuugcuccuuuuugaaauucacucugcagcgagcacuuuuuaaagucacgcacguaaugcauuuuaaagagcaucugcuguacggcuccauuugcucgaccucggcacuaagugugagauggaauggcaucucagugcagucccccacuccuuccucccagagccuguggugaauguacacugagauguauuuauaacuacacaggacuggggcucaaaaaugcagucuuuuguuaaauguguguuugcugauuaaaaugcaucuugcaaagaaagcgcauugcuaaugcagaaucuaguccaaauauauguauuauguaaugcacauuuuuuaauaaugcaggcaaucucgguguaucuauauuagugaaucagcucugggcugccaucuccuuuauaggcauaaaagcacuccaucugaagaaugaaguacuuucuuauguacacuaaagaaucauaaucuaccucguugcugacagcugacauuaguuuccauucaaagggcauuuacuagcacccauauauuccugauuuuucccccaacgugcccugaaaucagcuugaauaauauauuucuguuccauaugcugucgauggagcugugcuaauuagaagaaauaaagugggugggucaguguaggcagacucucuggaaacgugccccauuaguugggacucagaagcggagaugaggauuugaaauauacagcucuaaaugccccugcccagugucccaugauaauauccacacagugacuacagccacgcaggcaccugugauaauaaaacccuugcuguuccacaggaaaagugguagagcagggcacaacuggaacauagacauuuguccuuuugugggguuugacaagucaauccuacuuuaucagacuaaccucccagguucaagcaauucuuguggcucagccacccgaguagcuggaacuacaagcgugcgucaacacgccuggcuaauuuuuguauuuuuaguagagacaggauuucaccauguuggucaggcuggucuugaacuccuggccucaagugacccacccgccucggccucccaaagugcugggaucauaggugagagccaccaugcccagcccaaucacuauuuuaaugcuacaaacuaacacagagugcaagauacaagcuagacacagccaagaugcagaaaggaaaaccucaacacauccaaagcaguugcuggucucucacugggguaugaacucugcacuuagugguuuuaauacgggugugguguugaaggugugagguuaaguuccaucauggugagaauggcuguggguaccugacugacucuucagacaccaggcagaaguaccaguaccaggagggccuggugggccacccagugguagagccucuuuuuuuaagauuccccauacugacucaagaaggagaaaaggaccacaacccaugacauguguccuaagugaaacaaccuucuugauacucccagggauuuuaggaugauggcuuugcucugaguuguuucgccuuuggacuugucacuauggccaaaaaggcaccccauaaucaucauggagggccagacugaagacacgcacaccucaaaagcagcagccagguuagcucccacuguagggaucuccuccuguaggccaucauuugauuuucuagggccaagaaagagcggcacuauuuacuccaaaucuucagccuugcagaguacaacaacacgaucuaguggugucugaccgcccccuagcccugauccaaucauuuucucauguggaauucaagcuagauuaaacaauguugguggguacagagggauucugacugauucaaucuccugauucacagcaaauuaauccaaaauauccuuuccuuaauacaauacuuuuguuguuguuguucacuacucuaccuucagcaccuaaaacacagcuuggcacaugcaaggcacccaaugaguauugcugaguuaccuuuguuaaaaaccuaucuaggagccgggcgcgguggcucacgccuguaaucccagcacuuugggaggccgaggcgggcggaucacuugaggucaggaguuugaaaccagccuggccaauauggcgaaaccccucucuacuaaaacuacaaaaauuagccgagcguaguggugcacgccuguaaucccagcuacucaggaggcuuagguaggagaaucucuugaagccaggaggcagagguugcagugacccaagaucacaucagugcacuccagcuugggugacagagcaagauucugucucaaaaaaaaaaaaaaaaaaaaaaaaaccuaccuaggaaauggcuguaaggggccuccagugaggauuccgugucacccugaacugccccgcaggagagaagugguugugugaacugagagcgcaggaaagacuucccuuuacccaugcucucagcuccaguccacuuccagcaccaccuucucagcucaaucgagcucagggcaguccucagaugggcuugcagacuugcaaacuacuaccucaaccgugggggcccuuguugaagaagaugagguaauuagccaauucagacuguuugagcacguauuguuuggaaacuuuucuaauuacagucacuauaacagaucugcuaaagguaguuucaugauuaauggcugcccgaaguuaccauccucaaacuauuaagccauuggaaaaugcuagaggcuuaauacucguguauagacagacccucauuccccugaauauuugcuauuugggguucuggguuuuuagcugcucccaggcuguguuuauuuccccaauaacuggggaaacuggggaggggcacgaccccacgggagccugcgcccaccugcccaaguacuggaccuggggcuagcuugccgcuugcuccuugccacccgccaggccccccgcccaucgcuucgcccaaauccuuucaaacaagguucccuccugccaccugccggcccacuagggucugcgccacaggcucggcgccaccacgcagcucgcggggagguggcccccaccuccuuacugcacaugcccggcagaaguccgggcgcgcaacuucgcagaaccucacugcccgucccuccucgccucagucuccucuguccucucccaggcaagaggaccggcggaggcaccucucucgagucuuaggcugcggaaucuaagacucagcgagaggagcccgggaggagacagaacuuuccccuuuuuucccaucccuucuucuugcucagagaggcaagcaaggcgcggagcuuuagaaaguucuuaaguggucaggaagguaggugcuucccuuuuucuccucacaaggaggugaggcugggaccuccgggccagcuucucaccucauaggguguaccuuucccggcuccagcagccaaugugcuucggagccacucucugcagagccagagggcaggccggcuucucggugugugccuaagaggauggaucggaggucccgggcucagcaguggcgccgagcucgccauaauuacaacgaccugugcccgcccauaggccgccgggcagccaccgcgcuccucuggcucuccugcuccaucgcgcuccuccgcgcccuugccaccuccaacgcccgugcccagcagcgcgcggcugcccaacagcgccggagcuuccuuaacgcccaccaccgcuccggcgcccagguauucccugagucccccgaaucggaaucugaccacgagcacgaggaggcagaccuugagcugucccuccccgagugccuagaguacgaggaagaguucgacuacgagaccgagagcgagaccgaguccgaaaucgaguccgagaccgacuucgagaccgagccugagaccgcccccaccacugagcccgagaccgagccugaagacgaucgcggcccgguggugcccaagcacuccaccuucggccagucccucacccagcgucugcacgcucucaaguugcgaagccccgacgccuccccaagucgcgcgccgcccagcacucaggagccccagagccccagggaaggggaggagcucaagcccgaggacaaagauccaagggaccccgaagagucgaaggagcccaaggaggagaagcagcggcgucgcugcaagccaaagaagcccacccgccgugacgcguccccggaguccccuuccaaaaagggacccauccccauccggcgucacuaauggaggacgccguccagauucuccuuguuuucauggauucagguuaguugcccaccgcuaaacuggggagccugagggcggugugggagcagcgcagguggaaaggaggugagaaggaaaggcaggucaggggcgagugggaagagaggaggcucagcuggucagccugggaucgggggucagggugaggcggcgagggcucccccaaacuucccaggaugccaggggcgcccugguggccaaaggcuuguuggacggcggggcgcacgccgugcgucccgcuggagacaaccugaggucuccgagcuggugccccggcuacgcgacugaaucccgaacgcaccccagauuuggagcugcacacccaaacggcauugguaagucacuuguuuugcgcgcuuuucuuccuccuagaaagacuagucucaaauaaguuggccuucucagguguccaaaaugugguucggaggugcgcgcgccaacuuucacgaugugagagcagccgcgcuguagagacaccguugaaaugugcggaaaguaaucugaaugggaaugggcgagaacucuagagacugaccacccgggagggaagucacgcgcgcgcggcgccuaagcagcucagagccggagcccaggucccagagcugacaauuaagccgcgggaccuccgcgccagugccuccagcugccgugcgccagccuuggccgccacagcccgccucccgucgcucgcgggacagagaccgccucaaagagcgugcgcaccugcccgcgcgcgccggagcugaccucucccggcggcgggcgguuaggggaaaguaccugggggaaagguagaggagguaaggggacccuuggggaugccccuacgggcuaccaggguugaacgcacaggcauggucacgucgggguauugccaagcuuuuggcgcagcuggucggguggccaggcugcaugcggcuuagcaggagacguccugggcuguuugcgcaggaccucuggaggcccucgagaucgucgcaaguggaaagguaaagcggaacaagggacaggcuggagacgggggucgcgucuaacaucaggauaacuuacaauucguuuccaaagagcgcgguacgcgcagagcuggggaaagguguuggauccggcgccaguccuuggacgaucagucgucgaaaaggaggcaggggccggcggcuccggcagccuuggggaggggaggcgaggcggcgugcuccggccauuuucagcacggguagaguuaaguuuaaucuguaaccuggaggggaaucugcucugaugacccagcacaaaaacggcagcaaucugguaacgcaccuucggaagggaaggcgugcucuccucgccaguccuggggggaaagacugauaagugaaaugucuuuaaaaaaucucauccgacuuggaaauugauuuuuuuuuuccuggugugcgugucucauuuugcgccggcuuaauuauacggaugacaacgauuuggaggaauaguaaagcguuuugagggcuugagaugaaugacggucagguucuuaacuccuaagaaaaggaugaugauagaaggaaaauaccuuaaauggucuuccuuccaggaccuauuccguaggaaaggcgucgcggcgcccaagacuuaguucugccgggcugcagcgcagacugugguuggaugcuuuuguggucuucccuaguaaauacggagaaacuaguuuauuugcaagugguuuucugcgacagcaauguuagucucagaaguuuggaggcugcggaagggcuaggcgugccccgcuuuuggcuugccccuaagucgaaauuccugcuuaauguaaacaaugaugguguguuggcuuucugugacauuaaguguucaguuuuuccucugguaaugucucagccugaguucaccaagcaaaaugucucuagggacaagcaagaaaaacuagggauuguguugaauuucuuuggugugccuuucaagugugggagcuaucuucagacuggguauuccgggagacccguuuucccacagagaauuauucauuagagaaaugagcauguugccuuguugcaggaugaauaaacaaguuuuuuaaaagcccuccgugucgagcccacaccucacacccaucuugcuguuuuuuaaacagaagcccaacauagggauguuuccugaacuguaagcaauguaccauguucacauguagcgaggaggggcaaucuaggaacacacacugucuuucagacagucuuccacaaacugccucgccaucugcauuacagcccaauuguaaaaaccuguuaccuaccggcacacacucucccccgcucaauuccccucccccgcucaauucuccucccccgcucaauuccccucccccagcuucccucuuuacacccugauucaaggguggaaaagccagugcagaccauaugaagcaacugagagcuauaccaacccccgaggaaagcaccuauggcccucccugagaagacaggauuuugcuauauagacuucgcaaaccuucucucugccugagagacugguacucagcuccuuccuuuuccagagccauuuuuagcaacuuccccaagcauucccaacucacuagucucccagcuggcccuuugccccacccugcucaacugggguuagcaucugaauaggcccacuugccccuuuuacauaggugaggucugcggggugaggauaggcucccaagaaaaagcagaucuuauggugaaccacauaggugaauuaccagccacuuuuaauauuucaaauggagggugagggaggaggaggagcaggagaauaaagcuagcuaaacaugaugauaugcccccaauauugaaguuguuuccuuuaguacauuaaucauuugcuuaauggaaauuugcuuuugugggggaggggagggcgacccaaaggugcucuuguaacugaacuuaucugagcugggaauuuauguugcaauguuccaauauuguguggggucaaccugauguagguuuaaaguuuugcaaacaaaacucuuuuauguucaucagaauucaagaauuagaaauguuacaguuugggauuguuuugagauguuucuuuaaugcacugcaagccuuucucacccuggaguugcuuacagccuuuaacucuucagccuucauuuucugcagcuguguggaagguuaaggaggaagaaagcugaaacuucaguguugguaagaaugagguuuuuugguuuuuuaauaaucuacauggauuuaccucaauuaucaguuauuauuauacugcucuucaagaagagggaagcuuuugagaggaaacugagcagaaaccauggugugaguaaagcaugucuccuaacugcuuaccuggaaggugaccuaucacaaaaaccaaaucacuaaaauaaaauuaagcuuccaggccagugaugucaugugcuggcucaacugcugcucuucucuaaaaaaucacccagcagagggaugagaugcucaaaugacaucuuuaauccccauguucaagaaugagagauggaauuucuuguucuguugugggguuuugacacuaaugacucuauuuccuauaacuugaugucccaaacuggagcagugggaucuaagacgaaaggcccagggcuagcagcccagguugcuucuagccauggucaaguggccuuaggucagacccaacaccccucugccucaguuucuucuaaaaugagaucgcugaaugagaugauccuauuuaucccuuucagcuccaaaugucuagauugauuagcuuaagaagccugggguuguccaauuugacucuacacuagugauuuaacccuaauggaacucccaaaaaacaucgaaaguugcucaaauaaaaagcaccagcuagguaucgcgccauugcacuccagcccggccuacagugugagacuccaucucaaaaaaaaaacaaaacaaaacaacaacaacaacaaaaaaccccgaaaaacaaaaaaagcaccagcuaggaagaaaucuguuuuguguuggcuucauguaaauuuugucaaaucugcuuuacaguugguugcaaaauggucucaaaaggcaguuuagagaaugcagaauuccacuguguccuuucccuaaacuggaaacacuuagccauccugagagucguauuuaguguguguuuuacguguguguguguguuccccaccuucugucccugaccuuggugucuaagaacaagcuuuucagagcaggagcaggcagcaagguugcaaguacugaccuaguacugcagcuuggagaggcuaaccacugugggggacggcagacugaugggaacauugguugagugaccacaagugcuguugaaaguuuuuugguaacaguuuuaaguguuuugguuaagcuagaccugaaaaaaaugguauagaagcuacagcuauuugagauaaaccaguuuucucaaccuuuguuuuuuucaugaucacuccccucuucgcuucuucagacauaugcuucuuacuugccccuccccaugacauuuuaauaccauggacauacagcuagaccccacugucuguuuaugcacugcaggaccuugucacagcuaagacuuguuugcgcaccgcaucccccaaaaccaguuuugccuccaucauacaugcaugggauaaacaaagcaagcauuucaaaaacaaaaaaaucugguucugucaaauuaagugauguagcacccauuuuuguuuuauaauuucuuucuuacauaucaaaaggccauaugugggggguggggggcauaaauuuuuuacugguauuuguuuucuuucccuuguuuaaaaaucucaugaguuuuuucaaacgccuccaauagcuaugcugguccaagcacuaguggccauuaauucacagggcagagaagccagaauaaacagccuagugacuuaguucucccaaggccaagagccugcaaugcggggccaccauuaccuguugacagugcucagccagcagaggcaggacucugccugcaacuauucccggguagaaauggggaggcugccuucccagcucccacugggcauagccuguguguuuauuuuuuguguuuauuuuaggguaaguauguuacaaauuagcagggcacauggcuaugagaaaggccaacauaaacccaggcagcagggacagaggguaaguggugacaguaaaguggggagagauuuaaggaagacaaaaggaaaagaagaauuugagggaucacagaaaaaaaggaagauguggguagauaagagaaccccugggaaggagcagaaaagaagauuuagaaauggggaagggggucacaaagccaggaaauuuggcgguuauaaagaaagucguuugaaggaauaaagagagucuugaagagagaaagguugagggcagcuucaaguaucugguggcuaaggggguuagaaccaggugcaucaagggacagacuucagcucaacauuaggaagggcauuuuuaaaagccaaauauggcauuggagggcuaccaaugaggcucacagauucgacaccauuaacaucacugucccccugagaguuucguacagaccugguccaaaaauuccaauuucauagguguggaguuuucauacaaguacuucaauugcuacacucaaagagaaagauuuaacaccuagaaaucuagcugucuagcuccaaggcuaaagcuuuggguuuugguucacagcaagguuggucuucaagguccccacucucaaacuugagggguccaaggggcacaggccaaagaccggcagccagcagaagaccacguuucuucuccccucaaccccaugugagagcugguuucugaguguccuggcuuaugucgcugucuuaauuagauuucauuaggaaaauuugcccuggguaauugagguuguucuagaaggugaaauauaccauuccccuuaaacaaugaugcccagaagcccccaggguggcuggaauucccacuaugaauugcagaaauuuuaagcagagcuuccacuaaagccaaauuuaccuuccgagauucccucuuuccccuccaacccccacuuuugccucucucuuaguugcuuucccauggugcuguucaucuuuucuggaauggccucuccuccccugaaauucuuugcugcaucaucagcuagucuggagaaggaauccacaaaugucuggacccacuguucaagcacagguggucagaggacaguggcaugccuuggcugaaacagaauuuggggcaccuuuugagaagguugcugagcuacagcuaauuagcugagugaaggggucugaacucacgaugggggcuuuuuaaucugagcauaucaaguauuuucauaaagacuuuuuccacuaccucuaauaucagccuugcaucugccucuaaccugguaucuugccucauccauuugaggcuuuuuuccuuuagcuggcauuugcuucaaacagccuggccacgcagaccccucugcagauagcaguaugcugcugccuccaccggccaaggcgggcagaggagagucugaagggaaaaggauggcagcagcaagucuugauugaaaaguaauuaauuguacagcuucaaagucuauuacuacucacucagcacucagaaaacauuugucacugggaggcugagaagcuucauaguugccuaaauucuuuucuaccuucucuuucugcuuuuacuuuuuccucaauugaaagaaacccacugacaaccaaugacaugaaugggcugcagagaaggcacuucugcaaacuucaccacccaccuccucccugcaaagccgcagaccaaaaggaaaaugacuaccaaaaaaauacuguuuuucgugguuucuguucccuucccuuucacccaccucccuucccucucucuacuuugccuucucuuuguuggcuacagggauaaacccagaaagcugacagguagcuaccuaaacuugagauaugccuuaugcuuuugguaaugaguaagaaucccagaauguaaguagaaacacaauuacucguugaauacauaugccaugaaagcaucaauagagaggugagacuguuugggaggcccagggcaucacgugcggcuuccaaggaacggggcuguaauggugcuguucagagagucaaugguaaagaaauacacacauucuuucuauuggggguuccauauuuucaaaacgccacuguuugccaccuguggcaccugggccauuuggcuuuccucagacaugcagaguuuaauggaagcaugagaaauucuucccaugccuuucuuaguacaucaagugcagacgcuauuauuuuuaaguagccaaguauacacaauuuucaaguaaaccaucccuggguuucgacagccaauccuguccuccccuacuugacacaucaucucacugcagcccuacacuccagcacacagccccucaugacaggggucaagacccuggcacacagcgucuauccaucccaacucggccuuuuuuuucaggcaccagccucuccugacuuccucuuccuuagcugcauaaacacauuaauagacuuuccuuccucaguccuaucacauauuuaucuuuucccaugauggcaauccauccagcacuggaaagcuauguuuaagguacuuugcuauuauacaauuauaauggcagauccuaaaaaagccccggcaagguuaggccccagacgaugcugcccacuaacauccagcacuggccaucucccuccagaucaaggccauguuucugucuugagcuagcaaaauuaucagccuucaggaggaucaccagacaagccaaccaaucaggccaaucaagguggaccccaguaaacccacuagccgaucacccccagcucuuacuauaccggauuccucaggucccuguggccuugcaggugccacaggugggucaacuccucgaacauuuggccacacuucuggggucccugaccccauuacugauguuucagcucuuagcuccacucaccuaaaggacuuagguuuuucagagucugguagccagucacuacagagaaauaacaggaguggaaaaaagggggaauaucaggguuaaauacugggauuuauucuuccuagucuuaauuuaucuuuaaauuaaggcaauuccuauuuaaaucuaaggguccuuucucagcuuauaguggugauuuucaacugggggagauuuugccccccagaggacauuuagcaaagucuggagacauuuuugguuguuaaaacuaaggggaugcuacuggcaucuaguggguagaggcuagggaugcugcucaacauccuacaaugcacagggcagucaccacaacaaagaauugccuggccccaaauaccaccagugcagaggcuaaaacaccaagucuagaugagaugugcugagugguucugaaaccccuuccucuggugugcucccaucucucccuucugaguccucccuacucacuccuggacugucucccuuuuuccuguccagugcgccaauuguucaagauucuauuaccaaauguauuucuccccuaaagaguuuucucugacuccauaaauucaucuuuguaaguacgauugccaauuugaaugugugaucuuuaucuuuuucugaacuucagaccuuuccucccagaaaaugggcugcaaaaaucuccaucccaacugcccaaaguuccuuaaucugccaugucuaaaaccaaaucagcacugccaccuugccagccccucccacugacuucccugucccacucccaguguuccauccaucugggugccacacuuuggcuccuccaucuuuugugucuuucuagcauaagagcugcuccaggaggauccuuugggaccccucuugagugccguccuucagccuuccugcuuccuucaccgugcuaggucucuccuuuaaacaucuccuuugugcauaaccccuuuccuuuguucucgaucaggaucauccuccaugcugcuucugcuuuuccuaaaaguaggcucaaauccucacuugcagaacaaaaaacuuucaacauccuuuccguuuccugccaaaauagccucaaaagugcuugcccucauacuccauggcauccucagagagauucuaucuaauuucuccuaacuuuucucccccugcuccccaagagccagccaagguggccaguuguguuuacccagccacgccccauguuuccuaccauuaaauccuuuguucguggugggcaaaccgucucccaucccccacuaccaccuucuauucauagccaaggcgucuauccuuccuuggaggcccauauaaaaagucauuuucuccagcaagacuuucaagguccccccagguggaguucuuuucuuccauuuguaugcugcucuacucuccaggaugaggaacugguauuugucuaacuuguuaaauuuguuuuagucaccuccaugcaugugcuccccuggcaaagcucaugauaucagaaagaaugaacaaaggggucccacagacccaugagggugucgaacagagacccugaacccguuccucgacaaaugguacuuugggggugagcgcgaggccugacgaaagcaaacaaccccuuuggagcacccauggcagccucccuggggcuccaaccccaaugucuacugaccuuccacuugugcaggcucagcaucccuggggccucaacuccuuauccauccugggcugcuccucgcaguaagcccucuccuugggguccuggcccucuaccucccagcccuggaaaucuucuugcuccucaccuugcccggcaguggcaccccguuggcuggguuagccugccgccaucaacacacccaaggguuggccccugggaccccaccucucccccgaggcucggcaaccuguggcaugaggaagagugaccccacggcgcuagcgguccucguggucuuccaggccuagccgccauacacccgccccccaccggcuuccaaccaccccagcagcaccucuucgggcguuccaacgcggcgcccccuauuggaccucccacccauauccgguuuccggucugacgcccccugcucauucgccaggcagccuugauuggcaugaccccugcccaauggcugacccggcgcuggggucggaggggagugaguugguguugggacccaguugggccauucaguggaugcucaagugguuaagccgucuugcguggguguaguuggccaaaguuugaaucaaaguucaguguugacaucuggaaguguguagacccauagagcuaaagcgauauaucuuugggggaucccaaacguuucccaggguccaacuguguucgccuccuuccgugcugcguggccacauggaugguggaugcaggggugcaaggaugcacggugccugugguacccuggcucuaagagggaugcauuagacuaaacgggaucgcaacuugcggugguucgcccgccugcagcucuuauacagcagcccgugccgugcgcccugcuugcugcagcccgcccuguguaacucauccagccuccccucccccaggguucugcaggucagaugacccccugccuccugcccaguugcucugugccuagacguggcucgccaaucugucucacuggugagaccgaccugaugcgcaccugccgaguuuuaugugacccccuuacagcagcuuuucucccggguuccaaucccucugcagaccccagaccagagcauagcaugugcacacaucaaggccaccagguggugugggcauuuaccuuuggcuagcucugagcucaccgcagcaugguagcgggagcgcagcugcgcgggcaaccgccggguuuguggccgguuggcgggcucagugccgccucagugggcucuagcaguagaaaaguaaagcgacuacccuaagauacccagagcgagaggagaggggcuagaagggugcuggaggcaggcuguaguggggcuaaaggagcugacugaccagcgcugcggccggugcccgaagcagcgagcagcgcaccucagcuccgguugccgcgcggcaugguauuuaucuguggguucagugcgcacagcguuguccagucucgaaaccacccuaaaccggcauuaaaccccaaccaaaauccccuuuaacccuucccuagaacagcaggaccugcgaaacucugaggccgcuuugugagguccuccucugcgcagcacgccccccaccccucucuuggugccgccgcagcuacucccuagggggcuuugcucuuggugguacgcacccgagaccuucuuauuccccugcgucaccauccacauaaacaagagagcacccugcuugcgccgcugugggccacugcggagaccccuagagugugaugggggugggggcuguuaaagugcuuuaccggagccaaccucagcaagugacaaacaaaagcagcaaaaaguacacccaaggcauuuaaaaaacaaauugcgugcuugcauacucggcauccccucucccucgccucucucugcuucuuuggugggcucacgaccaccugucgcaucccuacgcgugccugcgccccuucccaggcaccaaaagccuugcgcuccggacuaggggcuugagauccggggcugccuggaggcugggggcuaugacucagaguuucagggguauccuggggugaugaaauccuucuucaguccccccucccccgaggagucgguuggguuggggagggaggguuucagcuccuguacuccagcguuccgaggcccacgucuugcgucacgugucccgcaacgcaggagcgcuuucucuggccagcggagaagcgaggagaaagacuccaaaucagucagggagaggaguggaaggagccaaaacgucccugcgaggccugcgcucaccagcccccuuacccaaagucccgggccccuggcgccaggagcaggcuccuggagccggagccagcucggcacuggaaccggcguccucugguggcagagagagagcgcuacuggcgauuuucggaccgaaucggcacgcucgucagauccaagcaggcgggacuggccuggagcaaaaagaaagagagaggagggcguaaggauagaccaaggaagaggggcuggggggcagccugggggcaugaaaaguggccaggaaggagccaagacuccaccagcaacaauugaguugcuucagccucagucuaggguuccuuccaggccuugaaccccccaaccucacaaggguuggaaagugaggccggugaacuuuccagcugguacuuugauuuuaaaauaauaauaauaauuuuuucacccuaguucgguugggugcuccaucuuacggagccccaaacuuauuuugagaggccgccaccguguuaugggcgugcgcaacugccucuacggcaauaauaugucaggacaacgcgauauccccccugaaaucggggaacagcccgagcaaccaccuuuggaggccccaggggcagcugcccccggugcugggccuagcccagccgaagagauggagaccgaaccgccucacaacgagcccauccccgucgagaaugauggcgaggccuguggacccccagaggucuccagacccaacuuucagguccucaacccggcauucagggaagcuggagcccauggaagcuacagcccaccuccugaggaagcaaugcccuucgaggcugaacagcccagcuugggaggcuucuggccuacacuggagcagccuggauuccccagugggguccaugcaggccuugaggccuucggcccagcacucauggagcccggagccuucaguggugccagaccaggccugggaggauacagcccuccaccagaagaagcuaugcccuuugaguuugaccagccugcccagagaggcugcagucaacuucucuuacaggucccagaccuugcuccaggaggcccaggugcugcagggguccccggagcuccucccgaggagccccaagcccucaggccugcaaaggcuggcuccagaggaggcuacagcccucccccugaggagacuaugccauuugagcuugauggagaaggauuuggggacgacagcccacccccggggcuuucccgaguuaucgcacaagucgacggcagcagccaguucgcggcagucgcggccucgagugcgguccgccucacucccgccgcgaacgcgccuccccucugggucccaggcgccaucggcagcccaucccaagaggcugucagaccuccuucuaacuucacgggcagcagccccuggauggagaucuccggacccccguucgagauuggcagcgcccccgcuggggucgacgacacucccgucaacauggacagccccccaaucgcgcuugacggcccgcccaucaaggucuccggagccccagauaagagagagcgagcagagagacccccaguugaggaggaagcagcagagauggaaggagccgcugaugccgcggagggaggaaaaguacccucuccgggguacggauccccugccgccggggcagccucagcggauaccgcugccagggcagccccugcagccccagccgauccugacuccggggcaaccccagaagaucccgacuccgggacagcaccagccgauccugacuccggggcauucgcagccgaucccgacuccggggcagccccugccgccccagccgaucccgacuccggggcggccccugacgccccagccgaucccgacuccggggcggccccugacgccccagccgauccagaugccggggcggccccugaggcucccgccgccccugcggcugcugagacccgggcagcccaugucgccccagcugcgccagacgcaggggcucccacugccccagccgcuucugccacccgggcagcccaaguccgccgggcggccucugcagccccugccuccggggccagacgcaagauccaucucagaccccccagccccgagauccaggcugccgauccgccuacuccgcggccuacucgcgcgucugccuggcggggcaaguccgagagcagccgcggccgccgcguguacuacgaugaagggguggccagcagcgacgaugacuccagcggagacgaguccgacgaugggaccuccggaugccuccgcugguuucagcaucggcgaaaucgccgccgccgaaagccccagcgcaacuuacuccgcaacuuucucgugcaagccuucgggggcugcuucggucgaucugagaguccccagcccaaagccucgcgcucucucaaggucaagaagguaccccuggcggagaagcgcagacagaugcgcaaagaagcccuggagaagcgggcccagaagcgcgcagagaagaaacgcaguaagcucaucgacaaacaacuccaggacgaaaagaugggcuacauguguacgcaccgccugcugcuucuagguaaugcggcggacucugccugcgggcagcagggccgccggggaaccggggaggggguggcagggcugccugguggggcuaggggcuccgcagugggaggaggggguccagccaaaggcgggaagaacuugcuagaaaguuccagggagggacccuaacugcccugggagcgggaggggaucuuugguggauucggguggccgaaguauaugcccuccagggagaaaaguggugccgagcgacacugagggucguuuccggcuggacaggccagcgccagcaaccguaagcuggacaggcaggggcuucaggugagccaggaacugccggggaggggccccggggccccgggacuccccuggcuaggcuggugggguccacggugggcuggggucauuggggaaggcgcgccccgccucgccuggcacggcugcuuggacucagacagcuugucguugguguguguugguguccauauucuguguucgccugugcaugauacgcugaaguguccccuguuccuaucccggcacccccaaauuacccgccgacuguguacuuguacuugggaacgggcuguguugugguuugcgccauggcccgggcaaaaaacuuucgcuguucgcacacucuggugguaccugcgcccgggcgcucugcggcaagcggugcggaggacacgcggggaagguggcggggccucccgggaaauaagcggggcccuuggccugggggagcggggaaucgcuuuucgccggccuccgcguaaccuuguuucuguaugucuuucucucuuuuuccuuuugcgcuaagcguuuccucacuucucauucguucgccaaacccucccgccuuuacaguugaaaaaccagacacacagguaucuggggcgcccggggcugcacaccucaguucgguauucugcacacacacagcucgccuggucgggggaugggggaaaggggaaacacaaccugcuguaggcaaguccggaucccaaaccacuugggggcugguuccaagggggugggcguggcuguguuuaaaaaauaugaaauaauuuuucuuccuagcgaagagcccgagguaagccaaucauuuuuacaaagaguacaguaggaggggcuugguuuaaaaagauggggguuauguguugugaguggaaugucaccuuuguguuugaaaugcaacuaaaauaaaaguuuucaaaaaaugcucugaguguauuugaaguguguggacaaaguauggcaaaaccgugaauaugacuugugaaaacaaguaaauguuugcaugugaauuuuuucaggcagcuuuagcugggggcaaagaggcuugucaaagguaaggucuucugcaaauuggcucuggauacaaaaaauauauaaagguauuuugauuacagaaguuaaaaaucaugauauucuugucaggaggguauuuugguggccuucuaccuucccccuccuccucugcucacauuuccccaccucucggugcccuccccucuccaggaucccccuccucaccccacagcaagacccucuccuguaucucccagucuuucccuggccauucccaguuccccacccuccccccagccccccaagacuucuuaacuucaaaucuggggcauuaaauauuuuugccacauuuaaacaaagcaucaauuagcaauggucugaauaugugguuuaaaugaaaacuuccaaacaaacuucacaagcuuaauuuuuacauuuuauucucuaagacuuucucuaagaccuuccaagggauuucaagaucacaguuuuuaaggcugcgcuacauuuguuaaauauguuagaaugugugaugguuuuuuauuaauggcauuauuggcauauaacugugcuauugugauguggcucucacaaaucacaauuuuaaaugugaggaucauuuuguguaugcccauccagguagaucaugacauugucauuuaccuaaagacauauaauauggucguuguuuuaaauuucaaaugucucaacuacacuaaagcuaccaaacauuaaaugacaaugcacugguuucccugcagacaacugauuuugccauaacagacccauuucaauauuccaagcacagcucugggaagcaaaccuguagauugggggugggaggacauaaaugcauacagacaggagacccaagugacagugugcaccugaccccuaauugucaaauuggugaugugccuuacaugcggggccucaguugccuccuuugugaaaugaagcuuuccuagcagaucuccacuaaggaaugcuuuugcaccaugauuugagucuucuauucuuccuggaggugggggguggaggagacacagucuacuuacaucaggacuggagacuuauaccauagauugugcagccaucaauccugcagcaaacuguccauguuugggaccagucuuaagaauauuagaaguuuccuuugucuccccuuauuuugucaccaggaguaaaaauuaacuuuaagaaaaggaaauuugcuggggucaccuuguaccuuguccuggcuuuguucucgggugcugguagccaaacaccuuuggaugcagcauaguccagaaggugggcuggcaaaccaugggccaugucuaacauaagccugaaauaugauagccaguguuagcugcuagcugaaacuguaccacugcaguuugucaaagcaggcuacaguuuuugaccaggcuuccuuuugcagaggugacguaccucuucuggaccugaauuauugaugggggacagggagaggaggaaggaugaggacuuacucacauguaggacaagacuuuuuacuaacuuuuuagucccaacauauaaaacaagacauccauacaucccuaccacugaaaaugcagaucaaauggcuguccuuugauaugguugcuaauuugugacaugcagauucaucuguugcuugaaaaaauguauguucaugugcuuauccuuucuguuuuuauugccgggacaauuuaaucucauuacagggaauccuaagaaaucaaagagagagagagagagagaaagauagauagaaaucaguaauaugauuaaaauucuaaaauaucuaaagaguucuuuuuaaagaagccuuuuucuuacucaacacuauccaccaauagacuguuuccauguuucuguuacguuuuuaaauaauuuugguggcuuaaacauuuuuuaaaacuucauuuaggugugauuuccuccuuaagaacugaauggggcuaauagaucagaguuucuuaguaucugccacauuuauuaaaauuguguaggcaaaugcuauauauaauaauggcuauucugcuaugaugcuuuauuuauacagugaaucacaauuaauuguaugauuauuuaugccaccaagugcaacaguaugcauuguauuccaucuugcagaagcaccuuuuuauuuuucuuuucucucucucucucucucuuuuuuaacauacagccauuuuuuuauauucuaaaugccuccacugagcuuuuggugugguaggaaggacauggcuuaucaggccacaaaauuuuggaguccagauagauuuauuauuuucucuuuucagucuccuaguaagauucaugcuucucaaagucugaaauucuaccuugguuuuaauucuuacagauuucucucaaaaaaaauuuucccauauagguagauuaauguuuaaaauuuacccccauuauuuacaauggaaaacugguuuuaagcaaaaagaauugggggucauccccuuacuguauguauccuccuaacuugaaaaggaaaaucucacugcucucaguaugauuaguaaccaguaauaauaauaacacauucugauuacauuuuuuguuuguuugauuugaaacaaagucucccucugucacccaggcuggagugcaauggcaggauuucugcucacugcaaccucugccucccagauucaagcaauucaccugccucagucuccagaguagcugggauuacaagcgugugccaccaugccuggcuaauuguuuguauuuuuaguagagaugggguuucaccauguuguucaagcuggucucgaacuccugaccucaagugaucuacccagccucccaaaguacugggauuacaggcaugagccacugugccuggccacauuuuacauuuuuuaaagccuuucaucuagucauauuugucucuugaaacaguccugggcaauaaaaacgugauagggccccauuucauaggcaaauaaaccaaaagcucagagauuaaauaucagacacuuuuuuuuuuuuuuuugagaaggagucucgcucuaucgcccaggcuggagugcgauggugugauuuuggcucacuacaaccucugccuccuggguucaagcgauucuccugccucagccuccugaguagcuaggauuacaggugcaugcaccaugcccggcuaauuuuuguauuguuaguagagaugggguuucaccauguuggucaggcuggucucaaacuccugaccucgugauccgcccgccucagccucccaaaguucugggauuacaggcaugagccaucgcgcccggccauaaggcacuuuuacucaaagacugcaagguagguaaaggaucacaaauuucaaauucagauaaugcuuaccagaaaugugaugauaagcuauaaagcauuauuuaaauguaaagcaugauuauucuaaguauacuaugugcucuuaaaaucccuugccaaaugacacgugucgaguagucugcuacuuucugaauuauagcaaaacgcacagaucccugguuauaaauguccauugaguauacaugaaacaugagcucccccauuucugagauggcugucauugcuuugguaauauuucauuuacacauuugcuuuaacucaucugccagcacugcaacguugcagucuuaguuuguugggcuacuguuuuccuuuuuuuuuuuuuaaaugcagguuuuuuuaaaaguuuuuugguuuuuuuguuuuguuuuguuuuguuuuuuugcagggucuaaagcuuuucuucuuguuuagguuuccacuaaauaauaauuaaucauuauaauaauaaaaugcaguuacuuuucugcauagcucuauuauaaguauagcguuagaauguuuagaauccuggucuggaucucaugaucuuaucaaaauaacucugcuccauagucuuuguagugauuuuuuuuuaaaaguaugccuuacuucuaguccaggcuaauuuccauuuagcaagagucagugcguggucuuagaaaucaccuuugacuuuuaugcaggaagguuaguuguuguuguuguuguuuuuaagauggagucucgcucugucaccuaggcuggagugcagugguacuaucucggcucacugcaacuucugccucccaguucaagggauucuccugccucagccucucgaauagcugggauuacagacaugcaccaccacaccuggauaauuuuuuguauuuuuaguagagaugggguuucaccauguuggccaggauggucuggaaauccugaccucaggugaucugcccaccuuggccucccaaagugcugggauuacaggcaugagccaccgugcccagccaggaagguuaguauuaagcaaaacauaaauuuauuuuuagagaagguaaccuagauuugaaauucccaaaggcagccaugcuccuucuucuuuuuagaguuaguuu

SEQ ID NO: 12605 - RNA, 38110 nt, Homo sapiens
aaacuaacucuaaaaagaagaaggagcauggcugccuuugggaauuucaaaucuagguuaccuucucuaaaaauaaauuuauguuuugcuuaauacuaaccuuccuggcugggcacgguggcucaugccuguaaucccagcacuuugggaggccaaggugggcagaucaccugaggucaggauuuccagaccauccuggccaacauggugaaaccccaucucuacuaaaaauacaaaaaauuauccaggugugguggugcaugucuguaaucccagcuauucgagaggcugaggcaggagaaucccuugaacugggaggcagaaguugcagugagccgagauaguaccacugcacuccagccuaggugacagagcgagacuccaucuuaaaaacaacaacaacaacaacuaaccuuccugcauaaaagucaaaggugauuucuaagaccacgcacugacucuugcuaaauggaaauuagccuggacuagaaguaaggcauacuuuuaaaaaaaaaucacuacaaagacuauggagcagaguuauuuugauaagaucaugagauccagaccaggauucuaaacauucuaacgcuauacuuauaauagagcuaugcagaaaaguaacugcauuuuauuauuauaaugauuaauuauuauuuaguggaaaccuaaacaagaagaaaagcuuuagacccugcaaaaaaacaaaacaaaacaaaacaaaaaaaccaaaaaacuuuuaaaaaaaccugcauuuaaaaaaaaaaaaaggaaaacaguagcccaacaaacuaagacugcaacguugcagugcuggcagaugaguuaaagcaaauguguaaaugaaauauuaccaaagcaaugacagccaucucagaaaugggggagcucauguuucauguauacucaauggacauuuauaaccagggaucugugcguuuugcuauaauucagaaaguagcagacuacucgacacgugucauuuggcaagggauuuuaagagcacauaguauacuuagaauaaucaugcuuuacauuuaaauaaugcuuuauagcuuaucaucacauuucugguaagcauuaucugaauuugaaauuugugauccuuuaccuaccuugcagucuuugaguaaaagugccuuauggccgggcgcgauggcucaugccuguaaucccagaacuuugggaggcugaggcgggcggaucacgaggucaggaguuugagaccagccugaccaacauggugaaaccccaucucuacuaacaauacaaaaauuagccgggcauggugcaugcaccuguaauccuagcuacucaggaggcugaggcaggagaaucgcuugaacccaggaggcagagguuguagugagccaaaaucacaccaucgcacuccagccugggcgauagagcgagacuccuucucaaaaaaaaaaaaaaaagugucugauauuuaaucucugagcuuuugguuuauuugccuaugaaauggggcccuaucacguuuuuauugcccaggacuguuucaagagacaaauaugacuagaugaaaggcuuuaaaaaauguaaaauguggccaggcacaguggcucaugccuguaaucccaguacuuugggaggcuggguagaucacuugaggucaggaguucgagaccagcuugaacaacauggugaaaccccaucucuacuaaaaauacaaacaauuagccaggcaugguggcacacgcuuguaaucccagcuacucuggagacugaggcaggugaauugcuugaaucugggaggcagagguugcagugagcagaaauccugccauugcacuccagccugggugacagagggagacuuuguuucaaaucaaacaaacaaaaaauguaaucagaauguguuauuauuauuacugguuacuaaucauacugagagcagugagauuuuccuuuucaaguuaggaggauacauacaguaaggggaugacccccaauucuuuuugcuuaaaaccaguuuuccauuguaaauaauggggguaaauuuuaaacauuaaucuaccuauaugggaaaauuuuuuuugagagaaaucuguaagaauuaaaaccaagguagaauuucagacuuugagaagcaugaaucuuacuaggagacugaaaagagaaaauaauaaaucuaucuggacuccaaaauuuuguggccugauaagccauguccuuccuaccacaccaaaagcucaguggaggcauuuagaauauaaaaaaauggcuguauguuaaaaaagagagagagagagagagaaaagaaaaauaaaaaggugcuucugcaagauggaauacaaugcauacuguugcacuugguggcauaaauaaucauacaauuaauugugauucacuguauaaauaaagcaucauagcagaauagccauuauuauauauagcauuugccuacacaauuuuaauaaauguggcagauacuaagaaacucugaucuauuagccccauucaguucuuaaggaggaaaucacaccuaaaugaaguuuuaaaaaauguuuaagccaccaaaauuauuuaaaaacguaacagaaacauggaaacagucuauugguggauaguguugaguaagaaaaaggcuucuuuaaaaagaacucuuuagauauuuuagaauuuuaaucauauuacugauuucuaucuaucuuucucucucucucucucucuuugauuucuuaggauucccuguaaugagauuaaauugucccggcaauaaaaacagaaaggauaagcacaugaacauacauuuuuucaagcaacagaugaaucugcaugucacaaauuagcaaccauaucaaaggacagccauuugaucugcauuuucagugguagggauguauggaugucuuguuuuauauguugggacuaaaaaguuaguaaaaagucuuguccuacaugugaguaaguccucauccuuccuccucucccugucccccaucaauaauucagguccagaagagguacgucaccucugcaaaaggaagccuggucaaaaacuguagccugcuuugacaaacugcagugguacaguuucagcuagcagcuaacacuggcuaucauauuucaggcuuauguuagacauggcccaugguuugccagcccaccuucuggacuaugcugcauccaaagguguuuggcuaccagcacccgagaacaaagccaggacaagguacaaggugaccccagcaaauuuccuuuucuuaaaguuaauuuuuacuccuggugacaaaauaaggggagacaaaggaaacuucuaauauucuuaagacuggucccaaacauggacaguuugcugcaggauugauggcugcacaaucuaugguauaagucuccaguccugauguaaguagacugugucuccuccaccccccaccuccaggaagaauagaagacucaaaucauggugcaaaagcauuccuuaguggagaucugcuaggaaagcuucauuucacaaaggaggcaacugaggccccgcauguaaggcacaucaccaauuugacaauuaggggucaggugcacacugucacuugggucuccugucuguaugcauuuauguccucccacccccaaucuacagguuugcuucccagagcugugcuuggaauauugaaaugggucuguuauggcaaaaucaguugucugcagggaaaccagugcauugucauuuaauguuugguagcuuuaguguaguugagacauuugaaauuuaaaacaacgaccauauuauaugucuuuagguaaaugacaaugucaugaucuaccuggaugggcauacacaaaaugauccucacauuuaaaauugugauuugugagagccacaucacaauagcacaguuauaugccaauaaugccauuaauaaaaaaccaucacacauucuaacauauuuaacaaauguagcgcagccuuaaaaacugugaucuugaaaucccuuggaaggucuuagagaaagucuuagagaauaaaauguaaaaauuaagcuugugaaguuuguuuggaaguuuucauuuaaaccacauauucagaccauugcuaauugaugcuuuguuuaaauguggcaaaaauauuuaaugccccagauuugaaguuaagaagucuuggggggcuggggggaggguggggaacugggaauggccagggaaagacugggagauacaggagagggucuugcuguggggugaggagggggauccuggagaggggagggcaccgagagguggggaaaugugagcagaggaggagggggaagguagaaggccaccaaaauacccuccugacaagaauaucaugauuuuuaacuucuguaaucaaaauaccuuuauauauuuuuuguauccagagccaauuugcagaagaccuuaccuuugacaagccucuuugcccccagcuaaagcugccugaaaaaauucacaugcaaacauuuacuuguuuucacaagucauauucacgguuuugccauacuuuguccacacacuucaaauacacucagagcauuuuuugaaaacuuuuauuuuaguugcauuucaaacacaaaggugacauuccacucacaacacauaacccccaucuuuuuaaaccaagccccuccuacuguacucuuuguaaaaaugauuggcuuaccucgggcucuucgcuaggaagaaaaauuauuucauauuuuuuaaacacagccacgcccacccccuuggaaccagcccccaagugguuugggauccggacuugccuacagcagguuguguuuccccuuucccccaucccccgaccaggcgagcugugugugugcagaauaccgaacugaggugugcagccccgggcgccccagauaccugugugucugguuuuucaacuguaaaggcgggaggguuuggcgaacgaaugagaagugaggaaacgcuuagcgcaaaaggaaaaagagagaaagacauacagaaacaagguuacgcggaggccggcgaaaagcgauuccccgcucccccaggccaagggccccgcuuauuucccgggaggccccgccaccuuccccgcguguccuccgcaccgcuugccgcagagcgcccgggcgcagguaccaccagagugugcgaacagcgaaaguuuuuugcccgggccauggcgcaaaccacaacacagcccguucccaaguacaaguacacagucggcggguaauuugggggugccgggauaggaacaggggacacuucagcguaucaugcacaggcgaacacagaauauggacaccaacacacaccaacgacaagcugucugaguccaagcagccgugccaggcgaggcggggcgcgccuuccccaaugaccccagcccaccguggaccccaccagccuagccaggggagucccggggccccggggccccuccccggcaguuccuggcucaccugaagccccugccuguccagcuuacgguugcuggcgcuggccuguccagccggaaacgacccucagugucgcucggcaccacuuuucucccuggagggcauauacuucggccacccgaauccaccaaagauccccucccgcucccagggcaguuagggucccucccuggaacuuucuagcaaguucuucccgccuuuggcuggacccccuccucccacugcggagccccuagccccaccaggcagcccugccacccccuccccgguuccccggcggcccugcugcccgcaggcagaguccgccgcauuaccuagaagcagcaggcggugcguacacauguagcccaucuuuucguccuggaguuguuugucgaugagcuuacugcguuucuucucugcgcgcuucugggcccgcuucuccagggcuucuuugcgcaucugucugcgcuucuccgccagggguaccuucuugaccuugagagagcgcgaggcuuugggcuggggacucucagaucgaccgaagcagcccccgaaggcuugcacgagaaaguugcggaguaaguugcgcuggggcuuucggcggcggcgauuucgccgaugcugaaaccagcggaggcauccggaggucccaucgucggacucgucuccgcuggagucaucgucgcugcuggccaccccuucaucguaguacacgcggcggccgcggcugcucucggacuugccccgccaggcagacgcgcgaguaggccgcggaguaggcggaucggcagccuggaucucggggcuggggggucugagauggaucuugcgucuggccccggaggcaggggcugcagaggccgcccggcggacuugggcugcccggguggcagaagcggcuggggcagugggagccccugcgucuggcgcagcuggggcgacaugggcugcccgggucucagcagccgcaggggcggcgggagccucaggggccgccccggcaucuggaucggcuggggcgucaggggccgccccggagucgggaucggcuggggcgucaggggccgccccggagucgggaucggcuggggcggcaggggcugccccggagucgggaucggcugcgaaugccccggagucaggaucggcuggugcugucccggagucgggaucuucugggguugccccggagucaggaucggcuggggcugcaggggcugcccuggcagcgguauccgcugaggcugccccggcggcaggggauccguaccccggagaggguacuuuuccucccuccgcggcaucagcggcuccuuccaucucugcugcuuccuccucaacugggggucucucugcucgcucucucuuaucuggggcuccggagaccuugaugggcgggccgucaagcgcgauuggggggcuguccauguugacgggagugucgucgaccccagcgggggcgcugccaaucucgaacggggguccggagaucuccauccaggggcugcugcccgugaaguuagaaggaggucugacagccucuugggaugggcugccgauggcgccugggacccagaggggaggcgcguucgcggcgggagugaggcggaccgcacucgaggccgcgacugccgcgaacuggcugcugccgucgacuugugcgauaacucgggaaagccccgggggugggcugucguccccaaauccuucuccaucaagcucaaauggcauagucuccucagggggagggcuguagccuccucuggagccagccuuugcaggccugagggcuuggggcuccucgggaggagcuccggggaccccugcagcaccugggccuccuggagcaaggucugggaccuguaagagaaguugacugcagccucucugggcaggcuggucaaacucaaagggcauagcuucuucugguggagggcuguauccucccaggccuggucuggcaccacugaaggcuccgggcuccaugagugcugggccgaaggccucaaggccugcauggaccccacuggggaauccaggcugcuccaguguaggccagaagccucccaagcugggcuguucagccucgaagggcauugcuuccucaggaggugggcuguagcuuccaugggcuccagcuucccugaaugccggguugaggaccugaaaguugggucuggagaccucuggggguccacaggccucgccaucauucucgacggggaugggcucguugugaggcgguucggucuccaucucuucggcugggcuaggcccagcaccgggggcagcugccccuggggccuccaaaggugguugcucgggcuguuccccgauuucaggggggauaucgcguuguccugacauauuauugccguagaggcaguugcgcacgcccauaacacgguggcggccucucaaaauaaguuuggggcuccguaagauggagcacccaaccgaacuagggugaaaaaauuauuauuauuauuuuaaaaucaaaguaccagcuggaaaguucaccggccucacuuuccaacccuugugagguugggggguucaaggccuggaaggaacccuagacugaggcugaagcaacucaauuguugcugguggagucuuggcuccuuccuggccacuuuucaugcccccaggcugccccccagccccucuuccuuggucuauccuuacgcccuccucucucuuucuuuuugcuccaggccagucccgccugcuuggaucugacgagcgugccgauucgguccgaaaaucgccaguagcgcucucucucugccaccagaggacgccgguuccagugccgagcuggcuccggcuccaggagccugcuccuggcgccaggggcccgggacuuuggguaagggggcuggugagcgcaggccucgcagggacguuuuggcuccuuccacuccucucccugacugauuuggagucuuucuccucgcuucuccgcuggccagagaaagcgcuccugcguugcgggacacgugacgcaagacgugggccucggaacgcuggaguacaggagcugaaacccucccuccccaacccaaccgacuccucgggggaggggggacugaagaaggauuucaucaccccaggauaccccugaaacucugagucauagcccccagccuccaggcagccccggaucucaagccccuaguccggagcgcaaggcuuuuggugccugggaaggggcgcaggcacgcguagggaugcgacagguggucgugagcccaccaaagaagcagagagaggcgagggagaggggaugccgaguaugcaagcacgcaauuuguuuuuuaaaugccuuggguguacuuuuugcugcuuuuguuugucacuugcugagguuggcuccgguaaagcacuuuaacagcccccacccccaucacacucuaggggucuccgcaguggcccacagcggcgcaagcagggugcucucuuguuuauguggauggugacgcaggggaauaagaaggucucgggugcguaccaccaagagcaaagcccccuagggaguagcugcggcggcaccaagagagggguggggggcgugcugcgcagaggaggaccucacaaagcggccucagaguuucgcagguccugcuguucuagggaaggguuaaaggggauuuugguugggguuuaaugccgguuuagggugguuucgagacuggacaacgcugugcgcacugaacccacagauaaauaccaugccgcgcggcaaccggagcugaggugcgcugcucgcugcuucgggcaccggccgcagcgcuggucagucagcuccuuuagccccacuacagccugccuccagcacccuucuagccccucuccucucgcucuggguaucuuaggguagucgcuuuacuuuucuacugcuagagcccacugaggcggcacugagcccgccaaccggccacaaacccggcgguugcccgcgcagcugcgcucccgcuaccaugcugcggugagcucagagcuagccaaagguaaaugcccacaccaccugguggccuugaugugugcacaugcuaugcucuggucuggggucugcagagggauuggaacccgggagaaaagcugcuguaagggggucacauaaaacucggcaggugcgcaucaggucggucucaccagugagacagauuggcgagccacgucuaggcacagagcaacugggcaggaggcagggggucaucugaccugcagaacccugggggaggggaggcuggaugaguuacacagggcgggcugcagcaagcagggcgcacggcacgggcugcuguauaagagcugcaggcgggcgaaccaccgcaaguugcgaucccguuuagucuaaugcaucccucuuagagccaggguaccacaggcaccgugcauccuugcaccccugcauccaccauccauguggccacgcagcacggaaggaggcgaacacaguuggacccugggaaacguuugggaucccccaaagauauaucgcuuuagcucuaugggucuacacacuuccagaugucaacacugaacuuugauucaaacuuuggccaacuacacccacgcaagacggcuuaaccacuugagcauccacugaauggcccaacugggucccaacaccaacucacuccccuccgaccccagcgccgggucagccauugggcaggggucaugccaaucaaggcugccuggcgaaugagcagggggcgucagaccggaaaccggauaugggugggagguccaauagggggcgccgcguuggaacgcccgaagaggugcugcuggggugguuggaagccgguggggggcggguguauggcggcuaggccuggaagaccacgaggaccgcuagcgccguggggucacucuuccucaugccacagguugccgagccucgggggagagguggggucccaggggccaacccuuggguguguugauggcggcaggcuaacccagccaacggggugccacugccgggcaaggugaggagcaagaagauuuccagggcugggagguagagggccaggaccccaaggagagggcuuacugcgaggagcagcccaggauggauaaggaguugaggccccagggaugcugagccugcacaaguggaaggucaguagacauugggguuggagccccagggaggcugccaugggugcuccaaagggguuguuugcuuucgucaggccucgcgcucacccccaaaguaccauuugucgaggaacggguucagggucucuguucgacacccucaugggucugugggaccccuuuguucauucuuucugauaucaugagcuuugccaggggagcacaugcauggaggugacuaaaacaaauuuaacaaguuagacaaauaccaguuccucauccuggagaguagagcagcauacaaauggaagaaaagaacuccaccuggggggaccuugaaagucuugcuggagaaaaugacuuuuuauaugggccuccaaggaaggauagacgccuuggcuaugaauagaaggugguagugggggaugggagacgguuugcccaccacgaacaaaggauuuaaugguaggaaacauggggcguggcuggguaaacacaacuggccaccuuggcuggcucuuggggagcagggggagaaaaguuaggagaaauuagauagaaucucucugaggaugccauggaguaugagggcaagcacuuuugaggcuauuuuggcaggaaacggaaaggauguugaaaguuuuuuguucugcaagugaggauuugagccuacuuuuaggaaaagcagaagcagcauggaggaugauccugaucgagaacaaaggaaagggguuaugcacaaaggagauguuuaaaggagagaccuagcacggugaaggaagcaggaaggcugaaggacggcacucaagaggggucccaaaggauccuccuggagcagcucuuaugcuagaaagacacaaaagauggaggagccaaaguguggcacccagauggauggaacacugggagugggacagggaagucagugggaggggcuggcaagguggcagugcugauuugguuuuagacauggcagauuaaggaacuuugggcaguugggauggagauuuuugcagcccauuuucugggaggaaaggucugaaguucagaaaaagauaaagaucacacauucaaauuggcaaucguacuuacaaagaugaauuuauggagucagagaaaacucuuuaggggagaaauacauuugguaauagaaucuugaacaauuggcgcacuggacaggaaaaagggagacaguccaggagugaguagggaggacucagaagggagagaugggagcacaccagaggaagggguuucagaaccacucagcacaucucaucuagacuugguguuuuagccucugcacuggugguauuuggggccaggcaauucuuuguuguggugacugcccugugcauuguaggauguugagcagcaucccuagccucuacccacuagaugccaguagcauccccuuaguuuuaacaaccaaaaaugucuccagacuuugcuaaauguccucuggggggcaaaaucucccccaguugaaaaucaccacuauaagcugagaaaggacccuuagauuuaaauaggaauugccuuaauuuaaagauaaauuaagacuaggaagaauaaaucccaguauuuaacccugauauucccccuuuuuuccacuccuguuauuucucuguagugacuggcuaccagacucugaaaaaccuaaguccuuuaggugaguggagcuaagagcugaaacaucaguaauggggucagggaccccagaaguguggccaaauguucgaggaguugacccaccuguggcaccugcaaggccacagggaccugaggaauccgguauaguaagagcugggggugaucggcuaguggguuuacugggguccaccuugauuggccugauugguuggcuugucuggugauccuccugaaggcugauaauuuugcuagcucaagacagaaacauggccuugaucuggagggagauggccagugcuggauguuagugggcagcaucgucuggggccuaaccuugccggggcuuuuuuaggaucugccauuauaauuguauaauagcaaaguaccuuaaacauagcuuuccagugcuggauggauugccaucaugggaaaagauaaauaugugauaggacugaggaaggaaagucuauuaauguguuuaugcagcuaaggaagaggaagucaggagaggcuggugccugaaaaaaaaggccgaguugggauggauagacgcugugugccagggucuugaccccugucaugaggggcugugugcuggaguguagggcugcagugagaugaugugucaaguaggggaggacaggauuggcugucgaaacccagggaugguuuacuugaaaauuguguauacuuggcuacuuaaaaauaauagcgucugcacuugauguacuaagaaaggcaugggaagaauuucucaugcuuccauuaaacucugcaugucugaggaaagccaaauggcccaggugccacagguggcaaacaguggcguuuugaaaauauggaacccccaauagaaagaauguguguauuucuuuaccauugacucucugaacagcaccauuacagccccguuccuuggaagccgcacgugaugcccugggccucccaaacagucucaccucucuauugaugcuuucauggcauauguauucaacgaguaauuguguuucuacuuacauucugggauucuuacucauuaccaaaagcauaaggcauaucucaaguuuagguagcuaccugucagcuuucuggguuuaucccuguagccaacaaagagaaggcaaaguagagagagggaagggaggugggugaaagggaagggaacagaaaccacgaaaaacaguauuuuuuugguagucauuuuccuuuuggucugcggcuuugcagggaggagguggguggugaaguuugcagaagugccuucucugcagcccauucaugucauugguugucaguggguuucuuucaauugaggaaaaaguaaaagcagaaagagaagguagaaaagaauuuaggcaacuaugaagcuucucagccucccagugacaaauguuuucugagugcugagugaguaguaauagacuuugaagcuguacaauuaauuacuuuucaaucaagacuugcugcugccauccuuuucccuucagacucuccucugcccgccuuggccgguggaggcagcagcauacugcuaucugcagaggggucugcguggccaggcuguuugaagcaaaugccagcuaaaggaaaaaagccucaaauggaugaggcaagauaccagguuagaggcagaugcaaggcugauauuagagguaguggaaaaagucuuuaugaaaauacuugauaugcucagauuaaaaagcccccaucgugaguucagaccccuucacucagcuaauuagcuguagcucagcaaccuucucaaaaggugccccaaauucuguuucagccaaggcaugccacuguccucugaccaccugugcuugaacaguggguccagacauuuguggauuccuucuccagacuagcugaugaugcagcaaagaauuucaggggaggagaggccauuccagaaaagaugaacagcaccaugggaaagcaacuaagagagaggcaaaaguggggguuggaggggaaagagggaaucucggaagguaaauuuggcuuuaguggaagcucugcuuaaaauuucugcaauucauagugggaauuccagccacccugggggcuucugggcaucauuguuuaaggggaaugguauauuucaccuucuagaacaaccucaauuacccagggcaaauuuuccuaaugaaaucuaauuaagacagcgacauaagccaggacacucagaaaccagcucucacaugggguugaggggagaagaaacguggucuucugcuggcugccggucuuuggccugugccccuuggaccccucaaguuugagaguggggaccuugaagaccaaccuugcugugaaccaaaacccaaagcuuuagccuuggagcuagacagcuagauuucuagguguuaaaucuuucucuuugaguguagcaauugaaguacuuguaugaaaacuccacaccuaugaaauuggaauuuuuggaccaggucuguacgaaacucucagggggacagugauguuaauggugucgaaucugugagccucauugguagcccuccaaugccauauuuggcuuuuaaaaaugcccuuccuaauguugagcugaagucugucccuugaugcaccugguucuaacccccuuagccaccagauacuugaagcugcccucaaccuuucucucuucaagacucucuuuauuccuucaaacgacuuucuuuauaaccgccaaauuuccuggcuuugugacccccuuccccauuucuaaaucuucuuuucugcuccuucccagggguucucuuaucuacccacaucuuccuuuuuuucugugaucccucaaauucuucuuuuccuuuugucuuccuuaaaucucuccccacuuuacugucaccacuuacccucugucccugcugccuggguuuauguuggccuuucucauagccaugugcccugcuaauuuguaacauacuuacccuaaaauaaacacaaaaaauaaacacacaggcuaugcccagugggagcugggaaggcagccuccccauuucuacccgggaauaguugcaggcagaguccugccucugcuggcugagcacugucaacagguaaugguggccccgcauugcaggcucuuggccuugggagaacuaagucacuaggcuguuuauucuggcuucucugcccugugaauuaauggccacuagugcuuggaccagcauagcuauuggaggcguuugaaaaaacucaugagauuuuuaaacaagggaaagaaaacaaauaccaguaaaaaauuuaugccccccaccccccacauauggccuuuugauauguaagaaagaaauuauaaaacaaaaaugggugcuacaucacuuaauuugacagaaccagauuuuuuuguuuuugaaaugcuugcuuuguuuaucccaugcauguaugauggaggcaaaacugguuuugggggaugcggugcgcaaacaagucuuagcugugacaagguccugcagugcauaaacagacaguggggucuagcuguauguccaugguauuaaaaugucauggggaggggcaaguaagaagcauaugucugaagaagcgaagaggggagugaucaugaaaaaaacaaagguugagaaaacugguuuaucucaaauagcuguagcuucuauaccauuuuuuucaggucuagcuuaaccaaaacacuuaaaacuguuaccaaaaaacuuucaacagcacuuguggucacucaaccaauguucccaucagucugccgucccccacagugguuagccucuccaagcugcaguacuaggucaguacuugcaaccuugcugccugcuccugcucugaaaagcuuguucuuagacaccaaggucagggacagaagguggggaacacacacacacacguaaaacacacacuaaauacgacucucaggauggcuaaguguuuccaguuuagggaaaggacacaguggaauucugcauucucuaaacugccuuuugagaccauuuugcaaccaacuguaaagcagauuugacaaaauuuacaugaagccaacacaaaacagauuucuuccuagcuggugcuuuuuuuguuuuucgggguuuuuuguuguuguuguuguuuuguuuuguuuuuuuuuugagauggagucucacacuguaggccgggcuggagugcaauggcgcgauaccuagcuggugcuuuuuauuugagcaacuuucgauguuuuuugggaguuccauuaggguuaaaucacuaguguagagucaaauuggacaaccccaggcuucuuaagcuaaucaaucuagacauuuggagcugaaagggauaaauaggaucaucucauucagcgaucucauuuuagaagaaacugaggcagagggguguugggucugaccuaaggccacuugaccauggcuagaagcaaccugggcugcuagcccugggccuuucgucuuagaucccacugcuccaguuugggacaucaaguuauaggaaauagagucauuagugucaaaaccccacaacagaacaagaaauuccaucucucauucuugaacauggggauuaaagaugucauuugagcaucucaucccucugcugggugauuuuuuagagaagagcagcaguugagccagcacaugacaucacuggccuggaagcuuaauuuuauuuuagugauuugguuuuugugauaggucaccuuccagguaagcaguuaggagacaugcuuuacucacaccaugguuucugcucaguuuccucucaaaagcuucccucuucuugaagagcaguauaauaauaacugauaauugagguaaauccauguagauuauuaaaaaaccaaaaaaccucauucuuaccaacacugaaguuucagcuuucuuccuccuuaaccuuccacacagcugcagaaaaugaaggcugaagaguuaaaggcuguaagcaacuccagggugagaaaggcuugcagugcauuaaagaaacaucucaaaacaaucccaaacuguaacauuucuaauucuugaauucugaugaacauaaaagaguuuuguuugcaaaacuuuaaaccuacaucagguugaccccacacaauauuggaacauugcaacauaaauucccagcucagauaaguucaguuacaagagcaccuuugggucgcccuccccucccccacaaaagcaaauuuccauuaagcaaaugauuaauguacuaaaggaaacaacuucaauauugggggcauaucaucauguuuagcuagcuuuauucuccugcuccuccuccucccucacccuccauuugaaauauuaaaaguggcugguaauucaccuaugugguucaccauaagaucugcuuuuucuugggagccuauccucaccccgcagaccucaccuauguaaaaggggcaagugggccuauucagaugcuaaccccaguugagcaggguggggcaaagggccagcugggagacuagugaguugggaaugcuuggggaaguugcuaaaaauggcucuggaaaaggaaggagcugaguaccagucucucaggcagagagaagguuugcgaagucuauauagcaaaauccugucuucucagggagggccauaggugcuuuccucggggguugguauagcucucaguugcuucauauggucugcacuggcuuuuccacccuugaaucaggguguaaagagggaagcugggggaggggaauugagcgggggaggagaauugagcgggggaggggaauugagcgggggagagugugugccgguagguaacagguuuuuacaauugggcuguaaugcagauggcgaggcaguuuguggaagacugucugaaagacaguguguguuccuagauugccccuccucgcuacaugugaacaugguacauugcuuacaguucaggaaacaucccuauguugggcuucuguuuaaaaaacagcaagaugggugugaggugugggcucgacacggagggcuuuuaaaaaacuuguuuauucauccugcaacaaggcaacaugcucauuucucuaaugaauaauucucugugggaaaacgggucucccggaauacccagucugaagauagcucccacacuugaaaggcacaccaaagaaauucaacacaaucccuaguuuuucuugcuugucccuagagacauuuugcuuggugaacucaggcugagacauuaccagaggaaaaacugaacacuuaaugucacagaaagccaacacaccaucauuguuuacauuaagcaggaauuucgacuuaggggcaagccaaaagcggggcacgccuagcccuuccgcagccuccaaacuucugagacuaacauugcugucgcagaaaaccacuugcaaauaaacuaguuucuccguauuuacuagggaagaccacaaaagcauccaaccacagucugcgcugcagcccggcagaacuaagucuugggcgccgcgacgccuuuccuacggaauagguccuggaaggaagaccauuuaagguauuuuccuucuaucaucauccuuuucuuaggaguuaagaaccugaccgucauucaucucaagcccucaaaacgcuuuacuauuccuccaaaucguugucauccguauaauuaagccggcgcaaaaugagacacgcacaccaggaaaaaaaaaaucaauuuccaagucggaugagauuuuuuaaagacauuucacuuaucagucuuuccccccaggacuggcgaggagagcacgccuucccuuccgaaggugcguuaccagauugcugccguuuuugugcugggucaucagagcagauuccccuccagguuacagauuaaacuuaacucuacccgugcugaaaauggccggagcacgccgccucgccuccccuccccaaggcugccggagccgccggccccugccuccuuuucgacgacugaucguccaaggacuggcgccggauccaacaccuuuccccagcucugcgcguaccgcgcucuuuggaaacgaauuguaaguuauccugauguuagacgcgacccccgucuccagccugucccuuguuccgcuuuaccuuuccacuugcgacgaucucgagggccuccagagguccugcgcaaacagcccaggacgucuccugcuaagccgcaugcagccuggccacccgaccagcugcgccaaaagcuuggcaauaccccgacgugaccaugccugugcguucaacccugguagcccguaggggcauccccaaggguccccuuaccuccucuaccuuucccccagguacuuuccccuaaccgcccgccgccgggagaggucagcuccggcgcgcgcgggcaggugcgcacgcucuuugaggcggucucugucccgcgagcgacgggaggcgggcuguggcggccaaggcuggcgcacggcagcuggaggcacuggcgcggaggucccgcggcuuaauugucagcucugggaccugggcuccggcucugagcugcuuaggcgccgcgcgcgcgugacuucccucccggguggucagucucuagaguucucgcccauucccauucagauuacuuuccgcacauuucaacggugucucuacagcgcggcugcucucacaucgugaaaguuggcgcgcgcaccuccgaaccacauuuuggacaccugagaaggccaacuuauuugagacuagucuuucuaggaggaagaaaagcgcgcaaaacaagugacuuaccaaugccguuugggugugcagcuccaaaucuggggugcguucgggauucagucgcguagccggggcaccagcucggagaccucagguugucuccagcgggacgcacggcgugcgccccgccguccaacaagccuuuggccaccagggcgccccuggcauccugggaaguuugggggagcccucgccgccucacccugacccccgaucccaggcugaccagcugagccuccucucuucccacucgccccugaccugccuuuccuucucaccuccuuuccaccugcgcugcucccacaccgcccucaggcuccccaguuuagcggugggcaacuaaccugaauccaugaaaacaaggagaaucuggacggcguccuccauuagugacgccggauggggaugggucccuuuuuggaaggggacuccggggacgcgucacggcgggugggcuucuuuggcuugcagcgacgccgcugcuucuccuccuugggcuccuucgacucuucggggucccuuggaucuuuguccucgggcuugagcuccuccccuucccuggggcucuggggcuccugagugcugggcggcgcgcgacuuggggaggcgucggggcuucgcaacuugagagcgugcagacgcugggugagggacuggccgaagguggagugcuugggcaccaccgggccgcgaucgucuucaggcucggucucgggcucaguggugggggcggucucaggcucggucucgaagucggucucggacucgauuucggacucggucucgcucucggucucguagucgaacucuuccucguacucuaggcacucggggagggacagcucaaggucugccuccucgugcucguggucagauuccgauucgggggacucagggaauaccugggcgccggagcgguggugggcguuaaggaagcuccggcgcuguugggcagccgcgcgcugcugggcacgggcguuggagguggcaagggcgcggaggagcgcgauggagcaggagagccagaggagcgcgguggcugcccggcggccuaugggcgggcacaggucguuguaauuauggcgagcucggcgccacugcugagcccgggaccuccgauccauccucuuaggcacacaccgagaagccggccugcccucuggcucugcagagaguggcuccgaagcacauuggcugcuggagccgggaaagguacacccuaugaggugagaagcuggcccggaggucccagccucaccuccuugugaggagaaaaagggaagcaccuaccuuccugaccacuuaagaacuuucuaaagcuccgcgccuugcuugccucucugagcaagaagaagggaugggaaaaaaggggaaaguucugucuccucccgggcuccucucgcugagucuuagauuccgcagccuaagacucgagagaggugccuccgccgguccucuugccugggagaggacagaggagacugaggcgaggagggacgggcagugagguucugcgaaguugcgcgcccggacuucugccgggcaugugcaguaaggaggugggggccaccuccccgcgagcugcgugguggcgccgagccuguggcgcagacccuagugggccggcagguggcaggagggaaccuuguuugaaaggauuugggcgaagcgaugggcggggggccuggcggguggcaaggagcaagcggcaagcuagccccagguccaguacuugggcaggugggcgcaggcucccguggggucgugccccuccccaguuuccccaguuauuggggaaauaaacacagccugggagcagcuaaaaacccagaaccccaaauagcaaauauucaggggaaugagggucugucuauacacgaguauuaagccucuagcauuuuccaauggcuuaauaguuugaggaugguaacuucgggcagccauuaaucaugaaacuaccuuuagcagaucuguuauagugacuguaauuagaaaaguuuccaaacaauacgugcucaaacagucugaauuggcuaauuaccucaucuucuucaacaagggcccccacgguugagguaguaguuugcaagucugcaagcccaucugaggacugcccugagcucgauugagcugagaagguggugcuggaaguggacuggagcugagagcauggguaaagggaagucuuuccugcgcucucaguucacacaaccacuucucuccugcggggcaguucagggugacacggaauccucacuggaggccccuuacagccauuuccuagguagguuuuuuuuuuuuuuuuuuuuuuuuugagacagaaucuugcucugucacccaagcuggagugcacugaugugaucuugggucacugcaaccucugccuccuggcuucaagagauucuccuaccuaagccuccugaguagcugggauuacaggcgugcaccacuacgcucggcuaauuuuuguaguuuuaguagagagggguuucgccauauuggccaggcugguuucaaacuccugaccucaagugauccgcccgccucggccucccaaagugcugggauuacaggcgugagccaccgcgcccggcuccuagauagguuuuuaacaaagguaacucagcaauacucauugggugccuugcaugugccaagcuguguuuuaggugcugaagguagaguagugaacaacaacaacaaaaguauuguauuaaggaaaggauauuuuggauuaauuugcugugaaucaggagauugaaucagucagaaucccucuguacccaccaacauuguuuaaucuagcuugaauuccacaugagaaaaugauuggaucagggcuagggggcggucagacaccacuagaucguguuguuguacucugcaaggcugaagauuuggaguaaauagugccgcucuuucuuggcccuagaaaaucaaaugauggccuacaggaggagaucccuacagugggagcuaaccuggcugcugcuuuugaggugugcgugucuucagucuggcccuccaugaugauuauggggugccuuuuuggccauagugacaaguccaaaggcgaaacaacucagagcaaagccaucauccuaaaaucccugggaguaucaagaagguuguuucacuuaggacacaugucauggguugugguccuuuucuccuucuugagucaguauggggaaucuuaaaaaaagaggcucuaccacuggguggcccaccaggcccuccugguacugguacuucugccuggugucugaagagucagucagguacccacagccauucucaccaugauggaacuuaaccucacaccuucaacaccacacccguauuaaaaccacuaagugcagaguucauaccccagugagagaccagcaacugcuuuggauguguugagguuuuccuuucugcaucuuggcugugucuagcuuguaucuugcacucuguguuaguuuguagcauuaaaauagugauugggcugggcaugguggcucucaccuaugaucccagcacuuugggaggccgaggcgggugggucacuugaggccaggaguucaagaccagccugaccaacauggugaaauccugucucuacuaaaaauacaaaaauuagccaggcguguugacgcacgcuuguaguuccagcuacucggguggcugagccacaagaauugcuugaaccugggagguuagucugauaaaguaggauugacuugucaaaccccacaaaaggacaaaugucuauguuccaguugugcccugcucuaccacuuuuccuguggaacagcaaggguuuuauuaucacaggugccugcguggcuguagucacuguguggauauuaucaugggacacugggcaggggcauuuagagcuguauauuucaaauccucaucuccgcuucugagucccaacuaauggggcacguuuccagagagucugccuacacugacccacccacuuuauuucuucuaauuagcacagcuccaucgacagcauauggaacagaaauauauuauucaagcugauuucagggcacguugggggaaaaaucaggaauauaugggugcuaguaaaugcccuuugaauggaaacuaaugucagcugucagcaacgagguagauuaugauucuuuaguguacauaagaaaguacuucauucuucagauggagugcuuuuaugccuauaaaggagauggcagcccagagcugauucacuaauauagauacaccgagauugccugcauuauuaaaaaaugugcauuacauaauacauauauuuggacuagauucugcauuagcaaugcgcuuucuuugcaagaugcauuuuaaucagcaaacacacauuuaacaaaagacugcauuuuugagccccaguccuguguaguuauaaauacaucucaguguacauucaccacaggcucugggaggaaggagugggggacugcacugagaugccauuccaucucacacuuagugccgaggucgagcaaauggagccguacagcagaugcucuuuaaaaugcauuacgugcgugacuuuaaaaagugcucgcugcagagugaauuucaaaaaggagcaagugggugaugaaccaccucuguuguuaccgggcugaggaacaaggggcucucucugucugcugguaaauaaaguaugggcauauaucacuugcgggucucugcuggagggaggcuccuaaaccaguuggacaggaaagcgcaguucccagcucacuacaguaucauacaguaagcuucugauucggauaaauugugaagaauauugucucuagcuccuuaaaggauuuucauguggaagaggccuuaagauuuauuauauauggcucuagagggcaaaauuagaaccuaucggugguaguuguagcagaaagccuucagcgcaacccaaagaagaaucugacauggagugggcugucagaaaguuggcgcuuugucagaagcaaugugaagucaaaggacagguaaccacacacuggagauguuuuucguggugugcgugagcaagugggguuggaacucggugcccaccgcagucuuaucagguuagccucugauuccauugaaggccucuguaggcugugggagaaggguuugggggcucuacugauggacacgauccucccccccgcccccacuuuuuacuauuuuggaagcauugaaagugcaaguggcucagugacaggaaggaguguugggguggcaguuuuaagacagggcaaacagaugugugcaauggacccagcggccuguggagcuuuccucaccaaggcagggcguggaggcucuuugcuccacaacucaucacuuguugaagcaaagaaaugagucaaguccaucuguuaauuacauugguucucuuugccuccucuccuggagcugucucggaaauuacaaaugaaauuggcuauuuagcaaucauaaauugagccacuucuaugaucaagacacuauuccgggcacuguggggagaucgaaguaauugaggaugagcaauuccugccauccaacaucacacacauugaugugaagugcccccaaauauuaaaaccagauugcugacagguguagaguaauacauuccagcccagauagacagggagggaaguugaguaacugguuagaaucagagguacaguucaucuugugauuuucagaaagagaugagucuuuaccuagucugacucugagauuuucuuuugauuuuuaaaagcccaugagaauugcuuucaauccacuuguuucuaaccaugugucuaccgugugcaaagccaugugccaguggcccugggggagacagaugaaucauggguucucagaaggcuugcaggcuauugucagaggucccacagaccucaaugcauuuucuaagaugaaacucaagauaauggauugguucugcccugccuggugagcggguauaaucacucuugaagauauuuuuuggauaaucauuggaaaggacuauuuuuggagaugaagagcuuuuccaacuuuccuuuggacagaaaugaauucagggaguuugcagcacucgcuaccccucacuguggcaaucagccaguaaggcucaaccccaccgagaauuugguauuggccccucccgccuguuccccagagaggaccagguacaaugcagaagcauuuggcucagcucucuagggugcuauuuugcugcuauucagacugcgcugauaucaauuggcucucaccaguagaaauggugaaaaccucgagcuccugauuuugagauuugggggaaugccaucuagagcuaaaagcaaacaauagagggaaauaaucaccuuuuugacauggcugguuucuguccaggccauuuuugggauuacaauacuguauuugugccauucguuuuuaaagggcguaggaucagaaaggagccuucguucugugcguagagauugcucggagcugucuucccaggagcucccuuacuuucucuucacuucgugcucuguugagcuucuccuacugauaagugccuaucucccucucucucccucugccacaggaggagcaauuucuagacucuggauccaacgggaagcaucuagaagcccccuugcucaggcaaagcaucaguacccaagagggguacaggcccucuuggacguggugucucauuucucucccguggcccuggagcuuggcauucuguauucuccgguucagacccuggacucugacacccugccuugcuucaucuugaguuccggcugucugcccagccggaccuacacugagcuugucugguucuuuccugcagccaguugagacaucauugucccaggacacccccagucuacgggguucuggccccagauguccaccucugcccugcccaccagcagccaugccagccagugagcugugggugaaaacacugcugauugcaaaggaccacucaaccgucaggaaagcucucggcucauagcuuugucuuuuguccagcuguccuggacauccuaucuuuccucuagccccuagcccugacagagagccucaaaguuguuuucaucuuaucugcugaggaucugacucaccccaucagacuucugggagggagagagcgagcgcgccucgagcccggaggggagaaacccuuaguguugucacgguuuaggcacacgcucauagaaauccuugcagcucgagcucuucaaaauaugauuagaccaauuuuacaugucuagucacugaggcuccaguagauugggacuauuucuauaugugcaaagugaaguggauaauugaggcaauuaucuucaggcaaaugaaucugggcacuguaaucaguccauccugauaacuggggagaaaucggcgucauucacuguagcauugcuuugcguuaaagagaauucuaagguauuuguuuguuauuuucgcuuggcuucauuuuucuaaaagacaguccagugaagaugagguccugccucgugcugguguuaggauguguggaccccuuaggucucagucaggugugugugggguugaucuggacgaguugauaaucagaucagugcccuagccgggugcauccuuggcuuccuugugguggauacuugguuuccacaucaggguuuucuuuccacuucuucuuuccuuguguaugagaacccugagguguuggauggguuggucuacaaggucaccuccacugcuaggaugauaggauuccuaauagggcccaugagugacauacauugugcaugauaaaauaucauggagccaggagaaugaaagaagggccucucaacgucagaaaugagaaugcacuggaggcuggugauuacuucuggacccccgcuuccccauccauuguuucggcuaaaagucaucauaaauugggaguccuucccuuuacuggucuagaaguucccucaggaagcagccgucacuucucucccugcucuucacugaggagggagggaagaggagcaagagaagacuuuccgguuuuccaaauggcagauuugguuucaggcaugugaggagccacauauaaaaagaaaaggcauugaggcaugugagauuugacuuaaguggaggagauccucgccuuuaagcaauaaucuguguauuuagggagccaauggcccagcaagaaguccagcagugccuccugagugccugggcaccugguggagauggugcagggucccuggcaaaagagccucugggacaggaguuguagccgccagccugugucacacacucacacucacaauuagaggacaacgggaauuuaauuaacuuccaaagugugauuuuugaccauaagcauucuaggaaugaggugcuguguggggauugagaugaaccuuggaaaauacuuaaggagaggcuuguuuuaugcugucaggaaaucuucaucuugucacuucguaaauuuuugaccuugcucaguuaguuagaaaaacaaaaacaaaagcuuccuguccacaacugagauaagagaguuuugcaagacaucucucuguccucggaguguuguggccuucuguggguucuguaguuuuaauugcuagugguuucauuccugcucaguuagugaaauugcgacauuuucccaguaucuuagcgugacugcccuacagccuuaauaaugaugauuuuagacuguaguuuaagaucugcuggggcaaaugccuucucacugcacaguaucucagcauucucugauguuuuguccauuuauuuuucuauaugaauuuaagaaccauuuuuaucaaguuuuauaaaugaccuuggugauauuuugacuggaauggcguucaauuuauaaauuaaguugggaaauauuaucaucuuuucugcauuuagucuuaagccagaaguauggccucucaaucuguucaggucacuauuucucucauuaaggauuuguguuuucuucauguaauuuuaauauauccuaugugaguuugauaugugaauauauaucauauauuucccaaguauuagaugcuuuuguugcauugugagugggcacucuuuuuuuaauuauauuuucaggccucuuauuauguauuuauagaaaugguauugauuuuuguacguuuuucucaucuucugccacuuucagaauugguugguuuuugaggcaaccagcagccuacucaggcaaacacucagagaagguuucuggaggauuugguagaagagacuaccucaucagggaaagaguugaacuaagucagcgguucccaaaugccaguccacagugaaaugagaaaacgaaagauguuguaguggggcuuucaucaagccaaauuuauucaggggagggacuuuugauuuugauucuugauuuugaggcuauauaagcuuccugccuuuuagaauuuugauaucauuucuuucuagaaggauuguagaugauaauuagggguuuuguuuugcuuuaagauuuuagagucuuugaaaauaaauaaaucagaaauccuuauaauaaaugaaugaaugaaugaaugaauaaaacugcuugaauucuacccuccccaaaagauuuuagaucuuuuuuuguuuuuguuuuuuuuuguuuuugagacagagucucgcucuaucgcccagacuggaaugcaguggcucaaucucggcucacugcaagcuccaccuccccgguucaugccauucucccggcuaauuuuguuuuuguauuuuuaguagagacgagguuucaccauguuagccaggauggucuccaucuccugaucucgugaucugcccgccucggccucccaaaguucugggauuacaggcaugagccacugcgcccgcugauguuguuuuuuaaauuuugcuuuuauuuaguuuucagugacuuuaucuagcagauuuuuuuaaaaaaaagcaaaacagcuggcaacccgaugugagugccacacauuucuuuugaaauauuagcguggucuggccgggcacaguggcuuaugccacuguucguagauuuuggucuaaaaucucaaaaucuaggaaccuccaauucgauguccuuuggguuuuacaguugugauauuugguaaaucuggacuucuuuuuauauuuuaaaaucauuuuuaguuuauucuuuuggguucuucuaguuaguagugccaguuagauugauguuuuuguuacuuauuuuggcuuucucugacuucauccuuugucuaugccuugcguuguccucugaaaguguguaggagagagaagggugaaaugggggcacccucguuuuauaucuguuuuuaaagggauuuuucucuaaugucuuuucucugacaguauuuaggugggcuucaaagggaaaauagaugguaucuuaugagagggcucaacagaaaguuuggaggugagaaaccagaagccagauuugggaucacacaggccuggauauaaaucuugccuccuucugcuugcuagcugaccagugacuaugccugguggcggugauggugcugguuaugauggugguguagcauugguggugaugguaguggugguugugaugguaguggugauggugaugguggugguggugauggugguguggugguguggcggugguggugaugguggugugguggugaugguggugguggugauuguggugguggugguguggugguggugauggugguggugaugguggugcugaugguaugaugguggugugguggugaugaugguggugugguggugaugguggugauggugaugauggugguguggugguggugauggugguggugguaaugauggugguguggcggugguggugauggugguguggcagugauggugguggugauuguggugaugguguuguggugguggugaugguggugugguggugauggugguggugaugaugauggugugguggugguggugauggugguggugauggugguguggcggugguggugaugguguggcguugaugguggugguggugauuguggugaugguggugugguggugguggugaugauggugauguggugguggugguuaugauagugguauagcagugguggugguggugguaugguggugguaauggccaagaggugagagagugagggggcaggaguuugaggagcccagccaugcagaaagagccuaaaauaaaguuggaguuggcagucgaguuggauuuuucuuuuuaauuucacuuuccaguucucuuuuaguggauucuuaauggaaagccuuagaagcuguagaguuuggucugcacaacugcacuggaugcccauucuagguccuguacucugcgaggcacugggaauacaauggugaaugcaugcagugagggggaucuggaaauaaugagucaucgcgcuaaggaaggucuccuuauaaccuaagcuaagggcacuggaaaagaaagauguucuuuuguuuuuuucccccugaguauacagcagaagaagccacccuauauuugggcaaggcagggaauacuuuacugaaaaagugauacgugcacacuugagcugagaacugaagggugagcauguggcagcaggggguuggugcaguuccaaguugaggaguagccagaggguggugcaguuccaagcgaggaauaguguauuugccagcucucuggcggaaagaagcuaagccuguuagggaaacucacaggucagcagagcuggagaacagagaugaaucuggagggcugggcagggaucucugggcccaacagguuaaacugcagucuuucuguugucuugaacagccauaaaccaugggaagccuuuguccugauggccaugagggaccaaaaucaaguugucuauuuuaaagaccucucuggccacagaguacggggauggaauuugagaggaagcuagaguugauaguagcugggucuagggaggugguugguuuuagaaauacauaaagcugaggauagugagaguggcuuuuagaguuauuuaggagagugucuuacaaggcuuggugauaacauggauguggggaauuggcugugucaggaugacacccagguagaacuagauggaagcuaguacuuuucacugagguagagaagcagggaaagaggcccaggugugagguagcaggaggccaugaguucugccauguugaguggggugguggggccaagagcucugccauguugaguggggcgguggggccaggagcucugccauguugaguggggcaguggggccaggagcucugccauguugaguggggcgguggggccaggagcucugccauguugaguggggcgguggggccaggagcucugccauguugaguggggcgguggggccaggagcucugccauguugaguggggcgguggggccaggagcucugccauguugaguggggugguggggcuaagaguucugccuuuggucuguugagaacaaggugccuuuaggcugcacgugacaagguaucaagacaagguaucagacagguagaaagauguucuaggucucgggcacaguggaaaggcugucauagaagcagaaaaagucuagugcuaagugggagacaagagaggaacacuccaaauugaguuuccaaccaaagucauuaucaacaggagucauccuggagcuggauggcacuggagagaucgagucucagcccuuuuauuuuacaaguaaggaaacugaggcuuagagaggugggaccagcugguuagugguaaagccacucuuagacugaauuuuucuaguccuaguucuaucccucaauuguuuacuacaccaagcagagaaucuucccgugaagguggaacaugagccaagggcucagaugucagcccccuugauaucagaucuauuuuuugucagcaaccaaauggacaguucacagcuucacauucuuuucuugaucacuuuagaacugacauuccuccagcuccuuauuaaagaaagagcaaagcaagagcuggcuagaagugguuuggaagguagaaauagacuauaccaugucuuuaguaaucagccuggcaaaguccacauggcagccgggaaggguuuggccaaggcuaaagccaguaggacuugguggcacucucuuuuucucuugguuguuccaaaagcaccaguuauuacuuaaaauuggccccuaaaauaggagcauuaagguacaagaaagggaaguucauuuuucucgagauccuuuuucaagaugucuacacugugacugauaacauaucagcagcuucucccagccaugacuucuuaacuauaauguguaacugcgcaugcaauuauaugaauuacauguauuaucuaauagcuuuaaaauauucgauaaagcuaaggcuaaugucugcuuugaugacccugcaccagccacaguuuucauacaucaccucucaaaucccccagagguuaccaacuucacaaauaauggguuuccauagaggaugucaucuugaaaaacacaaacauaguuucauguguuucauugggcuucacauugcagccuuuucaucuaucuacauaucuuggagacccuuuccugcugauuccuguaggauuugccuuguucuauuucaccaucaccucaucgucugggcugaauaaagacagucagcagucacaucccugucgacgugcauucagcucuugccacuuugucccuguuagaaacugcacugcugaccaugucguaguacacaccuccauguaaaugucacaaguguuucucuggagaugauaucaagcaguggagcugcugcucauaggccaacacagagccuuggcuacacugcacuucucuacgaggcaaccaguguguccccaccagcagggccugaguauuugucucccauccccugcuagcacgacccucuucuuucugguagaggagacaguaagaccuguggcauccccaggcccucuaugagucaggagagagggcauggagcuguuuuccugcucugcuuguggggcuggguuucugaggcccaugaccuuggcuucaucaauauuuucucuagccugucaagaaaaguugaacuucagugaaauauaucucagaaauuugccacaaggagagggcuagggaaaaccuaacuaaaagauguuagaaaagagaggccaaguguaucccagguucuguguccaguuucuuuuaguccuucaugaaggugacugagcuguuuuagaaauaacauaguucagccaggugcggugccucacaccuguaaucccagcacuuugggaggccgaggcaggcagaucacuugaggucaggaguucaagaccagccuggcaacaugaugaaacaccaucucuacuaaaaauacaaaaaaaaaaaaaaaaaaaaagccaggcaugguggcgcgcgccuguagucccagcuacucgggaggcugaggcaggcgaauugcuugaauccaggagccaggaucaugccacuacacuccagccuggguggcagagugagacucugucuaaaaaaagaaaaaaaaaggaagaaaagaaagaaguaacauaguucaaacugccauuggagaacucuuaauagugccccaauuauaaaccaugcaucucuccccgauuauaaaucauguaucucucccucaccaucugaucauuuuaaacccagguccccucugcuaauccaggaucuaaacaguuuaagccgggaauggccacaauuuaaagaaugcucuccagccuuugaaauucaggucccuguuccccuuuggccccaaacccucccccugcccacucgucguaggcauagaugaguuagucaugguguauaacuaggguuaccauaacauuugucauccaccugggacauuuuuaugcaugaaaggcagugcuaaccagggggaugcugggaugacaggggcagcagagcaggcuguuugggcccccagcccucccgucaugacagcagcaguguuguuaauaguaguaugacaacauugcaaaaaaauguauauguucagucacauaacucuacaaauaauucguauuaauguuauuauuauuagcacuuuuaaaagagaaguaacuucccuucucccacuauuuuuaaauagacuucagugugcugaaaguucucccauugagagcacuuaugcaguugggugaacuaucugcaugaaagugacauuugcucaucugucuuucucgcugaagucaucgucuaaagguaagcaaaagagcaagcucaggagaaagagaauggcgcacucucagagaccuuucuuggggcugcugauugagagacacaaggccuguggccaccaguugucguggcuuugugcagcagcagcaguggcagggacucugggcuuccaugcuccccucucguccaugccgggagcauugcagccucuccuagcagggcuaggaugccccacagcucugggccuugaacaggguaggguccguucagacuggggguuaugaguggccuuuguuggcagagacuacaguuaaaaccaucuaagcgcaaaaguaccuuagaaauuagaacaaaaauuccaccccuuuaggaauaucgaggucauuuuugcugacuucaauuauuuucgcaccaccuucacgguuuuugccauauuccaauacugaacugcacuucacacuucucucuaagucagcuguuuuuuuauguaaauacauugguuuuuaaaggaaaauuauacaacugcuauugaaagauuaccaguaucccuggcgucugguuaaguauuuuaaaaauacucaugaagacaagugcaugcucuggaaauggcagcguggcugaugucccuccaggugcagcccugagcaccuccuugauccuguccccauccacccagucucuucauugaccugagaaaugcucaucuggacucuaggagagauggugagagauggucuucuaggacacaaagauuucccaccaaaggggauaaaugagguuuugcucccagugucuggucaggugccucuuagcuaaggagagguaggaagaguucucauuccaaccagcggaagccuguugaguuucaacggggcuaaauuacuuggggcacauuuucuucccaugacauuuguugucuaauaauaagucaacagauggaguugucuugaucugccuuuaccaugacauuugcucccacuucacguguuuauguuugcggacgcagccaagagacagucgguagagcugugucccaagccccagcgagaugagcccgggcacuucucacuuccugcuggcaugcucugaagcaguguuccagccagaaggccucucacagaacccauccacucaccucuguucucacucccagcuuuucuggggauugggugaggggagcugggucuguucucccauagugcucucaguucuugauaggaugccagaaaguacaaugcucucuucaucaaguucaaaagcaggcaaaaccaaguaaugcaugcaugauaaaauguuuacagcgagcauaugauaaacucagcuucugcauuugguuucuucuggcaggggagaccacaaggagugggagaaggacauucugcuagaugaaguucuuggcuguguucuuucucggguugggcugcauagggucacagggguugaaugauaguauuuuuaaauacuaaauuuuaaaaguacguauucggacugccuccaugggucaguggcaugggacagcugaaaccaacccagggcauuugggggugggccugcugugcuauggcaaaaggagguuguuuugaggcugagcugcugcugaccagcauggugggacuuugcucaccuuucuucuuucuauacaaauuaagaacccucagaagaguucuuagcacauauuaggcccucaguaaauauuuguugaacaauuuuucacauguguauuuuuaaacuuguuguuauggaaauuuucaagcacaccaaggcagagaggaggccagcgcagcugcgcugcccgucagcuucugcugcucugguuuccucugucaccacaccuuuucuucuggagcccuucacagcaaaucccagaaaucauaguguuucaccccuggcaguuuuggacaguagacuggguucuucucuucuggauuuguggcucugauccaccuaacaguucguucuucauggguucuuuuaggauauguugaagccgaccucuuccuccccaaagagagcgugucaggaaaaugaagccuuucucuguaucucccugugggggauuuccucgcugcauagguguguacuuggcugcauguuugugcugggcauugugcuggaccuauguaucgaugaugagagaagaagccuguggccuggggccuccaugcaaaugcaggcugauggcgcgguuaggggagcagacccuuguuccugugagcacuaggagugcucuaaagcgaccacucaucuuuugagcccccuuucacgacucccaaguugaucauuggugauuucccccauugccaagucagaguggacauuuucagcagacaguaccccagcggacugcagcucugccccuucugacagaaggcacauugggaacgugcagagcccacauccagggugauggcaguugucaccauccauguggaaagaccuggccccggccagcugcugggccucuuugcacuguauuaauagcaaggccauggggcccacuggggucgggagacgggggggauggaggacagcuguggcggacaucaccgcaugcuccaggcacgugcgcccgucacaggcauacagauggccacaccuugaccugccucuccaaagccccccaagccccugccagccuucuccuuguaggggcaggaacuggcucgcacugaugacccauuugacaaaggagccaaauuaagaauggcaugauuggaauagaggguuccaguggccccguguucagggucaguuucugcuuuuauuggacgcacaggcaugggggccgaaugaggcagugguauuuaaacagcuggggauauuagguucuauacgccaaggcuggacagauauuuuuaaaugucacaggccaaauggaagcucaguuggcagcaggauggaggggcagggggauuuggaggccacugcauugccguggcuagauauggccaggagagcugagugggauuaaggcuugggaagaagccagccugggaagugcccgugaagagggagcagggaggaucauaugaggaaacaguaggcgccagggguggcgggcaggcaagagcgcaggugcuggggccagggg
